United States Patent 11,981,905 (POLYNUCLEOTIDE SEQUENCES AND PROTEINS ENCODED THEREBY USEFUL FOR MODIFYING PLANT CHARACTERISTICS) - sequence listing, part 6

SEQ ID NO: 14361 - protein, 148 aa, Panicum virgatum
  misc_feature: Ceres CLONE 1775953
  misc_feature (3)..(73): Pfam Name: Ribosomal_L24e Pfam Description: Ribosomal protein L24e
  misc_feature: Useful for making plants with modulated nitrogen use efficiency
MVLKTELCRFSGQKIYPGKGIRFIRADSQVFLFANSKCKRYFHNRLKPAKLTWTAMYRKQHKKDIHAEAVKKRRRTTKKPYSRSIVGATLEVIQKKRSEKPEVRDAAREAALRYVFHLSTELFLTILLLQEFCISKAGIAYWSFTTSF

SEQ ID NO: 14362 - DNA, 729 bp, Panicum virgatum
  misc_feature: Ceres CLONE 1775966
  misc_feature: Encodes the peptide sequence at SEQ ID NO. 14363
atctagcacgcttccggttccgggtcctcccgcctcgccgtctccggcgccctctccgtcagcgggcagcctccattgcgctggcgtcctctccgtcctccccatccgcagttccgcacccaggagtcctctgttcaacaccgaacgcagatcctatttaacccagatcccgaccacgctatcgccgcaccgcgccagcgccgccgccgcagccatggtgtacgtggattcgtgggacgagttcgtggagcgctccgtgcagctcttccgcgccaaccccagcgccacccgctatgtgatgaagtacaggcactgcgaggggaagctcgtgctcaaggtcaccgacgaccgtgagtgcttgaagttcaagacagatcaagctcaggatgcaaagaagatggagaagctcaacaacatcttttttgctctcatgactcgtgggcctgatgctgatatcagcgaagttacagggaaggaacaggcagagcaacagcaatccaagaaaggacgtggcaggaggcagtgatgcatgccttgcttcttgtttccttcggaaaattcacaactaggatggtggattgacgtgtcatttgactcttgtgcctacagcggtactcgaggaattttgaacgatcttggatattttccaatacagaaccaaaatatcatgctgaatctatcatgaattcatgatcaaagaaacactcaatcctagatcacttttttcgc

SEQ ID NO: 14363 - protein, 103 aa, Panicum virgatum
  misc_feature: Ceres CLONE 1775966
  misc_feature (2)..(76): Pfam Name: SRP9 Pfam Description: Signal recognition particle 9 kDa protein (SRP9)
MVYVDSWDEFVERSVQLFRANPSATRYVMKYRHCEGKLVLKVTDDRECLKFKTDQAQDAKKMEKLNNIFFALMTRGPDADISEVTGKEQAEQQQSKKGRGRRQ

SEQ ID NO: 14364 - DNA, 607 bp, Panicum virgatum
  misc_feature: Ceres CLONE 1776024
  misc_feature: Encodes the peptide sequence at SEQ ID NO. 14365
atccaactctgccagattccaagcccccgtgcccccaaaaaatcccccaattccggcgagcgtgaggaggagaccgaggcggcggcagcggcggcgatgtcggggcgcggcaagggcggcaaggggctgggcaagggcggtgccaagcgccaccgcaaggtgctccgcgacaacatccagggcatcaccaagccggcgatccgacggctggcccggaggggcggcgtgaagcgcatctcggggctcatctacgaggagacccgcggcgtcctcaagatcttcctcgagaacgtcatccgcgacgccgtcacctacaccgagcacgccaggcgcaagaccgtcaccgccatggacgtcgtctacgcgctcaagcgccagggccgcaccctctatggcttcggcggctaggcgccggcgccggcgcgcctcctgtggggcgcggcgtccgcgggcgcatcgtggatggggtgctgtctgtgattaggggatgcttcgttgttaagttacttcgatggcttgtgtcgctgttatgggttatggagcttctggttgtagcccgtccgaacatttgcagttgaagaaatgccagtactagttatcccgttcc

SEQ ID NO: 14365 - protein, 103 aa, Panicum virgatum; identical to SEQ ID NO: 12044
  misc_feature: Ceres CLONE 1776024
  misc_feature (25)..(94): Pfam Name: Histone Pfam Description: Core histone H2A/H2B/H3/H4

SEQ ID NO: 14366 - DNA, 665 bp, Panicum virgatum
  misc_feature: Ceres CLONE 1776031
  misc_feature: Encodes the peptide sequence at SEQ ID NO. 14367
gcgagccacgatccaccaccacacactctccagcacccggcggagcaagcggccagcgagagatccagaggcagcagcaatggccaccgtcagcgccgccgcggcgaccaccgtcgttgcccgcgccgccctagggctgccgcagctgagggcgaggagcgagagggtgcggtgcggctactcgagggacgccaggagcgcggcggccgccgtgagcgcgaggggcgccggcgcgtcgctgctggccgcggcaggcgcggtgaccgcgtcggcggggccggcgctggcgctcgtggacgacaggatgtcgacggagggcaccgggctgagcctggggctcagcaacaacctgctggggtggatcctcctgggggtcttcggcctcatctggtcgctctacaccgtctacacctccgacctcgacgaggacgaggagtccggcggcctctcgctctagataatatcatgtccgtcctctgctcctgttactaccgatccggatgtaaacatggcggtggtcatcggtgtaatgtcagacttggctatttaatttgtatctaagcttcgcttttgcgttggatcatgaagtgatgatatgttgatccgtggagattacgcgtgtactgcaacttcgcgagagaaaaaatccctatagtgttctgcgt

SEQ ID NO: 14367 - protein, 125 aa, Panicum virgatum
  misc_feature: Ceres CLONE 1776031
  misc_feature (1)..(125): Pfam Name: PsbW Pfam Description: Photosystem II reaction centre W protein, PsbW
MATVSAAAATTVVARAALGLPQLRARSERVRCGYSRDARSAAAAVSARGAGASLLAAAGAVTASAGPALALVDDRMSTEGTGLSLGLSNNLLGWILLGVFGLIWSLYTVYTSDLDEDEESGGLSL

SEQ ID NO: 14368 - DNA, 742 bp, Panicum virgatum
  misc_feature: Ceres CLONE 1776054
  misc_feature: Encodes the peptide sequence at SEQ ID NO. 14369
gaccgcgagcttgatttcggaacgaagctagggtttaggcttccgttgcgaatcgaggagggggcagggagtaggagcggcggcggcgatggcggcggaggaggacatgacggtgaaggagccgttggatctgatacggctcagcctcgacgagcgcatctacgtcaagctccgctccgagcgcgagctccgcggcaagctccatgcatatgatcagcatctcaatatgatacttggagatgttgaagagacagtgactactgtagaaattgatgatgagacttatgaggagatcgttcgcacgagcaaacgcactatccccttcctttttgtccgaggagatggtgtgatactggtttctccgcccttgcggaccgtttgaatgctgggttggtgcgttctgcaatcccaggagcaggaattggggaactgttatagggagaatcaacagcaggtttctgagatttgcacaggtttataaacactagacagcagcgttgtacgtcagcagtggctgtgtatttgaatctacctcccagtatggtcagcttaatcttatccaggggtcggctcggtaatgtacggcgaacgatatcacatgatcaatctttccagtaagtcgtcgattgattggtgttctgatcctcttctctctttgctgtgtgaatgtgagtgtgaactgagttgacattgatccatgtgatcgcgttccctgccagctactggtctagtaccatttacc

SEQ ID NO: 14369 - protein, 97 aa, Panicum virgatum
  misc_feature: Ceres CLONE 1776054
  misc_feature (14)..(92): Pfam Name: LSM Pfam Description: LSM domain
MAAEEDMTVKEPLDLIRLSLDERIYVKLRSERELRGKLHAYDQHLNMILGDVEETVTTVEIDDETYEEIVRTSKRTIPFLFVRGDGVILVSPPLRTV

SEQ ID NO: 14370 - DNA, 768 bp, Panicum virgatum
  misc_feature: Ceres CLONE 1776082
  misc_feature: Encodes the peptide sequence at SEQ ID NO. 14371
aaccaaagcgcgcgaactcccagctcggcggcggcggcggcgaggaggggatcgcagttgcagtcctgcgatggggagcgacatggaggcagagaataagagggcttcggcggccctggcccccatcgcgaagccgcttgcgggcaagaagctcggcaagcggaccctcaagctagtccgccgagcatctgaggccaaatgcttgaagcgaggagtcaaggaggttgtcaagagtattcgccgggggaacaagggattgtgtgtgattgctggcaacatttctcccatcgatgtaataactcatgttccgatactctgtgaagaagccaatattccttacatatatgttccatcaaaagaggatctcgcaaccgctggcaccaccaagaggccgacctattgcgtgctggtgatgaccaagccagccaagggggagctcgagggcgaggtcaaggagaagctcaagatggactacgaccaggtcacgtctgaagtcaccgaggtcacgtcagcgatgttttaatctataagcaaactcacggggccaacagaggcgccgaaccggcatcctttggtcatttggtgccctgtctgaaactctgtagagtgccagtgtgacctatgagaaaatcaatcgccttcctttacgaaccggttagatatgcgcctttttttctctctcaatgaacttgtgggataatgccagttcttagctactagcagaatctttttttatgaaaatttagccgcatctgtttacctttgttc

SEQ ID NO: 14371 - protein, 150 aa, Panicum virgatum
  misc_feature: Ceres CLONE 1776082
  misc_feature (30)..(124): Pfam Name: Ribosomal_L7Ae Pfam Description: Ribosomal protein L7Ae/L30e/S12e/Gadd45 family
MGSDMEAENKRASAALAPIAKPLAGKKLGKRTLKLVRRASEAKCLKRGVKEVVKSIRRGNKGLCVIAGNISPIDVITHVPILCEEANIPYIYVPSKEDLATAGTTKRPTYCVLVMTKPAKGELEGEVKEKLKMDYDQVTSEVTEVTSAMF

SEQ ID NO: 14372 - DNA, 688 bp, Panicum virgatum
  misc_feature: Ceres CLONE 1776146
  misc_feature: Encodes the peptide sequence at SEQ ID NO. 14373
ctttattcgccagcacaccacccgctccgctccggcgcttccacttccccatctctctcgctcgctctctgcgctcgccacgccatggctcccgccacggcaaccgccgcgttcactagcctcctccccgccggcgcctcgcggctcccctcggccgccgccgccgccggagcggcggcctccttcgtgcggctcccgcggcacccgacgggctgggctggggcctccgtcgcggcgccgcggacggcgcgcaggcgggcgcccggggtcgcctacgccaccgccgccaccgagaagagcatctacgactacaccgttaaggacattgatggaaaagatgttcctcttaagaagttcaaaaataaggtgttgctgattgttaacgttgcttctcaatgtgggttgacaacagcaaactacactgaattatctcatatctatgagaagtacaagactcaagaacctggatcgaattctcaaataaagcagtttgcctgtacaagatttaaagctgaatttcctatttttgacaaggttgatgtcaatggacctaatacagcccccatctataaatttctgaagtccagtgctggaggatttttgggcgatctagtcaagtggaattttgagaagttcttagtggacaagaatggcaaagttgtagagagatatccacctacaacttcac

SEQ ID NO: 14373 - protein, 201 aa, Panicum virgatum
  misc_feature: Ceres CLONE 1776146
  misc_feature (73)..(166): Pfam Name: GSHPx Pfam Description: Glutathione peroxidase
  misc_feature: SWISSPROT Homolog: EC 1.11.1.12 Phospholipid-hydroperoxide glutathione peroxidase
  misc_feature: Useful for making plants with modulated nitrogen use efficiency
  misc_feature: Useful for making plants with modulated flowering time
MAPATATAAFTSLLPAGASRLPSAAAAAGAAASFVRLPRHPTGWAGASVAAPRTARRRAPGVAYATAATEKSIYDYTVKDIDGKDVPLKKFKNKVLLIVNVASQCGLTTANYTELSHIYEKYKTQEPGSNSQIKQFACTRFKAEFPIFDKVDVNGPNTAPIYKFLKSSAGGFLGDLVKWNFEKFLVDKNGKVVERYPPTTS

SEQ ID NO: 14374 - DNA, 554 bp, Panicum virgatum
  misc_feature: Ceres CLONE 1776191
  misc_feature: Encodes the peptide sequence at SEQ ID NO. 14375
cagttcaggcaacagagcagcagcacaggcgtcgccatggcctcccagctctccgccgccgcttccatgtccgccgccgtgccgcagttccacggcctccggggccggtccgtggcggcgctgccgccggtgagggccggcaggaagcgcgcgcagggcatccggtgcgactacatcggctcggccaccaaccagatcatggtggtgtcgacgacgctgatgctggtggcggggcggttcgggctggcgccgtcggcgaaccggaaggcgacagcggggctgaagctcgagtcccgcgactccggcctgcagaccggcgaccccgccgggttcacgctcgccgacacgctggcctgcggcgccgtcggccacatcatcggcgtcggcatcgtgctcgggctcaagaacaccggcgcgctcgaccagatcatcggctaggtccagtgtctgcctttgccgctctcggcgccggcccggtgcccatgtaacctgcgtgtgtacatcgactccgcgctcatgcatctcgttccaatggacatagcttgtttgttgct

SEQ ID NO: 14375 - protein, 133 aa, Panicum virgatum
  misc_feature: Ceres CLONE 1776191
  misc_feature (48)..(128): Pfam Name: PSI_PSAK Pfam Description: Photosystem I psaG / psaK
MASQLSAAASMSAAVPQFHGLRGRSVAALPPVRAGRKRAQGIRCDYIGSATNQIMVVSTTLMLVAGRFGLAPSANRKATAGLKLESRDSGLQTGDPAGFTLADTLACGAVGHIIGVGIVLGLKNTGALDQIIG

SEQ ID NO: 14376 - DNA, 1940 bp, Panicum virgatum
  misc_feature: Ceres CLONE 1776195
  misc_feature: Encodes the peptide sequence at SEQ ID NO. 14377
gcaactgcaaggcaccgcacaagaactcgccaggaagcaacgtagcggaaaaggcaaatccaggggccaagccaagagaagccgctcgcccctgttggattgttccgttcttcgattccctcgcggaggtacactacgcaccccaccccacccaacccctgctccgaatccgcctctcccctgctcccgcggaaattccgcgtccaagtactcggatcttctcctgccgcttcccccgattttcctcacaacccgtttcgtctcctctcgcgtccgccgccgccgcgctgtctcctctcgcgtccgccgccgccgcgctccaggaccggagtcttctctcctcggggatcgtcggcgccctcttatccgccgctctctaccggtgctggactgccgtggggtggagatcggcttgaatcaactcttcgtttagtttgttggtggtgcgaaaatgagtgacaacctgatggacaaggttagcgcctttggcgagcgcctcaagatcaccgggacggaggtcagcaagaagatgacggccggcatgagctccatgagcttcaagatgaaggaattgttccaggggcagactccggccgacaagatcgtcgaggacgccacttctgagaaccttgatgggcctgactggaacttgaacttggagatatgtgacatgattaacaccgagaaggttaacagtgtggagctcatccgtggcatcaagaagcggatcatgctgaaggatgcaaggatccagtacctctccttgatcctgctcgagactattgtgaagaactgcgagaaggccttctcagaggttgcggctgaacgggttcttgatgagatggttaggctgattgatgaccctcagacagttgtcaataacaggaacaaggcccttatgctgattgaagcatggggggagtctggtgatgaactacgctacctgccagtctatgaggaaacctacaagagcttgaaatcaagaggagtgcggtttcctggacgtgacaatgagagcttggctcccatatttactcccccacgatcagttgctgaagctgacattcatgcaaacttgccccagcaggcttttgaagacgtgcatgttcatacatatactgccgaagaaacaaaagaagcatttgatgttgctcgtaacagcatagaacttctttcaactgttctttcctcttcccctgagcaggatgctttgcaggatgacttaacagccactcttgtgcaacaatgctaccaatctcagcacactatccagagaatcattgagacagttggtgacaatgaagctgtgctctttgaggccttgagtgtgaatgatgagatccagaaagtgctatccaaatatgaagagatgaagcaacccatggcctcggagcaagcagaacagcgtccagtggtcataccgattgccacagaacacgaggattccactgctgctggcactgaagatgccctggtcagaaaaccagctgctgctagggcaaggtcaggtggagatgacgatatccttgatgatctcgacgagatgatatttggcaagaaggggggtagcagttcgcatgaagcgcccaaaaagccggatccgaagaaagatgacctgatcagcttttaaggaccttcccgtaatcacacctcgaacttgctattttatggtgctgtactcagttggtagaagattgcagattctgtaggatttggatcgcttgtttattctgatacgatcatacctgccccttttctcagtttgtccagttgttaagttgctgcactctctcaatcatctgttctggtttggctaatcgagcaggtctggaacatagtgttgtttatcactggtctctctatatatgccactatgccagcgatgtgaactttgagatggggtcaaaatctgccaatcttattgatgccacatcgtcacc

SEQ ID NO: 14377 - protein, 392 aa, Panicum virgatum
  misc_feature: Ceres CLONE 1776195
  misc_feature (42)..(179): Pfam Name: VHS Pfam Description: VHS domain
  misc_feature (222)..(316): Pfam Name: GAT Pfam Description: GAT domain
MSDNLMDKVSAFGERLKITGTEVSKKMTAGMSSMSFKMKELFQGQTPADKIVEDATSENLDGPDWNLNLEICDMINTEKVNSVELIRGIKKRIMLKDARIQYLSLILLETIVKNCEKAFSEVAAERVLDEMVRLIDDPQTVVNNRNKALMLIEAWGESGDELRYLPVYEETYKSLKSRGVRFPGRDNESLAPIFTPPRSVAEADIHANLPQQAFEDVHVHTYTAEETKEAFDVARNSIELLSTVLSSSPEQDALQDDLTATLVQQCYQSQHTIQRIIETVGDNEAVLFEALSVNDEIQKVLSKYEEMKQPMASEQAEQRPVVIPIATEHEDSTAAGTEDALVRKPAAARARSGGDDDILDDLDEMIFGKKGGSSSHEAPKKPDPKKDDLISF

SEQ ID NO: 14378 - DNA, 1266 bp, Panicum virgatum
  misc_feature: Ceres CLONE 1776196
  misc_feature: Encodes the peptide sequence at SEQ ID NO. 14379
acttctcactcttcacttcccacttgtcgcctcgcttcgcattttcctctgccgctcgctgcagtctcgctagctcccacgaaaagcgaggggcctggaggggggagggcaagggggggggagaggagaggaagcaacagagaacaaacaaacagctcctgagctgagagcctgagatggcggcgccggcgccgaagcaggaggagctgcagccgcacgccgtcagggaccagctgccggccgtctcatactgcctcaccagcccgccaccatggccggaggccatcctcctcggcttccagcactacctcgtcatgctcggcaccaccgtcatcatccccaccgcgctcgtcccccagatgggcggcggcaatgaggagaaggcgcgggtgatccagacgctgctgttcgtcgccgggatcaacacgctgattcagagcttcctcggcacgcgcctccccgccgtcatcgggggctcctacaccttcgtcgcgcccaccatctccatcatcctcgccggccgctacagcggcattgccgatccccacgaaaaattcctgcgcatcatgcgggggacgcagggagcgctcattgtggcctccaccctccaaatcatcatgggcttcagcggactttggcgcattgttgtcaggctattgagcccgctatctgctgctccactggtagccctcgtcggatttgggctctatgaactcggatttccgagtgttgccaaatgcattgagattggtcttccacagattttactgcttgtggctctttctcagtacataccacatctactccccttagtgggtactgcctttgagaggtttgctgtcataatgtccgttatggttgtgtggctttacgctttcttcctgacagttggtggcgcctataagaatgctgctcccaaaacccaattccactgccgtactgatcgatctgggcttgttgggggtgctccatggataagtgtaccttatccatttcagtggggagcaccaacctttgatgctggtgaagcttttgctatgatggcagcttcctttgttgctcttgtggagtctactggtgcattcattgccgtttcaaggtatgccagtgcaactccatgtcctccttctgtcatgagtcgtggcattggttggcagggggtcggtattttgttgggtggcttatttggaacagctaatggctcctccgtatctgttgaaaatgctgggttgctcggtttgacacgcgttggtagcagacgtgttg

SEQ ID NO: 14379 - protein, 363 aa, Panicum virgatum
  misc_feature: Ceres CLONE 1776196
  misc_feature (34)..(363): Pfam Name: Xan_ur_permease Pfam Description: Permease family
MAAPAPKQEELQPHAVRDQLPAVSYCLTSPPPWPEAILLGFQHYLVMLGTTVIIPTALVPQMGGGNEEKARVIQTLLFVAGINTLIQSFLGTRLPAVIGGSYTFVAPTISIILAGRYSGIADPHEKFLRIMRGTQGALIVASTLQIIMGFSGLWRIVVRLLSPLSAAPLVALVGFGLYELGFPSVAKCIEIGLPQILLLVALSQYIPHLLPLVGTAFERFAVIMSVMVVWLYAFFLTVGGAYKNAAPKTQFHCRTDRSGLVGGAPWISVPYPFQWGAPTFDAGEAFAMMAASFVALVESTGAFIAVSRYASATPCPPSVMSRGIGWQGVGILLGGLFGTANGSSVSVENAGLLGLTRVGSRRV

SEQ ID NO: 14380 - DNA, 730 bp, Panicum virgatum
  misc_feature: Ceres CLONE 1776219
  misc_feature: Encodes the peptide sequence at SEQ ID NO. 14381
atcctcacatcatccacctccgcagagcttcacgcattgcacggggagcaaaggaaaccatctcccagactcccagcggcagcggcggagaaagctagcgcccaaacccaatccacctagctagctagcgagataggcatggcgcgctgggccattgcgatccacggcggcgcgggcgtggacccgaacctgccggagagccgccaggaagaggccaagcgcgtgctggcgcggtgcctgcaggccggcgtggacatgctgcgcgcgggggcctcggcgctcgacgtcgtcgaggccgtggtgcgcgagctcgagaccgaccccttcttcaactccggccgcggctccgcgctcacccgccgcggcaccgtcgagatggaggccagcatcatggacggccgcggccgccgctgcggcgccgtgtccggcgtctccaccgtcaagaaccccgtctccctggcgcgccgcgtcatggacaagtcgccgcactcgtacctcgccttcgacggcgccgaggagttcgcccgcgagcaggtacggtggccgcccgccgccccaaccaatccccccggattaatctcccgtgctcgttactgtttccagcatgaatcgtgcatggcctctataccatgcagaaccaccactactaattaaggaaataataatcacggtttaagagaaaattaagttttttttacgacctggcgggcgtaatggccggaccgaggag

SEQ ID NO: 14381 - protein, 171 aa, Panicum virgatum
  misc_feature: Ceres CLONE 1776219
  misc_feature (2)..(171): Pfam Name: Asparaginase_2 Pfam Description: Asparaginase
  misc_feature: SWISSPROT Homolog: EC 3.5.1.1 Asparaginase
MARWAIAIHGGAGVDPNLPESRQEEAKRVLARCLQAGVDMLRAGASALDVVEAVVRELETDPFFNSGRGSALTRRGTVEMEASIMDGRGRRCGAVSGVSTVKNPVSLARRVMDKSPHSYLAFDGAEEFAREQVRWPPAAPTNPPGLISRARYCFQHESCMASIPCRTTTTN

SEQ ID NO: 14382 - DNA, 629 bp, Panicum virgatum
  misc_feature: Ceres CLONE 1776219-R
  misc_feature: Encodes the peptide sequence at SEQ ID NO. 14383
gcctccccatcagcatctacgcgccggagacggtggggtgcgcggcggttgactcgagcggcttcaccgcggcggccacctccacgggcgggctcatgaacaagatgacgggccgcatcggcgactcgccgctcatcggctccggcacctacgcctgcggcgcctgcgccgtgtcgtgcacgggggagggcgaggccatcatccgctccacgctggcgcgggacgtggccgccgtcatggagtacaaggacctgccgctgcaggaggccgtcgactactgcgtcaaggagcgcctcgacgagggcttcgcgggcctcatcgccgtctccagcaccggcgaggtcgcctacgggttcaactgcaccggcatgttcaggggatgcgccaccgaggacggcttcatggaggtcggcatctgggagtgagccagcggagcggagcggagctgggcgtgcgtgcacacgtggccatcttgcgattgccacgtgggtaatcctccttctcagtcagggtcgtgggtattgtggcttgctttagtcgtagtgattggagatgggatgaataatgatgatcgtgattgtgatggtgatggttattgccctgtgaaataaaattgtgaaaagttatat

SEQ ID NO: 14383 - protein, 140 aa, Panicum virgatum
  misc_feature: Ceres CLONE 1776219-R
  misc_feature (1)..(140): Pfam Name: Asparaginase_2 Pfam Description: Asparaginase
  misc_feature: SWISSPROT Homolog: EC 3.5.1.1 Asparaginase
LPISIYAPETVGCAAVDSSGFTAAATSTGGLMNKMTGRIGDSPLIGSGTYACGACAVSCTGEGEAIIRSTLARDVAAVMEYKDLPLQEAVDYCVKERLDEGFAGLIAVSSTGEVAYGFNCTGMFRGCATEDGFMEVGIWE

SEQ ID NO: 14384 - DNA, 1877 bp, Panicum virgatum
  misc_feature: Ceres CLONE 1776227
  misc_feature: Encodes the peptide sequence at SEQ ID NO. 14385
attccactcgcgcacccgccgcggccgtcggctctactagctcgcaacggcaggaaccaggagcagggagaggggatggagcagtacgaggtggtggagcagatcggccggggcgcctacggctccgcctacctcgtcctccaccgggccgagcgcaagaggtacgtgatgaagaagatccgcctctccaagcagaacgacaagttccagcggaccgcctaccaggagatgtccctaatggcaagcctcagcaacccgtacatcgtcgagtacaaggacggttgggtggacgaggggacctccgtctgcatcgtcacaagctactgcgaaggaggcgacatggcggagaggatcaagaaggcaagaggcgtactcttctctgaagagagggtctgccggtggttcacacaattgctcctcgcccttgattacctgcactgtaaccgggtgctccaccgcgatctcaagtgttccaacattttattgacaagggataacaacatcagacttgctgactttgggttggcgaaactgctcatggaggaccttgcctcatcggtcgtaggaaccccaaactacatgtgtccagaaatactagcagacataccttatggatacaaatctgacatatggtcacttggttgctgtatgtttgagattttggcacaccgccctgcattcagaactacagacatggcagcattggttaacaaaataaacagatattcaatatctccaatgcccccaatatactcatcagcactgaagcagatagtgaagagcatgctaaggaaaaatccagaacataggccaactgctggagaactattgaggcatccacacctgcaaccatatcttgccgaatcatgcagctattcaccaatctatcttccagtgaagcccaccaaaagtaacctgggagacaagcagtcaaggaagccaagcaatggcagaaagagaactgtcaaagccaatggatccaacggaacattagaaactgcaacagagcacaatgtggaaggatacagctccacaaacttttctgacgtatcaaccattggtacccaggaagccttgattttgcaaatgccgggggatctagatgccagaaacaaagagccagagagcagcaatgttttatcacttcagcatgcagaagagaacttgatggcaacaactgatcgacagattgattcgcccatacgtcttaaagctataagaaccagcaacataaaagatgaggcccccgtcagtgcgtcaaatcaaaaacctgatgaggcgccaataccaaatgaggaattgacaattggagttgtgcaagaagaaaggaaggatgtgaagccacgctcttatcaagtaccaaagccaggctcaggtgacacaactatgacagaggaatcatcaccaatcagcacgctaaaactcgtgcatacagaaagcacaccggctgagtgggatcatctgaacatagttcagcagagagccgacgctctggagtcactcctagagctttgtgcaaagctcctggagcaggagaggctcgaggagcttgcaggtgttctccgaccattcggcgaaggagccgtgtcgtctcgagagacagcaatatggctgacgaagagcctcatgtcgccaccgaagtttggagagtccccaacaaagcttctgtaacattagataaatttgaggatttcattttcaaaaccacgtgctatttcgagagtgtacatagcttctcaagaatccatgatttgtgattaatgaggcttgagttttatttaaaatcttgatgtatatggtttgcatgacactgggcactgtgtgcgcctgcagactatttatcggctatttattatacaaaaatagcatgtgctgcc

SEQ ID NO: 14385 - protein, 531 aa, Panicum virgatum
  misc_feature: Ceres CLONE 1776227
  misc_feature (4)..(257): Pfam Name: Pkinase Pfam Description: Protein kinase domain
  misc_feature: SWISSPROT Homolog: EC 2.7.11.1 Non-specific serine/threonine protein kinase
MEQYEVVEQIGRGAYGSAYLVLHRAERKRYVMKKIRLSKQNDKFQRTAYQEMSLMASLSNPYIVEYKDGWVDEGTSVCIVTSYCEGGDMAERIKKARGVLFSEERVCRWFTQLLLALDYLHCNRVLHRDLKCSNILLTRDNNIRLADFGLAKLLMEDLASSVVGTPNYMCPEILADIPYGYKSDIWSLGCCMFEILAHRPAFRTTDMAALVNKINRYSISPMPPIYSSALKQIVKSMLRKNPEHRPTAGELLRHPHLQPYLAESCSYSPIYLPVKPTKSNLGDKQSRKPSNGRKRTVKANGSNGTLETATEHNVEGYSSTNFSDVSTIGTQEALILQMPGDLDARNKEPESSNVLSLQHAEENLMATTDRQIDSPIRLKAIRTSNIKDEAPVSASNQKPDEAPIPNEELTIGVVQEERKDVKPRSYQVPKPGSGDTTMTEESSPISTLKLVHTESTPAEWDHLNIVQQRADALESLLELCAKLLEQERLEELAGVLRPFGEGAVSSRETAIWLTKSLMSPPKFGESPTKLL

SEQ ID NO: 14386 - DNA, 1927 bp, Panicum virgatum
  misc_feature: Ceres CLONE 1776244
  misc_feature: Encodes the peptide sequence at SEQ ID NO. 14387
acgcactacttgtgctctccctaggccaaagccaaacccacccgcgccacccctcctcttccccttctccatccccatcgccgccgtccccgatctcctccggcctctcgggaatgggcagcctggcgtcggagaggacggtggtggggtgggccgcccgggacgccaccgggcacctctccccctacacctacaccgtcaggtacgaacccgccggccatggccatctcgatcgaccgctccgccgccgccacccttcgatcccttcctgctcgattacctaccacacctgctgttctagtcacaggcacgcaccactaagctcgaatcaggctgagaaagccgaaaataaagccacaaccttcgttttcattcagtacatataggttctacagtgcaatatattaatatggcagacagggagcatcccatcgactgcatatttacactcctttttcaggaggagttcccatgtttacattccttcgatcgagagaagaatcttgctaacgctttcctttttttttgtaaaaaaaacaagaaagctaacgctgttcttatgccgccgtgactcgtgagccattgtctttttctttgaaccgaagtccgccattatctaatattctaattgtctcaaagcatgcgcctcctgcctgcaagaatcaactactgcttgtctgcttttctatatatgggtttgttctggtgccgacaacaacaggaacacaggccctgaagatgtggtggtcaaggtgctgtactgtgggatttgccatactgacatccaccaggccaagaaccacctcggcgcttccaagtaccccatggtccctgggcatgaggtggtcggcgaggtggtggaggtcgggcccgaggtgagcaagcaccgcgtcggcgacgtcgttggcgtcggggtgatcgtcgggtgctgccgtgagtgccgcccctgcaaggccaacgttgagcagtactgcaacaagaggatctggtcctacaacgacgtctacaccgacggccaacccacgcagggcgggttcgcctccaccatggtcgtcgaccagaagtttgtggtgccgatcccggcaggcctggcgccggagcaggcggcgccgctgctgtgcgcgggcgtgacggtgtacagcccgctgaagcacttcgggctgacggccccgggcctccgcggcggcatcctggggctcggcggcgtgggccacatgggtgtgaaggtggcgaaggcgatgggccaccacgtgacggtgatcagttcgtcgtcccagaagcgcgcggaggcgatagacgagctgggcgcggacgcgtacctggtgagctccgacgcggaggccatggcggcggccgccgactcgctggactacatcatcgacacggtgccggtgcaccacccgctggagccgtacctggcgctgctgcggctggacggcaagcacgtgctgttgggcgtggtcggcgagccgctgagcttcgtggcgcccatggtgatgctgggccgcaaggccgtgacgggcagcttcatcggcagcgtcgacgagaccgccgagctgctgcggttctgcgtcgacaaggggctcacctcccagatcgaggtggtcgagatggggtacgtcaacgaggcgctcgagcgcctggagcgcaacgacgtccgctaccgcttcgtcgtcgacgtcgccggcagcaacatcgaggaggcggcgggggcgccggccaactgacggggcgccgcccatggaaccgtgtgaggctgtgccggcgtcgtagcgttcgttctcgtgtccgaggtgtgtgggtcgtgtgcgttggatcggcttgcagatggtggatgcttgatgtgagtttcgttatggagtagtactattattttgaagtttacatgtatctggttctggtctcaccaaccattacaatctctgct

SEQ ID NO: 14387 - protein, 300 aa, Panicum virgatum
  misc_feature: Ceres CLONE 1776244
  misc_feature (116)..(251): Pfam Name: ADH_zinc_N Pfam Description: Zinc-binding dehydrogenase
  misc_feature (1)..(85): Pfam Name: ADH_N Pfam Description: Alcohol dehydrogenase GroES-like domain
  misc_feature: SWISSPROT Homolog: EC 1.1.1.195 Cinnamyl-alcohol dehydrogenase
  misc_feature: Useful for making plants with altered carbohydrate content 220>
  misc_feature: Useful for making plants with altered lignin content
  misc_feature: Useful for making plants with altered cell wall content and/or composition
  misc_feature: The sequence is a functional homolog of SEQ ID NO 2 in US patent 7288696
MVPGHEVVGEVVEVGPEVSKHRVGDVVGVGVIVGCCRECRPCKANVEQYCNKRIWSYNDVYTDGQPTQGGFASTMVVDQKFVVPIPAGLAPEQAAPLLCAGVTVYSPLKHFGLTAPGLRGGILGLGGVGHMGVKVAKAMGHHVTVISSSSQKRAEAIDELGADAYLVSSDAEAMAAAADSLDYIIDTVPVHHPLEPYLALLRLDGKHVLLGVVGEPLSFVAPMVMLGRKAVTGSFIGSVDETAELLRFCVDKGLTSQIEVVEMGYVNEALERLERNDVRYRFVVDVAGSNIEEAAGAPAN

SEQ ID NO: 14388 - DNA, 604 bp, Panicum virgatum
  misc_feature: Ceres CLONE 1776246-R
  misc_feature: Encodes the peptide sequence at SEQ ID NO. 14389
cccccaacaacgtcaagtccagtgtgtgtgacatccccgccccaaggggctgaagatggcaggcaccttcgtcggcaactccacctccatccaggagatgttccgcagggtgagcgagcagttcaccgccatgttcaggcgcaaggcctttttgcactggtacactggcgaggggatggacgagatggagttcaccgaggccgagagcaacatgaacgacctggtcgcagagtatcagcagtaccaggacgccaccgctgacgaggagtacgaggacgaggaggaagaggaggcagtggccgaatagcgatggctccggtgcccttcccaaggccaccgtctgcccaggttgtgtccctgtgaatgggtttgtcttctgtgcttctcgtggctttgcatgatcacgtacgttgtcgtcgttgaggtcgcgtctgtgctccggctgcggttgcagtaatgtacgtactgtgttgtactaggtcaccgtcggtttctgttccgcatactttgtcaagtagcttacggctttgcactgctagtgctcaccttgagctgatcgcctgtaatttctgacgagtattggtagtgagtgatttcttctcgc

SEQ ID NO: 14389 - protein, 83 aa, Panicum virgatum
  misc_feature: Ceres CLONE 1776246-R
  misc_feature: Useful for making plants with modulated flowering time
MAGTFVGNSTSIQEMFRRVSEQFTAMFRRKAFLHWYTGEGMDEMEFTEAESNMNDLVAEYQQYQDATADEEYEDEEEEEAVAE

SEQ ID NO: 14390 - DNA, 153 bp, Panicum virgatum
  misc_feature: Ceres CLONE 1776246
gttgaaggagcaccggcttgtggccctggtgcggccctgcctcggactgcttggtggatagcccgctgcggctccccgcgctcgccgatgagctgctcggcgggcagggcgtggcaatcgcggtcgccgccgcctacgccggagatgtggcgc

SEQ ID NO: 14391 - DNA, 1198 bp, Panicum virgatum
  misc_feature: Ceres CLONE 1776248
  misc_feature: Encodes the peptide sequence at SEQ ID NO. 14392
acaaacaacaagcagaaaccactctagcttgcactacgactgccactgaaccacgatcacctcccactaccaagcaccagctagtcctcgcctatttcaccctgagaaatcagaaatggcatcgcctcgtggtagcactcgcgttcggcacggcacgagccacgtcgcgctcgtgctgatcgccgtgctgcttctgacctcggcacgtctcaccctgggcgccagcaggaggcttctggagctgtacaagccgccggccagcgcgcggctcacctaccacaacggcgccgtgctgcagggccgcatcccggtgtccatcctctggtacggcagcttcacgccggcgcagaaggccgtggtcaccgaattcctccagtccctcaccgccgcctcgcaggcgcccaccccgtccgtctcgcagtggtggaacaccatcaaccagctctacctgtccaaggcgccgcggaggggcagcagtgccaacggcgcggaggtggcgctcgccggccaggtctccgacgaggcgtgctcgctggggaagcgcctcacgctggcgcagctcccgcagctggcggcgcgggccggacccaagaagggcggcatcgcgctggtgctcaccgcgcaggacgtggccgtggaggggttctgcatgagccgctgcggcctgcacggctcggacgccaaggccgagaccgcctacatctgggtcggcaactccgccacgcagtgccccggccagtgctcgtggccgttccaccagccgccgtacgggccccagacgccggcgctcgtgccgcccagcggcgacgtcggcgtggacggcatggtgatcaacatcgccagcatggtcgcgagcacggtgaccaacccgttctgggacgggttctaccagggcgacaaggacgcgccgctggaggctgccactgcctgcactggggtctacggcagcggcgcgtaccccggtttcgccggaaacctggcggtggatcgtgcgacgggggcgagttacaacgccaatggcgcgcgtgggaggaagtacctgcttcccgcgctgttcgaccctgaaacgtccacgtgttcaactttggtgtaacggctatggaaacaatcctgacagaaatgtgtagtaacactgtatatatatgagtatatatatgagtgactggaagtgtactgtagtacgggttaatttttgttt

SEQ ID NO: 14392 - protein, 325 aa, Panicum virgatum
  misc_feature: Ceres CLONE 1776248
  misc_feature (52)..(325): Pfam Name: Phi_1 Pfam Description: Phosphate-induced protein 1 conserved region
MASPRGSTRVRHGTSHVALVLIAVLLLTSARLTLGASRRLLELYKPPASARLTYHNGAVLQGRIPVSILWYGSFTPAQKAVVTEFLQSLTAASQAPTPSVSQWWNTINQLYLSKAPRRGSSANGAEVALAGQVSDEACSLGKRLTLAQLPQLAARAGPKKGGIALVLTAQDVAVEGFCMSRCGLHGSDAKAETAYIWVGNSATQCPGQCSWPFHQPPYGPQTPALVPPSGDVGVDGMVINIASMVASTVTNPFWDGFYQGDKDAPLEAATACTGVYGSGAYPGFAGNLAVDRATGASYNANGARGRKYLLPALFDPETSTCSTLV

SEQ ID NO: 14393 - DNA, 720 bp, Panicum virgatum
  misc_feature: Ceres CLONE 1776251
  misc_feature: Encodes the peptide sequence at SEQ ID NO. 14394
acctcatcgatcgatccagccagtcgcctatcctcgcctgctgcgcgcgtctatctgctctcctagggagatctcgcgcagcgcggtaacccaccttcccacctcgtcgccgtcgcagatggccggcctcaggatgaagctcgtcgccgccgccgccgtggccgccgcgctcgtggcgtccgccgccgccgccacagaggcccccgccccggcggcgggaagaagggcgggaagaagaagaagaagagcaagaagaagcccaaggtggcggcggcggcgggcggtggcagcagcagcgggaagaagccgcgtctgcagagccggctgtcgttcacggagctgagcgggatggtgtcgcccgaggacctgtcgctctcgctggtgggctccaacctccacgtcttcaccatcgccgagctgcgcgccgtcacccgggacttctccatgaccaacttcatcggcgagggcggcttcggacccgtctacaagggctacgtcgacgacaagaccaagccaggcctgcgcgcgcagcccgtcgccgtgaagctgctcgacctcgagggctcccagggacacaccgaatggctgaccgaagtcatcttcctggggcagctgcggcaccctcatctcgtgaagctcatcggctactgctacgaggacgagcaccggctgctcgtctacgagttcatgaccaggggcagcctggagaaacatctcttc

SEQ ID NO: 14394 - protein, 123 aa, Panicum virgatum
  misc_feature: Ceres CLONE 1776251
  misc_feature: SWISSPROT Homolog: EC 2.7.11.1 Non-specific serine/threonine protein kinase
  misc_feature: Useful for making plants with modulated drought sensitivity
  misc_feature: Useful for making plants with modulated heat sensitivity
MVSPEDLSLSLVGSNLHVFTIAELRAVTRDFSMTNFIGEGGFGPVYKGYVDDKTKPGLRAQPVAVKLLDLEGSQGHTEWLTEVIFLGQLRHPHLVKLIGYCYEDEHRLLVYEFMTRGSLEKHL

SEQ ID NO: 14395 - DNA, 664 bp, Panicum virgatum
  misc_feature: Ceres CLONE 1776251-R
  misc_feature: Encodes the peptide sequence at SEQ ID NO. 14396
ccacgtctcgacacgagtcatgggcacgcagggctacgccgcgccggagtacatcatgaccggccacctgacggcgaagagcgacgtgtacggctacggcgtggtgctgctggagctgctgacggggcggcggtcggtggacaagagccggccgccacgggagcagagcctggtggagtgggcgcggccgtacctgacggacgcgcgccgcctggaccgcgtcatggaccccaacctggccggccagtactccggccgcgccgcgcacaaggccgcggcggtggcgcaccagtgcgtcagcctcaaccccaagtcccgcccgcacatgtccgccgtcgtcgaggcgctcgagccgctcctcgcgctcgacgactgcctcgtcgggcccttcgtctacgtcgcgccgccggaggagaacaacaataatggcggcgacggggctgcgggcggcaaggggggctccggcggccgaggccggaggaagtccagagatggcgcggcggccgtcgtgcggccggagtagctagctattagctagtagtgatccgtgatactagatggtcatggtatgggcttgcattgcttgctcgccctgtctctggattgttgctgcctgtagcaggctagcaggtgggtgagctaccgatcaagccagcgtttgtgt

SEQ ID NO: 14396 - protein, 173 aa, Panicum virgatum
  misc_feature: Ceres CLONE 1776251-R
  misc_feature: SWISSPROT Homolog: EC 2.7.11.1 Non-specific serine/threonine protein kinase
  misc_feature: Useful for making plants with modulated heat sensitivity
HVSTRVMGTQGYAAPEYIMTGHLTAKSDVYGYGVVLLELLTGRRSVDKSRPPREQSLVEWARPYLTDARRLDRVMDPNLAGQYSGRAAHKAAAVAHQCVSLNPKSRPHMSAVVEALEPLLALDDCLVGPFVYVAPPEENNNNGGDGAAGGKGGSGGRGRRKSRDGAAAVVRPE

SEQ ID NO: 14397 - DNA, 1165 bp, Panicum virgatum
  misc_feature: Ceres CLONE 1776286
  misc_feature: Encodes the peptide sequence at SEQ ID NO. 14398
agtggatgattgcagtccagttccagccagccagaacccatccctcataatttggatgccatgagttatctcttcaagagcaggagtgaaccaacgccgatgataccagcatctttacaagaacaactggcaaagataaatgaggtccgggggctccttggcgacctgccgatggagatgccgaaattcctgtcagacgccactatccgtcggttcctccaagcaagaaactggagcacagttcatgctgccaagagtctgaaagaagctgccagttggagacgtcagtacaagccagagaaaatttgttgggaaaacatcgcggatagtgagaatgaggctaggagagcttacataccagactaccttgacaagaacggaagaatggtcttcataacactgccaacaataaagacgaaagcatcagagaaggatcttataaaatacctagtgtataacctagaaaacttggtgctgaattcagaagatgcagaagagagtgttgtctggataagtgacttccggggttgggcagtatcaagtacaccattttcattgacccgagaatcattgcatataattcaaaaatattatccaagactgatagcagttgctattctaacaaacccgccaaggatttttgaatctttttggaagataataaagcacttcctcgagccaaaaatgaacgagaaagtgaaattcgtgtacaacaattcagagtgccaaaggataatgggtgatatgtttgacctggacaagctggagtctacctttggaggaagaaacacagcgggcctggatatcgacaagtatgccgagaaaatgagaagacaagatcagataaggggagcctggacacaagccaatggcaacacctcttcaccctgatttttaatgagttcctgttccgtgctaattaagagcacaataacaccactgtcagcagttaattaaactggacaaagattgaacgactctatctaccctacatgctctgagcctctgaggcatgccagcatattagtgatcccataaataggttcatgttgatagttaagaacatagggggatgttaactttgaagttctgaatgatattgttcgggatgtcgggttatattaaagatatgccaacaaaatattatgcatgaagctcctggatt

SEQ ID NO: 14398 - protein, 276 aa, Panicum virgatum
  misc_feature: Ceres CLONE 1776286
  misc_feature (84)..(265): Pfam Name: CRAL_TRIO Pfam Description: CRAL/TRIO domain
MSYLFKSRSEPTPMIPASLQEQLAKINEVRGLLGDLPMEMPKFLSDATIRRFLQARNWSTVHAAKSLKEAASWRRQYKPEKICWENIADSENEARRAYIPDYLDKNGRMVFITLPTIKTKASEKDLIKYLVYNLENLVLNSEDAEESVVWISDFRGWAVSSTPFSLTRESLHIIQKYYPRLIAVAILTNPPRIFESFWKIIKHFLEPKMNEKVKFVYNNSECQRIMGDMFDLDKLESTFGGRNTAGLDIDKYAEKMRRQDQIRGAWTQANGNTSSP

SEQ ID NO: 14399 - DNA, 1340 bp, Panicum virgatum
  misc_feature: Ceres CLONE 1776292
  misc_feature: Encodes the peptide sequence at SEQ ID NO. 14400
gatttctcctctgcttctctcaagccctaaacccatggcgccgccgggcccctccgccggcgtccgcctgctcctcctccgccgcctcctctccacgggtaccgaagcggcggcgggggctgctgctgcgcccaccgccgccgccaccgccaccgccaccgccgcgaaggcggggaataagggggactcgctggcgctctaccgccgtctggtggcgctgggccgctccggggaggggagcgtgtcgcgggcgctcagcaagtgggtgcggcagggtggcgcgctgcccgtccaagatctcgtcgagcacgtcaaggagctccgcaagtacaagcgctatggccacgccctcgagctgatggactggatggtcaatgcaaggggcacgaccatgtcacacgctaaccatgcaatacaactagatcttatctataaagtgcgtggcattgaggcagctgaggcttattttgctgatctccctgatccagccaagaaccatcgaacttatggtgcacttcttaattgttattgctcagcaaaaatggaagagaaagcaacagatctctacaacaagatggttgagcttggcatctgttccagtgagctactcttcagtaatctgatgtccatttacatgaagttaggccggcatgggaaggtcgatagtctctttgaggaaatgaaggtgaagaatgttaaaccgagtaacatgacatgccgcattctgatgaccagctatgcacaatcaaacaagatagatgctattgaagaacttctaaaagaaatggcagaaaaggatgtggctcttggatggtctgcatatagcacactcgcttctatctatataaatgctggcctggttgaaaaagcagagtctgctttgaagaaactagaagggcttgttggtcctgatgatggtatgctaccttttgatttccttataagcctctacgcttcagtaggcaatttgagcgaggtcaacagggtatgggatgtgataaaggccaaattctcaaaggtgaccaagagaagctaccttggcatgcttcaagctctttataagctcaatgatattgacggcatgaagcagatttatgtggattgggaatccaattataaattctattatgtgaggctgacaaatatgatgattcgtgggcatctgaagcttgacttgacagaagaagcagaggcactgtgggagaaggccaaggaaaaaggcacgaagttcgactccaaaacatgcgagctatttcttgatcactacatgggtaaggggggcatgaacttggcactgaactggttggagaatatgattaaactccccaacaaagcaggga

SEQ ID NO: 14400 - protein, 435 aa, Panicum virgatum
  misc_feature: Ceres CLONE 1776292
  misc_feature (156)..(190): Pfam Name: PPR Pfam Description: PPR repeat
  misc_feature (191)..(225): Pfam Name: PPR Pfam Description: PPR repeat
MAPPGPSAGVRLLLLRRLLSTGTEAAAGAAAAPTAAATATATAAKAGNKGDSLALYRRLVALGRSGEGSVSRALSKWVRQGGALPVQDLVEHVKELRKYKRYGHALELMDWMVNARGTTMSHANHAIQLDLIYKVRGIEAAEAYFADLPDPAKNHRTYGALLNCYCSAKMEEKATDLYNKMVELGICSSELLFSNLMSIYMKLGRHGKVDSLFEEMKVKNVKPSNMTCRILMTSYAQSNKIDAIEELLKEMAEKDVALGWSAYSTLASIYINAGLVEKAESALKKLEGLVGPDDGMLPFDFLISLYASVGNLSEVNRVWDVIKAKFSKVTKRSYLGMLQALYKLNDIDGMKQIYVDWESNYKFYYVRLTNMMIRGHLKLDLTEEAEALWEKAKEKGTKFDSKTCELFLDHYMGKGGMNLALNWLENMIKLPNKAG

SEQ ID NO: 14401 - DNA, 1917 bp, Panicum virgatum
  misc_feature: Ceres CLONE 1776311
  misc_feature: Encodes the peptide sequence at SEQ ID NO. 14402
gcaacaggaggagcggagagagagccccaccccaggcagctagctcaccaccgcggcgcagcggcaatggcgacccgccggcagccccgccgcgccttcccgctggtcccgctcctgctctccctcatggccgccgccgcgtacggccgcctcatctccgacggctccccgtcggcgccgctcgtctcggtgatccgcctcgccgcgccggccgcggcggcggcggaagagaagtgcgagcagtcgtacggattcctcccctgcaccaccaccgtgctcgggaacctcttcctcgtcctcgtctacggcttcctcatgttcaaggccgccacgtacctgtccgcgggcagcgagctgctgctcgagatcatggggccggggctcgtcggcggactcctcctccccatcctcggcgccctccccgacgcgctcctcgtcctcgtatctggcctctctgggagtaaagagactgcacaaagtcaggtcctgatcggaatggggctgcttgctggttccactgtcttcctcctcaccctgctttggggaacctgtgttgttgttggtaaatgtgaccttgggccaaaccgtgaggcagttgatttaacgaacaccaagggcttcagcctgactggcactggtattacaactgatgtacagaccagctatgcggcacggatcatggggctatctgtaatccccttcatcattgcccaattccccaagatgttgaagacccaccatgggcagcgcctggctgtcttgttggccctaatcgcgtcattcttgctcgtgttttcctactgcctgtatcaggttttccagccatggattcagaggaggaagctcgcgtacgccaagcacaaacatgtgatctccgggatcctgaggcatgcccaaatgcaggcactcggccgtctgctcaacgatgacggcacacccaatgaagacgtcatcagaaagctgttccgcaagattgacatagatgaaagccgcaccctttcccgttccgagctgcacgctctcatcgtcggtatcaacttcgaggagctcgacttcgacaggatggacgcggtcaacaaggtcatggacgacttcgacacgtcccgcaatgacgtcgtggaggaggaggagttcgtgcaggggatgaagaaatggctcaatgaggccaagcgcagcgtgccggcaagcggcgctttctccaaaaagttcatcaacgacttccacgagaggacgaggcaggagcacgaccagctgattgacaggtcggacgaagcggtggagagcgtggagaaccccgggtggtgcatcgccaaggccgtggggttcctcctcctgggcgccgccatcgccgccgcgttcgcggacccgctcgtggacgccgtccacaacttctccaacgccacgcacatcccgtccttcttcatctccttcatcgccctcccgctggcgaccaactctagtgaggccgtctccgccatcatcttcgccagcaggaagaagcagaggacctgctccctcaccttctcggaggtgtacggcggcgtgacgatgaacaacacgctgtgcctgggcgtgttcctggcgctcatctacttccggaacttgacgtggaacttctcatcggaggtgctcatcatcctggtcgtctgcgtcatcatggccctcttcaccagcttccggaccacgttcccgctatggacctgcctcatcgcctacatgctctaccccctctcgctggtcgtcgtctacatcctcgactacgtcttcggctggtcataggcgcattggctctcctcaagtgaacgcctgttttttggcggccacaagtcggtttggtcctgtaattttgactgctgtgggcagagactgtttctcgtgttgatctaatcatgctcaaacctttccggccttgtgtag

SEQ ID NO: 14402 - protein, 570 aa, Panicum virgatum
  misc_feature: Ceres CLONE 1776311
  misc_feature (82)..(252): Pfam Name: Na_Ca_ex Pfam Description: Sodium/calcium exchanger protein
  misc_feature (426)..(560): Pfam Name: Na_Ca_ex Pfam Description: Sodium/calcium exchanger protein
MATRRQPRRAFPLVPLLLSLMAAAAYGRLISDGSPSAPLVSVIRLAAPAAAAAEEKCEQSYGFLPCTTTVLGNLFLVLVYGFLMFKAATYLSAGSELLLEIMGPGLVGGLLLPILGALPDALLVLVSGLSGSKETAQSQVLIGMGLLAGSTVFLLTLLWGTCVVVGKCDLGPNREAVDLTNTKGFSLTGTGITTDVQTSYAARIMGLSVIPFIIAQFPKMLKTHHGQRLAVLLALIASFLLVFSYCLYQVFQPWIQRRKLAYAKHKHVISGILRHAQMQALGRLLNDDGTPNEDVIRKLFRKIDIDESRTLSRSELHALIVGINFEELDFDRMDAVNKVMDDFDTSRNDVVEEEEFVQGMKKWLNEAKRSVPASGAFSKKFINDFHERTRQEHDQLIDRSDEAVESVENPGWCIAKAVGFLLLGAAIAAAFADPLVDAVHNFSNATHIPSFFISFIALPLATNSSEAVSAIIFASRKKQRTCSLTFSEVYGGVTMNNTLCLGVFLALIYFRNLTWNFSSEVLIILVVCVIMALFTSFRTTFPLWTCLIAYMLYPLSLVVVYILDYVFGWS

SEQ ID NO: 14403 - DNA, 1804 bp, Panicum virgatum
  misc_feature: Ceres CLONE 1776319
  misc_feature: Encodes the peptide sequence at SEQ ID NO. 14404
tggcttctcctgcaccgcaacggcacaacaagaaccaccaccaccacctccatcactctccagtcctcccccaccccgtccactgagccaccgctgctgctgctgctgctgctgcgagctcggctgcagctccaccctccagctcctctacctcccccgccccccgccctctctcctcccagcagccttgcacttgcagcgacttgctaacagtgcgctccccgggcagaatgaccaaagatgaggagttcaagctggtcaagatccagaaccatgtgctgagggtgaacatacactgcgacgggtgcaagcacaaggtcaagaagctgcttcagaagattgaaggcgtgtactcggtggccatcgatgtggacaaccacaaggtctcggtgacgggggacgtggacgccgagaccttgatccggaagctcaccaggggtggcaagcacgccgagctgtggtcacagcacaagggcggcggcaaccagggccacaagggcaataaccagcagaagcagcagcagaaccaccaccagcaccagcagcatcagcagcagcagaagcaaggtgccaatctgagcaaggatggccacaacaacaagaacaacaatggcgggcagaaggagcagggcaagcaggggggaggagttggaagcctcatgcagggcctcaaggcgttcaagagccagcacaacaacaagcaccagcttgctgacctcagctccgaggatgatgacatgtatgatgatgaggatgacgagttcgacgatgactatgaggaggagctccgcttcctgggggacaagatgagccagcttgggttccacagcaataaccaccaccagaaccagaacaagaacggcaacaatgcggctgtcaacaataaccacaacaatggcaagaaaggtaatggcggcgctggaggcggagccaatcaccaccagaatcagaagaatgcgaatgtgatcaacatggcagcggcgaatgccaagatgggtggtggcgtcccgaaccagaagaatgcgaatgtgatcaacatggcggcagcggcagcggcaaacgccaagatggccaatggtgcccagaggaacaccggtgccatgtctggcatgctgggcctgagccatggcctgggagcgggcaatgcggctcctggcttccaaggctacacaggcttcaaccatccgtcctatgctgctgccggctatggaggccttcagcaacagcaccacctccagcagcagcaaaacaacaacctcatggcgagcatgcaggggtaccatcatcacccagcggcgacggcggcgatgatgaacaatttgaggggcctgaacagcaacatgatgatgatgcatcagccccagcagcagccgcagatgatgtaccactcctctccccagatcagcccctacactggctattacaacccttacaactactactaccatccccatcctggcagcgctggttacccggccagcaatggggatgtggagaccatgttcagtgatgagaacaccaagggatgtgttgtcatgtagggatgttgctacaaagctagaatctagaggttgttgatgaaggatggtaatggtgatgcagtcctgctaccttttcttttcttttttccttatttttctgctcttctggtttcgcctgtatcaagaatgaatcatggtgttgacttagatgtgctgttcaaagtaggggcaacttgagagggtgatcaaacagtgtaatgtaataccttttactgcctagtgctttgccctgactggcttgctataatttgtatattgtatag

SEQ ID NO: 14404 - protein, 436 aa, Panicum virgatum
  misc_feature: Ceres CLONE 1776319
  misc_feature (16)..(76): Pfam Name: HMA Pfam Description: Heavy-metal-associated domain
MTKDEEFKLVKIQNHVLRVNIHCDGCKHKVKKLLQKIEGVYSVAIDVDNHKVSVTGDVDAETLIRKLTRGGKHAELWSQHKGGGNQGHKGNNQQKQQQNHHQHQQHQQQQKQGANLSKDGHNNKNNNGGQKEQGKQGGGVGSLMQGLKAFKSQHNNKHQLADLSSEDDDMYDDEDDEFDDDYEEELRFLGDKMSQLGFHSNNHHQNQNKNGNNAAVNNNHNNGKKGNGGAGGGANHHQNQKNANVINMAAANAKMGGGVPNQKNANVINMAAAAAANAKMANGAQRNTGAMSGMLGLSHGLGAGNAAPGFQGYTGFNHPSYAAAGYGGLQQQHHLQQQQNNNLMASMQGYHHHPAATAAMMNNLRGLNSNMMMMHQPQQQPQMMYHSSPQISPYTGYYNPYNYYYHPHPGSAGYPASNGDVETMFSDENTKGCVVM

SEQ ID NO: 14405 - DNA, 596 bp, Panicum virgatum
  misc_feature: Ceres CLONE 1776320
  misc_feature: Encodes the peptide sequence at SEQ ID NO. 14406
atccgaaagccaaagcgagtctcaccagtcaaagaaccagttctaatatctttgctgatctgttctgctgcttttagtttggaaagcctttactgccggcgatcatggaggaccaaaggaacccccagcaccaccctcccggtcatctccctcccacggcccccgatctcgcggatgcgaaagacttgcacctgcagcaacttgctaacagtgcgctacccgggaagaatgaccaaagatgaagaggtgcggctggtcaagatccagaaccgtgtgctgagggtgaacatacactgcgaccggtgcaaacacaaagtcaagaaactgcttcagaagattgaaggcgtgtactcggtggccatcgatgtggacaaccacaaggtctcggtgacgggggacgtggacgccgagaccttgatccggaagctcaccaggggtggcaagcacgcccagctgtggtcacagcacaagggcggcggcaaccagggccacaagggcaataaccagcagaagcagcagcagaaccaccaccagcaccagcagcatcagcagcagcagaagcaaggtgccaatctgagcaaggacggccacaacaa

SEQ ID NO: 14406 - protein, 122 aa, Panicum virgatum
  misc_feature: Ceres CLONE 1776320
  misc_feature (16)..(76): Pfam Name: HMA Pfam Description: Heavy-metal-associated domain
MTKDEEVRLVKIQNRVLRVNIHCDRCKHKVKKLLQKIEGVYSVAIDVDNHKVSVTGDVDAETLIRKLTRGGKHAQLWSQHKGGGNQGHKGNNQQKQQQNHHQHQQHQQQQKQGANLSKDGHN

SEQ ID NO: 14407 - DNA, 659 bp, Panicum virgatum
  misc_feature: Ceres CLONE 1776320-R
  misc_feature: Encodes the peptide sequence at SEQ ID NO. 14408
ctgcggttcctcgacaccggcgacggcacggccggcctcgccggggacgcgctctccgccgaggtgtggaagcagctgtggccggccaacaggcggcggcagagggagttcttctgcttcggcatggacgtcctgctcaagctggacctcgagggaacgcggcgcttcttcgacgccttcttcaacctcgagccgcactactggcacggcttcctgtcgtccaggctgttcctgccggagctcttgatgttcaggctagcgctgttcgggaacgcctccaacacgtcgaggctggagatcatggccaagggcaccttgcctctgggcaagatgattggcaacttgatacaggacagagatgggtgagggtatgtatgcctgcatttctcacctgaagatctccattggatctctgattttggcattgctgatgctcagtgtatttgagatttgcaaagaaagattcacgaaacaccagtctaggagcttctgtcagatataggaattgctgctgcaacgttattttagtattggtgagcacaatttacagtcacaattctatgacgagagctgtatagttgcaaactgagggatgttacgacaatccacgtatcagatatcatggtcttcaaatacaagaccgatttcccacaaaatat

SEQ ID NO: 14408 - protein, 121 aa, Panicum virgatum
  misc_feature: Ceres CLONE 1776320-R
  misc_feature: SWISSPROT Homolog: EC 5.3.99.8 Capsanthin/capsorubin synthase
LRFLDTGDGTAGLAGDALSAEVWKQLWPANRRRQREFFCFGMDVLLKLDLEGTRRFFDAFFNLEPHYWHGFLSSRLFLPELLMFRLALFGNASNTSRLEIMAKGTLPLGKMIGNLIQDRDG

SEQ ID NO: 14409 - DNA, 3460 bp, Panicum virgatum
  misc_feature: Ceres CLONE 1776323
  misc_feature: Encodes the peptide sequence at SEQ ID NO. 14410
ctctcgcggcctgcttcagtcttctcctcctccaaagaacctgtggattcagttcttgtgtgataggggctttcagagctttggttggttgctcggggtccatttcctgggctcccgagtcttgggcccccccacctcttcctccccttccatgggagcttcgaagctgctggatctctgcaagtgaccatgagccagagttttgacatcaacgtgcttcgtgaggaagcaaggactaggtggttaaagccttcagaagtgtactatatcttgcaaaatcacgagaggttcccaatcacctatgaggcacccaagcagccacccagtggttcactattcctttacaatcgtcgtgtgaatcggtatttccggagagatggtcacacatggcggaggaagaaggatggaagaactgttggggaggctcatgaacgattgaaggttggaaatgttgatgctctgagttgctattatgctcatggtgagaaaaatccatgtttccagaggcggtgtttctggatgttggaacctgcatatgagcacattgtgctggtacagtatagagaggtggctgagggcagatattattcatcacagctgtcgaatgggccaccagaatctctttcatctttgggatatccacatgccatctatggaaaccaatatctcagctctacatctggcactagtgagggcagtgaatcccatcagagctattctaatttgagttctgtaactgaagtaagttcctattctggtaataaagagtacaacaaagatggtggcagtttactaagcataccagagcttggacagacttgtctggaacaaactacagaagtttattgggttgataatggtaattcaaaaactaagtatgggcttaatgtggctttgaagaagatagctgagcagttaagcttgggtgacgatgatgatgactatatttacacaaatcaagttcagcctttgggattcgctacaaatactgagcccacagataagaaggatggcgaccaaataaaacaaattcaaccagaaggaacggaaaaaggtttaggcaggaatatagcaccatcatgggaagatgtgttgcattccagttcaggtttgccaattccatctatataccagtcagatgtccagtatcagcaaaattcagaatatcatccacctggaagcctagacagcagtgatttgcgcatacaactttctgctgctaaaagatttcttttagggccggaagcctccattggctcaccatcttcgaactttatgctgaggagcaaggagaacagtggaactgatattctttcggctcatgagagtaggcttgaaagctctctgaacccagattggaaaacaaaagcactgttaacatttcaaagcaattcacagggctctgaaataagggacttgttgtttgaccgtggtcagcttgaaccctactccagagcagatacaagacttaccttgggacagacaaagcagtttgacattcgtgagatttctccagaatgggcattctcctatgagatcaccaaggtcatcattacgggagattatctatgtgatccgtcaaatttgtgttgggccgtcatgtttggtgacagtgaggtacctgctgaaatagttcagccgggtgttcttcgctgccacacaccactgcacagcagtggaaaactcagagtctgcattacttcggggaacagagaagtttgcagtgaattcaaagaatttgagtttcgctcaaaaccaacctcttctggtttctcagaccttgcaccatcttctagatccctgaaatctagtgaagaattattacttcttgccaaatttgctagaatgcttttgtcagagaatggaagctctgaagttccagatagcgatccccaatctggacagtgcccaaaacttaggatgaatgaagagctctgggataggttaattgatgaactcaaactaggatgtgaaaatccactaagtacagttgatcagattatggaggaacttctgaaaagtagattccaacagtggttatcagtgaagctcaaaggattcaatggaacagcttcttctttgtccaagcatgaccagggtattatacacttaatttctgcactaggctatgagtgggcactgtcttcagttctcagtgctggtgttggtctaaactttcgtgattcaaatggatggactgcacttcattgggctgcttactttggatgggaaaagatggttgctgcacttcttgctgctggtgcatcggcaacagcagtcactgatcctactgcgcaagacccagttggcaaaacagcagctttcctggcttctgaacgagggcatacaggccttgcaggttatctttcagaagtatcgctgactagctatcttgcatcactgactatagaagaaagtgatgtttcaaaaggatctgctgaaattgaagcagagagggcagtggaaagcgtatctcagaggagtgcgcaactgcatggtggcacagaagatgagctctcaatgaaggactctttagcagcagtgagaaacgcagctcaagcagcagctcgcatccagaatgctttccgtgtcttctctttcaggaagtgacagcaaaagactgctcgacttagggatgaatatggaatgactcaagaagatatagacgaacttgcagccgcatcaagattgtaccaccaagctcatgcttcaagtggccagttttacgataaagcggctgtttcaattcagaagaaatacaaaggttggaaagggcgcaagcattttctaaacatgagaagaaatgcagttaaaatacaggcgcatgtaagaggccatcaagtgaggaagaaatacagaacaattgtaagcactgtcagtgtgctagagaaagtaatacttaggtggcgccggaaaggacatggcctacgtggcttccgagctgagcagcaaccaatggtaggagcagtagaggaggacgatgaggaagatgatgactttgacgatgatgaagcggtcaaggttttccgtcggcagaaggttgatcaggctgtaaaggaggctgtgtcaagagtgttgtccatggtagactctactgaagcaaggatgcagtatcgtcgaatgcttgaggagtttcgccaagcatcagctgaattgggtggatcacatgaagtaacatcaatatttgacagtgatttggaattgttagggatcaacaacttcatgctctgaaaagagcgcaacatgaaaggagcatttcagtttcaagagctggtgtatgaagtatataaaagtgttcaacttgctactaactaggacttctagtctgtacagtgattgcctggttgttgtagactgctcttctatgcacttttaatccctaaattatttgggaatggcagttctgtgaacactgcattgtatttgggtatttgtaattttaggggatatccttttgtcg

SEQ ID NO: 14410 - protein, 806 aa, Panicum virgatum
  misc_feature: Ceres CLONE 1776323
  misc_feature (10)..(128): Pfam Name: CG-1 Pfam Description: CG-1 domain
  misc_feature (667)..(699): Pfam Name: Ank Pfam Description: Ankyrin repeat
MSQSFDINVLREEARTRWLKPSEVYYILQNHERFPITYEAPKQPPSGSLFLYNRRVNRYFRRDGHTWRRKKDGRTVGEAHERLKVGNVDALSCYYAHGEKNPCFQRRCFWMLEPAYEHIVLVQYREVAEGRYYSSQLSNGPPESLSSLGYPHAIYGNQYLSSTSGTSEGSESHQSYSNLSSVTEVSSYSGNKEYNKDGGSLLSIPELGQTCLEQTTEVYWVDNGNSKTKYGLNVALKKIAEQLSLGDDDDDYIYTNQVQPLGFATNTEPTDKKDGDQIKQIQPEGTEKGLGRNIAPSWEDVLHSSSGLPIPSIYQSDVQYQQNSEYHPPGSLDSSDLRIQLSAAKRFLLGPEASIGSPSSNFMLRSKENSGTDILSAHESRLESSLNPDWKTKALLTFQSNSQGSEIRDLLFDRGQLEPYSRADTRLTLGQTKQFDIREISPEWAFSYEITKVIITGDYLCDPSNLCWAVMFGDSEVPAEIVQPGVLRCHTPLHSSGKLRVCITSGNREVCSEFKEFEFRSKPTSSGFSDLAPSSRSLKSSEELLLLAKFARMLLSENGSSEVPDSDPQSGQCPKLRMNEELWDRLIDELKLGCENPLSTVDQIMEELLKSRFQQWLSVKLKGFNGTASSLSKHDQGIIHLISALGYEWALSSVLSAGVGLNFRDSNGWTALHWAAYFGWEKMVAALLAAGASATAVTDPTAQDPVGKTAAFLASERGHTGLAGYLSEVSLTSYLASLTIEESDVSKGSAEIEAERAVESVSQRSAQLHGGTEDELSMKDSLAAVRNAAQAAARIQNAFRVFSFRK

SEQ ID NO: 14411 - DNA, 1688 bp, Panicum virgatum
  misc_feature: Ceres CLONE 1776327
  misc_feature: Encodes the peptide sequence at SEQ ID NO. 14412
gcaaggaaagcccctaacgaatcccaccgcctcgcccccgtcctccgccggctgccgccgcatcccggcatccccacgattccgaccatggcgggcgacagtagcaacctcgatgcggcgatagagtcactcctgaatgtcgagaagcagatgagactggccggcgatgtcgccggcacgcggaaggccgtcatcgacatcgtcgagctttgctacaaggccggtgcgtggaagacactgaatgaccagatcgttctcctctcgaagaggagaggccaggtcaagcaggccattaccgccatggttcagaaagcaatggagtacattgatttgacaccagacatggacacacgcattgagctaatcaaaacattgagcagcgtctctgctggcaaaatatatgtcgagatagagcgagcaagattgatcaaaagacttgcgaaaatcaaagaggagcagggaaagattgatgaggctgctgatttgatgcaagaagttgctgtcgaaacatttggttctatggcaaagacagaaaaaattgctttcattctcgagcaggtccgcctatgtctggatcgtcaagattttgtccgggcacagattttatccaggagaatcagtactagagtatttgatgcagatccatcaaaggaaaaaaagaaaccgaaagaaggtgacagtattgttcaggatgctcctgcagaaataccttccctcctagaattgaaacgcatctactatgaactgatgattcgatattactcgcacaacaatgattacctggagatctgccgctgctacaaggcaatttatgatattccagctataaaagaggatccagcaaagtggataccgattcttaggaagatttgttggtacttagtgctggcacctcatgatcctatgcaatcgagccttctcaatgctactctagaggataaaaacctttctgagatcccaaatttcagattattgctgaagcagctggttactatggaggtcattcaatggacaagtttgtgggaattctacaggaatgaatatgagaatgagaagcttcttggaggagctttgggtgccaaaactgaagaagatttgaagctgaggattatagaacataatatcttggttgtctccaagtactattcaaggattaccctaaagaggattgcggaccttctctgtctgagtttgcaggaggcagagaaacatctttcagacatggttaactcaaaatctctgattgcaaagatcgacaggccaatgggtgtagtgagattccgtacagctcaagacagcaacggagtactcaactcatgggccacaaacctcgagaagcttcttgaccttgttgagaagagctgccaccagatacacaaggagaccatgatccacaaggcggtgttgaaagcttagttttggctcgtggctttaggttccctttgtaacctcccgtggtcaaatgtcacaaattacaggacatgaagctttcccttgtttgctttggcaagaagtgatagcttttgaacatttgtgcacaatggagattaccgaatcagttgtgcacagttttcttaagatttggctaactcatgttgagtatttgcaatcagccaaatattgccaaagcctataagatcaacctcgttgacaatattaagcttgctgtcgtatgcctttccaaactt

SEQ ID NO: 14412 - protein, 442 aa, Panicum virgatum
  misc_feature: Ceres CLONE 1776327
  misc_feature (291)..(400): Pfam Name: PCI Pfam Description: PCI domain
MAGDSSNLDAAIESLLNVEKQMRLAGDVAGTRKAVIDIVELCYKAGAWKTLNDQIVLLSKRRGQVKQAITAMVQKAMEYIDLTPDMDTRIELIKTLSSVSAGKIYVEIERARLIKRLAKIKEEQGKIDEAADLMQEVAVETFGSMAKTEKIAFILEQVRLCLDRQDFVRAQILSRRISTRVFDADPSKEKKKPKEGDSIVQDAPAEIPSLLELKRIYYELMIRYYSHNNDYLEICRCYKAIYDIPAIKEDPAKWIPILRKICWYLVLAPHDPMQSSLLNATLEDKNLSEIPNFRLLLKQLVTMEVIQWTSLWEFYRNEYENEKLLGGALGAKTEEDLKLRIIEHNILVVSKYYSRITLKRIADLLCLSLQEAEKHLSDMVNSKSLIAKIDRPMGVVRFRTAQDSNGVLNSWATNLEKLLDLVEKSCHQIHKETMIHKAVLKA

SEQ ID NO: 14413 - DNA, 2035 bp, Panicum virgatum
  misc_feature: Ceres CLONE 1776333
  misc_feature: Encodes the peptide sequence at SEQ ID NO. 14414
ccatctccgcctccgcctcctccagcgcctgctgctccggctgaggccctccttccctcctctcctctactctccgctcgctcgctccctcctcgtctcgcctgcgccgccaccaccaccgcctcctcgcagcgccccccggcctctcctcctcggcgcgcgctgccccgatcccgccggagtgcccgcgccgaccgccggcgaggagctccgggcggctggttcgccgtgacctcgcggggctgcgtcctcgtcgtccggctgttctcgcccgtcgtcgctgcttccgcgagtggcgccgtgtcggcggcgcatgccggcggcggcgcgggaacgaggcgagggcggcgcgccttgtcgccgcgcggactgacatgacttgagccttgagatttaggatgtgtacagaggggctgtattcttgtgtataggttctctttcaattgatcaaaccgttgcagtttctgacggaatgttggagggtcaatcttgcctgatatcaaggtcactgccaagctcctgtgagcaggaatccagactagcttacatgactttccacctcctcgagatcacaaggagtaagcgcccacctgcaaacctgtctattgaacacgacgttgctgcagtggcagcgttgactaaacggaccaagtccgccgagaaccagaagggtgagccactggatagtcagggcagtaatgatcagggcgattcagattcaagcaccctgataagttccattggtcgggataactctatcaactgccttgcccgttgctctcgttctgattatggttctattgcatcactcaaccgaagcttccggtcacttgtccgcactggtgatctgtacaaggaacgtcggcagcttgggatttcagaacactgggtctacttctcctgcaatgtgcaggagtgggaggcgtatgatccctaccgttcacggtggatgacacttccaagaatgccccataatgaatgtttcatgtgctctgacaaggagtcacttgctgtgggcactgaacttctggtgtttggaaaggagattctttcacatattgttctgagctatagcattctgacaaattcatggtcgcggggtgttgaaatgaatgcccctagatgtttgtttggatcagctagtttcggagagaaagcaattatagctggtggcatggatgctgatggacgggtgcttcgctctgctgagctgtataactctgaaactaaaagatggataacacttccaaacatgaataaagctaggcggatgtgttctggtgtatttatggatggaaagttttacgtaattggtggaatggcgagtaacacggaagtccttacctgtggagaagagtatgatttagatagaggtacctggcgggtgattgagaacatgtctgaggggctcaatggtgcaagtggtgctcctccacttgttgctgtagtcgaaaatgagttgtatgcagcgcaatacgcaggaaagctagtaagaaagtacaataaaagagagaactcatggataacattgggtgagttaccagagcgacctgaagccgtgaatggatggggcattgcattccggggctgtggagagcggcttttggttattggtggaccaagagtgttgggtggtgggatgattgagcttcattcttggatcccaagggaaggtccattacaatggaacatgatcggaagcaaaccttctggtaactttgtttataactgtgctgtcatggggtgctgatctgttctctctcaaacataccgtcgacaagaaagattgtgatattggttttatcatatggcataaagcactgattctacctgatgggtaatctctgcattctttttgacatttcagattttactcaaggccgaatagagtagtcagttccatgtactcgttaatagttacccattggtttctgttttcagcacatttgatttgcagtacctttgctccatatactctgttgaaatgagttctctgagatggatgcatatatgtgacaaactgtaattgagatag

SEQ ID NO: 14414 - protein, 425 aa, Panicum virgatum; identical to SEQ ID NO: 13735
  misc_feature: Ceres CLONE 1776333
  misc_feature (216)..(262): Pfam Name: Kelch_1 Pfam Description: Kelch motif
  misc_feature (264)..(310): Pfam Name: Kelch_1 Pfam Description: Kelch motif

SEQ ID NO: 14415 - DNA, 2207 bp, Panicum virgatum
  misc_feature: Ceres CLONE 1776341
  misc_feature: Encodes the peptide sequence at SEQ ID NO. 14416
gtctccgtctctctcctccgcctccccttccgctccccttctctctcctcccttcctcgcttggaccttggatccgagcccaaaccctaagccccaacggtcccctcccctcccctccccgaccaaaccctaaaacccactacccctcttcgatttcccgcctaatcataccccaccaccgcgcgctcgcgtcgaattcgaaccggccattcggagctcgaatttgaattcgagctcgaatcacccgcgccgggagcgagggcgagctgggggagctcgattcgatgcggtgctgagcgtgggtcaaccaatttgggccgggcggtggcgcggtcggcgggatctgaaccctagcggccggccggatctgagagaccgcgccggcgaggtgctcggcggtatgagtggttgggaagggcacagaggagaagcggagatatgagcggaggcggcgggagcggcaccggggacgagttcgggcgggcggtggcgcgggccgcggtggcgcaggcgctggaggccgcggggttcgactgcgcgcaccgctccgcggtggacgcggtcgttgacgtcctcctgcgctacatctcccacctgggccggtccgcggccttcaacgccaacttcgccggccgcgcgctcgccaacgagctcgacgtcatccaggcgctcgaggaggtcggctccgacacggacgggtttgcgggcgcgtccgccacggggcactgcctcgtcggctccggcgtcgtcagggacctcatggcgttcgtcgacaccaaggacgaggtgccgttcgtgcggccgctgcccaggttccctgtgccgcgcgtgcagccgcagccctctgccagcttcgcggtggccgggagggaaaccgggatgaagcacgtgcctgagtggctcccggttttccctgatccgcacacctatgtgaggacagaggcgtgggttgagccgccggcaaccaaggaccgggtggacaaggtggaacaggtgcggcaacggaggaaggctgagaagtccctgctcagcttgcagcaaaggctagcacaggctggtgctgaaggatttcatccagcagttgggctcacacaggatagcacggagaagggcaaggagatactggcagctgggaccaagagaaatccatttcttgagccagcattgccgcctggagagaaggatatatccgaggttgatatgcctcctgaaaagaagaaactctctgtccttgaggcatttgcaccagctattcaagctacagccatcagggagattgatgctgggacagggttagatcaaaaccaaaggagcatcgttccaaaagagagggcgccagtacacctcaagattggatttggtaagaagcctgtagcagctgtcccgaattcaggagccctggatctgagggatgatccttccttcttgaaggaggaagcgaaggatgacaagaagcggagagcagggatgatattaagagcatcaatggagaacccacaggaacttcctcaactctgaagtgatttatggatgaactgcggtgacagaatggaatcgcatcacagtgcgattgagtttattggagctatggatatttcagattgatggtggaacttcaatttccagaatcttgaggccatgcgtcggtgatacgactttccttgtatcttaatgacatcagaagcattcttagaacattgctaacagcacccaggctctcccttccccacctaccattttcctggaatcacaaggcactggttattctgcagcgctgcaactgaagttccaccgtttcacccccattcaacttaggttctgctggtatttcaccgctaaggcgttaactgtaagtgagccacttcatacggagctgattttggaggccgtgtttcctctccccagacatggcgtccaaaataatgatgctcccgagttactttttgtagctgtattccctggtagaattgaaaagagatgtttgtacaaaagctaacctgattctcctgacctagactccaagacttgtctcggtcaggattgatgtacctagtggattactcccaagagccagcttctttatgttacatgttggcctaatagctccggcctgaagtttggtcgccggcctgcgatctgggcgctttcaaaacacctgatgggactcatttcatgatgatttgattgattcaaagaagatttgaccg

SEQ ID NO: 14416 - protein, 359 aa, Panicum virgatum
  misc_feature: Ceres CLONE 1776341
  misc_feature (11)..(87): Pfam Name: Bromo_TP Pfam Description: Bromodomain associated
MSGGGGSGTGDEFGRAVARAAVAQALEAAGFDCAHRSAVDAVVDVLLRYISHLGRSAAFNANFAGRALANELDVIQALEEVGSDTDGFAGASATGHCLVGSGVVRDLMAFVDTKDEVPFVRPLPRFPVPRVQPQPSASFAVAGRETGMKHVPEWLPVFPDPHTYVRTEAWVEPPATKDRVDKVEQVRQRRKAEKSLLSLQQRLAQAGAEGFHPAVGLTQDSTEKGKEILAAGTKRNPFLEPALPPGEKDISEVDMPPEKKKLSVLEAFAPAIQATAIREIDAGTGLDQNQRSIVPKERAPVHLKIGFGKKPVAAVPNSGALDLRDDPSFLKEEAKDDKKRRAGMILRASMENPQELPQL

SEQ ID NO: 14417 - DNA, 2690 bp, Panicum virgatum
  misc_feature: Ceres CLONE 1776352
  misc_feature: Encodes the peptide sequence at SEQ ID NO. 14418
gtccgccgccgcttacccctgcgtccccaatccaattccaaatccaatcccccccgctcctcctcctcctcaaaccctagatcgatccacccacccacccacctatcagcccgccatgtccgcgctaggggtgcgcccagggatgctgcgccagaaggagaacaccccggcggacgcgcaggccggcaagcgccagcgcaccgccaccgggcccgcgaggcagccgctctccgcagccgcacagccgccgccgcctgaggacgagcccatggtcttcgcgggcagggaggacgtcgaggcccttctcaacgagaagatgaagggcaagaacaagatggactataagggaaggaacgaacagatgatggaatacatcaagaagttgcgggcctgcataaaatggttgcttgagagagaagatgcaaaccttgttgaaattgggaacattagtgcccggcttgaggctcaaggaaaagaacactccgagacagtggctgagttgaagaattctattgatgaagcaaggtcaataaatgaggagcttcagaaacagtacacttctctacaagagactctggagaaggtcaaggccgagaaactggatgctctacatgctctagatgaggaaaaggatgcaaggacatcagctgaatcaatgaagaataagcttttggaagatttgaaaagaatcaagttggaggaaacccgccttaatgaccagattaagatgcttcaggacacaaacaaaaggcttcaagaatataacacaagtttgcagcaatataatagcaatctccaatcagatgcaacaaaaaattccgaaacaatagcaaagctgcaaaaagagaagaatgcgatggtggagacaatgaatggtctgaaggatcatgctaactcagtaaaaatgcagcttgatttgacaaagtctttgcaaactgaagctgcaaaacaaaaggatgatttattaaaggagcttgaaggtcttagaatggagcttcaacgtgtacgggaggaccgtgacagtaagtatgccgaagtaaattctttgatggctgagataggaacatacaaagaaatgacaggaaaaactgccatagagttagatggtgccatgacaagaactgctgcgcttgaggaaacctgttcatcccagagacagatgatagagacattggaaactaagcttgcatctgccagtgaaaggttaaagatgtccgatttgacggccttggaaaccatgactgagtatgagaatcaaaagaaaatgttgaagagccttcagtcacgcctagaagaagcagagcaacaaattctagatggcgagaaattacgaaaaaagctacacaatacgatccttgagctgaaaggaaatattagagtattctgtagagtaaggcctctgctaccaaatgagtcaggagctgtctcatatccaaagagtggagaaaacattggccgtggtgttgagttgatgcataatgctcaaacatattcatttacttttgataaagtatttgatcattcagcatcacaagaacatgtgtttattgaaatatctcaactggtgcaaagcgctctggatggctataaggtatgcatatttgcgtatggtcaaactggatctggaaaaacatatacaatgatgggtaatccagatttagatgatcagaaaggaatgataccaagatccctggaacaaatatttcaagctagccaggctcttaagtcgcagggttggaaatataatatgcaggcctcgatgttggaaatctacaatgagactataagggacttgcttgctgcaaatcgcatggctgctcaagatggtggttcttcaaagtacacaatcaagcatgatgccaatggtaacactcaagtgtccgacctcacggttgtggacgtaattagtatcagtgaagtttcttctcttcttagaagggctgctcacagcaggtcagttggaagaacacaaatgaatgaggaatcatccagaagtcactgtgttttcacccttcgaatttttggtgtaaacgagggaacagatcaacaggttcaaggagtgctcaatcttatagatttagcaggcagcgagcgtctcaacaaaagtggtgccactggtgatagactgaaagagactcaggctatcaataaaagcttgtcatgcttaagtgatgtgatcttctcaattgcaaagaaagatgaacatgtcccgtttaggaactcaaagttgacgtacctgctgcagccatgccttggaggggattcgaagacgctgatgtttgtaaatctgtctcctgaagtgtcttccactggagagtcaatttgctcgttgcggtttgctgcgagggtgaactcttgcgagatcgggatccctcggcgccaaactcagatgcggagctcgcaatgatgacatgcggtgatggtggtggcggattgccaagatcaatccatctgttgatggaccattggtggtgtatgtttgtgttgtttgagttgatttactgatgcagttgatcatttgcatcctgtgatgggtgttggtgtgagttgttgggttcatttggactgtggtttgttgattgtgctaacggccggcctactgaatcttagaatctgatttgtacaaatttgtgtgatgacttgtggcaaattattttctaattcgttgtagtcttgatttggcgttgtag

SEQ ID NO: 14418 - protein, 763 aa, Panicum virgatum
  misc_feature: Ceres CLONE 1776352
  misc_feature (425)..(749): Pfam Name: Kinesin Pfam Description: Kinesin motor domain
  misc_feature: SWISSPROT Homolog: EC 2.7.11.1 Non-specific serine/threonine protein kinase
MSALGVRPGMLRQKENTPADAQAGKRQRTATGPARQPLSAAAQPPPPEDEPMVFAGREDVEALLNEKMKGKNKMDYKGRNEQMMEYIKKLRACIKWLLEREDANLVEIGNISARLEAQGKEHSETVAELKNSIDEARSINEELQKQYTSLQETLEKVKAEKLDALHALDEEKDARTSAESMKNKLLEDLKRIKLEETRLNDQIKMLQDTNKRLQEYNTSLQQYNSNLQSDATKNSETIAKLQKEKNAMVETMNGLKDHANSVKMQLDLTKSLQTEAAKQKDDLLKELEGLRMELQRVREDRDSKYAEVNSLMAEIGTYKEMTGKTAIELDGAMTRTAALEETCSSQRQMIETLETKLASASERLKMSDLTALETMTEYENQKKMLKSLQSRLEEAEQQILDGEKLRKKLHNTILELKGNIRVFCRVRPLLPNESGAVSYPKSGENIGRGVELMHNAQTYSFTFDKVFDHSASQEHVFIEISQLVQSALDGYKVCIFAYGQTGSGKTYTMMGNPDLDDQKGMIPRSLEQIFQASQALKSQGWKYNMQASMLEIYNETIRDLLAANRMAAQDGGSSKYTIKHDANGNTQVSDLTVVDVISISEVSSLLRRAAHSRSVGRTQMNEESSRSHCVFTLRIFGVNEGTDQQVQGVLNLIDLAGSERLNKSGATGDRLKETQAINKSLSCLSDVIFSIAKKDEHVPFRNSKLTYLLQPCLGGDSKTLMFVNLSPEVSSTGESICSLRFAARVNSCEIGIPRRQTQMRSSQ

SEQ ID NO: 14419 - DNA, 726 bp, Panicum virgatum
  misc_feature: Ceres CLONE 1776359
  misc_feature: Encodes the peptide sequence at SEQ ID NO. 14420
gggcccccagctgacccgccgcgagcgccaatggcggccgccgtgctggcgctgtcctgctgctgcggcgccgcggccgcgacggcagcggcggaggcggaccgcatcgccagcctgccggggcagccgccggtcaacttctccatgtactccggctacgtcaccgtggacgcggccgcggggcgggcgctcttctactggctcatcgacgcggccggcgtgccctcggggtccgcgccgctcctgctctggctcaacggcggccccgggtgctcctccgtcggctacggcgcgtcggaggagctcggcgcattccggatcaacgccgacggcaggacgctctccttgaacgcctacccatggaacaaagtggcgaacatgctgttcttggactcgccggccggcgtcggctactcctactccaacaccacctccgatctgtacaatgccggcgacaacaagacagcccatgactcgtacactttcttggtgaattggctggagcgatttccacagtacaagtatcgtgatttctacatcacaggggagagctacggaggtcattatgtgcctcagttgtctcaggtagtataccggaacaacaaaggagttgaaaagccaatcctaaacttcaaaggcttcatggtcagaaatgcggtaattgacgactaccatgactacattggaacatttgagtactggtggacgcatggggcttatctcaga

SEQ ID NO: 14420 - protein, 231 aa, Panicum virgatum
  misc_feature: Ceres CLONE 1776359
  misc_feature (30)..(230): Pfam Name: Peptidase_S10 Pfam Description: Serine carboxypeptidase
  misc_feature: SWISSPROT Homolog: EC 3.4.16.6 Carboxypeptidase D
MAAAVLALSCCCGAAAATAAAEADRIASLPGQPPVNFSMYSGYVTVDAAAGRALFYWLIDAAGVPSGSAPLLLWLNGGPGCSSVGYGASEELGAFRINADGRTLSLNAYPWNKVANMLFLDSPAGVGYSYSNTTSDLYNAGDNKTAHDSYTFLVNWLERFPQYKYRDFYITGESYGGHYVPQLSQVVYRNNKGVEKPILNFKGFMVRNAVIDDYHDYIGTFEYWWTHGAYL

SEQ ID NO: 14421 - DNA, 664 bp, Panicum virgatum
  misc_feature: Ceres CLONE 1776359-R
  misc_feature: Encodes the peptide sequence at SEQ ID NO. 14422
agggaaaattgatgcatacagcatctatactcctacctgtaagaagacttcagtgcgtaagtgctggctaataagaggaagaacgccctggcttcccagaggatatgatccctgcaccgaaaagtactccacaaagtactacaacttacctgaggtgcagaaagctttacacgccaatgtcactggaataccatatgcctgggtaggctgcagcgacccaatttatgaatattggaaagattcaccgaggtccatgcttcctatttaccgtgaacttattgcagcaggcaaacggatatgggtgttcagcggtgatgctgattctgttgtccccctcactgggacgagatactccatcgatgcgctctctctaccaacagtgacaaactggtatccttggtatgacggcaaagaggttggtggatggtgccaagtgtacaagggtttgacactggtgacgatccaaggtgcggggaacgaggttcccctccaccgcccgcggcaaggcctgaagctcttcgagcacttcctgcgcgatgaagccatgcccaagcctgtacatagcattcagacgttttagaatttgatatctcgcttgatatttttctaatcctatgttttggaaccttagcttattttcttttctcttcctcatgtttttcac

SEQ ID NO: 14422 - protein, 192 aa, Panicum virgatum
  misc_feature: Ceres CLONE 1776359-R
  misc_feature (1)..(179): Pfam Name: Peptidase_S10 Pfam Description: Serine carboxypeptidase
  misc_feature: SWISSPROT Homolog: EC 3.4.16.6 Carboxypeptidase D
GKIDAYSIYTPTCKKTSVRKCWLIRGRTPWLPRGYDPCTEKYSTKYYNLPEVQKALHANVTGIPYAWVGCSDPIYEYWKDSPRSMLPIYRELIAAGKRIWVFSGDADSVVPLTGTRYSIDALSLPTVTNWYPWYDGKEVGGWCQVYKGLTLVTIQGAGNEVPLHRPRQGLKLFEHFLRDEAMPKPVHSIQTF

SEQ ID NO: 14423 - DNA, 1892 bp, Panicum virgatum
  misc_feature: Ceres CLONE 1776361
  misc_feature: Encodes the peptide sequence at SEQ ID NO. 14424
aaggaattccccagcggggcggcgacacgcaccaggtgggaacccgagcgccacaactcgctccctccgctccccgctcccttctccacaagtcgggaggcggcagcgctctctccacaaagcccccgctcccacgcgcgcgccgccctcgccgccggggaggcggtgctcaggcggactccggaccgcgccgccctcttcctccgccacctcgagatttgactttcaagcaccagttatgcaaagggacaccagctctagcgatgcttctgcttctcacacagggcgtgttagacgtcggagacagccaagtgaggctgccacggatgggaatagagctaatggacagccattgcttgtcaatgatcggaacaagtataaatcaatgcttatccgtacatattcaacagtatagatgattggaggctttgccttgattgtttacatgggtcatctatatatctgggccatggttgttgtgattcaaatatacatggcaagagagcttttcaacctactcagaaaatccagtgaagaaaaacaactgccagggttccgactgctgaattggcacttctttttcacggcgatgctgtacacttatgggcgctttcttagtcggcagcttgtgaatacagtaacttcagatcacttactgtataaggtcgtcagcggcctaataaagtaccagatgtttatttgctattttctttatattgcagggtttgtatggtttattttgactctgaagaaaaagacatacaagtaccaattcaaacagtatgcgtggacgcacatgatacttttaacagtttttgcacagtcctcgttcactgtggcaaacatatttgaagggattttctggtttcttctgcctgcttcactcattgtgatcaatgatatctttgcttatttattcgggttctttcttgggagaacaccactaatcaagttgtccccaaagaaaacttgggaaggttttattggtgcatcagtgacaactatcatctctgcatttctgttagcaaatgtaatgggccattcccaatggttgacatgccccagaaaggatctgtcaactggatggctttattgcaatcctggtccaatgtttaagccagagcattactcgttgggagaatgggtaccacactggttcccatggaaagaagttgccattatgccggtgcagtggcatgctttagccctaggtctgtttgcatcaataatagcaccatttggaggtttttttgcgagtggcttcaagagggcttttaagataaaggattttggtgacagcatacctgggcatggggggattactgacagaatggattgtcaaatggttatggcagtgtttgcgtacatataccaccaatcattcattgcgccccagaatttctctgttgagataatcttggatcagattataagaaacctaacctatgaggagcaaaaatacttgtacaagcagcttggcgaaatcttccatgagaggcagatgcaaagctgagttaatgtgcttatgagaagcatgatgtgttgtgtatttaagccttcggctcattctgtagctctagattcgtgtatagcagcattgctctaatgcacaataatatagcgattccttgtttaaaccattgtacagaatggtagaaaggagagaatgaatggcttttaggtgctttattcgctctccactgacgctgccttatgcagtttatcatatatgccgtgctaattatattcccttatcatcttttcttccctcttatattgtgaccagggacctggaaagctgtattcttgcttatcacttagtggtcctgattccggaccaaatgttcgaggatacatagaataagaagggagcagagcaaattcttatttag

SEQ ID NO: 14424 - protein, 365 aa, Panicum virgatum
  misc_feature: Ceres CLONE 1776361
  misc_feature (1)..(323): Pfam Name: CTP_transf_1 Pfam Description: Cytidylyltransferase family
  misc_feature: SWISSPROT Homolog: EC 2.7.7.41 Phosphatidate cytidylyltransferase
MIGGFALIVYMGHLYIWAMVVVIQIYMARELFNLLRKSSEEKQLPGFRLLNWHFFFTAMLYTYGRFLSRQLVNTVTSDHLLYKVVSGLIKYQMFICYFLYIAGFVWFILTLKKKTYKYQFKQYAWTHMILLTVFAQSSFTVANIFEGIFWFLLPASLIVINDIFAYLFGFFLGRTPLIKLSPKKTWEGFIGASVTTIISAFLLANVMGHSQWLTCPRKDLSTGWLYCNPGPMFKPEHYSLGEWVPHWFPWKEVAIMPVQWHALALGLFASIIAPFGGFFASGFKRAFKIKDFGDSIPGHGGITDRMDCQMVMAVFAYIYHQSFIAPQNFSVEIILDQIIRNLTYEEQKYLYKQLGEIFHERQMQS

SEQ ID NO: 14425 - DNA, 1816 bp, Panicum virgatum
  misc_feature: Ceres CLONE 1776394
  misc_feature: Encodes the peptide sequence at SEQ ID NO. 14426
agaagggccagaacagtcgatagatctgtctaggccgccgcccatgtagcaaatcgagtacaagtgtgctgatcgaatcccctccaagctcgcatcaattttgcacctttcgcctcaaaatcatggcaagagcaccaagaatcttgcacctgctcctcgctctgtgctcactttccagcagcagcgtcgccgtcgccgtcgcctcagcttccggcgccgccgatgcgttcgtcggctgcctcaccgccgccggcgtcccgccgggcctcctccagaccccggcgtccccgtcctacgacgcgctcctgcgctcctccgtccgcaacctccgctacgtcgcgccgggcaccccgtggccgctcgccatcgtggccgccaccgagcccgcccacgcgcaggccgccgtgcgctgcggccgccgccacggcgtccgcgtccgcacccgcagcggcgggcacgactacgagggcctctcctacgcgtccctcgacccgcgcgagagcttcgccgtgctcgaccttgccgcgttccgggaggtccgcgtcgacgccgcgcgcgccgaggcctgggccgggtcgggagccacgctcggcgaggtctactacgccgtcggcgccgctagccgcgcgctcgcgttccccgcgggggtctgccccaccgtcggcgtcggcgggcacctcggcggcggcgggttcggcacgctgatgcgccggtacggcctcgcggccgacaacgtcctcgacgccgtcctcgtggacgccgacgggaggctcctcaatcggaccaccatgggggaggacctcttctgggccatccgcggtggcggcggcgagagcttcggcgtcgtgctgtcttggaagctccgcctcgtgcccgtgccggagacggtcaccgtgttcaccgtccgccggtcaagaaaccagtccgcgtccgagctcatcaccaaatggcaggaaatcgcgccggcgctgccgcgggacctcatcctccgcgtcgtggtgcagggccggcacgcgcagttcgaagccctgttcctcggccgctgcagccgcgtcctcgagcacatgcgagctcacttccccgagctcggcgtggcgcgagcggactgcgaggagatcagctggatccaatccaccgtctacttcgccttctactccagctccaagccgccggagctcctcctcgacaggatcggggagacaggccggtacgtcaaggccaagtccgactacgtgcaagaacccatcccacggcacgcgtgggagagcacatggtcgtggctggagaagcccgaggccgggctgctcatcctggacccctacggcggccggatggccagcatctcgccgtcggcgacgccgttcccgcaccggaaggggaacctctacaacctccagtactactccttttggttcgagaacggcacggcggcgatggagaagcggatgaactgggtccgaggactgtacagggagatggagccgtacgtgtccaagaatccaagaactgggtatgtgaactacagggacctggatctcgggacgaatgagctggagggcaacgtgactagctacgcgaaggcgaggatttggggggagaagtatttcagaggtaattttgagaggttggcagctgtgaaggccatggtggatcctgatgatttcttcaggaatgagcagagcatccctcctctgccggctgccaagggatggagctccatttgattggaggtcctcgcttttggaatgtatacagttctttttgtggtgaatacgggatttccttttgaaaaaaaaataaaagggattttcttttc

SEQ ID NO: 14426 - protein, 533 aa, Panicum virgatum
  misc_feature: Ceres CLONE 1776394
  misc_feature (463)..(522): Pfam Name: BBE Pfam Description: Berberine and berberine like
  misc_feature (79)..(221): Pfam Name: FAD_binding_4 Pfam Description: FAD binding domain
  misc_feature: SWISSPROT Homolog: EC 1.21.3.3 Reticuline oxidase
MARAPRILHLLLALCSLSSSSVAVAVASASGAADAFVGCLTAAGVPPGLLQTPASPSYDALLRSSVRNLRYVAPGTPWPLAIVAATEPAHAQAAVRCGRRHGVRVRTRSGGHDYEGLSYASLDPRESFAVLDLAAFREVRVDAARAEAWAGSGATLGEVYYAVGAASRALAFPAGVCPTVGVGGHLGGGGFGTLMRRYGLAADNVLDAVLVDADGRLLNRTTMGEDLFWAIRGGGGESFGVVLSWKLRLVPVPETVTVFTVRRSRNQSASELITKWQEIAPALPRDLILRVVVQGRHAQFEALFLGRCSRVLEHMRAHFPELGVARADCEEISWIQSTVYFAFYSSSKPPELLLDRIGETGRYVKAKSDYVQEPIPRHAWESTWSWLEKPEAGLLILDPYGGRMASISPSATPFPHRKGNLYNLQYYSFWFENGTAAMEKRMNWVRGLYREMEPYVSKNPRTGYVNYRDLDLGTNELEGNVTSYAKARIWGEKYFRGNFERLAAVKAMVDPDDFFRNEQSIPPLPAAKGWSSI

SEQ ID NO: 14427 - DNA, 1451 bp, Panicum virgatum
  misc_feature: Ceres CLONE 1776397
  misc_feature: Encodes the peptide sequence at SEQ ID NO. 14428
aagacgagctcggccgccggcgtgaacgcgaggtgactgcaccgctgcacggctctttcctctcgctcccagccgccatggcgaatttatttatggctcacggctgctagctcgccaagacgccaacaaaccccgtcttccacggcgctagctgctctagcctgacgatggcgctgctgaggggatgcctctgcagatccgaggaagacttcagagggcttctcaacttggagaatctccggttattctcgtacaaggagatcagagcagcaacgaacaacttcgaccggagtaacaagctaggacgaggtggctttggaactgtgtacaagggagtatggggagatggcaccgcatttgctgcaaaggttttgtgttctgaatccgagcaggggatcaaggaattcctagctgaaatcgagagcatttctgaagccaagcacgcgaacctcgtcaggctgctgggctgctgcatccagaggaaaaacaggatcctcgtctacgaatacctcgagaacaacagccttgatcatgcgttgcagttgcagggttcagcgaacggagcgacgaggctgacctggagcacgagggcggacatctgcgtgggcactgccaaggggctgagctatctgcacgaggagcacgagccgaacatcgtgcacagagacatcaaggccagcaacgttcttctcgacagagactacaggccgaaaatcggagattttgggctggcaaagttgtttccggacaatgttactcacatcagcacgggcgtggtcggaacgtgtgggtatttggcgcctgagtattttgtgcatgggcagctgaccaagaaggccgacgtctacagcttcggcgtgcttgttcttgagatcatcagcgggaggaggatctcgcagactatccactcagacatgttcctggtacgagaggcatgggtgctgtaccagcagggcagcctgctggacatggtggacgcgcgcatggaggactaccaggaggaggaggtgctgcggtacctcagggtggggctggcctgcacgcaggcggcgcccagcagccgccccacgatgggccaggtggtggccctcctgtcgcggcccgtgtgctctgcctcgttcacgtgcagcgaggtcgctccgcggtaagcagcttggtggcggtcgaagcaggtccaagttgaacgcccgaggtcggcctcggcaatgtacctgtacatagcagttgcacgtacgggaggcggcgtttgtgcttgcctcgaccctcgatgtagattacaggcgcggtgcgctcagggtagccgtcataccaggggccaggggaattgtgatccaactcgagaaatcgggtggagaatattgcaaaagtataacattcatccctcgatgtagattacaaactggagtgatgcggcgagataaatcaaaagaaaaagtgtatttttcatccct

SEQ ID NO: 14428 - protein, 326 aa, Panicum virgatum
  misc_feature: Ceres CLONE 1776397
  misc_feature (39)..(309): Pfam Name: Pkinase Pfam Description: Protein kinase domain
  misc_feature: SWISSPROT Homolog: EC 2.7.11.1 Non-specific serine/threonine protein kinase
MALLRGCLCRSEEDFRGLLNLENLRLFSYKEIRAATNNFDRSNKLGRGGFGTVYKGVWGDGTAFAAKVLCSESEQGIKEFLAEIESISEAKHANLVRLLGCCIQRKNRILVYEYLENNSLDHALQLQGSANGATRLTWSTRADICVGTAKGLSYLHEEHEPNIVHRDIKASNVLLDRDYRPKIGDFGLAKLFPDNVTHISTGVVGTCGYLAPEYFVHGQLTKKADVYSFGVLVLEIISGRRISQTIHSDMFLVREAWVLYQQGSLLDMVDARMEDYQEEEVLRYLRVGLACTQAAPSSRPTMGQVVALLSRPVCSASFTCSEVAPR

SEQ ID NO: 14429 - DNA, 1657 bp, Panicum virgatum
  misc_feature: Ceres CLONE 1776434
  misc_feature: Encodes the peptide sequence at SEQ ID NO. 14430
gtttggtgagtccgtctctgtttattggttacttctttaaaaatattattattaactggatccactgctcatatttcactgttcttcccaagcagatttatgtttgaaaccatattttcgtgagattcctttttgtcttattgtttttatctgttagcatgactcatcaatatgtatatcctaccatcataaaggtgcacaaagcttccaacgggacgaagctcttgaggagatactgttacaaaacatggctcctctgaccccaagactggtaattcccatagatgtgaagaagcagccatgggagcaaaaggtccctctccataaccgctggcatccagatatccctcctgttgctgatgtaactgaaggggaattgtttcgcgtcgagatggttgattggactggagggcgggttagggatgataactctgcagatgatatcaaattccttgatctcacaattactcattatcttagtgggcccctaagaatagttgattctgaagggcttccagcttcacctggtgatcttcttgcagtagagatctgcaaccttggtccacttcctggcgatgagtggggttatactgcaatatttgaaagggaaaatggaggtggattcttaactgaccactttcctagtgcaagaaaggccatttggtattttgaaggaatttatgcatattcccctcagataccaggtgttcgttttccaggattaactcatcctggtatagtaggaactgcaccatcaattgaacttcttaatatatggaatgaaagggagaaaaagttggctgagacaagtccagagactcttaaagtgtgtgaagtcctacaccagagaccccttgctaatttgccgacccctgagaactgcttacttggaaagattcagaaagagatggctgaatggcacaaaatggcaaatgaagcagccagaactattcctggaagggagaatggtgggaattgtgacataaagaatctaagcagaggtttcaaagtttatctaccagtatttgttgaaggagcaaatcttagtactggtgatatgcacttctcccagggtgatggtgaagtttcattttgtggcgcaattgaaatgagtggattccttgagctcaagtgtgagatcataagaggtgggatgaaagaatacttgaccccagttggtccaacgccactacatgtgaatcctatctttgagataggtcctgtggagccacatttctcagagtggttagtatttgagggcatcagtgtggatgagtatgggaagcagcatttccttgatgcatcagttgcctacaaacgtgcagttctgaatgccatcgagtacctttccaaatttgggtactccaaggagcaggcatatcttttactttcgtgctgcccttgcgagggtaggatatctggaatagtagattctcctaacgcagtgacaactcttgccatccctacagcaatatttgaccaggatataaaaccaaaacgcttgagcgggagaccacttsgaggaccaaaattgagaaggcttcgggattttttgagctgctcaaacagtgaacaccttcctgtcacccaaggccaaagtggcactagagagccctagtgatgaatcggatttagaaactgaagcaatccatttact

SEQ ID NO: 14430 - protein, 456 aa, Panicum virgatum
  misc_feature: Ceres CLONE 1776434
  misc_feature (8)..(413): Pfam Name: FmdA_AmdA Pfam Description: Acetamidase/Formamidase family
  misc_feature: SWISSPROT Homolog: EC 3.5.1.49 Formamidase
  misc_feature (425)..(425): Xaa is any aa, unknown, or other
MAPLTPRLVIPIDVKKQPWEQKVPLHNRWHPDIPPVADVTEGELFRVEMVDWTGGRVRDDNSADDIKFLDLTITHYLSGPLRIVDSEGLPASPGDLLAVEICNLGPLPGDEWGYTAIFERENGGGFLTDHFPSARKAIWYFEGIYAYSPQIPGVRFPGLTHPGIVGTAPSIELLNIWNEREKKLAETSPETLKVCEVLHQRPLANLPTPENCLLGKIQKEMAEWHKMANEAARTIPGRENGGNCDIKNLSRGFKVYLPVFVEGANLSTGDMHFSQGDGEVSFCGAIEMSGFLELKCEIIRGGMKEYLTPVGPTPLHVNPIFEIGPVEPHFSEWLVFEGISVDEYGKQHFLDASVAYKRAVLNAIEYLSKFGYSKEQAYLLLSCCPCEGRISGIVDSPNAVTTLAIPTAIFDQDIKPKRLSGRPLXGPKLRRLRDFLSCSNSEHLPVTQGQSGTREP

SEQ ID NO: 14431 - DNA, 524 bp, Panicum virgatum
  misc_feature: Ceres CLONE 1776436
  misc_feature: Encodes the peptide sequence at SEQ ID NO. 14432
aacacgcctcgtacagttcatcaagtaaagccacatcagatcacacacaatctagctgcagaaatggcgtcgacggtggcgagcctctctaccccggcggcggcctttgcggccacagacgtagtcccgaggaggaagatcgccggccgcgtctggttccccgtggcgcgccgcgtcggcttcgcggtgaggtcgagcgggccggggacgccgccggggatctcggacaaggtgtcagagagcatcaagaaggcggaggagacgtgcgcggacgagaaggtctccggagagtgcgcggcggcgtgggacgaggtggaggagctcagcgccgcggcgagccacgcccgggacaagctcaaggagaacagcgacccgttggaaaactactgcaaggagaaccccgagaccgacgagtgccgcatctacgacaactagaccatgcctgtatccagtggcggagccaggggggctggcaggggccatgccccccccccccacccccccggagatgagaacgggtgagg

SEQ ID NO: 14432 - protein, 123 aa, Panicum virgatum; identical to SEQ ID NO: 14336
  misc_feature: Ceres CLONE 1776436
  misc_feature (53)..(123): Pfam Name: CP12 Pfam Description: CP12 domain
  misc_feature: SWISSPROT Homolog: EC 1.2.1.13 Glyceraldehyde-3-phosphate dehydrogenase (NADP(+)) (phosphorylating)

SEQ ID NO: 14433 - DNA, 573 bp, Panicum virgatum
  misc_feature: Ceres CLONE 1776436-R
cgccagtccgacggagtgtggacaagaagccagcgacaccttgtcgtgattcagctggggatggaaggaaaggcaacggctgaagattcaagattactctgaacaaggccatcggcaaggacaaagaaatgcctattagatgccaattcttagttacatttctaaatttgtttttttttcatgtatcagtttcctctctatatacatatggaatctagtaaggagtagtgaaggttccagagattcccaaacacttcatagtgtcagagcgaggctgggcgacggtgatgccggccgttgcggcaagctcgccgtggtgagagcaggtggtgctgcacgtgaggtggtgtgtccttgagcattggaagggtgcagccggaggagcatactgcggcagagctggttggagttggcgaggtgagattccaaatcgagttttggttgggtgctatcgtgctctatcagatgggatttcgtgagaaatcagcaaggatttgaagctgcttggtgctatcgtgctccttcagttggaaggattttgtgaggaatcgatatttatctcctctgttggag

SEQ ID NO: 14434 - DNA, 654 bp, Panicum virgatum
  misc_feature: Ceres CLONE 1776446-R
  misc_feature: Encodes the peptide sequence at SEQ ID NO. 14435
gacgagcaccgcctcgccgtggccaagtccctgggcgcggacgcggcggtgcgggtgtcggcgaggcccgaggacaccgccgaggaggtggcgcggatccaggcggcgctgggcggcgcggagatcgacgtgagcctggactgcgccgggttcagcaagacgctggcgacggcgctggaggcgacgctgcccggggggcgggtgtgcctggtggggatggggcacaacgagatgacggtgccgctgacgtcggcggcgatccgggaggtggacgtggtgggcatcttccggtacaaggacacgtggccgctgtgcatcgagttcctgcgctccggcaaggtggacgtgaagccgctcatcacccaccgcttcggcttctcgcagcgggaggtggaggaggccttcgaggtcagcgcgcgcggccgcgacgccatcaaggtcatgttcaacctctaggccggacgactgggtgggtaggcggccgccggtcgcgctccggggatcgatcgatgaataaaataaggtagtggaagtggccggcgccgtccgtcggtcggcgatcctccggcgaagggcgcagaaaaccttgatcggcggcgagatgccatggcgttgttttggattggaataaccgtggctttaatttgttgcttc

SEQ ID NO: 14435 - protein, 151 aa, Panicum virgatum
  misc_feature: Ceres CLONE 1776446-R
  misc_feature (1)..(111): Pfam Name: ADH_zinc_N Pfam Description: Zinc-binding dehydrogenase
  misc_feature: SWISSPROT Homolog: EC 1.1.1.14 L-iditol 2-dehydrogenase
DEHRLAVAKSLGADAAVRVSARPEDTAEEVARIQAALGGAEIDVSLDCAGFSKTLATALEATLPGGRVCLVGMGHNEMTVPLTSAAIREVDVVGIFRYKDTWPLCIEFLRSGKVDVKPLITHRFGFSQREVEEAFEVSARGRDAIKVMFNL

SEQ ID NO: 14436 - DNA, 159 bp, Panicum virgatum
  misc_feature: Ceres CLONE 1776446
catgggtttaggaaagggaattgcaattgctaccatgcagctggtattgatatggagcataacatccaccgtcatgtcgaccccatctgcccctcctcccccctctgctctcatcgtctctttccgaagtacaacatcccttttcgctactgctccatg

SEQ ID NO: 14437 - DNA, 1634 bp, Panicum virgatum
  misc_feature: Ceres CLONE 1776452
  misc_feature: Encodes the peptide sequence at SEQ ID NO. 14438
acccaaacaagcgaagcccatcctcccatccccaagcggaattaaacctcacctaacccctcccatggccgatcaccccctcgccggcgagcaccacccctcgccggcgagctcggccgcgacggccctgggcccgctgctgcttctcccgtcggagctcctgcacgagatcctcctccgcctggccgtcccggagctcctccgcgtgcgctccgtggcgcgcccgctctccagcctcatctcctccccggacttccgccgcctctaccacctctcctcggcgtcgtcggggcccggcccggccgccgcgtggctgctcctcttcaagaagctcccgccccgcgacgccgccatccggggcttccacgggccctcgggccgctggttccgcatcccggtctcggccatcctcgcccccgccgtgccgcccggcgaggacctctacttcctcgccgcctccggcagctccttcctgttcgccgccaacggccgccgcgagctcgtggtcgtcgacctcaccgcgcgcgccgcgcgccggctcccgccgtccccgctcgggccacgcggcacctcctcctggcgccgcttcggcctcaagctcgtcgccgatccccccggatcgaaccggtttaggtttctgtttgctgagctggtgaacaacacgccattcctgttcgagtaccggtcggagacggacacgtggcagcagtcggagtcggtcctggcggaggggaactcgccggcgtcccccgacggcacgtacctctgcgcggcgcacgccgggccggactgcgtcatggtgtactccggcccgggcgcggacgaacgcccggtcttcttccgcccccggttccctcacgccgccgccggcgccgcggcggggcacggggaccggctgcacgtgtacggctacgggagcgcggccgtggtgcggtcggcggcggtcgacgacccgacgagccgggcccgggtgaaggtggtgacgggcgtggagctgtacgggttcggggccgtgggcggcgactgggagctggtggccagcgtgccgggcgagctggtggaggggttccggaagccgtacgccgtgatgacggggctgctggcggagcgggagggcgtggtccggctggtgctcatctccaactgccgcggcgcgtgggacctggtgtggctgtcgtacgaccgcgcgcgcggcggggagtggcggtgggtgcccgtgccggactggggcggcagcaaggggctcaacatggccggcatcgccgtctcctccaccttctcccgcctctggccgctggccgcgccgccggcgtccagcagctgcggcggccgccagtgatccagctgatcggatcggcgcgggcccgggagtccgtccgcgcgcgctgtacatacaggtgtgtgcaaaagccagagggagcgtgggcgagtgctgggggtccaaggcggccgtgtccccctagtcccccacgccacgcttcgtttccatggtggggccgtggcgcggcatgatcgcccatgatagctacgccgatgtggactagtcacttggtgagagcgaacgaaacgtttcagataagggatggccagtggtgtgtgcgtgcttctactctcttgtatagtgcaattgctgc

SEQ ID NO: 14438 - protein, 424 aa, Panicum virgatum
  misc_feature: Ceres CLONE 1776452
  misc_feature (23)..(70): Pfam Name: F-box Pfam Description: F-box domain
MADHPLAGEHHPSPASSAATALGPLLLLPSELLHEILLRLAVPELLRVRSVARPLSSLISSPDFRRLYHLSSASSGPGPAAAWLLLFKKLPPRDAAIRGFHGPSGRWFRIPVSAILAPAVPPGEDLYFLAASGSSFLFAANGRRELVVVDLTARAARRLPPSPLGPRGTSSWRRFGLKLVADPPGSNRFRFLFAELVNNTPFLFEYRSETDTWQQSESVLAEGNSPASPDGTYLCAAHAGPDCVMVYSGPGADERPVFFRPRFPHAAAGAAAGHGDRLHVYGYGSAAVVRSAAVDDPTSRARVKVVTGVELYGFGAVGGDWELVASVPGELVEGFRKPYAVMTGLLAEREGVVRLVLISNCRGAWDLVWLSYDRARGGEWRWVPVPDWGGSKGLNMAGIAVSSTFSRLWPLAAPPASSSCGGRQ

SEQ ID NO: 14439 - DNA, 727 bp, Panicum virgatum
  misc_feature: Ceres CLONE 1776460
  misc_feature: Encodes the peptide sequence at SEQ ID NO. 14440
aagcaaaactgcaaagtaaaaagattcgacaagctaagccacccccataatggacatggagctaagtccagcaacgctcctcttcgtcttcctcctttccctgccaattcttgtgaccttgctgcgccgcaaatcaactccgacctccaacaagaggcggcctccaggcccgtggaacttccccttgattggaagcctctaccacttcatcaagtcgcatccgccggtcgtcctccgggagctggccaagaagtatggccctgtgatgttcctccggatgggccagatcgacactgtcgtgatatcctcgccggcggcggcgcaggaggttctccgcgagaaggatgtcatcttcgcttcgaggccgagcatcgtggcttcggaggtcttcacctacggaaacctcgatgtcggcttctcgccatatggcgcctattggcggacgctgcgcaagctctgcacggtggagctcctcagtgcaaagatggtgcggcagttcgcacccatcagggataacgagacgttgtccctcatcagaaatatccaagctgctggccgaggtggtgaaccggtgaccaatctcgcgagtctgctgctagcctgctcgaactcgatcacggcaaaggcggccttcggccaggtttgcagcaaggagctccgggacaagttcttgaggtcaattgctgtcgcaatgagcttcagcggaggcttcaccgtcggggatgtc

SEQ ID NO: 14440 - protein, 225 aa, Panicum virgatum
  misc_feature: Ceres CLONE 1776460
  misc_feature: SWISSPROT Homolog: EC 1.14.13.68 4-hydroxyphenylacetaldehyde oxime monooxygenase
MDMELSPATLLFVFLLSLPILVTLLRRKSTPTSNKRRPPGPWNFPLIGSLYHFIKSHPPVVLRELAKKYGPVMFLRMGQIDTVVISSPAAAQEVLREKDVIFASRPSIVASEVFTYGNLDVGFSPYGAYWRTLRKLCTVELLSAKMVRQFAPIRDNETLSLIRNIQAAGRGGEPVTNLASLLLACSNSITAKAAFGQVCSKELRDKFLRSIAVAMSFSGGFTVGD

SEQ ID NO: 14441 - DNA, 665 bp, Panicum virgatum
  misc_feature: Ceres CLONE 1776460-R
  misc_feature: Encodes the peptide sequence at SEQ ID NO. 14442
accccagtggtgccattgctggttccccatttctgtcaggagacttgcgaggtaggtgggttccaagtcacgaagggcactagggtcatggtcaacgcgtgggctatggcaaggagccctaagtattggcatgacgcagagaagtttaggccggagaggtttgaggatggcatgcttgacttcaaaggctctcgctttgagtacttgccatttggggcagggaggagaaggtgccctggtgatactttcgggttggctgtgttagagctcattgttgcacgccttctctactacatcgactggagcctcccagcaggaatgcagcccgatgacattgacatggaaatgatcgttgctgcaacaactaggagaaagaacccgctgcagctgttggtatcaccatataaggtggttcccatgcaaggctgattcatgagataattagtatatgcatgctggccaacatctacagttgtgcctccggacctcataaggtccctgtcttgtttgtataatgggaatagacgaacaaatataaaaactatatatgtactgtggtcaacagcgtgagtactactccgctgaaggtacatgctagtaggacattataggaagtccaacataatatcacacgtcgatcatattgtactgaaaataatttctcc

SEQ ID NO: 14442 - protein, 142 aa, Panicum virgatum
  misc_feature: Ceres CLONE 1776460-R
  misc_feature: SWISSPROT Homolog: EC 1.14.13.68 4-hydroxyphenylacetaldehyde oxime monooxygenase
TPVVPLLVPHFCQETCEVGGFQVTKGTRVMVNAWAMARSPKYWHDAEKFRPERFEDGMLDFKGSRFEYLPFGAGRRRCPGDTFGLAVLELIVARLLYYIDWSLPAGMQPDDIDMEMIVAATTRRKNPLQLLVSPYKVVPMQG

SEQ ID NO: 14443 - DNA, 1428 bp, Panicum virgatum
  misc_feature: Ceres CLONE 1776468
  misc_feature: Encodes the peptide sequence at SEQ ID NO. 14444
ttccgcactcccccacccgtccctcccgcgccgccaccccccccacaggtaaggaggaggaggcgaggatgtcgcaccgcaagttcgagcacccgaggcacggttccctcggcttcctccccaggaagcgcgcctcccgccaccggggcaaggtgaagtccttccccagggatgaccccaagaagccatgccacctcaccgccttccttggctacaaggctggcatgacacacattgtccgtgaggtcgagaagcctggatccaaactccacaagaaggaaacctgcgaagctgttaccatcattgaaactcctcctgttgtcattgttggtcttgtggcatatgtgaagactcctcgtggcctccgcaccctcaactctgtctgggcacagcacttgagtgaggaagtgaggaggaggttctacaagaactggtgcaagagcaagaagaaggctttcactaagtatgctctaaagtatgacagtgatgcaggcaagaaggaaattcagctgcagcttgagaagatgaagaagtatgcttctgttatccgcgtgattgcccacacccagattaggaagatgaagggtttgaagcagaagaaggctcacctcatggagatccaggtcaatggtggtaccattgccgacaaggtggactatggctacaagttctttgagaaggaggttccggttgatgctgtgttccagaaggatgagatgattaacatcattggtgtgaccaagggtaagggttatgagggtgtggtcactcgttggggtgtcacccgccttccccgcaagacccacaggggtctccgcaaggttgcctgtattggtgcctggcatccggctagggtttcctacactgttgcccgtgctggtcagaatggttaccaccaccgtactgagatgaacaagaaggtttacaagattgggaaggctggacaggagagccatgatgcctccacagagtttgacaggacggataaagacatcactcccatgggtggcttccctcactatggtatcgtgaagggcgactacctgatgatcaagggttgctgcgtcggccccaagaagagagtggtgaccctccgccagtccctgttgaagcagacgtcgcggctggccctggaggagatcaagctcaagttcatcgacacatcttccaagtttgggcacggtcgcttccagaccaccgacgagaagcagaagttctacggcaaggtcaaggcctaagcttctgcagctggtggtgctcgttctgcccctgcgaacatccttaattgtactaagttctgtagcagaagatgtttttgagaacctgttccaagtttatctgtggatttgtgtcctgtgctgtagtcccttgttggcgtgattttggcatatctgcaatgcatttgccattcggagtgttttggagatc

SEQ ID NO: 14444 - protein, 389 aa, Panicum virgatum
  misc_feature: Ceres CLONE 1776468
  misc_feature (50)..(343): Pfam Name: Ribosomal_L3 Pfam Description: Ribosomal protein L3
MSHRKFEHPRHGSLGFLPRKRASRHRGKVKSFPRDDPKKPCHLTAFLGYKAGMTHIVREVEKPGSKLHKKETCEAVTIIETPPVVIVGLVAYVKTPRGLRTLNSVWAQHLSEEVRRRFYKNWCKSKKKAFTKYALKYDSDAGKKEIQLQLEKMKKYASVIRVIAHTQIRKMKGLKQKKAHLMEIQVNGGTIADKVDYGYKFFEKEVPVDAVFQKDEMINIIGVTKGKGYEGVVTRWGVTRLPRKTHRGLRKVACIGAWHPARVSYTVARAGQNGYHHRTEMNKKVYKIGKAGQESHDASTEFDRTDKDITPMGGFPHYGIVKGDYLMIKGCCVGPKKRVVTLRQSLLKQTSRLALEEIKLKFIDTSSKFGHGRFQTTDEKQKFYGKVKA

SEQ ID NO: 14445 - DNA, 1537 bp, Panicum virgatum
  misc_feature: Ceres CLONE 1776469
  misc_feature: Encodes the peptide sequence at SEQ ID NO. 14446
gtgcacactcctgccctctagcttagcttgtaccactgccagcagcagccatggcggcgagcggcaagaagctcccgccgttcctcttcacgctgctgctgctgctctccaccgccgtgacgcccatcctctcgctcccggacgccgaccacgaggtcgactgcgactgcgacaagcccaaggcgcccaagccgtcgcacccgcccaagaccaagccctcctacccgtcgcccaagcccaagaaccccaagccgcccaaaggcccctcctacccgtcgccggcgacgcgcccgcccaagggccgcccctccaacccgccggtcactcgtcctcgtcctccggtcgtcggcccgcccaaaggccccgtcacgcgcccgccggtcgtcgggccaccggtcacgcgcccgccggtcacacgtccgccggtgacctacccgccgatcaccggccctccgacgacgccgccgatcaccggcccaccggtcacggtacccccgatcaccggcccaccaggcaccgtccccccgatcaccggcccaccggtcaccgtccctccgatcaccggcccgccctcgacgacgcctccggtcgtcggcccgcccaaaggccccgtcacgcgcccgccggtcgtcgggccaccggtcacgcgcccgccggtcacacgtccgccggtgacctacccgccgatcaccggccctccgacgacgccgccgatcaccggcccaccggtcacggtacccccgatcaccggcccaccggtcaccgtccctccgatcaccggcccgccctcgacgacgcctccggtcaccggcccgccggtgaccaaccctcccggcggcggcagctcgacgccgtgcccgccgcctcctcccgcgaccccgacgccgtcgtcgccgacgtgcccggcggactcgctgaagctgggcgcgtgcgtggacctgctgggcgggctggtgcacgtcgggctgggcgaccccgtggtgaacaagtgctgcccgctgctggagggcctggtggagctggaggcggccgtgtgcctctgcaccaccatcaagctcaagctcctcaacatcaacatctacctgcccctggcgctccagctgctcctcacctgcggcaagacgccgccgcccggctacacctgcaccgtctgatgatggatcaactagcagtaacccgtgcacacatataatgcagggtttttggagtgagtttcttcagtagtttgaggagaaattaatcgacatgagaggatgtcgtcgtctgcttcttccaagctagctaggctccagaagagaggagcacgtcgatctgccgacggatcatgatcgctctagctacctgtgtttggttgtttttctgttgttgtttgatcgttcttaaccggcctgcctgttgagttgtttcagttaatttcgctggtctcggcacaacttgattgtttgtgtgtgtcgtgtggttcagttcgatgcaaagagggttgatggctgatttctgctaccactattaggtcacgatgaagagcttgcatgtcccg

SEQ ID NO: 14446 - protein, 367 aa, Panicum virgatum
  misc_feature: Ceres CLONE 1776469
  misc_feature (284)..(365): Pfam Name: Tryp_alpha_amyl Pfam Description: Protease inhibitor/seed storage/LTP family
MAASGKKLPPFLFTLLLLLSTAVTPILSLPDADHEVDCDCDKPKAPKPSHPPKTKPSYPSPKPKNPKPPKGPSYPSPATRPPKGRPSNPPVTRPRPPVVGPPKGPVTRPPVVGPPVTRPPVTRPPVTYPPITGPPTTPPITGPPVTVPPITGPPGTVPPITGPPVTVPPITGPPSTTPPVVGPPKGPVTRPPVVGPPVTRPPVTRPPVTYPPITGPPTTPPITGPPVTVPPITGPPVTVPPITGPPSTTPPVTGPPVTNPPGGGSSTPCPPPPPATPTPSSPTCPADSLKLGACVDLLGGLVHVGLGDPVVNKCCPLLEGLVELEAAVCLCTTIKLKLLNINIYLPLALQLLLTCGKTPPPGYTCTV

SEQ ID NO: 14447 - DNA, 1403 bp, Panicum virgatum
  misc_feature: Ceres CLONE 1776475
  misc_feature: Encodes the peptide sequence at SEQ ID NO. 14448
ataaaagccgcccgcctccacccctcccctgcactccatcgcctcgccgccgttccccgcaaccgctcgccctaatcgcgccccggccctgctcgccgtcgccccctccagatctccgccccgccgccgaggtagcaggctgcagtctgacaaagtggagggcttaggtgttgctgcttcttttatgtctgaacaatctttgctttatttgggattgttgggagagtattctcgtgcaacgagaaaaaggcacaagcttccattccactgcatgcatcaagagcccatctggtcatcttgttctgaggtgtcttttgctggtgctcagagtcagcctggttttctccaaggatcagcagttactctcggttcaggattcttccacatctgatagcatctgcttcagaaatctttatccaagatggcgctgcaaaacattggtgcttcaaacagggatgatgccttctacaggtacaagatgccccggatgattaccaaaatagaagggcgtggtaatggcatcaagacaaatattgtgaacatggttgatattgcaaaagcacttgccaggccagcttcctacacaaccaaatactttgggtgtgagcttggcgcacagtctaagtttgatgagaagacaggaatttccttggttaatggggctcatgacacttcaaagctggctggtctccttgaggtgttcatcaagaagtatgtccagtgttatgggtgtggcaaccctgagactgagattctcatttccaagacccagatgatatcactgaaatgtgctgcctgtggcttcgtctcagatgttgacatgagggacaagctcacaacctttatcctgaagaacccacctgaacagaagaagggaggaaaagataagaaggcgatgaggagagctgagaaggagcgtctgaaggaaggtgaggctgctgatgaggagcagaagaaactgaagaaggatgcaaagaagaaaggtgcatcttccaaggaatcaacagctaaggtttcaaagaagaaggctgctgctgcagctgttgctgctggctccgatgaagatcattcaacgtctccaactcgcagtcgtgatggtgacaatgcagctgcagacgaggatgatgatgatgatgatgtcaagtggcagaccgacacttctttggaggctgcaaaacaacgcatgcaggagcaactgagtgcggcaactgctgagatggtgatgctgtccactgatgagactgagaagaagacgaagcaggccacccctaaagaagccactgctaatggttctgcgaaagcccaagagagctctgagccaaccgtcactaagcccagtccctacaatgaactggttggagacatcaaggctagcttggggaagtgctgcaacaccccctcag

SEQ ID NO: 14448 - protein, 327 aa, Panicum virgatum
  misc_feature: Ceres CLONE 1776475
  misc_feature (1)..(131): Pfam Name: eIF-5_eIF-2B Pfam Description: Domain found in IF2B/IF5
MALQNIGASNRDDAFYRYKMPRMITKIEGRGNGIKTNIVNMVDIAKALARPASYTTKYFGCELGAQSKFDEKTGISLVNGAHDTSKLAGLLEVFIKKYVQCYGCGNPETEILISKTQMISLKCAACGFVSDVDMRDKLTTFILKNPPEQKKGGKDKKAMRRAEKERLKEGEAADEEQKKLKKDAKKKGASSKESTAKVSKKKAAAAAVAAGSDEDHSTSPTRSRDGDNAAADEDDDDDDVKWQTDTSLEAAKQRMQEQLSAATAEMVMLSTDETEKKTKQATPKEATANGSAKAQESSEPTVTKPSPYNELVGDIKASLGKCCNTPS

SEQ ID NO: 14449 - DNA, 650 bp, Panicum virgatum
  misc_feature: Ceres CLONE 1776475-R
  misc_feature: Encodes the peptide sequence at SEQ ID NO. 14450
ctccctcccccaggatgtgatgaatgctctccttgaggctctctttgatggagtgggcaagggatttgcaaaggaggtggtgaagaacaagaagtaccttgccgcagctgtgcctgatgagggtgcccagactgtcctggtccaggccattgagtcttttggtggcaagtgcagccccgaggcacttaaggaggtcccggtcgttctgaaagccctgtacgatggagatgtgctggaggaggaaaccatcgtggagtggtacaatgccgccgtggctgctggcaagaactcccaggtcgtgaagaatgccaagccgtttgtggagtggctccagagcgctgagtctgaagaagaggatgatgagtgaggcctgtggatgcggcactgctttgatctcacagcactccgttactactatttatctgtgtcttgcttgtgtcgtggttgtcttatctcgtgtgttattgttggtgtcatatgtgatggtgtcagtcttttgcgtccagtctgaacaattggtgtttgtatgaactgcgttatgcgagtgtgtaagcagcgtactttctgtggttagttgcttgtggtgtcgtgtgcccgttttctgctacattcagagtgatgtttattggaagttgcggtttacctatttc

SEQ ID NO: 14450 - protein, 121 aa, Panicum virgatum
  misc_feature: Ceres CLONE 1776475-R
  misc_feature (40)..(121): Pfam Name: W2 Pfam Description: eIF4-gamma/eIF5/eIF2-epsilon
SLPQDVMNALLEALFDGVGKGFAKEVVKNKKYLAAAVPDEGAQTVLVQAIESFGGKCSPEALKEVPVVLKALYDGDVLEEETIVEWYNAAVAAGKNSQVVKNAKPFVEWLQSAESEEEDDE

SEQ ID NO: 14451 - DNA, 1760 bp, Panicum virgatum
  misc_feature: Ceres CLONE 1776479
  misc_feature: Encodes the peptide sequence at SEQ ID NO. 14452
atcagtcagtatcacactgtgctgttgctgctcctcttcagcagaaaaaaagggggaaaaggaaacacctcccaattccagcaatgtcggcgccaccgtcgggcggcggcggcgccctcatcaacgaggtgctcaccgacgacgagctccgcgcggtgctctcccgtctggggcccgaggcggagcgcgacgccttcgggctcgtgtgccgccgatggctccggatccagagctccgagcggcggcgcctgcgcgcgcgcgccggcccggacatgctgcgccgcctcgccgcgcgcttcccgggagccctcgagctcgacctctcccagtccccctcccgctccttctaccccggggtcatcgacgacgacctcgacgtcatcgccagcagcttccgcaacctgcgtgtcctcgcgctgcagaattgcaaaggtatctctgatgttggaattgccaaattgggagatggactgccatttctgcagtctgttgatgtttctcgctgcataaagctgagtgataaaggtttgaaggcagttgcactggggtgccagaaattgaggcagctgcatatcacaggatgcagattaataactgataatttattgctttctctatcaaagagctgtctacaattggaaaatcttggagcagcaggatgtaacagcataacagatactggtatatctgctctagctgatggctgtcatcatgtaaaattccttgacattagtaaatgtaataaagttggtgatcctggagtctgtaaaattgctgaggtttcttcatcacacttggtgtcaataaagctattggactgcagcaaggtgggagataagtccatctattcattagctaagtgctgcagtaacctagagactcttgtcattggtggatgtcggaacattagcgatgcatccatgcaagctcttgctcttgcctgctccagcagcttaaggagcctgagaatggactggtgcctgaaaataacagacacgtcattgcgaagtctgctgtctaactgtgaacttcttgtggcgattgatgttggatgctgtgaccagataaccgacgttgcatttcaggacggggaaggaaatgggtttcggtctgaactgaaagttttgaagatcagcagctgtgttcggctcacagttgcaggggtcagcagtgtgattaaatccttcaaggctcttgagtacctggacattcggtcttgtcctcaggttacaagggacagctgcgagcaagctggaatacagtttcctagtgcatgtaaggtgaatttctatggaagcttgctggagtctgatccatctgctgagaggttcttctaagatcaggtgccagctgtgagctcagttgcacccaactttcaagtgaagcatgaaactaagattcaaagagtcctgcatcatgtagacaagtgcttgacactgttgttctgctttcaccatcaaacgcatgcaagcatcgggaatcactatagatgcaaaccataagcaatatgccataacccaattcaatggcatgtgatttagtctgtagaaaatagtaccagtacccatgaaataagttgtctgaacaacgtatgtttatgcattatgtgttgtgcgttgtgccaatcaagcggattgtattcaaattcaacatgttcattttataatgcctgcgtaaatgtattgtagtttgtttttatctgcatcacttgtacagatctttgatttggcattgtagtgtttggtttgttgacttgagct

SEQ ID NO: 14452 - protein, 417 aa, Panicum virgatum
  misc_feature: Ceres CLONE 1776479
  misc_feature: SWISSPROT Homolog: EC 1.14.11.27 [Histone H3]-lysine-36 demethylase
MSAPPSGGGGALINEVLTDDELRAVLSRLGPEAERDAFGLVCRRWLRIQSSERRRLRARAGPDMLRRLAARFPGALELDLSQSPSRSFYPGVIDDDLDVIASSFRNLRVLALQNCKGISDVGIAKLGDGLPFLQSVDVSRCIKLSDKGLKAVALGCQKLRQLHITGCRLITDNLLLSLSKSCLQLENLGAAGCNSITDTGISALADGCHHVKFLDISKCNKVGDPGVCKIAEVSSSHLVSIKLLDCSKVGDKSIYSLAKCCSNLETLVIGGCRNISDASMQALALACSSSLRSLRMDWCLKITDTSLRSLLSNCELLVAIDVGCCDQITDVAFQDGEGNGFRSELKVLKISSCVRLTVAGVSSVIKSFKALEYLDIRSCPQVTRDSCEQAGIQFPSACKVNFYGSLLESDPSAERFF

SEQ ID NO: 14453 - DNA, 320 bp, Panicum virgatum
  misc_feature: Ceres CLONE 1776482
  misc_feature: Encodes the peptide sequence at SEQ ID NO. 14454
gtttctctggcgaccatgcacaaaagactgtctttcccagcgttgtcgagctgctgctcagctctggcctcatggggggaagggggcataaggatgcgtacaggagagatatctctcagtcgctaagaggcatgatgtcactgacgtaccccatcaagattggcattgtcaacagctgcgattacatggagaacatctgtccgctctccttctactcctaacttcatgtggcggctgacgacctccctttactgctcacagacgcccctctcgtcgtataggtggacgcggagaacatgatgccgatcatgtccgacacc

SEQ ID NO: 14454 - protein, 72 aa, Panicum virgatum
  misc_feature: Ceres CLONE 1776482
  misc_feature: SWISSPROT Homolog: EC 2.7.10.2 Non-specific protein-tyrosine kinase
FSGDHAQKTVFPSVVELLLSSGLMGGRGHKDAYRRDISQSLRGMMSLTYPIKIGIVNSCDYMENICPLSFYS

SEQ ID NO: 14455 - DNA, 645 bp, Panicum virgatum
  misc_feature: Ceres CLONE 1776482-R
cttgaaaattctgataaatttcaggccttatcagctagagtagacgtaattcccctcttcttggataggccaattaatcttcacttggatgacaatgatatagagatcgctccctcaccttcttctgaatgtaagaagcgagatagcagaaactgtgctgctgtcagtgttcaacacaaaccaagtggagtcactgcggaaagttcaggtgagagaaactattttggaaacaggctaaaagctacaagtaggttgaaagcaaagctccttttatttgcaagagaattgggagtatcaaacatgaagacgatgaacaaacaagctataaaggatatatgcagccgtgaaacgcgaaggtacacatttgggcctcagaaattggtccatgatctcaacacaggcaaccagttatcagatttgaacttggttctggaaggtgaaatagaaccattcattagaggtcgtattatcgccagacaatgatgatacaactcaccaattgattgattgtcccccctcattgcgatcttgtacatttatttgtctttatacaaaccacaccacatcaaaggatgacctctgtaaaatatcacatttcaagccaaaaggcatgacacctggtatacaaaacattacgttgtttgc

SEQ ID NO: 14456 - DNA, 2011 bp, Panicum virgatum
  misc_feature: Ceres CLONE 1776494
  misc_feature: Encodes the peptide sequence at SEQ ID NO. 14457
acgaggccgcccgccgcgacgcgctcctgcccgtgcccacctccctcctctccccctccgcctccgcagcgcccgcggtaacctcaccacgccacgccgcatcgcgtgcgagccccaaccgtcgccggcccgcccccaacccaattaagccgcccccgcggcgcgatccggtccggtggccaccgctgccgccccgccggagcgaggaggaggaggaaggaagggaggcggggaggggagcgcgggggggatgctagaggcgaagccgccgtcgccgggctccggcgcggcggcgcacatccacggccaccggcggtgggcggcgccgctgctcgcgtcggtcctgctctcctcgctcctcatctccgcgtcgctcttcttctcctcctcccgcgcgctgctcctctccttctcgccgctccccaccgcggcctccgccgagccgctcttcgtcgaggccaagctccgccagcagatgcgggccggggagcgcccgccgccgcccgccgtgcccaggatcgcctacctcatctccggctccgcgggggacggcgccgcgctgagccggacgctccgggcgctctaccacccggccaacacctacgtcgtgcacctcgacctcgaggcccccgccgccgagcgcgccgagctcgccgccgccgtccgggcggaccccgtctacgccaggttccgcaacgtcagggtcgtcacacgcgccaacctcgtcacctaccggggcccgaccatggtggccaacacgctgcacgcggcggccatcctgctgcgcgaggggggcgattgggactggttcatcaacctctccgcatccgactacccgctcgtcacccaggacgatctgttgcatgtgctctctgagttgcccaggcagcttaacttcattgagcataccagcgacatcggatagaaggagtaccagagggcaaaaccagtgatcatcgaccctgggctatacagcctgcagaagtctgatgttttctggattacagagaaaaggagtgtcccaactgcattcaagctttttactggttcagcatggatgatgcttactcatcagtttattgaatactgcatatggggatgggacaacctaccaaggacagtcctgatgtattatgccaactttctttcttcaccagagggttacttccacacggttatctgcaatgtcccagagttccgcaacaccacagtcaaccatgatctgcatttcatttcttgggacaacccaccaaagcaacatcctcattatctcacagtcgatgactttgaaggtatgcttaacagtaatgctccctttgcaaggaagttcggaagagaagatccagtgctagacaagattgaccaggaactattgggccgccaacctgatggatttgtgcctggtggatggacatatctgttgaatacaactgagaaaggaggacccttaactgttgaacgtgtgcaagatctccgcccagggcctggagtggacagattaaagaaacttgtcacaggcttgctcacccaagaaggttttgatgacaagcattgcttgtgaaactcccagtaagatgattctggggcattaggtttacatggtcaaatttgaggatttgaggtgagggcattgatccatttgctagtaatctctactagctgaaggagcagcacatactcatgtccgcgtggatgcaatgatatgataggtgctcttatagacaggccgcttgagttcagttaccgtacagcaggagaccacagatgtagcaggcggagattatacagagctagtagctcattaggttatggtagatgatcatatcagcccccaaccatcaataatcttggaatttttgacctctgcgctgcgggttgtgcaaggtggccacttgcttgtcttgtctgggagccatggcaccaaccaccgggtatttgccagctggtagcgtgtgagacttcgttgtattgactagcagatatttctgggaaaactgatacatttgattgc

SEQ ID NO: 14457 - protein, 224 aa, Panicum virgatum
  misc_feature: Ceres CLONE 1776494
  misc_feature (90)..(223): Pfam Name: Branch Pfam Description: Core-2/I-Branching enzyme
  misc_feature: SWISSPROT Homolog: EC 2.4.2.26 Protein xylosyltransferase
  misc_feature: Useful for making plants with altered carbohydrate content
MLEAKPPSPGSGAAAHIHGHRRWAAPLLASVLLSSLLISASLFFSSSRALLLSFSPLPTAASAEPLFVEAKLRQQMRAGERPPPPAVPRIAYLISGSAGDGAALSRTLRALYHPANTYVVHLDLEAPAAERAELAAAVRADPVYARFRNVRVVTRANLVTYRGPTMVANTLHAAAILLREGGDWDWFINLSASDYPLVTQDDLLHVLSELPRQLNFIEHTSDIG

SEQ ID NO: 14458 - DNA, 1769 bp, Panicum virgatum
  misc_feature: Ceres CLONE 1776497
  misc_feature: Encodes the peptide sequence at SEQ ID NO. 14459
aaaaaaaaaaacactcattccacgcggcggcggtttccatcaccggcggcgccggtaccctgcctgatccaaccaggcgattcggcccgcaccagccatggacgcgccccaactcctcctcggggcgctcctcttcctcgtccccaccgcgctcctcctcctcggcctccacctcgcgcggggcaggcgcccgcgcctcccgccgggcccgccgtccctgcccctcctcggcagcgtggtgtggctcaccaactcgcccgccgagatcgagcccctgctgcggcacctcttcgcgcgccacggccccgtcgtggcgctccgcgtcggggcgcgcctctccgtcttcgtcgccgaccgccgcctcgcgcacgcggcgctcgttgagcgcggcgccgcgctggcggaccgcccggcgctcgcgtcgaccaggctcctcggcgagaacgacaacactatcacccgcgccagctacgggcccgtgtggcgcctcctccgccgcaacctcgtcgccgagacgctgcacccgtcgcgggtgaggcttttcgcgccgtcccgcgcctgggtgcgccgcgtgctcgccgacaagctcggggaggccgggcgcgccggcgcgctgccgccccgcgtcgtggagacgttccagtacgccatgttctgcctcctcgtgctcatgtgcttcggcgagcgcctcgacgagcccgcggtgcgcgccatcgccgccgcgcagcgggagacgctcatctacatcacccggagcatgaccgtcttcgatttcttcccatcggtcaccaagcacctcttccgcgcgcggctggacaaggcgcgggcgctgcggcggcgcatcaaggagctcttcctgccgctcatcaacgcgcggcgcgagtacagggggcggggcggcgagccgaggaaggagaccatgttcgagcactcgtacgtggacaccctgctcgacatcaagctccacgaggacggcgatcgcccgcttaccgacgatgagatcatcctcctctgctccgagttcctcaacgccgggacggacaccacctccactgggctgcagtggatcatggccgagcttgtgaagaacccagccatccaggacaagctctaccacgagatcaaagccgccaccgacgacgacaaggaagaggtctccgaggaggacgtccacaacatgccgtacctcaaggcggtgatcctggagggcctccggaagcacccgccgggccacatggtgctgccgcacaaggcggcggaggacatggagatcggcgggtacctcatccccaagggcactacggtgaacttcatggtggccgagatgggccgggacgagcgggagtggaagaacccgatggagttctcgcctgagcggttcctcccgggcggcgacggcgagggcgtcgacgtgacgggcaccaaggggatcaggatgatgccattcggcgtgggccggaggatctgcgcggggctcggcatcgcgatgctgcaactggagtacttcgttgccaacatggtcagggaattcgagtggcaggaggtgcccggcgaggaggtggacttcgccgagaagaacgagttcaccaccgtcatgaagaagccgctttgcccgcgccttgtgcccaggaggactcggagtacgagtgctcactagctatctggaattactgcgatccaattgcagagtggttctatggtttcttgctgtgtgatgtatatctattcagaatactgctaacaagctgtcaagaattacagcttttttt

SEQ ID NO: 14459 - protein, 519 aa, Panicum virgatum
  misc_feature: Ceres CLONE 1776497
  misc_feature (35)..(510): Pfam Name: p450 Pfam Description: Cytochrome P450
  misc_feature: SWISSPROT Homolog: EC 1.14.13.21 Flavonoid 3'-monooxygenase
MDAPQLLLGALLFLVPTALLLLGLHLARGRRPRLPPGPPSLPLLGSVVWLTNSPAEIEPLLRHLFARHGPVVALRVGARLSVFVADRRLAHAALVERGAALADRPALASTRLLGENDNTITRASYGPVWRLLRRNLVAETLHPSRVRLFAPSRAWVRRVLADKLGEAGRAGALPPRVVETFQYAMFCLLVLMCFGERLDEPAVRAIAAAQRETLIYITRSMTVFDFFPSVTKHLFRARLDKARALRRRIKELFLPLINARREYRGRGGEPRKETMFEHSYVDTLLDIKLHEDGDRPLTDDEIILLCSEFLNAGTDTTSTGLQWIMAELVKNPAIQDKLYHEIKAATDDDKEEVSEEDVHNMPYLKAVILEGLRKHPPGHMVLPHKAAEDMEIGGYLIPKGTTVNFMVAEMGRDEREWKNPMEFSPERFLPGGDGEGVDVTGTKGIRMMPFGVGRRICAGLGIAMLQLEYFVANMVREFEWQEVPGEEVDFAEKNEFTTVMKKPLCPRLVPRRTRSTSAH

SEQ ID NO: 14460 - DNA, 1271 bp, Panicum virgatum
  misc_feature: Ceres CLONE 1776510
  misc_feature: Encodes the peptide sequence at SEQ ID NO. 14461
attctcctctcctccctcgtgattatccatccccccaaatccctgccccaaaccagcctccgatccatccggccccgaatcgccgccgggatctccgcgcgtggcgggcgatggctggcgcgggcgcggcggaggtggagagggcgcacgagctctaccggggcggccgacaccgggaggcgctggagctctactccgcggcgctggcggcggcgcgggccccggcccagcgcatcgcgctccacagcaaccgtgccgcatgctacctcaagctccacgacttccacaaggcagcagaagagtgtacatctgtccttgagttggatagggagcatgctggagctttgatgttacgtgcccagactctggttactctgaaagattatcagtcagctctgtttgatgtcaacaggctcattgagataaatccatcgtctgaattatatcggaacctgcaggcacgattgaagacacagctatcactggcccctattcctgagtgtgaagaggagtccatgtttcttgaagaagaaaaggaagaacttcctccaaaaggacatcagaagattgagacttctatcactaagcttgaccaacctgaaactgaactggttctcgagaacaaaccttcaaatggacctgttctcgaaagaaaacctgcaagtgaaccccagaaggttgatgttgctcccattctgccttcaaaaccccagggctgggaggccattccaaaaccaaagggccattcaggtcttgattactcaaagtgggacagcgtggaagatgattcgagtgaagacgaggatgatgaagaagaagaagagttgccgcagtataagtttaaagtcagaactgttgtgcggtctgtaaagtgaacaagattagcaatgttcaaactataatctgtgtagtctgacaggatgcctactgaccagggtgccacttatccatcttcagttaaattattttggatgaacaactatacatattggttgatattttgcttcaaaaccaggttgcccaatctcgaaaataagctcaggttaaacgatttgtccaatactcaaatgctgcccgacaataatccagagcaattatttgtttttcgaagcgatggagatggatatgatggcagggtccatgatgtacaaagatccaagctaataacattacagtagtccagcgcagtttaggaccatagtctcgcctcggcggacctgtgcacctagcgtcctctggattttggactataatatgatccgtttttggtc

SEQ ID NO: 14461 - protein, 254 aa, Panicum virgatum
  misc_feature: Ceres CLONE 1776510
  misc_feature (42)..(75): Pfam Name: TPR_2 Pfam Description: Tetratricopeptide repeat
  misc_feature: SWISSPROT Homolog: EC 5.2.1.8 Peptidylprolyl isomerase
MAGAGAAEVERAHELYRGGRHREALELYSAALAAARAPAQRIALHSNRAACYLKLHDFHKAAEECTSVLELDREHAGALMLRAQTLVTLKDYQSALFDVNRLIEINPSSELYRNLQARLKTQLSLAPIPECEEESMFLEEEKEELPPKGHQKIETSITKLDQPETELVLENKPSNGPVLERKPASEPQKVDVAPILPSKPQGWEAIPKPKGHSGLDYSKWDSVEDDSSEDEDDEEEEELPQYKFKVRTVVRSVK

SEQ ID NO: 14462 - DNA, 2289 bp, Panicum virgatum
  misc_feature: Ceres CLONE 1776530
  misc_feature: Encodes the peptide sequence at SEQ ID NO. 14463
agggctctacacgaagttaggcggccaaagtgttggtaaccaaccccctctcccctcttccccagtgaaactttcagactcccgttttagtaaagcagggagcttggccaggatgaagtttatgaaacttggcacccggccggacaccttcttcacctccgagtccgtgaggtctgtctgcacggaggtggccaccgacctgcagatcctggtggatggctgcgtctatcatctccacaagtttcctctgctctcgaaatgcatgctcctgcaagcgctctgcgccgattccggcgacagcggcgacagcggcggcgacgccgtcgagctcccgggattcccgggcggcgccgaggcgttcgaggcctgcaccaagttctgctacggcatcaccatcacggtgagcgcgcggaacctcgtgccgctgcggtgcgcggcggcgcacctcggcatgtccgaggccgccgaccggggcaacctcgccgccaagctcgacgcgttcctcgcctcgtgcctcctccgccgctggaaggacgcgctcggcgtgctcagctccacgcgccactacgccccgctctgcgaggacctcggcctcacgtcccgctgcgtcgacgccgtggccgccctcatcatcaacccggacaccgccccgccggccaggtcgacgtcggcgtcgccgtggtgggcgcacgacatcgccgagctcggcgtcgacctcttctggcgcatcatggtgtccgttaaggccaccggcgccgtccacgagaagaccgtcggcgacgcgctcaaggcgtacgcgcgccgctggctgccgaacgtctccaaggacgggctctccgcggaccagccgttcgacaacgacgccggcggcggcgcggacgtgaagcaggtcgccacgcggcaccgcctcctcctcgagaagatcgtgagcctgctcccggcggagagggacgccgtctcctgcggcttcctgctcaagctcctcaaggcggccaacatcctgagcgcttccgccgcgtccaaggcggagctggtgcggcgggcggcgtggcagctcgaggaggccagcgtcgcggacctgcttgtcccgtcgctgtcctgcgtcagcgagacgctctacgacgtggacgccgtggcggccatcctcgacgagttcgcgctgcggtacgcggccgccgcgccggcgcacccgccggcgatggccctgtccgggagccccgacgacagcccggcgcactcgggcgggcaccggcggtcgcgttcggcggagagcgtgagcttcgacggcacgcgacggtccttgtcggccgcgcccgtgtcgcagggcgcgctggcgcgggtgggcaagttggtggacggcttcctgattgaggtggccaaggaccccaacatgccgctggacaagctgctcgccattgccgaggccgtgccggacagcgcccggccggagcacgatggcctctacaaagtcgtcgacacatacctcaaggcgcatccggagatgagcaaaagcgcccgaaagcggctgtgccgggtgctcaactaccggaagctgtcggagaaggcgtccgcgcacgcggcgcagaacgagctcctcccgctgcgcgtggtcgtgcaggttctcttcttcgagcacgcgcgcgccgcggcgctggcttcgggcgggcacgccgccgcggacctgcccagcaacatccgggcgctgctgtccaagacgtccgggtcgtcggaggacgacgaggccgaccgcgtcgacgagcagcggctccgcgcgctggccgacggcgcgtccccgggcgacgactggagcgtggagggcctccgccgcgcggcgtccaagatcgccactctgcggatgaagctggccgaggaggacgaggaccccgacgccgacgagttcgcccggaaggctgggctggggcgcagcgcgtcgctgcggttcagggcgtcgctgcgggtcagggcgttctgcgccatccccgccgggaagccgaagcggatgctcagcaagctgtggccgctcggcaggagcggcggcagccattagcggccgttgtctagctcccgtgatctcctgttttttctgaggatgatttgtttatctcttcgatttagtactcctccgatcctacatcttcttcttcctcctcttatatcagttactccaggcgaaaggccgggccgttgagatggctagcccggcccggtagggtcgcgttcctagcaggttctgagtttgaatcttatcagaagtgaattttagattgctgggagaaaaaaaaggagacg

SEQ ID NO: 14463 - protein, 644 aa, Panicum virgatum
  misc_feature: Ceres CLONE 1776530
  misc_feature (188)..(486): Pfam Name: NPH3 Pfam Description: NPH3 family
MKFMKLGTRPDTFFTSESVRSVCTEVATDLQILVDGCVYHLHKFPLLSKCMLLQALCADSGDSGDSGGDAVELPGFPGGAEAFEACTKFCYGITITVSARNLVPLRCAAAHLGMSEAADRGNLAAKLDAFLASCLLRRWKDALGVLSSTRHYAPLCEDLGLTSRCVDAVAALIINPDTAPPARSTSASPWWAHDIAELGVDLFWRIMVSVKATGAVHEKTVGDALKAYARRWLPNVSKDGLSADQPFDNDAGGGADVKQVATRHRLLLEKIVSLLPAERDAVSCGFLLKLLKAANILSASAASKAELVRRAAWQLEEASVADLLVPSLSCVSETLYDVDAVAAILDEFALRYAAAAPAHPPAMALSGSPDDSPAHSGGHRRSRSAESVSFDGTRRSLSAAPVSQGALARVGKLVDGFLIEVAKDPNMPLDKLLAIAEAVPDSARPEHDGLYKVVDTYLKAHPEMSKSARKRLCRVLNYRKLSEKASAHAAQNELLPLRVVVQVLFFEHARAAALASGGHAAADLPSNIRALLSKTSGSSEDDEADRVDEQRLRALADGASPGDDWSVEGLRRAASKIATLRMKLAEEDEDPDADEFARKAGLGRSASLRFRASLRVRAFCAIPAGKPKRMLSKLWPLGRSGGSH

SEQ ID NO: 14464 - DNA, 859 bp, Panicum virgatum
  misc_feature: Ceres CLONE 1776551
  misc_feature: Encodes the peptide sequence at SEQ ID NO. 14465
acgccacgccattgaacgctccgggcctttcttcccactctcgcgtccgcgtccatcgcttcccttccttaatcccgcgctccttgccacgcttcgatccctcccccaccatcaggctcatggcggatcagctcaccgacgaccagatcgccgagttcaaggaggccttcagcctcttcgacaaggacggggatggttgcatcacaaccaaggagctgggtactgtcatgcgttccctgggccagaaccctacagaggctgagctccaggacatgatcaatgaggttgatgccgatggcaacggcaccatcgattttccagaatttctcaatcttatggctcgcaagatgaaggacactgactcagaggaagagcttaaggaggccttccgtgtgtttgacaaggaccaaaatggcttcatctccgcagctgagctccgccatgtcatgacaaatcttggtgagaagctaactgatgaggaggtggatgagatgatccgtgaggctgatgtcgatggcgatggtcagatcaactatgaggagtttgtcaaggtcatgatggccaagtgagccactgaaccataatctgaaggcggagaagattgtgcattgcatattagtcaagatgcaactcttatttcatcaacttgctgtgaaacattctattagctgtagttgctaaaaggacagtgcagttcctgctatgttcttccctcctgtgtgttttcagatctcttgttttatgtgaacctgtaatgctcgccctgcctggtgtgtactggttgcagttgctcccttatgtagttatatttttttccatgaacttctgcttgactacaaagtatcattggatgaccggc

SEQ ID NO: 14465 - protein, 149 aa, Panicum virgatum; identical to SEQ ID NO: 12456
  misc_feature: Ceres CLONE 1776551
  misc_feature (121)..(149): Pfam Name: efhand Pfam Description: EF hand
  misc_feature (85)..(113): Pfam Name: efhand Pfam Description: EF hand
  misc_feature (12)..(40): Pfam Name: efhand Pfam Description: EF hand
  misc_feature (48)..(76): Pfam Name: efhand Pfam Description: EF hand
  misc_feature: SWISSPROT Homolog: EC 2.7.11.1 Non-specific serine/threonine protein kinase
  misc_feature: Useful for making plants with modulated salt sensitivity

SEQ ID NO: 14466 - DNA, 1794 bp, Panicum virgatum
  misc_feature: Ceres CLONE 1776556
  misc_feature: Encodes the peptide sequence at SEQ ID NO. 14467
aggcaggcgcgaggcaggagaggacgtcggtgcgttcgtgccgtgcgtgccatagcgcgcgccgtccctgatctctcccccctacaccccgacggccgccgcagatctgagggtcatcggcagccatgatctccagcaagctcaagtccgtcgacttctacaggaaaatccctagggatttgaccgaggcatcattatctggtgctggattatccattgtagcagcactaactatgatgtttttgtttggaatggagttgagcagttacttagcagttaatactacaacatctgtgattgttgataggagttcagatggggagtttctgcggatagatttcaatataagctttcctgcactttcatgtgaatttgcatcagttgatgtcagcgatgtgctgggaacaaacagattgaacataacaaaaactgttcgcaaatattcgattgatcggaatttagtaccaactggatcagagttccaccctggccctattcccattgtcagtaagcatggagatgatgtagaagaggatcatgttgatggttcagttcccttgtcatctcgcaattttgatagctattcacaccaatattctgttttggttgtcaacttttatgccccctggtgttactggagcaatcgactgaaaccttcgtgggagaagactgcgaaaataataagggagagatatgaccctgaaatggatggtagaatccttctgggcaaggttgactgcactgaggaaattgacttgtgtaggaggcaccacatacaaggatacccatccattcgcgttttccgtaaagggtctgatatcaaggaaaatcagggtcaccatgatcatgaatcatactacggggaacgtgatactgagagtttagtcgcggcaatggaagcttatgttgcaaacattccaaaagaggctcatgtgcttgctttggaagacaaatccaataagactgttgatccttccaagcgccctgctccgatgaccagtggatgcagaatagaaggttttgtgcgagtgaaaagggttccagggagtgttgttatatcagctcgatctgggtcacactcgtttgatccatcccagataaatgtttcacactatgtgaatcagttctcgtttggcaaaaaactttcaccaaggatgtttcatgaattcttaagactaactccctatcttcgtggataccatgatagattagctggacagtcttacagtgttaagcagggtgaggttaacgccaatgttactattgagcattacctacaagttgtgaagactgagcttgtaacactgaggtcctcaaaggaactgaaagtgctcgaggaatacgaatacacagcacacagcagcttggtgcacagcttctacgttcctgttgtgaaatttcattttgagccttctcccatgcaggtcttggtaactgaagttccgagatccttctctcatttcatcacaaatgtctgcgctattattggtggagtcttcacggttgctggaatactggattccatcttccacaatacgctaaggatggtgaagaaggttgagctaggaaagaacatttaaattccggtgccgcttcagcggatgtgctaggtagccattatttcgttgtacctgggatagcgattcatagtgatctatatattgaagtcttgaagaggggaaacgtgagttaggcagagttgaaactagggaccgtggacttgatactagggacatcactgttttgctacatcccttacaaataatacagtggatccttgagggtgaaccccgc

SEQ ID NO: 14467 - protein, 484 aa, Panicum virgatum
  misc_feature: Ceres CLONE 1776556
  misc_feature (141)..(260): Pfam Name: Thioredoxin Pfam Description: Thioredoxin
  misc_feature: SWISSPROT Homolog: EC 5.3.4.1 Protein disulfide-isomerase
MISSKLKSVDFYRKIPRDLTEASLSGAGLSIVAALTMMFLFGMELSSYLAVNTTTSVIVDRSSDGEFLRIDFNISFPALSCEFASVDVSDVLGTNRLNITKTVRKYSIDRNLVPTGSEFHPGPIPIVSKHGDDVEEDHVDGSVPLSSRNFDSYSHQYSVLVVNFYAPWCYWSNRLKPSWEKTAKIIRERYDPEMDGRILLGKVDCTEEIDLCRRHHIQGYPSIRVFRKGSDIKENQGHHDHESYYGERDTESLVAAMEAYVANIPKEAHVLALEDKSNKTVDPSKRPAPMTSGCRIEGFVRVKRVPGSVVISARSGSHSFDPSQINVSHYVNQFSFGKKLSPRMFHEFLRLTPYLRGYHDRLAGQSYSVKQGEVNANVTIEHYLQVVKTELVTLRSSKELKVLEEYEYTAHSSLVHSFYVPVVKFHFEPSPMQVLVTEVPRSFSHFITNVCAIIGGVFTVAGILDSIFHNTLRMVKKVELGKNI

SEQ ID NO: 14468 - DNA, 2645 bp, Panicum virgatum
  misc_feature: Ceres CLONE 1776564
  misc_feature: Encodes the peptide sequence at SEQ ID NO. 14469
agctgccgccgtgctagtttccagtgcacgcgcgcacacgcacaatttcatcatcaccaggattgaaacgatccgtgaaacaaggggataaatcggtcggattcggaggagccgagtaaacaaaggggtgctcttcccttccgactcctagcgttttcgttagggggaaggagagcattgctgcgcggggatggggaggaggagcggaggcggtggtgggacggtgggcgtgccatggctgctgctgctcctcggatgctgctgctgcagcagacggatcttcgctgctgcggacacggaccccaacgatcttgctgtcctcaatacactctttactagtctgaattctcctgggcagctcaatggttggcaggcaaatggtggtgatccttgtggccagtcatggaagggggtaatttgctcaggatcaggggtcactaaaatcttattgccgaacttgggactctccgggaatctggcctacaacatgaataacttgggttcattgactgagcttgacatgagccaaaacagccttggcggtggaaaccaaatacagtacaatcttccctatatgaagcttgagaaactcaatcttgcaggaaatcagtttggcggaaatttaccctactcaatttcaacgatgaataatcttaagtatttaaaccttaaccacaaccaattactaggaaatatttccgatgtattttccagcctttatagtttgacagaactagatctctcctttaattctcttactggtgatctaccacaaagtttcactggattgtcaagcctgaaaaaattatatttgcagaacaatcaatttactggttatatcaatgtcctagctaatctcccccttgaagctctgaatgttgcaaacaaccgtttcacaggttggattcctagtcagcttaagaagataaacagtatacagactgacggaaattcttggagcacaggaccagcgccacctcctcctccatatacagcgccgcctcccccaaatcgtcggaacggcccaaggcagaatggtgatggttctggtggaaaatctggaataagtggtggaggtgtagcaggaattatcatatcattgctggttgttggagcaattgttgcattctttctaataaaaagaagaaaacgcaaagctgctatggaagaacactttgaacagcaccagccattcacttccttcccctcgaacgaagttaaagacatgaagcctattgatgagtctactgcagtagacatagagtctttgtcttcacctacttcgattagtttgaaaccacccctgaagatagaacaccacaaatcgtttgatgatgatgatgatttttcaaacaaacctgtttcaaagaaaagcaatatagcacctataaaggcaactgtttattcagttgcggatctacagatggcaacagatagcttcagcttcgacaaccttgttggagagggtacttttggacgtgtttacagggcacagttcaatgatggaaaggttctggccatcaagaaattagacagcaccgtgatgccattccaatcatctgatgactttgctgaactggtctcaaatatttcaaaattacaccatccgaatctgaatgagcttgtgggctactgtatggaacatgggcagcacttgcttgtgtatgattttcacaggaatggatcgcttcatgatctactccacctttctgacgagtacagtaagccactcagttggaactctcgtgttaagattgcacttggctctgctcgtgcactagagtatcttcatgaaatatgttctccatccatcatccataagaatttcaagtcatcaaacattttgctggactcggaattcaatcctcacctttcagatgctggacttgcaagctttattcctgatgctgaattccaggcagcagaacaaagtgccggatacactgccccagaggtggacatgaccggtcagtacaccctcaagagtgatgtctacagctttggaattgtcatgcttgagctattgactgggcgtagaccatttgatagctctagacccagatcagagcagtcacttgtgcggtgggcaactccccagctgcatgacattgatgcattggacaggatggtggatcctgcactcaagggtctatacccagccaaatctctatcccgatttgctgatgtgctcgcgctgtgtgtccagcccgaaccagaattcaggccaccaacgtcagaggtggtgcaagcattggttcgacttgtgcagagggccaacatgacgaagagaatgctcgatggagatacttctcggcgagcagatgatcaggacccagatttcatatgacggaagcaaaacacgagcctttcaggttgtatttatttcgttcgactagcccccagcagatagagagagagaagatttggaagaagaaacagagaagtttgttggttccgcccgtacataatcacagttttttcatggtgacaaaagagtgtatactatggtccatggtttgtattgtgcatacaaaacagtaccttgatcgtagatttattataccattctgtttcaaacaggactatagccaaattgtactctaagatactcaatttaaaaatgcaattcattttagttttgtcct

SEQ ID NO: 14469 - protein, 718 aa, Panicum virgatum
  misc_feature: Ceres CLONE 1776564
  misc_feature (417)..(688): Pfam Name: Pkinase_Tyr Pfam Description: Protein tyrosine kinase
  misc_feature (37)..(78): Pfam Name: LRRNT_2 Pfam Description: Leucine rich repeat N-terminal domain
  misc_feature: SWISSPROT Homolog: EC 2.7.11.1 Non-specific serine/threonine protein kinase
MGRRSGGGGGTVGVPWLLLLLGCCCCSRRIFAAADTDPNDLAVLNTLFTSLNSPGQLNGWQANGGDPCGQSWKGVICSGSGVTKILLPNLGLSGNLAYNMNNLGSLTELDMSQNSLGGGNQIQYNLPYMKLEKLNLAGNQFGGNLPYSISTMNNLKYLNLNHNQLLGNISDVFSSLYSLTELDLSFNSLTGDLPQSFTGLSSLKKLYLQNNQFTGYINVLANLPLEALNVANNRFTGWIPSQLKKINSIQTDGNSWSTGPAPPPPPYTAPPPPNRRNGPRQNGDGSGGKSGISGGGVAGIIISLLVVGAIVAFFLIKRRKRKAAMEEHFEQHQPFTSFPSNEVKDMKPIDESTAVDIESLSSPTSISLKPPLKIEHHKSFDDDDDFSNKPVSKKSNIAPIKATVYSVADLQMATDSFSFDNLVGEGTFGRVYRAQFNDGKVLAIKKLDSTVMPFQSSDDFAELVSNISKLHHPNLNELVGYCMEHGQHLLVYDFHRNGSLHDLLHLSDEYSKPLSWNSRVKIALGSARALEYLHEICSPSIIHKNFKSSNILLDSEFNPHLSDAGLASFIPDAEFQAAEQSAGYTAPEVDMTGQYTLKSDVYSFGIVMLELLTGRRPFDSSRPRSEQSLVRWATPQLHDIDALDRMVDPALKGLYPAKSLSRFADVLALCVQPEPEFRPPTSEVVQALVRLVQRANMTKRMLDGDTSRRADDQDPDFI

SEQ ID NO: 14470 - DNA, 683 bp, Panicum virgatum
  misc_feature: Ceres CLONE 1776586
  misc_feature: Encodes the peptide sequence at SEQ ID NO. 14471
atccccagcaccccacctccgaagctctcggctccggcggcaacggcgagatggtgaaggggcgcactgggcagcgcgtgaggctctacgtccggggcaccatcctcggatacaagaggtccaagtcgaaccagtacgagaacacgtcgctggtgcagatcgaaggggtgaacaccaaggaggacgtcgcgtggtactgcggcaagcggatggcgtacatctacaaggccaagaccaagagcagcggcacccactaccgctgcatctggggcaaggtcacccgcccgcacggcaactctggcgtcgtccgcgccaagttcaagtccaacctgccgccggagtctatggggcgcaaggtcagagtcttcatgtaccccagcagcatctaaagataatttcaagatgtggaggattgtgcttatctgctaggttgtcttgagctaaaaagttccttgtaaggggtctgttcaggttaagagttagcgacatgaactgtctatttgagaaccatttgaagttctccctggttttggtgttgtggacctaaatcttatatggagttgaagttggaactgaaagtaatttgtcatgttttgttcgtagcccacattgcatcagttgtcgggttctgaatcagttattgaccaaaaggctatgccggcacaaacaaatttgtgtttttg

SEQ ID NO: 14471 - protein, 112 aa, Panicum virgatum
  misc_feature: Ceres CLONE 1776586
  misc_feature (12)..(106): Pfam Name: Ribosomal_L35Ae Pfam Description: Ribosomal protein L35Ae
MVKGRTGQRVRLYVRGTILGYKRSKSNQYENTSLVQIEGVNTKEDVAWYCGKRMAYIYKAKTKSSGTHYRCIWGKVTRPHGNSGVVRAKFKSNLPPESMGRKVRVFMYPSSI

SEQ ID NO: 14472 - DNA, 752 bp, Panicum virgatum
  misc_feature: Ceres CLONE 1776608
  misc_feature: Encodes the peptide sequence at SEQ ID NO. 14473
ccaatcctctcccgctctggagtcagggctcgggcctcaggttcatctcctccctctgtttcttaaacctttcccttctctcggactcccctccgctcttccttccctggcggcgacgactcggcgagcggcggcgccatttgtcacgtcttcgcccagccctttgccggcgacgagcgtcctccaggtgtcagctgagccggcagctgcgagtgttctcaagccgccgccatgttgttcttctcctacttcaaggagctcgtggggaaggaggtgacggtggagctcaagaacgacctggcgatccgcgggacactccactcggtcgaccagtacctcaacatcaagctcgagaacactcgagttgttgatcaggacaagtacccccacatgctatctgtgcggaactgcttcatcaggggctcggtggtgcggtacgtgctgctcccgcaggacggcgtggacattgacatcctccacgatgccaccaggagggaggcgcgcggaggctgatcgacacgccccccctcaactggtgcctcgccttcttccccgacaggaaccctgatctgatctgtgaaacatgtatccatcctcctggtgttattagacacagacagctgactggccaaactgttatccatcagctcccctggtactttgcagtgacagacattccaggttgggtgacctgcatgttccttgtgggctgctattagtagtgctgttagactgaatcagccccacttatt

SEQ ID NO: 14473 - protein, 93 aa, Panicum virgatum
  misc_feature: Ceres CLONE 1776608
  misc_feature (5)..(72): Pfam Name: LSM Pfam Description: LSM domain
MLFFSYFKELVGKEVTVELKNDLAIRGTLHSVDQYLNIKLENTRVVDQDKYPHMLSVRNCFIRGSVVRYVLLPQDGVDIDILHDATRREARGG

SEQ ID NO: 14474 - DNA, 1210 bp, Panicum virgatum
  misc_feature: Ceres CLONE 1776620
  misc_feature: Encodes the peptide sequence at SEQ ID NO. 14475
cctcacagagcaccagaccatctcagctttgcttctcagctaactatctttaggctccggttgctgcgagaagcaaggcaggcatggaggggaaggaggaggacgtccgcctgggcgccaacaagttctccgagcgccagcccatcggcacggcggcgcaaggcaccgatgacaaggactacaaggagcccccgccggcgccgctcttcgagcccggggagctcaagtcctggtccttctaccgcgccggcatcgccgagttcgtcgccaccttcctcttcctctacatcagcatcctcaccgtgatgggcgtcagcaagtcccaatccaagtgcgccaccgtcggcatccagggcatcgcctggtccttcggcggcatgatcttcgccctcgtctactgcaccgccggcatctccggcggccacatcaacccggcggtgaccttcggcctgttcctggcgaggaagctgtcgctcaccagggccatcttctacatggtcatgcagtgcctgggcgccatctgcggcgccggcgtcgtcaagggcttccagcaggggctgtacatgggcaacggcggcggcgccaacgtcgtcgcgcccggctacaccaagggcgacggcctcggcgctgagatcgtcggcaccttcatcctcgtctacaccgtcttctccgccaccgacgccaagaggaacgccagggactcccacgtcccgatccttgctcccctcccaattgggttcgccgtgttcctggtccacctggccaccatccccatcaccggcaccggcatcaacccggcaaggagccttggcgctgccatcatctacaacagggaccatgcctgggatgaccactggatcttctgggtcggccccttcatcggcgccgccctggcggccatctaccaccaggtgatcatcagggcgatcccgttcaaaagcaggtcctaagctgctgctgctgctgctgctgtgttctgctgtgaggtgccagtcctgacaggcaaagcttgcttcggatggggtggtcgtctccattctccaatccctactgtgtcgctgtggagtttcatttctcttcaagtttgatgtactgcactatgtttatctgaaccccggacttaatttcagtacccaattgtgtaatacgccgctagtgtcatgtgaagatttaagttatgagatggccaagggttccatgttccaagtcc

SEQ ID NO: 14475 - protein, 288 aa, Panicum virgatum
  misc_feature: Ceres CLONE 1776620
  misc_feature (46)..(275): Pfam Name: MIP Pfam Description: Major intrinsic protein
  misc_feature: Useful for making plants with modulated water use efficiency
  misc_feature: Useful for making plants with modulated drought sensitivity
  misc_feature: Useful for making plants with modulated cold sensitivity
MEGKEEDVRLGANKFSERQPIGTAAQGTDDKDYKEPPPAPLFEPGELKSWSFYRAGIAEFVATFLFLYISILTVMGVSKSQSKCATVGIQGIAWSFGGMIFALVYCTAGISGGHINPAVTFGLFLARKLSLTRAIFYMVMQCLGAICGAGVVKGFQQGLYMGNGGGANVVAPGYTKGDGLGAEIVGTFILVYTVFSATDAKRNARDSHVPILAPLPIGFAVFLVHLATIPITGTGINPARSLGAAIIYNRDHAWDDHWIFWVGPFIGAALAAIYHQVIIRAIPFKSRS

SEQ ID NO: 14476 - DNA, 709 bp, Panicum virgatum
  misc_feature: Ceres CLONE 1776647
  misc_feature: Encodes the peptide sequence at SEQ ID NO. 14477
aaatcacgtgccctcccggaggtcgaaccgaagccaccagcccaccaccagcacgagtcaccggcgagggagagggcgagaggcggcgcggccggaggagtcggggagcgatggcgttcacgatgcgagcggtgaaggtgcccccgaactcggcgtcgctggaggaggcgcggcaccgcgtgttcgacttcttcaagcaggcctgccgctccatccccaccgtcatggagatctacaacctcgacgacgtcgtcactccctcccagctccgctccaccatcgccaaggagattcgcaagaatcagaacatcaccaaccccaaggttattgatatgcttctgttcaaggggatggaagagctgaacaacatagttgagcacgcaaagcagcgccatcatgttattgggcagtatgtgattggccaagagggcctggtgcatgagctgggctcaaaggatcaagggacctctgatttcctgaagaaattctacagtagcaattacttctgatcagaattacagattttcaccttctgtaatactcgggaggtgcttcaaataagatgctgaacccagacccagttatttcgccctggaggttttgatttatttggctgaatcctctgctcaatatgatgttgctgttagtagtttcactttgtggattgttgttgtacttacagaattgatgtttataaatcaagcctacg

SEQ ID NO: 14477 - protein, 132 aa, Panicum virgatum
  misc_feature: Ceres CLONE 1776647
  misc_feature (19)..(89): Pfam Name: Complex1_LYR Pfam Description: Complex 1 protein (LYR family)
MAFTMRAVKVPPNSASLEEARHRVFDFFKQACRSIPTVMEIYNLDDVVTPSQLRSTIAKEIRKNQNITNPKVIDMLLFKGMEELNNIVEHAKQRHHVIGQYVIGQEGLVHELGSKDQGTSDFLKKFYSSNYF

SEQ ID NO: 14478 - DNA, 864 bp, Panicum virgatum
  misc_feature: Ceres CLONE 1776721
  misc_feature: Encodes the peptide sequence at SEQ ID NO. 14479
aaagcccaacccacgtcccactcgtccagtcctccccgaagccggcggcggcggacgaagcagcggcagccggcaggccatggcgtcgtcgtcgaccccggcggccgtccgcgagatgcagaaggatctcgagatccaggctaacgccctcagcaagatccagaaagatatcgcaaagaaccaccaggtccgcaagcagtacaccatccaggtcggcgagaacgagctcgtcctcaaggagttggagctactgaatgatggggcgaacgtgtacaagctcatcggaccggtgctcgtcaagcaggaccttgcggaggccaaggccaacgtcaagaagcgcatcgagtacatctcggcagagctgaagcggatggaccgggcactgaaggatttggaagacaagcagaacagcaagaagaaatcaatattcaagttgcaacagaggatgcaggctgtgcaagctaaggcttagacacctgcttgctgaatgcaactagtccaagccttcctgcaatcacccatcccaataccatccagttttttgtgtggacttaggtgtccagtgttctggtctctgaaacgaaagattggttatgcctgtattcatgatgtttatgtgagattgaaacgttcttgacgtctatgtagcaaagaatgttatctggatgctctgatgtaaaagccggtcactagattgaaggtgtatggtaagcctgtagtggtttccttggttgagcttattggtgggccattgcattttgtgccatttttccttctctggactgaatgcttctgaaagaggaatgttagtcacggtatttcagctctttctgtaaattaagctgcacgatcattttcccgctt

SEQ ID NO: 14479 - protein, 130 aa, Panicum virgatum
  misc_feature: Ceres CLONE 1776721
  misc_feature (18)..(123): Pfam Name: Prefoldin_2 Pfam Description: Prefoldin subunit
MASSSTPAAVREMQKDLEIQANALSKIQKDIAKNHQVRKQYTIQVGENELVLKELELLNDGANVYKLIGPVLVKQDLAEAKANVKKRIEYISAELKRMDRALKDLEDKQNSKKKSIFKLQQRMQAVQAKA

SEQ ID NO: 14480 - DNA, 781 bp, Panicum virgatum
  misc_feature: Ceres CLONE 1776746
  misc_feature: Encodes the peptide sequence at SEQ ID NO. 14481
gagccggacggacaaaccgaccagacccacagtttccagtttccaccacaccccctctcttgcgcttcagtccggcgggtgagtcgtcgtgacgccggcatccatggcggcggtggtgcgcggcgtcctgaggggcatcaaggagaaaggcctcgccaacttcctccgcgacgcccgcgaggaaggatacctgaattgcattctggatgggaaccttttgcaaacaaaaattcacaatattggcgcaacacttgtaggggttgacaagtttggaaacaagtactatgagaaactgcaagacactcagcatggaaggcataggtgggtggaatatgcagagaaagatcgttacaatgcatcccaagtgcctcctgaatggcacggatggctgcatcacatcacagataacactggcgatcagctgctggcccggaagactgctcggtaccttgtggagcacaagcagaactactccggtgagggcgaggagctgatctaccactccaaggggcatgcccttaacccggggcagagggactggacgaggtaccagccctgggagccaaagaaagagcaagcctaataaaaatgtcgtgtctgatcggggaggaccaccctgtgttgtgttttcctgctttcttgccttgggccaggtgttgctgagctgaataatcaatcaatcagcgagtgactcgttcggcctcgggtccttggagcgatcctgaataatgttgtactggacgacaatactgtataattcgatcatctttgtttgatttcg

SEQ ID NO: 14481 - protein, 159 aa, Panicum virgatum
  misc_feature: Ceres CLONE 1776746
  misc_feature (48)..(154): Pfam Name: NDUFA12 Pfam Description: NADH ubiquinone oxidoreductase subunit NDUFA12
MAAVVRGVLRGIKEKGLANFLRDAREEGYLNCILDGNLLQTKIHNIGATLVGVDKFGNKYYEKLQDTQHGRHRWVEYAEKDRYNASQVPPEWHGWLHHITDNTGDQLLARKTARYLVEHKQNYSGEGEELIYHSKGHALNPGQRDWTRYQPWEPKKEQA

SEQ ID NO: 14482 - DNA, 791 bp, Panicum virgatum
  misc_feature: Ceres CLONE 1776768
  misc_feature: Encodes the peptide sequence at SEQ ID NO. 14483
gtccacctcctgagccctgcccaccctccaaccccggcggcggcagcggcggcggcggcgcagcagcagcagctgaagatggtgaagttcctgaagcccggcaaggccgtgatcctccttcagggccggttcgccggccggaaggcggtgatcgtgcgcgtgttcgaggagggcacacgcgaccgcccctacgggcactgcctcgtcgccggcctcgccaagtatcccaagaaggtgatccgcaaggactccgccaagaagacggccaagaagtcccgtgtcaagtgcttcatcaagctcgttaacttcacccacctcatgcccacccgctacacccttgacgtcgacttcaaggacgtcgcctcgggcgggcccgacgcgctctccacccgggacaagaaggtcgccacctgcaaggccgcgaaggcccgcctcgaggagaggttcaagacaggcaagaacaggtggttctttaccaagctccgcttctagatgccaggcgtccagcatagtacctgctttagttgtcaatttcatgtatcggacacccttatctctgttttggtattgccgtgaagacttcgtgcttactgttatggatcttggagaggttgacatgtcgatgatgttttaaatgatgtcaatcgtagaccttgtccaaattttgttcagaatcattgcgtggaatgtgctgatttcaatcttacgggtgttaggtattcgagatgcatcacctaagccttattactacgacttcatggtccttgttttacatgcgagttctgtttgat

SEQ ID NO: 14483 - protein, 137 aa, Panicum virgatum
  misc_feature: Ceres CLONE 1776768
  misc_feature (52)..(137): Pfam Name: Ribosomal_L27e Pfam Description: Ribosomal L27e protein family
  misc_feature (7)..(40): Pfam Name: KOW Pfam Description: KOW motif
MVKFLKPGKAVILLQGRFAGRKAVIVRVFEEGTRDRPYGHCLVAGLAKYPKKVIRKDSAKKTAKKSRVKCFIKLVNFTHLMPTRYTLDVDFKDVASGGPDALSTRDKKVATCKAAKARLEERFKTGKNRWFFTKLRF

SEQ ID NO: 14484 - DNA, 691 bp, Panicum virgatum
  misc_feature: Ceres CLONE 1776789
  misc_feature: Encodes the peptide sequence at SEQ ID NO. 14485
accggtcgtccactcgccgtcgttgctttctcggaacgatcccgcaggctgggaagcgccggggacgctgcggcttctgtcgtcgtgatcggaagctagcgccgcgctccgatctctggccgtatagacaggcaggggcggcgcccgtcgtcgtctcggcggcggccatggacgacggcggctcctcgtcgccggcttcgtacatcagactggtgcagcatctgatcgagaagtgcatctgctacaacatgaacaaggaggagtgcatggagacgctggagaagcacgccaagatcatgcccgtcatcacatccaccgtgtggaaggagctggagaaggagaacagggaattcttcgagacgtacaagaaggatcgaggagaagattccacgcgggagaatccttccacgcgggagaatcctcctcctgacggtgggtcgtctgcttcttccaagagctcagccgacgacgacgaccagacggcggaccagtaggacgactcgctctcatgtggaaggaccatcgatgcatgcatggtacctgccatacatatatattgagatcagagctgtatgcatggagtagctagctagcagtaataatctagcttatatatcactgtcagcatcaccagtgtaattatgtgtgcgtgtactatattaattgggtagtagatttacagccctgcatc

SEQ ID NO: 14485 - protein, 108 aa, Panicum virgatum
  misc_feature: Ceres CLONE 1776789
  misc_feature: SWISSPROT Homolog: EC 2.5.1.3 Thiamine-phosphate diphosphorylase
MDDGGSSSPASYIRLVQHLIEKCICYNMNKEECMETLEKHAKIMPVITSTVWKELEKENREFFETYKKDRGEDSTRENPSTRENPPPDGGSSASSKSSADDDDQTADQ

SEQ ID NO: 14486 - DNA, 1000 bp, Panicum virgatum
  misc_feature: Ceres CLONE 1776801
  misc_feature: Encodes the peptide sequence at SEQ ID NO. 14487
actcttcgcgccgccggagtacccaaattctcatccccctcactcaccggagcgccgcagccccctcaccacccccacccttcacccggccatggcggagcgcggcggagagcgcggtggcgagcgcggcgggttcggccggggcttcggccgcggcggccgcggcgaccgtggcgggcgccgtggtggccggcgcgggcagcgccaggaggaggagaagtgggtccccgtcaccaagctcggccgcctcgtgaaggagcaaaagatcagcaagatcgaggagatctacctacactcgctccccgtcaaggagcaccagatcgtggagaccctcgtccctggcctcaaggacgaggtcatgaagatcacgcccgtgcagaagcagacgcgcgccgggcagcgcacccgcttcaaggccttcgtcgtcgtcggagactgcgacggccacgtcgggctcggcgtcaagtgcgccaaggaggtggccaccgccatccgcggcgccatcatcctcgccaagctctccgtcgtgcccgtcaggagggggtactggggtaacaagatcggccagccgcacaccgtgccctgcaaggtcaccggcaagtgcggttccgtcaccgtgcgcatggtgcccgctcccaggggttccggcatcgtcgccgcgcgcgtgcctaagaaggtgctgcagttcgctggcattgaggatgtcttcacctcgtcccgtggctccaccaagactcttggcaacttcgtgaaggcaaccttcgactgcctgatgaagacctacggtttccttacacctgagttctggaaggagaccagcttcaggatgaccccgttccagcagttcactgatctcctggcaatccctaccaagggtcttatgctcgaggccccagttgagacagtagaagcttaggatattggagtaaagagttctactcgcttcgagttgtctaatgcactttctatattatagttaagaactttgggagtcaacttt

SEQ ID NO: 14487 - protein, 274 aa, Panicum virgatum
  misc_feature: Ceres CLONE 1776801
  misc_feature (84)..(150): Pfam Name: Ribosomal_S5 Pfam Description: Ribosomal protein S5, N-terminal domain
  misc_feature (167)..(240): Pfam Name: Ribosomal_S5_C Pfam Description: Ribosomal protein S5, C-terminal domain
MAERGGERGGERGGFGRGFGRGGRGDRGGRRGGRRGQRQEEEKWVPVTKLGRLVKEQKISKIEEIYLHSLPVKEHQIVETLVPGLKDEVMKITPVQKQTRAGQRTRFKAFVVVGDCDGHVGLGVKCAKEVATAIRGAIILAKLSVVPVRRGYWGNKIGQPHTVPCKVTGKCGSVTVRMVPAPRGSGIVAARVPKKVLQFAGIEDVFTSSRGSTKTLGNFVKATFDCLMKTYGFLTPEFWKETSFRMTPFQQFTDLLAIPTKGLMLEAPVETVEA

SEQ ID NO: 14488 - DNA, 717 bp, Panicum virgatum
  misc_feature: Ceres CLONE 1776818
  misc_feature: Encodes the peptide sequence at SEQ ID NO. 14489
accctagaagccccctgcctcctgcgcctccaccctcctcgccgcctctccccctccgagaccgtagatccgtccggtgagaggagcccgcccgccgccatgtcgtccgctgagctcgcctgcacctacgccgccctcatcctcagcgatgacggcatcccgatcacggccgagaagatcgcgacggtggtgaaggccgcgaacgtcaaggtggagtcttactggcccacgctctttgccaagctcctggagaagcgcagcgttgaggacctcatcctctccgttggatctggtggtggtgctgccccagttgctgctgctgcccctgctggtggtgctgcagcagctgctgccccggctgttgaggagaagaaggaagagcccaaggaggagtctgatgacgacatgggcttcagcctgttcgactgaggagcccctggccagccattagcaaattcacttatgttgtccaagactatcttatgttatgtccctaggcttttgttataagtactcaaattttgagtttttgagatgtgctatggctatgtgctgaacctcaaaccatcttattagagtgaaaacttgttcctatgttcttgtgttcaatcttaaaagtttcgtgaggtctatgtttatttctcttagattctggttcagatgccctgcaatcttgtgctgattggctgatatgtatctgcgctgccctttctactc

SEQ ID NO: 14489 - protein, 109 aa, Panicum virgatum
  misc_feature: Ceres CLONE 1776818
  misc_feature (21)..(108): Pfam Name: Ribosomal_60s Pfam Description: 60s Acidic ribosomal protein
MSSAELACTYAALILSDDGIPITAEKIATVVKAANVKVESYWPTLFAKLLEKRSVEDLILSVGSGGGAAPVAAAAPAGGAAAAAAPAVEEKKEEPKEESDDDMGFSLFD

SEQ ID NO: 14490 - DNA, 661 bp, Panicum virgatum
  misc_feature: Ceres CLONE 1776849
  misc_feature: Encodes the peptide sequence at SEQ ID NO. 14491
gtgctgcgccttggggagttctcatggagcagggtaagaaagcaaaggtactgtgcctgcatggcttccggacaagtgggaatttcttgaagaagcagatcagcaagtggcacccttctatattccagcagtttgacatggtattccctgatggcatcttcccagctggtggaaagtcggaaatagatggcatatttccaccaccgtactttgagtggttccagttcaataagttcacggaatacacaaatctagatgaatgcatttcatatctgtgtgattacatggtgaaaaatagaccttttgaaggcctacttggattctcccagggtgcaacactttcagcccttctgattggctaccaatcacagggcaaggttttgagtgatcatccaccaattaagtttatggtctccatatctgggagcaagttcagggacccaagcatctgcaatatcgcctacaaggacccgatcaaggtgaaatcagtgcattttattggagaaaaggactggctcaaaataccctccgaggagctggcttctgcctttgttgaccctctcatcataaggcatccccaaggccatacagtccctaggcttgacgatgcatctgtgaaactactttctgaatggagctcaaacatcctggaagacctcaa

SEQ ID NO: 14491 - protein, 212 aa, Panicum virgatum
  misc_feature: Ceres CLONE 1776849
  misc_feature (4)..(205): Pfam Name: FSH1 Pfam Description: Serine hydrolase (FSH1)
  misc_feature: SWISSPROT Homolog: EC 1.5.1.3 Dihydrofolate reductase
MEQGKKAKVLCLHGFRTSGNFLKKQISKWHPSIFQQFDMVFPDGIFPAGGKSEIDGIFPPPYFEWFQFNKFTEYTNLDECISYLCDYMVKNRPFEGLLGFSQGATLSALLIGYQSQGKVLSDHPPIKFMVSISGSKFRDPSICNIAYKDPIKVKSVHFIGEKDWLKIPSEELASAFVDPLIIRHPQGHTVPRLDDASVKLLSEWSSNILEDL

SEQ ID NO: 14492 - DNA, 688 bp, Panicum virgatum
  misc_feature: Ceres CLONE 1776873
  misc_feature: Encodes the peptide sequence at SEQ ID NO. 14493
tacactaactagcaccggtcacagcaccaaccgtaccgccatggcctccctcgccgccgtctccgtgcagccggtcgccgtaaagggcctcgccggcagctccatctccggcaggaggctcgccgccgctaggccgtcgcgcgccggcgcctgccgctccgcccgcaggccccgcggcgccgccgtggtggccaagtacggcgacaagagcgtctacttcgacctcgacgacatcggcaacaccaccgggcagtgggacctctacggctccgacgcgccctcgccctacaacccgctccagagcaagttcttcgagacgttcgcggggccgttcaccaagaggggcctgctgctcaagttcctgctgctgggcggcgggtcgctgctggcctacgtcagcgcgtcggcgtcgccggacctgctgccgatcaagaaggggccgcagcagccgccgcagccggggccgcgcggcaagatctaagctcagttgttccttctcctccatctgtctctactagctgcttgcttgtaccaccattggctccggacgccatggatcgtcgtccctgctgcctgttgtgctgctgatatttgatcgcgctgcctgtttatcgatgttgatactgttgtatttatactctggcatacgattacaaatttacaatggtgttgcgtacgtgcttacctt

SEQ ID NO: 14493 - protein, 146 aa, Panicum virgatum
  misc_feature: Ceres CLONE 1776873
  misc_feature (5)..(146): Pfam Name: PSI_PsaH Pfam Description: Photosystem I reaction centre subunit VI
MASLAAVSVQPVAVKGLAGSSISGRRLAAARPSRAGACRSARRPRGAAVVAKYGDKSVYFDLDDIGNTTGQWDLYGSDAPSPYNPLQSKFFETFAGPFTKRGLLLKFLLLGGGSLLAYVSASASPDLLPIKKGPQQPPQPGPRGKI

SEQ ID NO: 14494 - DNA, 1142 bp, Panicum virgatum
  misc_feature: Ceres CLONE 1776913
  misc_feature: Encodes the peptide sequence at SEQ ID NO. 14495
aacttgcgttggcaacacaacagggaagaaaagcggaaagaggggaaaggaaggagggcgatccaatcatcactccaccagcttccctgagcggcgagaagcctaccaccgatccgatcgagttctcggagggggatctccccacgaatcgctccaaccgaaaccctggtcgcccccgcggaccggagggtccaagatgagtttcttgtttgggaagcggaagacgcccgccgagctcttgagagagaacaagagaatgttagatcgatccatcagggaaattgagcgggagaggcaaggattgcaggcccaggagaaaaagctcatcactgagatcaagaaaacagctaaagaaggccagatgggagctgtcaaagtaatggccaaagatcttatccgtacccggcatcagataacaaagttctaccaacttaaatcccagctccaaggagtttctctaagagttcagacgctaaaatcaactcaagctatgggtgatgctatgaagggtgttacaaaagcaatggctcaaatgaataggcagctaaatttgccagggttgcagaagataatgcaagagtttgagcgacaaaatgagaggatggagatggtgagcgaggtgatgggagatgccatagatgatgctttggaaggagacgaggaagaagaagaaactgaggagcttgtgaatcaagtacttgatgaaattggcattgatatcaaccaagagcttgttggagccccatcggctgctgttgctcagcctgcttctgctggaaaggttgcccaggctgaaagcgccgggaacgctgacagcggaatcgacgccgatttgcaggcaaggttgaacaatctaaggagaatgtaaatgctgcccgatgctgcattaggaaaagagtagtgccttgtagcaccgtttcctgtgaatgtgaatgaatacccactgaaacaaactttacaagccagtgtgtatgttgaaacaaatgaagtattcaatatgctggtaataatcacaagtgtatatctgcaagtatgttatgcttgaaaagtcgatatgaattgctttttcccttctgaatccacgaaggattgttgcatgcagatttggtatgtcaggttgctgtaaactcgagttcgagtcc

SEQ ID NO: 14495 - protein, 223 aa, Panicum virgatum
  misc_feature: Ceres CLONE 1776913
  misc_feature (17)..(187): Pfam Name: Snf7 Pfam Description: Snf7
MSFLFGKRKTPAELLRENKRMLDRSIREIERERQGLQAQEKKLITEIKKTAKEGQMGAVKVMAKDLIRTRHQITKFYQLKSQLQGVSLRVQTLKSTQAMGDAMKGVTKAMAQMNRQLNLPGLQKIMQEFERQNERMEMVSEVMGDAIDDALEGDEEEEETEELVNQVLDEIGIDINQELVGAPSAAVAQPASAGKVAQAESAGNADSGIDADLQARLNNLRRM

SEQ ID NO: 14496 - DNA, 696 bp, Panicum virgatum
  misc_feature: Ceres CLONE 1776950
  misc_feature: Encodes the peptide sequence at SEQ ID NO. 14497
gagacaaaaatatcccccacccacgacgagcgccagcagcagcagcagccatggggatagccgtggtggttcccgtcgcggcggcctcctcctcctacctcggggcgccgccgaggcgcgccgcggcgccggcgcgcgcccacgtcgcagcggccgggatgtccgcgagggcgtcttccttcgtcgggacctcggggggcggcggggcgctcgggtgcaagtgcctgttcgggctcggggtgcctgagctcgcggttatcgccggcgtcgccgcgctcgtgttcgggcccaagcagctccccgagatcggccgcaacatcggcaagaccgtcaagagcttccagcaggcggctaaggagtttgaaactgaactgaagaaagagcctagggaaggcggcgacgagcccccgcctgcaacccccatggcggtaggcgatggggaggagaaaaagggggcttgaggcatcgtctagtagcaaggagcacacgaggatccatcttgttagcgttctgtatgtacaactgtattctgggcttctggagttagcagcaaatgcctgcccgtttattttggtcaccttgcagtttcaggccacatagcgatattgtttgtagttttgtacccgggaagaacaacttttctgtgaaagatgtcgtgttattcaataaatatgaggcttaccttgagcattattc

SEQ ID NO: 14497 - protein, 136 aa, Panicum virgatum
  misc_feature: Ceres CLONE 1776950
  misc_feature (62)..(114): Pfam Name: MttA_Hcf106 Pfam Description: mttA/Hcf106 family
MGIAVVVPVAAASSSYLGAPPRRAAAPARAHVAAAGMSARASSFVGTSGGGGALGCKCLFGLGVPELAVIAGVAALVFGPKQLPEIGRNIGKTVKSFQQAAKEFETELKKEPREGGDEPPPATPMAVGDGEEKKGA

SEQ ID NO: 14498 - DNA, 1825 bp, Panicum virgatum
  misc_feature: Ceres CLONE 1776958
  misc_feature: Encodes the peptide sequence at SEQ ID NO. 14499
ccggccctcccaccatctcgcgatctacccgccgccgccgccgatggctttcgccgcacggaggagacttgccatcagcctctccgaccacttctcccgccgcctccacccctccatctcgcacctcatcccgcccgaccacgaccgcttcgagagcccctcctcctcggccgcctcgccttcacctcaatcaccacccgcaaagccgttcccctcctcccttgctcggccgtcgagatcccgagcccttaccagcctccccatccccttcgcgctccatctcgcggcccaccgtaacttctccacgacctcctccgcatcagcaccagacatcgatgtcgcggcagacatgctcaccgacgccgcctcctcggtaccggtgtcggagctgctctcgggcgaggtggtttccgctgcagcctccgtacccatgcctccagcgccgtatgcgggggaggtggctgccgcagcagccgaatcgtttcccccggtcgccgccatgcaatacctcctggatgccgtgcagtccttcactggcctcaactggtgggctactattgcgctgacgacagtgctgatccggttactgacagtcccattgctcatcaaccagttgaagtccatgatgaagttaaatgacttgagaccagaaattgaagccattaatgaagagatgcgaaattcaactgatccaagatcaatggaagtggggaaacagaaattgggtgagctattcattagacatggtgtgactccatttacacgatggaagggtctattcatacaggggactatattcatgacctttttctttgctatatctaacatggttaagaaagtcccttctcttaaagggggcggagcatattggtttactgatttgacaactcctgatgatcttttcatcctcccagtgttagcatcactgtcatttttggctacagcagagctcgatatgcaagacggcagggaaggaaatcctacggcaaaatcattgaaaaagttctccagattttatgctgttatgtttgttccatgtacaataggctttccaaaggcttatttttttgtctttgtctcatctagcttgttctatcttgtatacagtgttgttatccagaaaccagccataagactatggttggatcttcctcccttggaatctcagcccacacctgcacgaatgcaagccttaagtctctttggtgaacctaagccaagtcctggagtttattctcctatcgcagacaaggagtgcaagcaatctggagttggttctcctatcgcagacaacgagtgcaagcaatctggagttggttctcctattgcagacaaggagtgcgagcaatctggagttcattctcccattgccgacaaggagcacaagaaatctagctctgtgctgattgaccgtatcagagatcttgagaacagggcaaaatctagaggtgaacctctagagtaattcctgatttttatgcacttggaagtaaagaagcacgcctccttttgggttttgtaacttcatggtggggggaaaggatacccagtatgtgtgcattgtattgaggtttgatttgggagaggtggctgtttttcagatcatgggtccactatcgtttcagtgaataaattggagcaattctggcatctgtaattgtttcgtaatgcaatataacccaagtagcttaacaatagcatgttgttccttggattaagcatagtgattctgccgagcagcaccaaccagttgttttttcccttaatgctcaaaactcaaaatctacacttgtatctgtaagtttgtaatgttgtgtacttttgg

SEQ ID NO: 14499 - protein, 473 aa, Panicum virgatum
  misc_feature: Ceres CLONE 1776958
  misc_feature (167)..(363): Pfam Name: 60KD_IMP Pfam Description: 60Kd inner membrane protein
MAFAARRRLAISLSDHFSRRLHPSISHLIPPDHDRFESPSSSAASPSPQSPPAKPFPSSLARPSRSRALTSLPIPFALHLAAHRNFSTTSSASAPDIDVAADMLTDAASSVPVSELLSGEVVSAAASVPMPPAPYAGEVAAAAAESFPPVAAMQYLLDAVQSFTGLNWWATIALTTVLIRLLTVPLLINQLKSMMKLNDLRPEIEAINEEMRNSTDPRSMEVGKQKLGELFIRHGVTPFTRWKGLFIQGTIFMTFFFAISNMVKKVPSLKGGGAYWFTDLTTPDDLFILPVLASLSFLATAELDMQDGREGNPTAKSLKKFSRFYAVMFVPCTIGFPKAYFFVFVSSSLFYLVYSVVIQKPAIRLWLDLPPLESQPTPARMQALSLFGEPKPSPGVYSPIADKECKQSGVGSPIADNECKQSGVGSPIADKECEQSGVHSPIADKEHKKSSSVLIDRIRDLENRAKSRGEPLE

SEQ ID NO: 14500 - DNA, 1700 bp, Panicum virgatum
  misc_feature: Ceres CLONE 1776959
  misc_feature: Encodes the peptide sequence at SEQ ID NO. 14501
aaccctcttcccgcatccatccccactctcttcgtccccgccaggcgccggcggcaaccaaagcaaccaaccctaatctgcacggcgaccgaccacgccgcatcctgccgctcccgttcctcgaggccccacgaaactccagccctcttcagttcagccatgacatcggaggacgaagctaacgccgcggcggtggcggcggaggagggtgcggaggcgacggagggggaaaactggcggcggaaggggaagcacgacaagcccaagccgtgggacgaggaccccaacatcgaccactagaagatcgagaagttcgacccatcctggaacgagggcggcatgctcgaagtcaactccttctccaccctcttcccccagtaccgagagaagtacctgcaggagtcgtggccgatcgtgaagggcgcattgaaggagcacggtatctcgtgcgagcttaatttggtggagggatccatgactgtttcaaccaccaggaagaccagggatccctacattattgttaaggccagggaactgataaagctattgtccaggagcgtccctgcacttcaggcgaccaaaattctcgatgatgagatgaactgtgatattataaagattggtggccttgtaagaaataaggaacgatttgttaaaaggagagaacgccttttaggccctaatttatctacacttaaggccattgagattttgactggctgctacatcttagtgcagggaaacacagttgcagccatgggttcctatactggaaggggactgaaacaagttagaaggattgtagaggattgcatgaagaatctcaagcatccagtgtaccacatcaaggaactcctaatcaaacgcgagctagccaaaaatcctgctctagccactgaaaactgggataggtttctaccgaagttcaagaagaagaatgtcaaacagaagaagcctcaaactaaggagaagaaaccatacacaccctttccgccacctcaacagcctagcaagatcgatgctcaacttgaaactggtgagtatttcatgagtgagaaaaagaaatcagcaaagaaatggcaagagaagctggagaagcaatcagggaaagctgaagaaaacaaaagaaagagagaggctgcatttgttcccccaaaggagaacactgcaggtccatctgaatctgtcaagactgccaatgacaatagtgagatagctgatatagccaagtcattaaaggaaaaggcaaaggaattcagaaagaacaaagcccaagagaatgtcagagctgaatcgtatcttgcaagtaatgaagaaccatgcccaaaaaaaaagaagaaatcaaccaagtccaagtaaccataatccgtatgcatcggacagtgagaattgagaatgattacacgagccatcgcatcactttagagtgcaagagttgcaattgaagatgatggaacaaaaattaaaaccttctgaaggtctgttcttgatgcaatagttggtctgcgcggtttgttggtctgttcatggtaacctgtcatcagaccaaggaacagaacaaattcgagtcattctggctcctcacaaaagtgatcgttttgtcccatataccctgaatgtttttgtgtgcacctactgcttggatgatttggttgaattgatttgcgcaatgaggaaatggatgagtttgccatttcttc

SEQ ID NO: 14501 - protein, 339 aa, Panicum virgatum
  misc_feature: Ceres CLONE 1776959
  misc_feature: Useful for biocontainment applications
  misc_feature: Useful for making plants with modulated biomass
  misc_feature: Useful for making plants with modulated flowering time
MLEVNSFSTLFPQYREKYLQESWPIVKGALKEHGISCELNLVEGSMTVSTTRKTRDPYIIVKARELIKLLSRSVPALQATKILDDEMNCDIIKIGGLVRNKERFVKRRERLLGPNLSTLKAIEILTGCYILVQGNTVAAMGSYTGRGLKQVRRIVEDCMKNLKHPVYHIKELLIKRELAKNPALATENWDRFLPKFKKKNVKQKKPQTKEKKPYTPFPPPQQPSKIDAQLETGEYFMSEKKKSAKKWQEKLEKQSGKAEENKRKREAAFVPPKENTAGPSESVKTANDNSEIADIAKSLKEKAKEFRKNKAQENVRAESYLASNEEPCPKKKKKSTKSK

SEQ ID NO: 14502 - DNA, 1622 bp, Panicum virgatum
  misc_feature: Ceres CLONE 1776966
  misc_feature: Encodes the peptide sequence at SEQ ID NO. 14503
gtgcgctgcggccgggtcggatctgagaccattcctcccaacttattaccatcccatccaatcccccggcttcctcctctccccccgccggatcggatcggatccgccgaccaccccgcgccgccgccgccgccgccgcaacatcagcatcagcagatcagagaagatggccgcagttgacaccttcctcttcacctcggagtctgtgaacgagggacaccctgacaagctctgcgatcaggtctcagatgccgtgctcgatgcttgccttgctgaggaccctgacagcaaggttgcttgcgagacctgcaccaagactaacatggtcatggtctttggtgagatcaccaccaaggccaatgtcgactacgagaagattgttagggagacttgccgcaacattggtttcgtgtcagcagatgtcgggcttgatgctgaccactgcaaggtgctcgtgaacattgagcagcaatcccctgatattgctcagggtgtgcatggtcacttcacaaagcgccctgaggagattggagctggtgaccagggacacatgtttgggtatgcgactgatgaaacccctgagctgatgcccctcagccatgtccttgccaccaagcttggtgctcatctcactgaggtgcgcaagaacgggacctgcccctggctcaggcctgatggaaagacccaggtgactgttgagtaccgcaatgagggtggtgccatggtgcccatccgtgtccacactgtcctcatctctacccagcacgacgagacagtcaccaacgatgagattgccgctgacctcaaggagcatgtcatcaaacctgtcatccctgagcagtaccttgatgagaagaccatcttccaccttaacccatctggtcgctttgtcatcggtggacctcatggtgatgctggtctcactggccggaagatcatcattgatacctatggtggctggggagcccacggtggtggtgctttctctggcaaggacccgaccaaggtcgaccgcagtggagcctacattgcaaggcaggctgccaagagcattgtcgctaacggccttgctcgccgtgccatcgtccaggtctcctacgccattggtgtgcccgagccactctccgtgtttgtggacacatacggcactggcacgatccctgacaaggagatcctcaagattgtgaaggagaacttcgacttcaggcctggcatgatcatcatcaacctcgacctcaagaaaggtggcaacgagcgctatcttaagacagcggcctacggtcactttggaagggatgaccctgacttcacctgggaggtggtgaagcccctcaagtgggagaagccttctgcctaaggtgcccttttggaagaagcttttggtctgtcacgcttatcatgttttgtggctccagtgttgtgattcttgatctgccccttactgtcatttgtattgtaccgtcttaataagtggtacttgtgagggtattactgtgtcttgttatttacttagaggagggtttattgtctactgtttctggttttgctacatatgtcatggtaaaccaagaatgaatctacaggttactttgagaagaaatggaacctgctgctttctggtt

SEQ ID NO: 14503 - protein, 396 aa, Panicum virgatum
  misc_feature: Ceres CLONE 1776966
  misc_feature (119)..(241): Pfam Name: S-AdoMet_synt_M Pfam Description: S-adenosylmethionine synthetase, central domain
  misc_feature (243)..(385): Pfam Name: S-AdoMet_synt_C Pfam Description: S-adenosylmethionine synthetase, C-terminal domain
  misc_feature (5)..(104): Pfam Name: S-AdoMet_synt_N Pfam Description: S-adenosylmethionine synthetase, N-terminal domain
  misc_feature: SWISSPROT Homolog: EC 2.5.1.6 Methionine adenosyltransferase
  misc_feature: Useful for making plants with modulated biomass
MAAVDTFLFTSESVNEGHPDKLCDQVSDAVLDACLAEDPDSKVACETCTKTNMVMVFGEITTKANVDYEKIVRETCRNIGFVSADVGLDADHCKVLVNIEQQSPDIAQGVHGHFTKRPEEIGAGDQGHMFGYATDETPELMPLSHVLATKLGAHLTEVRKNGTCPWLRPDGKTQVTVEYRNEGGAMVPIRVHTVLISTQHDETVTNDEIAADLKEHVIKPVIPEQYLDEKTIFHLNPSGRFVIGGPHGDAGLTGRKIIIDTYGGWGAHGGGAFSGKDPTKVDRSGAYIARQAAKSIVANGLARRAIVQVSYAIGVPEPLSVFVDTYGTGTIPDKEILKIVKENFDFRPGMIIINLDLKKGGNERYLKTAAYGHFGRDDPDFTWEVVKPLKWEKPSA

SEQ ID NO: 14504 - DNA, 687 bp, Panicum virgatum
  misc_feature: Ceres CLONE 1776967
  misc_feature: Encodes the peptide sequence at SEQ ID NO. 14505
agggtttcctcccaccactccccacccccttccaaccccagcacccggcggcggcggcgagcggcggcgatgacgacgagcctgaagaagaaccgtaagaagcgcggccacgtgtccgcggggcacggccgcatcggcaagcaccggaagcacccgggaggccgcgggaacgccggtggcatgcaccaccaccgcatcctcttcgacaagtaccacccgggctacttcggcaaggtgggcatgcgctacttccacaagctccgcaacaagttctactgcccgtcggtcaacgtcgagcggctctggtcgatggtgcccgccgacaaggccgcggaggcggcgggcggcgccgacaaggccccgctggtggacgtgacgcagttcggctacttcaaggtgctcggcaaggggatgctgccgcccaagcccatcgtcgtcaaggccaagctcatctccaaggtcgcggagaagaagatcaaggccgccggcggcgccgtcgtgctcaccgcataggtctttttgcatcctgtttcgtctatctgttctaagagaacaccttaatttgttgtggatcctgagtttttagaccggccacgtcttccctgcaccgctcggcgaagcaatggcgaccacagcgccgctgctctcgccccagcgcggtcgcgctgcccgtatcccccgccgccc

SEQ ID NO: 14505 - protein, 147 aa, Panicum virgatum; identical to SEQ ID NO: 12136
  misc_feature: Ceres CLONE 1776967
  misc_feature (109)..(141): Pfam Name: L15 Pfam Description: Ribosomal protein L15

SEQ ID NO: 14506 - DNA, 670 bp, Panicum virgatum
  misc_feature: Ceres CLONE 1776967-R
gatcctataaagcctcttataatgtggaacccacgccttgttagtggagatgttggagtaggctttaatgttcggaatctacgcagaaatttcttaagtacttttaccactgtttactcgatgaggccattgccaactggtgcagtctttagatgctatcctggaaagtggaaagtattttatgatgatccaagcagaccaaatcggtatttgcttgccagagaactcacaagtcgccccgacgcaacagatattgagaggatatttggaggtgccgatgagcaatctgaagagtcaccatcgttgatgaacaatgtcatgggcgtgtttagttctgtcagccgatttatgagggtcatctccaagtgaaaatggacatctgaagtccctgataatccccatgacggtttattcttaaatcttgagttatgcaagaagatagtttcggtgcatcccttctgttttcagtctgaaactccatgggtaccgctttttctagcaacatccagtatgttttgggatttctgcgcagctatcaaatgtttacagtaacataccgtttggattcattgagtcatccgaggattctacactgtccaactcttatgtatgtacctgtgtaccaaaaaaaaaactctgtagatagttctttattctggattctggaatt

SEQ ID NO: 14507 - DNA, 606 bp, Panicum virgatum
  misc_feature: Ceres CLONE 1776984
  misc_feature: Encodes the peptide sequence at SEQ ID NO. 14508
attcctcgctgcttctgcacccggcacctccctccccccctccgcagttcgccgccggcggatggagtcgggttggagcatccgccttttaccagatactacccaaactatccatccggcgaccatggggcacggcgtcatctgctcccgcaccagtgacgagcacgactacttccgcgcggcgcacgtcggggacctcgacgccctgtccgcgctcctcgccgccgacacctccctcgctcgccgcggcacccactacgaccgcctctccgcgatcaacatcgccgccgccaatggacgccacgaggtgctgtccatgatcttggatcacggggtgccgccggacgtggtgaatctgctcaatcctactcctctgatgctcgcggcaatgcacggcaagattgactgcgtgctcatgctcctccaggacggcgcccatatcttgatgttagattctgtgcacggacggagctgtctgcaccacgctgcctacatcagccatgtggactgcctgctggtcatcctctcggcggcgcaaacgacaccggtggctgactcatgtggtatcgcccggatcgacaatcttcagggacgaccacagcgcca

SEQ ID NO: 14508 - protein, 160 aa, Panicum virgatum
  misc_feature: Ceres CLONE 1776984
  misc_feature (79)..(111): Pfam Name: Ank Pfam Description: Ankyrin repeat
  misc_feature: SWISSPROT Homolog: EC 2.7.11.1 Non-specific serine/threonine protein kinase
MGHGVICSRTSDEHDYFRAAHVGDLDALSALLAADTSLARRGTHYDRLSAINIAAANGRHEVLSMILDHGVPPDVVNLLNPTPLMLAAMHGKIDCVLMLLQDGAHILMLDSVHGRSCLHHAAYISHVDCLLVILSAAQTTPVADSCGIARIDNLQGRPQR

SEQ ID NO: 14509 - DNA, 1892 bp, Panicum virgatum
  misc_feature: Ceres CLONE 1776987
  misc_feature: Encodes the peptide sequence at SEQ ID NO. 14510
gcacctcacgagcagccaagagcaaaggcaagcccgctcacgaacacccacccaccgtggcaatggccgacacggccaccaccgccccgctcctgacgagccacaagccgcccaaggcgccgaccatcgatgaaaccatcgagaattacgtcggcgccaccggcgtcatgcagctgttcaaggccgtcctgctggccttcgcctgggccttcgacgcgcagcaggtgttcatctccgtgttcacggacgccgagccgcagtggcgctgcaccggcgcctcggcgtcctgctcgccggccgcgccgccggccgcgccgtgcggactcccgccgggcgcgtgggcgtgggaccgccccgcccagacgaccatggtctcggagtgggcgctcaagtgcgccggccccgcgctcgtgtcgctcccggcgtcggccttcttcgccggctgcctggcgggcgggttcctgctcaccacgctcgcggactcgctcctcggacgcaggaagatgctcctcacgtccctcgtgtccatgtccgtcgccggcgtgctcaccgcgttcgcgccgaacgtgtgggcgtacgccgcgctacggttcgtgtccgggttcgggcgctccatggtgggcacgtgcacgctggtcctgtccacggagctcgtcggcaagcggtggcgcgacacggtgagcgtggccggcttcttcttcttcaccgtcgggttcctgtccctcccggcgctcggctacacgttccgcgaggcgtcgtggcggaacatgtacctgtggacgtccgtgccgtcgctctgctactccgtcctgctctacttcctcgcccaggagtcgccgcggtggctgctggtgcgcggccggaagcaggacgccatggacacgctgcagcagatcgcgtcgctcaacggcaacagcatcacgtccagcttctccatgctgcacgcgtgcacaatgcacgcggacgacggcgccggcgccggcggcgcgttcgccacgatgcggtccatgtgggagcggccgtgggcgctccggaggctggcggcgatcatgacgaccagcttcggcgtcggcatggtctactacggcatgccgctcaacgtcggcagcctgggcaccaacctgtacctgagcgttacgtacaacgcgctggccgagctgccgtcggctgtcctgtcgctggccttcatcggcagggtgaaccgccggagcacgatcgtcgcgctcaccgcgacggcgggcgctttcagcctcatgtgcgtcgccatcccggagggctcgacggcgcggatggtatccgaactgctctccttcttcgcgaccatcacggcgttcaacctcatcctgatctactccatcgagctgtttccgacgtcggtgcgcaactcggcggtggggctggtgcggcaggcgctggtgctgggcggcgtggcggcgcccgtactcgtcgcgctgggacggcagcggagcttctggtccttcggcgtgttcgggctctgcatcgggtgcttggggctcttcgccgcctgcctcccggagacgaggggccggagcatgtcggacaccatggaggaggaggagcacaagcaggccgccgccgccacggcctgcaccggcggcggcgcaaccgacattgccacgaaggataacagtgacgccgtctagtgacgacgtccgtgtacgtttcacgacgcggcaataattgctgctctgatgatgatatttcggcggcggcgggggctacataggcctagcaccaagctgtcagcctgccgcctctgtccaaccgtgtaaagcttgctgccaaaggtgtgtttagctcgcgaaaagtttgctgtagcatgtttcggttttatttggcaactattgtccaatcatggagtaattagtctc

SEQ ID NO: 14510 - protein, 533 aa, Panicum virgatum
  misc_feature: Ceres CLONE 1776987
  misc_feature (42)..(459): Pfam Name: MFS_1 Pfam Description: Major Facilitator Superfamily
MADTATTAPLLTSHKPPKAPTIDETIENYVGATGVMQLFKAVLLAFAWAFDAQQVFISVFTDAEPQWRCTGASASCSPAAPPAAPCGLPPGAWAWDRPAQTTMVSEWALKCAGPALVSLPASAFFAGCLAGGFLLTTLADSLLGRRKMLLTSLVSMSVAGVLTAFAPNVWAYAALRFVSGFGRSMVGTCTLVLSTELVGKRWRDTVSVAGFFFFTVGFLSLPALGYTFREASWRNMYLWTSVPSLCYSVLLYFLAQESPRWLLVRGRKQDAMDTLQQIASLNGNSITSSFSMLHACTMHADDGAGAGGAFATMRSMWERPWALRRLAAIMTTSFGVGMVYYGMPLNVGSLGTNLYLSVTYNALAELPSAVLSLAFIGRVNRRSTIVALTATAGAFSLMCVAIPEGSTARMVSELLSFFATITAFNLILIYSIELFPTSVRNSAVGLVRQALVLGGVAAPVLVALGRQRSFWSFGVFGLCIGCLGLFAACLPETRGRSMSDTMEEEEHKQAAAATACTGGGATDIATKDNSDAV

SEQ ID NO: 14511 - DNA, 1747 bp, Panicum virgatum
  misc_feature: Ceres CLONE 1776989
  misc_feature: Encodes the peptide sequence at SEQ ID NO. 14512
ccccacccttcgcccaaggaggcccagcctcgcctcaccctccctcccgcccgcccccgccgatccatccacccaataaagcgcctgtacagatccaaccctcaggatccggatcgccccgccccgcgccgatccgcgcgatttcgttcgatttttcctccgttttttggcccgaatttttttgtgggttttctctcttcttcgatcggagcgctagggtttgggcgcgcgaggggcggcgcattccagggccatcgtcgccgggggctagggtgatttctcaccggggggaggggaccggaccgaagcgatggagaagaagaaggtggcgatcccgctcgtgtgccacggccactcgcggcccgtggtggacctcttctacagccccgtcacgcccgacggctacttcctcatcagcgccagcaaggatacaaatccaatgcttcgtaatggtgagactggtgactggattgggacatttcaaggtcataaaggagctgtttggagctgttgtcttgacagaaatgctctgcgtgctgcatctgcatctgctgacttctcagctaaagtatgggatgcactgactggtgatgagctacattcatttgaacacaagcatatagtacgggcctgtgccttttctgaggatacccacctgttactcaccggaggcatggagaagactttgcgtgtgtatgacatgaaccgccctgatgcagctccaagagagcttgacaaatcacctggttctgtccgaactgttgcttggcttcatagtgaccaaactatattaagttcctgcactgatatgggtggagtaaggctatgggatgtgagaactggaaaaattgtccaaactcttgaaaccaaggcatctgtcactagtgcagaagtaagccaggatggcaggttcattactacagctgatggctcaagtgtaaaattttgggacgcaaatcactttgggcttgttaaaagctatgatatgccatgcaatgtggagtcagcttcactggaaccaaagtctgggagtaaatttgtcgctggaggagaagatttgtgggttcatgtatttgatttcttcactggtgaagaaataacttgtaacaaagggcatcatggtccagtccactgcgtccggttcgcacctggtggtgaatcatatgcctcagggtcagaagatggcaccatccggatctggcagcttagctccccgaatgctgatgacagtgaggcggccaatggcaaggcaactgctggggtgaacgaggttacaaccaagatcgaaggcttccacatccccaaggaggggcagaccgaggggtagaagtgtatcgcatctctggcatgcttagcggtgcttggttattgggaggagattgccatcagagcctccgtgcttattcagtttctcccttccgagtcatcatcaaggcctatttgcaatccaaggatagaccggcttcttgagtcatcatcacagcactgggagagaaccatgtcccttcgtgagcaattggtggtggtgggtttttgtatggggccctcgctttgataggacaatatcagcatagcgcgtttagtgtcgtgaataaaccaagagaaaaaagcaagttccgtagcttagttgctgtgactgcgtccagaaaggtttagtattttgtaccgctgctggtaaccgtgattgtggtgaccttttttttcctcatcgttttaatccgtacaatacaatgcatgagggcttcag

SEQ ID NO: 14512 - protein, 338 aa, Panicum virgatum
  misc_feature: Ceres CLONE 1776989
  misc_feature (260)..(298): Pfam Name: WD40 Pfam Description: WD domain, G-beta repeat
  misc_feature (51)..(89): Pfam Name: WD40 Pfam Description: WD domain, G-beta repeat
  misc_feature (93)..(130): Pfam Name: WD40 Pfam Description: WD domain, G-beta repeat
  misc_feature: SWISSPROT Homolog: EC 2.7.11.7 [Myosin heavy-chain] kinase
MEKKKVAIPLVCHGHSRPVVDLFYSPVTPDGYFLISASKDTNPMLRNGETGDWIGTFQGHKGAVWSCCLDRNALRAASASADFSAKVWDALTGDELHSFEHKHIVRACAFSEDTHLLLTGGMEKTLRVYDMNRPDAAPRELDKSPGSVRTVAWLHSDQTILSSCTDMGGVRLWDVRTGKIVQTLETKASVTSAEVSQDGRFITTADGSSVKFWDANHFGLVKSYDMPCNVESASLEPKSGSKFVAGGEDLWVHVFDFFTGEEITCNKGHHGPVHCVRFAPGGESYASGSEDGTIRIWQLSSPNADDSEAANGKATAGVNEVTTKIEGFHIPKEGQTEG

SEQ ID NO: 14513 - DNA, 1399 bp, Panicum virgatum
  misc_feature: Ceres CLONE 1776991
  misc_feature: Encodes the peptide sequence at SEQ ID NO. 14514
aagctgctccagaactggcttcattgaagaaggcctcggttgacacttgacaccaggtagctgtccctctatccatcccctttacttcgtctcccaactcaaccattctccctgtgtcatcaccagcaacaggtaattctcccaactcacccaaaataattctcttgagctgtgttgcctttgtctgtgtgatactgtgatggatagataagctacttcagaagtgactgcttcaaaagtgatgtgggcgggggcggggtctgttatttggcagtctaatggatggattaaactactggcctactgcagaagtggtgctgtgctagatgttcgtacatacatagtactgatgcagtgatgcaatgcactgatagttaggatgctttgcacattttcataccggcttgttctgttttctttcagtcttcgagaaactccacctcagaaacgaaataaacaaaacaagtaaaggattagcttcttgtattgtgtatgcactgaatctcgaactcctcactgagtacaggaagatgggctcgttagatgccacacgagctgaactcggcctcgttgttctgtacctgaacaaagccgaggctagggacaagatctgcagggcgattcagtatggctcaaagttcataagcaacgggcagcccggcaccgcgcaggatgtcgatagatcgaccaccttggctcgaaaagttttccgtcttcctcagtgggtcaatgatcttcatgctcttatcagcccgcctgctaaagggactcctctcacacttgtcctgcttggcaagtccaaaaacgcgctgctttcgacgttcttattcctggatcaatttgtgtggttaggacgaacaggaataatcaagaacaaggaggcgacggaccgggttgccaggatatccctctactattggatggcttcttctgcctgcgctagtctagtggagcttggagagcttaagcggctatcgaaatcgatgaggaagcttgcaagagagctgaggcacactgataaatacgagaacgaacagtaccagaacaaaatgaagcagtcggatgagcggctcctggccctggtgaaggcggccatggacgtggtcgtggccatcgggcttcttcagctggcacccaagaaggtcacccccagagtgacgggagctctcggattcgtcacctcgctcatctcctgctatcagcaactcccttcccgtggccccgcggccaaagtcaaggcgtgagatgggtccgggtcctccctactatggaagtagccgtcgctggaaattgagatagctatacttgagcatggaccgcacgataataatgtgtatatatatacgtatgtgccagtgtagaatacatggggtggcagtgctcctggctttatgctttc

SEQ ID NO: 14514 - protein, 237 aa, Panicum virgatum
  misc_feature: Ceres CLONE 1776991
  misc_feature (11)..(226): Pfam Name: PEX11 Pfam Description: Peroxisomal biogenesis factor 11 (PEX11)
MGSLDATRAELGLVVLYLNKAEARDKICRAIQYGSKFISNGQPGTAQDVDRSTTLARKVFRLPQWVNDLHALISPPAKGTPLTLVLLGKSKNALLSTFLFLDQFVWLGRTGIIKNKEATDRVARISLYYWMASSACASLVELGELKRLSKSMRKLARELRHTDKYENEQYQNKMKQSDERLLALVKAAMDVVVAIGLLQLAPKKVTPRVTGALGFVTSLISCYQQLPSRGPAAKVKA

SEQ ID NO: 14515 - DNA, 2412 bp, Panicum virgatum
  misc_feature: Ceres CLONE 1776998
  misc_feature: Encodes the peptide sequence at SEQ ID NO. 14516
aaccgacggggcgaggcgaggatgcgagctctcgcggcagcagcaactgcagtggcggcgcctactcccgcgcgcctccgtctccgcctcccgctcgcgccccgcgccccgcgctccggtcattgtagagcagcttcttcctccaggcttctgcggatctcctgcagcgccaccaccatgggagacgagacctcgacctccgttcctgcccaggagcagggacctgctgtgggtgctgggagtgtcaagcaacagctctccaagctggtcatttcatccctccgggctacggtgcctgaagtggaggtagaaccgatggttgaagtttcagcaaagtttgctgactaccagtgcaacaatgctatgggattatggtcaaagattaaaggatctggaaccagtttcaaaaaccctaatgctattggacaggccattgcaaagaacttgccttcctctgacattattgagtccacatctgtcgctggacctggttttgtgaatattactttatcgaaccgctgggttgctaagagaatacaagatatgcttgtcaatggtattaatacttgggcacctattctgccagtaaagagggcagtgattgatttttcgtcacctaacattgcaaaggaaatgcatgttggacatttaaggtctaccataattggagatacattagcacgcatgtttgagttctcaaatgttgatgttctgaggcgaaaccatgtgggagattggggtacacagtttgggatgctcatagaatatctgtttgaaaaatttccaaattggcaggaaataggtagccaggccattggtgacctccagattttctataaagcatccaagcataggtttgacaatgatcaagagtttaaagagagggctcaacaaggagttgttcggctacagggaggggaggagaaataccgagaagcatggaaaaagatttgtgacatcagtaggagcgaatttgacttggtgtacaagcgcctaaacgtggagcttgaagaaaagggggagagtttctacaatccttatatacctaaggtgttggcggagttgagtagcaaaggattgatccaggagagtgagggtgctcaagtaatatttatcgaaggttatcagatccctttgatagtggttaaaagagatggtggcttcaactatgcctcgacagacttagcttctctttggtatcggctcaatgttgagaaggcagaatggataatatacgtgacagatgttggtcagcagcagcacttcgaaatgtttttcaatgctgcaaagatggctggttggctcccagatccaaaggaaaagaagtatccaaaaacgagtcatgttggatttggccttgttcttgggtcagatggcaagcgcttccgcactcgtagtactgaggttgttcgattggtagagctgcttgatgaggctaaatctcggagtaaatcagaactactgcagcggctcactgaaaatggtaaaattgttgactggacggatgaggaattagaacaaacttcagaggcagttggatatggtgctgtgaagtatgctgatctgaagaacaataggctgaccaattacacatttagttttgaacagatgcttagcgataagggaaacactgctgtgtaccttcagtacgctcatgctcgcatttgttccattattcggaaatcaaacaaggatctggaagagctgaaaatgagcggagccatttctcttgaccatccagatgagcgtgtcttggggctgtatctgatccgatttgcagaggttgttgaagaggcttgcacaaatctccttccaaatgttgtgtgtgaatacttgtacaatctatcagaaatgttcacaaaattctataccaactgtcaggtggttgggtcaccggaggagacgagccggctactgctttgccaagcgactgctgttgtcatgcgtcagtgctttcagctgctcgggattacgccagtctacaagctgtgagcagcggtgctctcaattcatcttcaccaatcagttcacgtagaaaccttattcaccatggttgcagttttggtcttgtaacctagtcgagtcagctaacatactcttatccactgccccgttcgaaagcagaagggacacaagctgtagctaaattgatctcgtgcattatttattacgtctgtcgcgtggttggcagcttatttgtcgatgatgtatgtaagtgtgatggggagctgagtagccgaacctgcggttcttacgttttggtggtggagcgattggctaccaggtaagggtttggtggagtaaccgcatcaattgatactgtaacttttttattttcacgtccgaagcatgtaaggttgcgtattcttgaatagacaatcctcagatccaggccgaacttatctagatgcg

SEQ ID NO: 14516 - protein, 604 aa, Panicum virgatum
  misc_feature: Ceres CLONE 1776998
  misc_feature (119)..(475): Pfam Name: tRNA-synt_1d Pfam Description: tRNA synthetases class I (R)
  misc_feature (489)..(604): Pfam Name: DALR_1 Pfam Description: DALR anticodon binding domain
  misc_feature (25)..(111): Pfam Name: Arg_tRNA_synt_N Pfam Description: Arginyl tRNA synthetase N terminal domain
  misc_feature: SWISSPROT Homolog: EC 6.1.1.19 Arginine--tRNA ligase
MGDETSTSVPAQEQGPAVGAGSVKQQLSKLVISSLRATVPEVEVEPMVEVSAKFADYQCNNAMGLWSKIKGSGTSFKNPNAIGQAIAKNLPSSDIIESTSVAGPGFVNITLSNRWVAKRIQDMLVNGINTWAPILPVKRAVIDFSSPNIAKEMHVGHLRSTIIGDTLARMFEFSNVDVLRRNHVGDWGTQFGMLIEYLFEKFPNWQEIGSQAIGDLQIFYKASKHRFDNDQEFKERAQQGVVRLQGGEEKYREAWKKICDISRSEFDLVYKRLNVELEEKGESFYNPYIPKVLAELSSKGLIQESEGAQVIFIEGYQIPLIVVKRDGGFNYASTDLASLWYRLNVEKAEWIIYVTDVGQQQHFEMFFNAAKMAGWLPDPKEKKYPKTSHVGFGLVLGSDGKRFRTRSTEVVRLVELLDEAKSRSKSELLQRLTENGKIVDWTDEELEQTSEAVGYGAVKYADLKNNRLTNYTFSFEQMLSDKGNTAVYLQYAHARICSIIRKSNKDLEELKMSGAISLDHPDERVLGLYLIRFAEVVEEACTNLLPNVVCEYLYNLSEMFTKFYTNCQVVGSPEETSRLLLCQATAVVMRQCFQLLGITPVYKL

SEQ ID NO: 14517 - DNA, 1666 bp, Panicum virgatum
  misc_feature: Ceres CLONE 1777004
  misc_feature: Encodes the peptide sequence at SEQ ID NO. 14518
actgctgcacttgcaacgcaacgccgacgccgagacaaagcaaaaagcatgcagccggcccggccggccgcctagccgcgcgctgcccgctgcttataaaatagctagaattagtagtacatgcccaccagcttcagttgtgctagctgctcatctctagccttgttgattggtagctgatcgagtgctagctgctgctgaccactagagcagcagcagaaggaggaggagatcatcagctcgatcatcatccacatgggttcctacgtccaaggtattatatctatcgatctatatatataattgcttctttcccgcatcatatccatcctgcttgctacctaattgcatatatatgcttgcttcctatactgatcgattttgttttcttttccgaaacaacaaaacaaaacaaaacaatacatgaacaggcgataacgatgaggcagtcccggtctatcaatctggcgctgaggtcctgcagaagctgcaggagaaatgccaggcggcggcggcggccatgtactcgagcgtggtgggcggcatcatcctggaccctgccatgatggtcctcccggtggacgaccacatggtccaccgcgggcacggcgtgttcgacaccgccatgctcctggacgggtgcctgtacgagctggacccgcacctggaccgcttcctccgctccgccgcccgggcccggatcgccgcgcccttcccgcgcgccacgctgcggagcatcctcatccagatgaccgccgcctccggctgccgcaagggctccatccgctactggctcagcgccgggcccggggacttcctgctctcccccaagggctgcccgtcgccggccttctacgcggtggtcatcccggcggactacgagcagtgccgcggcggcgtgcgcgccgtcaccacgtcggtgcccatgaagccgccgctgttcgccaccaccaagaacgtcaactacctgcccaacgtgctgtccatcatggacgccgaggaccgcggcgccttcgcctccgtgtgggtggacgagcaggggcacgtcgccaaggggcccatggtcaacgtcgccttcgtcaccccgggccgcgagctcgtgctcccggagttcgacaggatcctcagcggctgcacggccaggcgcctcctcgcgctggcgccgaggctcgtggaggacggccggctggcggcggtgaccaccaggaacatcacggccgaggaggccaagcgcagcgtggagatggccttcgtcggaagcgggctgcccgtgctgcccatcgtggagtgggacgaccagcccatcggggatgggaaggttggagagctgatgctggcgctgtcggatctgctctgggaggacatgaagtccggcccggacaggatcgccgtcccctacaattaattaatggttaattaatcaagcagtgcggcctccgacaaattaaactacctactctaaattaataagcaatagctatgcctgcatcctggtggctgcttgtgtgtgtgtatgatgggtggggatgggaagcaagctccatgccatatatattgttgtatgctgtgttcggttggctgtggctggtagttggtgctaatttgttgtcaaagaaaaataatattggctggctgctggctagtggccgatgctgatttggtgtgg

SEQ ID NO: 14518 - protein, 294 aa, Panicum virgatum
  misc_feature: Ceres CLONE 1777004
  misc_feature (7)..(279): Pfam Name: Aminotran_4 Pfam Description: Aminotransferase class IV
  misc_feature: SWISSPROT Homolog: EC 2.6.1.21 D-amino-acid transaminase
MYSSVVGGIILDPAMMVLPVDDHMVHRGHGVFDTAMLLDGCLYELDPHLDRFLRSAARARIAAPFPRATLRSILIQMTAASGCRKGSIRYWLSAGPGDFLLSPKGCPSPAFYAVVIPADYEQCRGGVRAVTTSVPMKPPLFATTKNVNYLPNVLSIMDAEDRGAFASVWVDEQGHVAKGPMVNVAFVTPGRELVLPEFDRILSGCTARRLLALAPRLVEDGRLAAVTTRNITAEEAKRSVEMAFVGSGLPVLPIVEWDDQPIGDGKVGELMLALSDLLWEDMKSGPDRIAVPYN

SEQ ID NO: 14519 - DNA, 1913 bp, Panicum virgatum
  misc_feature: Ceres CLONE 1777007
  misc_feature: Encodes the peptide sequence at SEQ ID NO. 14520
aggaggagcgcatcccatcccatccgatccccaagccacgaggcccggccgacgacgaggtatgaatgccaccacgtgtgtgcagaactcatttccttgcacctgccggtttgttgccttgttcgtcaaagcaaaagcttcttccttcccgttcaatccacaggtctggctagctacctcccgggctgccgcttccttcttccctaatcggctaatccccttcgcctgctctgcctccttctgattcagccccttcctttccatcctcgtgtctcctctgctatgggcttcgatagacagggctccctgctggctccaatcgacatgctcttgttcctctcccatgggcaaccatagcatttgttcttcctcccacccccaaaatcccctcttttttcgcagttcttcgtctatcctcttcacggtctgttgaattaggtgaagctctcgcatttttcaacgatttctcaccgatggggtgcttcgccttcagaagcggcaagggcaggtccaagagccagccggcccccggcgccaagacggcgccggccaagtcgcccccggcgtccgactcctccggtggcgtcgggcagaggagcaaggcctcgtccgcatcggcgtccacgcccaccaggagcatccaggagctgtccgaggagcggggcgcgcagcggctgcgggtgttcgacctcgacgagctccagagcgccaccaacggcttcagccgcgcgctcaaggtcggcgaggggggcttcggctccgtctaccgcgccttcttccgctccgccggcggcggccgcgtcgtcctcgccgtcaagcgcctcaaccagcgcagccttcagggtcacaagcagtggctggctgaagtccaattcctgggtgttcttgagcacccgaatctcgtaaagctgatcggctactgtgcagtggattcagaagcaggcaatcacaggctgctggtctacgagttcatgcccaacaagaccttggatgaccacctgttcaaccgagctcatcctcccctttcatggagattgaggctgcagatcatgataggcgctgcacggggcctggattatctccatgaaggagtgccggaagttcaggtgatctacagggattttaaagcatccaacattcttctcgacgccgaattcaagccaaaactgtcggattttggcctggcaagggaggggccgaccgaaggcaaaacgcacgtctccaccgcggtggttgggacgcacgggtacgcggcgccggactacatcgagacggggcacctgacgacgaagagcgacgtgtggagcttcggcgtggtgctgtacgagatcctgacggggcggcggtcgctggagcggagccgccccgcggaggagcagaagctgctggcttgggtgcggcggcacccgccggacggcggcgggttccgggccatcatggacccgcgtctgggcgggcggtacccgctggccgccgcgcgcgaggtggccaggctcgccgaccggtgcctcggcaagaaccccaaggagcgcccggcgatgagggacgtcgtcgaggacctcgagcgggtgctgcagatggagcccccgccgccgcccgccgacaagaaaggaggcgatggcaggccgccgccgtcggtcaagaggtgacgacggcgtttgcgtttggggctgaaacaccggcgccggattttccaaattccaagtttgttttttttttctctctcgcaaacacatgtattaagcaggagagaaaaaaagtttgtgtgtatatagaagatagaagattaccctattattatatagagaccataagcgcaccaaaatagaagatgttcaggtttaaaacagacaatttctctatcaggattcagaaaggctatacatatatgaagacagatgaattgaacaggc

SEQ ID NO: 14520 - protein, 391 aa, Panicum virgatum
  misc_feature: Ceres CLONE 1777007
  misc_feature (83)..(363): Pfam Name: Pkinase Pfam Description: Protein kinase domain
  misc_feature: SWISSPROT Homolog: EC 2.7.11.1 Non-specific serine/threonine protein kinase
  misc_feature: Useful for making plants with modulated heat sensitivity
MGCFAFRSGKGRSKSQPAPGAKTAPAKSPPASDSSGGVGQRSKASSASASTPTRSIQELSEERGAQRLRVFDLDELQSATNGFSRALKVGEGGFGSVYRAFFRSAGGGRVVLAVKRLNQRSLQGHKQWLAEVQFLGVLEHPNLVKLIGYCAVDSEAGNHRLLVYEFMPNKTLDDHLFNRAHPPLSWRLRLQIMIGAARGLDYLHEGVPEVQVIYRDFKASNILLDAEFKPKLSDFGLAREGPTEGKTHVSTAVVGTHGYAAPDYIETGHLTTKSDVWSFGVVLYEILTGRRSLERSRPAEEQKLLAWVRRHPPDGGGFRAIMDPRLGGRYPLAAAREVARLADRCLGKNPKERPAMRDVVEDLERVLQMEPPPPPADKKGGDGRPPPSVKR

SEQ ID NO: 14521 - DNA, 1602 bp, Panicum virgatum
  misc_feature: Ceres CLONE 1777016
  misc_feature: Encodes the peptide sequence at SEQ ID NO. 14522
gaagaggtgataacaattgcgcggccacccgctcccgccgtgtggcgctcgtctaacacgacgcgaacggtttcgatcacagccgccacccaggcgtgagcgcgaacgcgggccacgaacgccgcgccccatcccgattcccacccagcgcgcgagccatggccgccgccgcaacagcagcagccggaggcctcgtccacctccggcctccgcagtccgccgcgcctcgcttcggcgcctcccgcgcgccgccgctccgctcgcggaggccgggccagcaccagcggcctcgccgccacggggccgggcgggtctccgcgcggtcggtcgcggtcggggaggcggcgtacgcggaccctgaggcggcgctcctcgaggccctcctcggcgtccaaggccgcggccgcgccgtcgcgccgcggcagctccaggaggtggagagcgccgtgcaggccctcgaagtcctgggaggcgtgcctgatccgacaagttcaagtttaattgaaggtagctggcagctcatcttcactacgagaccagggacagcatcccctattcagcggacttttgttggagttgactctttcaggatcttccaggaagtttacctccggacagatgatccaagggtggttaatgttgtacggttttcagaatcagttggtgatctgaaagtagaggcagaagcaactattgaggacggaaagcgcattcttttccgttttgaccgagcagcattcaccttcaaatttctgccattcaaagttccatacccagtgccatttaggcttcttggagatgaagcaaagggttggcttgacacaacatacttatcccatgctgggaacatacgtatttcaaggggaaacaaaggaaccacatttgtcctacagaagagtccagatgcaaggcaaattttgttgtcaactatatctgcagggacaggagtagaagaggtcattgatgattttatttcaagccaaaatggagctgaagttgatctggacattctggtgggagaatggcaactactgtggggcacacagactgaaggtgaaagttggtcaactcttgcgtctaccggtctcaaggacttccagattataaaagaaggcggccaattgaagaattcagtgagcccgtttccaggcgttagcctcagtgcaagaggcaacatttgcaaaacagggaataacaatacctttagcgtgtccatgaaggaaggagctattcgatttggtggtgtgcagtttcccttggatgctgaaggagaatttgtcatggaaatcttgtacatcgacaacaagataaggatatctaggcttaaccagcacattctagtccacttgcgcgtcacaaatgcagcataaacaacataatgaaggatatgtggccatgttttttttatcattgttgagtacagcttgaatcaatatgattagtttgagcaatataattttgatttctaagattgttcattggtgtacagctaaccatagtaaagcaaaactcagattggtgtattctgtgtctgcatgatttacatgtactcaaaacgtttctcaaaaatatggaaccacagtccacagttgagcattttcc

SEQ ID NO: 14522 - protein, 403 aa, Panicum virgatum
  misc_feature: Ceres CLONE 1777016
  misc_feature (65)..(245): Pfam Name: PAP_fibrillin Pfam Description: PAP_fibrillin
MAAAATAAAGGLVHLRPPQSAAPRFGASRAPPLRSRRPGQHQRPRRHGAGRVSARSVAVGEAAYADPEAALLEALLGVQGRGRAVAPRQLQEVESAVQALEVLGGVPDPTSSSLIEGSWQLIFTTRPGTASPIQRTFVGVDSFRIFQEVYLRTDDPRVVNVVRFSESVGDLKVEAEATIEDGKRILFRFDRAAFTFKFLPFKVPYPVPFRLLGDEAKGWLDTTYLSHAGNIRISRGNKGTTFVLQKSPDARQILLSTISAGTGVEEVIDDFISSQNGAEVDLDILVGEWQLLWGTQTEGESWSTLASTGLKDFQIIKEGGQLKNSVSPFPGVSLSARGNICKTGNNNTFSVSMKEGAIRFGGVQFPLDAEGEFVMEILYIDNKIRISRLNQHILVHLRVTNAA

SEQ ID NO: 14523 - DNA, 713 bp, Panicum virgatum
  misc_feature: Ceres CLONE 1777021
  misc_feature: Encodes the peptide sequence at SEQ ID NO. 14524
ccagtagcagagcagcagcagcagctgaatccagcggggcatggcggccaagggcgccgcgccggcggtggcgctgagcagcggccaccggatgcccgcggtggggctgggcgtctggcggatggagaagcccgccatccgcagcctcgtccactccgcgctccgcatcggctaccgccacctcgactgcgccgctgactaccagaatgaagctgaagttggtgaggcacttgcagaggcattccaaactggacttgtcaagagggaggatctgttcatcacaaccaagctatggaattcagatcacggtcatgtaattgaagcctgtaaggatagcttgaagaagctgcagctagattatcttgatctctatcttgttcacttcccagtagctactagacatactggagttggtacaacttcgaatgctcttggtgatgatggtgtgcttgacattgataccactatctcattagaaacaacatggcatgcgatggaagaacttgtttctatgggactggtccgcagcattgggatcagcaactatgacatcttcctcaccagagactgcttggcctatgctaagataaagcctgcagtgaaccaaattgagacgcacccctacttccagcgtgattcgcttgtcaagttctgccagaagcatgggatctgcgttacagcgcacaccccccttgggtagttccactgccaat

SEQ ID NO: 14524 - protein, 219 aa, Panicum virgatum
  misc_feature: Ceres CLONE 1777021
  misc_feature (12)..(219): Pfam Name: Aldo_ket_red Pfam Description: Aldo/keto reductase family
  misc_feature: SWISSPROT Homolog: EC 1.1.1.200 Aldose-6-phosphate reductase (NADPH)
MAAKGAAPAVALSSGHRMPAVGLGVWRMEKPAIRSLVHSALRIGYRHLDCAADYQNEAEVGEALAEAFQTGLVKREDLFITTKLWNSDHGHVIEACKDSLKKLQLDYLDLYLVHFPVATRHTGVGTTSNALGDDGVLDIDTTISLETTWHAMEELVSMGLVRSIGISNYDIFLTRDCLAYAKIKPAVNQIETHPYFQRDSLVKFCQKHGICVTAHTPLG

SEQ ID NO: 14525 - DNA, 744 bp, Panicum virgatum
  misc_feature: Ceres CLONE 1777027
  misc_feature: Encodes the peptide sequence at SEQ ID NO. 14526
gcactggtttaggttttgcgcggtggcagtgaggccttgaagctagggttaggatccccgggcggcggagggatggacaagaagaaggcggcggtgccgctggtgtgccacggccactcgcggccggtcgtggaccttttctacagccccgtcacgcccgacggctacttcctcatcagcgccagcaaggattcaaatccaatgcttcgcaatggtgagactggagattggattgggacatttcaaggccacaaaggtgctgtttggagcgcttgtcttgacaccaatgctctgcgtgctgcctctggttccgctgacttctcagcaaaaatatgggatgcgctgacaggcgatgtgctgcactccttcgaacacaagcacattgtccgtgcatgtgctttttctgaagatacccacatgttgcttactggaggtttcgagaagattttgcggatatatgatttgaaccgtccggatgcagctccaagagaaattgagaaatcacctggttctgtcagaactgtcacttggcttcatagtgaccaaactatactaagttcctgcacagatatgggtggtgtgaggtttgtctggatgtaccattaactgtattaatttttagctctagattttccctttgtattccctattgtgattagtgctgccacgtagaaattgattttatatacaaaataggcatgctgaagtgctgaacgcttattcagattgctaggcataattggc

SEQ ID NO: 14526 - protein, 177 aa, Panicum virgatum
  misc_feature: Ceres CLONE 1777027
  misc_feature (51)..(89): Pfam Name: WD40 Pfam Description: WD domain, G-beta repeat
  misc_feature (92)..(130): Pfam Name: WD40 Pfam Description: WD domain, G-beta repeat
MDKKKAAVPLVCHGHSRPVVDLFYSPVTPDGYFLISASKDSNPMLRNGETGDWIGTFQGHKGAVWSACLDTNALRAASGSADFSAKIWDALTGDVLHSFEHKHIVRACAFSEDTHMLLTGGFEKILRIYDLNRPDAAPREIEKSPGSVRTVTWLHSDQTILSSCTDMGGVRFVWMYH

SEQ ID NO: 14527 - DNA, 679 bp, Panicum virgatum
  misc_feature: Ceres CLONE 1777027-R
  misc_feature: Encodes the peptide sequence at SEQ ID NO. 14528
cggtttatcacaacaactgatggctcaagtgtgaagttttgggatgcaaatcactatggacttgttaagagctacaatatgccatgtgcagtggagtcagcttctcttgaaccaaagtatgggaacaaatttgtcactggtggagaagacatgtgggttcgtgtcttcgatttcttcactggagaagaattagcatgtaacaaggggcaccatggcccagtccactgcgtccgattctccccagttggcgaatcttatgcatcagggtcggaagatggcaccatccgaatctggcagctgggcccagctaccagcgaagagcaggaggctgcaaacgcaaacgggaagacgaaggttgaggtaaatgatgccgcgcgcaagattgagggcttccacattcccagggacaggcaggcagaggggtcgtgaatttgtgatgctgatgcaccacttcacgctgggagactgctgttgtcaaatgctctgcgggtggtctgttgtaatacgggggggtttcatgtagcaacactgggatgaaatggtgaaattttgtaggggggcggtatcctaactctcagtggcatcgagttcgaaaaaaaaaaatcccagttgcatgcagtacacagtcgggacagtttttctctcctctctcactgaaagagtagcaagttgaaatgtt

SEQ ID NO: 14528 - protein, 142 aa, Panicum virgatum
  misc_feature: Ceres CLONE 1777027-R
  misc_feature (61)..(99): Pfam Name: WD40 Pfam Description: WD domain, G-beta repeat
  misc_feature: SWISSPROT Homolog: EC 2.3.1.48 Histone acetyltransferase
RFITTTDGSSVKFWDANHYGLVKSYNMPCAVESASLEPKYGNKFVTGGEDMWVRVFDFFTGEELACNKGHHGPVHCVRFSPVGESYASGSEDGTIRIWQLGPATSEEQEAANANGKTKVEVNDAARKIEGFHIPRDRQAEGS

SEQ ID NO: 14529 - DNA, 3492 bp, Panicum virgatum
  misc_feature: Ceres CLONE 1777029
  misc_feature: Encodes the peptide sequence at SEQ ID NO. 14530
gatccaccatttgccaagaaacccaccaaactcaaaaacgatatggaacaataactaaccaaccacctctactgcaacctagtaccttccttctcccttggcgtgcctctgcagcaagctgtggttttttatggcttttagctttggctacagattgaattgacgagtacaagtgggatgggcgaagcagctgattatttctgatcgcactcatttgtttgagcaatttcacggatcgaccaaagagcaaggatatcgtgtccttgcggacaacttcagcttgggcaggataccacaggaagctcatcgccctcagcaagagcaagcacatcaagcagaggaattagttggagagtttagctgagcgagatggcggcagctgccgtggtgagcatctccatgggggtcatgaagcccgtcctggccaagctcaccaccctcatgggtgatgagtacaagaagctcaagggcctgcgcaaggtggtgatcttcctccagcgtgagctcagagacatggatgctctccttgagaagatggacctcgccgatgaacttgacccacaggccaagaattggaggaaagatataatagagatgtcctatgacatcgaagaccgcattgacgacttcatgcaacgtgttggtgaagctgacaacaaggtggggatccttcggaaagcttatgagtatctgagaactttcttggatcgtcgccagctagcaaatcagtttgacgagatcaagaccaaagtaatggaagcaagtaaacgccgaaagaggtacatgcttgatcagtccatctcaattactgcccctgtagctgttgatcctcgcttatcagttatctacaaggactctgcgagccttgtgggcattgatgcccaaaaaaatgagcttgtcaattgggcaatggacaaagggcaacaattaaaggtgatggcgatagtaggatttggaggtttagggaagaccacactagccaatgaggtgtaccgcgaagtgggagggaagtttgacagcaaggcatttgtgtccgtttctcaaaagccagagatgatagggctattcaacagcttgctatcgcaacttggcctaggcccatatcctcatgcttgccagctgcaagatccaatcaacaaactcagagagcatctacagaataagaggtacttcatcataattgatgatttgtgggataaacaagcgtgggatgtcattcaatgtgctttcccaccaaataatcagtgtagtagagtaataataactacacgaaatgagaatctagccggatcatgttgcggcaatgaccatggatgcattcataatatgaagcctctaagtgagcaagactcaaagaagctcttctttggtagaatatttggatctgaagatgcttgtccttctgagctcaggaatgcttcatctgaaattttgaagaagtgtaatggtctaccccttgcaattattacaatggctagtatgttatcttgccaaccaaaaatattggaaggacagtgggagtatatccataattcactagccactaagtttgcaacaaactccaactatgaagacatgatgtacatcttagacctcagctacaagaatctcccccgtcatctgaaggcttgctttttgtatctcggctcttacccagaagaccatgaaatcagtaggactcagctagttaggcgatgggtggcggaaggttttgtgagtgactctagtgggcaagatgtatgggatgttgcggagagttatttcaacgagctggtcaacaggagcatgattcaacctttatatcatcttcccaatttgaggatatggggctgcagagtgcatgatatgctacttgaattggttgtaaagagatgtaaggaatataattttctgagtttggtaaatgatctacaagcggtggtacaagtgcaagacaaggccattcgtcgactcaacgttgttggcttgcgaggtgcagaggttgatacagtggctgtaaccactgctgtgaattacctagcacagattcgttcgcttagcatgctaggacaatcaaattgggtaccttcgttgctggagtttaagtttgtgagggtgttatcccttgctattaatggtagggctgagatgccggtggacctgactattatcaaccagttgtcacagctgagatacttaaaggtactaggaattggtaaaagtataataataccttgtcaaattcgggggttgcgacttttggagactttggatttatctggtttattcttctgtagcatttcattagagattgttgatatgccacggttgtcccatctgacggtgccacatggtacgagattgcctgaccggattggcaaggtaaaatcactgcgcactttgcatgactttatgctgccaatggactcgttggagggtattataggcctgggcgagctcaccgctctgtcagatttgaatttgtctctccccaatggagggtgtacagggttgtcgaaggctgcatggatgacagctctaagcacttgtcttgataaacttggtaacctcaaacaactacgtgtaagtccttttgatgtcttcaaacaagttgttgccctgcgcgctgatgcactgagctcactttcccctcccttctgcaacctcgagctgcttgatctgggatatgtatgcaccttccctcgagttcctaggtggatcgaccatctccataacctttgtgagctgttcattggggcgaagcaagtactccaggaagatgttgccgtcattgggacaaggctgtcgtctctcatctgcctcagcctgcggatcccaggcgtcccgacggaaaggatcgtgataggaggctccacgggattcccagttctccaagggtttggtttcgactgcgatggtatgtcgttcctggcgtttgaagcaggggcgatgcctgcgctccgagagctaaagttggtcttggatgcacacgaatgggacaaggcagcacctgccgggctccaccatctcctgagcctcgagaaaatcacaacaaagcgggcgcgctacgggggcaaacggcagaggcttaccgcaactggtgaagatgacactgcgctgatcaggagcgtgttccaggaagctgctgacactctccccacacgccctgaattcgaactcggcccacagaaaatcagacccctggaggaggaggactaattggatggatgattgaggcgcaggatcttcacccaatataaatcaataaccccggcatagcacaggctccctggccagttgcccaaatatatgtcaccgcttacatcgagttgttatccatgtgttccgtccaccataatcgagcctgagtctagtccttggtggttgtactagtctatctttttttttaaaaaaaaataacttctcaaccctccatttttatcatccaaattgtgcgtagggctccttcctttgtaatgcaacatccttcttacaatgcaacatccttcttac

SEQ ID NO: 14530 - protein, 942 aa, Panicum virgatum
  misc_feature: Ceres CLONE 1777029
  misc_feature (151)..(454): Pfam Name: NB-ARC Pfam Description: NB-ARC domain
MAAAAVVSISMGVMKPVLAKLTTLMGDEYKKLKGLRKVVIFLQRELRDMDALLEKMDLADELDPQAKNWRKDIIEMSYDIEDRIDDFMQRVGEADNKVGILRKAYEYLRTFLDRRQLANQFDEIKTKVMEASKRRKRYMLDQSISITAPVAVDPRLSVIYKDSASLVGIDAQKNELVNWAMDKGQQLKVMAIVGFGGLGKTTLANEVYREVGGKFDSKAFVSVSQKPEMIGLFNSLLSQLGLGPYPHACQLQDPINKLREHLQNKRYFIIIDDLWDKQAWDVIQCAFPPNNQCSRVIITTRNENLAGSCCGNDHGCIHNMKPLSEQDSKKLFFGRIFGSEDACPSELRNASSEILKKCNGLPLAIITMASMLSCQPKILEGQWEYIHNSLATKFATNSNYEDMMYILDLSYKNLPRHLKACFLYLGSYPEDHEISRTQLVRRWVAEGFVSDSSGQDVWDVAESYFNELVNRSMIQPLYHLPNLRIWGCRVHDMLLELVVKRCKEYNFLSLVNDLQAVVQVQDKAIRRLNVVGLRGAEVDTVAVTTAVNYLAQIRSLSMLGQSNWVPSLLEFKFVRVLSLAINGRAEMPVDLTIINQLSQLRYLKVLGIGKSIIIPCQIRGLRLLETLDLSGLFFCSISLEIVDMPRLSHLTVPHGTRLPDRIGKVKSLRTLHDFMLPMDSLEGIIGLGELTALSDLNLSLPNGGCTGLSKAAWMTALSTCLDKLGNLKQLRVSPFDVFKQVVALRADALSSLSPPFCNLELLDLGYVCTFPRVPRWIDHLHNLCELFIGAKQVLQEDVAVIGTRLSSLICLSLRIPGVPTERIVIGGSTGFPVLQGFGFDCDGMSFLAFEAGAMPALRELKLVLDAHEWDKAAPAGLHHLLSLEKITTKRARYGGKRQRLTATGEDDTALIRSVFQEAADTLPTRPEFELGPQKIRPLEEED

SEQ ID NO: 14531 - DNA, 759 bp, Panicum virgatum
  misc_feature: Ceres CLONE 1777033
  misc_feature: Encodes the peptide sequence at SEQ ID NO. 14532
agcgctggcatcactcggagccttgcctctgtaggtagagagtgtgttgtttgcagggggaagaagggaagagggcaatggcgacctccttccaggggacgaccaccaagtgcaccgcctgcgacaagacggtgtacctcgtcgacaagctcaccgccgacaaccgcgtctaccacaaggcctgcttccgctgccaccactgcaagggaaccctcaagcttgcgaactacaactccttcgagggggtgctctactgcaggcctcacttcgaccagctgttcaagaggacggggagtctggacaagagcttcgaaggaacccccaaggttgtcaagccagaaagaaagaatgaggtatgcaacaaactgtgattcatgctttgcagagtagaagcaggtcgagtaaatgttaaactgcactgtttttttcagtaattaaggtacacagggaaaaaaaacagtaggcatttgaatcattcatcataatatatgcagaggaactcaaatctgaagtgaccatagatctagtccatgcaaatgcacagtagtgagaagaagggtgagataaataggcactcagagcttgatgaatgacgcatggatctgaagagagtaagtctagctagtaagaagtgacatataggaagaaggaaaatattgataaaaccttggccccctgaaatagatcactatatcagtggtataggttttcatgtttcataccatacagttggcactattcatcctttggtctttatga

SEQ ID NO: 14532 - protein, 97 aa, Panicum virgatum
  misc_feature: Ceres CLONE 1777033
  misc_feature (12)..(68): Pfam Name: LIM Pfam Description: LIM domain
  misc_feature: SWISSPROT Homolog: EC 2.7.11.1 Non-specific serine/threonine protein kinase
  misc_feature: Useful for making plants with altered carbohydrate content
  misc_feature: The sequence is a functional homolog of SEQ ID NO 1308 in the 11/479,226 US patent application
  misc_feature: The sequence is a functional homolog of SEQ ID NO 612 in the 10/412,699 US patent application
  misc_feature: Useful for making plants with modulated heat sensitivity
  misc_feature: The sequence is a functional homolog of SEQ ID NO 428 in the 10/412,699 US patent application
  misc_feature: The sequence is a functional homolog of SEQ ID NO 616 in the 11/435,388 US patent application
  misc_feature: The sequence is a functional homolog of SEQ ID NO 992 in the 11/479,226 US patent application
MATSFQGTTTKCTACDKTVYLVDKLTADNRVYHKACFRCHHCKGTLKLANYNSFEGVLYCRPHFDQLFKRTGSLDKSFEGTPKVVKPERKNEVCNKL

SEQ ID NO: 14533 - DNA, 632 bp, Panicum virgatum
  misc_feature: Ceres CLONE 1777033-R
gatgctcaattattgatgattgacaacagtatctgaattcacattcgtgactcatacaaatgtgtttaaaaaaataatagaaagtctattcatgaagacagcatttgctgcatttccatgttggaagcttgattcttgatactttctgctgaaatgtaagaaaggtgacaggcatatcgtacctcttgagtattaatttgcatgataacaacactcacaccaattcttcaggtaactgtcaacaacactatgtatcacaagagctgcttcaagtgctgccatggaggatgcaccatcagcccttcgaactacatcgcgcacgaggggaagctctactgcaagcatcatcacatccagctgatcaaggagaaggggaacttcagccagctcgagaatgatcatgagaagacatcacaggctggatcgctggaggacgaagaagcagagtactaatctttgagcatttccacagatgaataatgaatctccttgcatttgctcgagagcaatatacctttctatggcacggtttggtttcagttttaccaatggaggtcatgagcactcagagaacaatgatacgtcatcttgtatcttcatgtaaaccttgttatatctgagtcaaattctct

SEQ ID NO: 14534 - DNA, 1567 bp, Panicum virgatum
  misc_feature: Ceres CLONE 1777035
  misc_feature: Encodes the peptide sequence at SEQ ID NO. 14535
agccacagcacagcacggcacggccggtctctccttcttcttcttcttccccggcgccagcggacctgcgggacctcgtcgtcgtcggccgatccttcactggcagggcagcagcgagctgcaattaacggcggcggcggaggatcggggaggaggacgacgaagatggtggtggagtccgcggggggcggcggaggggactgcctcatcaagctgttcgggaagaccatccccgtgccggaggccgccgccgacaaggagagcggcagcagcatcagctcctgcaccgaatccgacaccccggagaacgcctcggagccgtccccgcagccggaggtcatggacgccgaggaccccaagagctcgccggagacgcagccgccgcccggcgccggcgacttggccgggcagagggagaagctcaagaggcccgacaaggtgctgccgtgcccgcgctgcaacagcatggacaccaagttctgctacttcaacaactacaacgtcaaccagccgcgccacttctgcaagaactgccagcgctactggaccgccggcggtgccatgcgcaacgtgcccgtcggcgccggccgccgcaagaacaagcacgccgtcgccgcctcccacttcctgcacagggtccgggccgcgctgcccgccgccgccggcgacccgctcagggccaacgccacggtgctcagcttcggcggccacggccacggcgcgcctcccgcggcgctgcaggacctcgccgagcaggtgacccacctgaaggagaagctgctcgtcccggcaaggaacgccggcgacccatcgccggtgggtccgtgcagcgaaggaccaagcagcacggacgacaaggcccatggcggcggcatcaaggagaagcccgccgtagacaggcctgcaaacggagcgccgcagcttccggcaagcatgaacggagcaaccgtgtggccgtacggcggctgcgcgccatctccggcggcgtatttctcgtcgggcatcgcgattccgatatacccggccgcaccgggttactggggctgcatggttcccgcccccggaccttggagcctgccatggtcggtgcagggcctctcgttgcccaccagtgctccttcactcccgtcatcggggcctgaccccgacctcacgctgggcaagcaccccagggagggggacgaggggagaagcgcccatggtggtggcaaggtgtgggcgcccaagacgatccggatcgacgacgccgacgaggtggccaggagctcgatctggtccctcatcgggatcaaaggcgacaggaagcaggacgccgcggatcatcacggcgctgccgggcacaagcacgggacggtgttcgagcagaagcgggaggccaagaagcaaccggcgatgatcgcaagctcgccgctcctgcacaccaaccccgtcgcgctgacacgctcggtgaccttccaggagggatcttgaagcccatcgatcggcactactgaaatttttgtaaatcagagagaggattgtaatataggtattggggggaagaaggaaacagagtgagtgtatgtgt

SEQ ID NO: 14535 - protein, 434 aa, Panicum virgatum
  misc_feature: Ceres CLONE 1777035
  misc_feature (88)..(150): Pfam Name: zf-Dof Pfam Description: Dof domain, zinc finger
  misc_feature: The sequence is a functional homolog of SEQ ID NO 1132 in the 10/374,780 US patent application
  misc_feature: The sequence is a functional homolog of SEQ ID NO 1331 in the 10/412,699 US patent application
  misc_feature: The sequence is a functional homolog of SEQ ID NO 1130 in the 10/374,780 US patent application
  misc_feature: The sequence is a functional homolog of SEQ ID NO 1329 in the 10/412,699 US patent application
  misc_feature: Useful for biocontainment applications
  misc_feature: Useful for making plants with modulated biomass
  misc_feature: Useful for making plants with modulated flowering time
  misc_feature: Useful for making plants with modulated light quality response
MVVESAGGGGGDCLIKLFGKTIPVPEAAADKESGSSISSCTESDTPENASEPSPQPEVMDAEDPKSSPETQPPPGAGDLAGQREKLKRPDKVLPCPRCNSMDTKFCYFNNYNVNQPRHFCKNCQRYWTAGGAMRNVPVGAGRRKNKHAVAASHFLHRVRAALPAAAGDPLRANATVLSFGGHGHGAPPAALQDLAEQVTHLKEKLLVPARNAGDPSPVGPCSEGPSSTDDKAHGGGIKEKPAVDRPANGAPQLPASMNGATVWPYGGCAPSPAAYFSSGIAIPIYPAAPGYWGCMVPAPGPWSLPWSVQGLSLPTSAPSLPSSGPDPDLTLGKHPREGDEGRSAHGGGKVWAPKTIRIDDADEVARSSIWSLIGIKGDRKQDAADHHGAAGHKHGTVFEQKREAKKQPAMIASSPLLHTNPVALTRSVTFQEGS

SEQ ID NO: 14536 - DNA, 243 bp, Panicum virgatum
  misc_feature: Ceres CLONE 1777038
  misc_feature: Encodes the peptide sequence at SEQ ID NO. 14537
tgtcctggcctgcccatggcagagtgtgtcgtgccgcacatagtggcatcgttgctgcatggctttgattggcgcctgccagagggtgtgtccacggagcaattggacttgagcgaaaaatttaccactgtgaatgtattggccgtcccactaagggcagtgcccgttgtaagaaccaagtagtttacttgtttacgatcaatgcaaataagggtgcaaatactgcccaaaaaataagggttc

SEQ ID NO: 14537 - protein, 60 aa, Panicum virgatum
  misc_feature: Ceres CLONE 1777038
  misc_feature: SWISSPROT Homolog: EC 1.14.21.3 Berbamunine synthase
CPGLPMAECVVPHIVASLLHGFDWRLPEGVSTEQLDLSEKFTTVNVLAVPLRAVPVVRTK

SEQ ID NO: 14538 - DNA, 2184 bp, Panicum virgatum
  misc_feature: Ceres CLONE 1777040
  misc_feature: Encodes the peptide sequence at SEQ ID NO. 14539
cccgtttcacatcatctaccacctcgaaggaatgttgcagcagtcagtctccactctccactcccccagttcgtgctcacttctattgtcgggggcggcggcccgccgcggttcgtactgctccgcggcggcttcttggtcctatctccgtttgtagcgtgttcctccgtgcgcgtgtcaggaaaggaatgaagaaagggctcttcattgaggacaaaatcagccttgcggcctttcctgctcgtgactttctaccgaggttcctctagaaaggggtggcattttagccgacaaacggcggatgaagtttttcctgaagccttgttcacatggtgcctgaaggaacttctagctttgcttgagagcttccggagtataccttcttcacagctaatcagatccttgggtgcaacaatatgttgcccaagcgaccacatggcgtggttatgctgttaatgctcatggttttcgatgtttcaggcgcatttgttggtatcactattggcaacgaaatgtcaaacctaccatcagcaacagacatagtggctatccttaaagaaaagaagattcagcatgttcgtctgattgattcaaaccatcagatgttgactgcccttgcaaatactggaatagaagtcatggttggggttcccaatgatcagctgctatgtgtggggcagtctcgttccacagctgctgattggattaacaagaacgtcgctgcttatgttcaagcaactaacatcacatatatcgcagtgggtgatgaggttcttactaacattccaaatgcagcccttgttcttgtacctgcattgcaattcctccaatcagcactgttagctgcaaacctcaatactcaggtgaaaatctcgagtccacattcaatggatatgatctcgaaggcatttcctccctccactgccactttcaattcgacatggaacacagtaatgtctcagtatcttcggtttctgaaggatacaggatcttcattcatgctgaatgcccaaccatactatggctacgtcggagggcaaggcgtattccccttggagtatgcactgttccgctctctcaatcccaacagtcaaatttcagatcccaacaccaatctgttctataccaatatgtttgatgcaataattgatgctacttacaactcaatccaagcaatgaatttcacggagatccctgttctggtcacagcttctggctggccatggcgtggtgggccaaatgagaaggctgctactgttgataatgctttggcctacaatacaaacctcatacgtcatgtactgaataattctggtacacctagccaaccaacgaaccagtcgagcacctacatctttgagctattcaacgaggatcttcgttcaggacctgaatcagagaaaagttgggggattatgtttcctaacgcaaccactgtgtactctctatcatttgaggacgtggccacaactatcccagaatcaccggctctgcgtgggatgttttgtgtggcaaattcaagtgcaccccatagtgcacttaagcatagtttggattgggcatgtggccctggctctgcgaactgcagtgcaattcagcctggacaaccgtgctatgaatcagataacattgtagctgttgcatcatatgctttgaacgattattatcatagaacacaagctagtggtggtacatgcagctttaatggcactgcaatgatgacatctactgatccaagccatgactcatgcattttcgctggaagcactggcgccaacggcagcaacggtggtacagcttctgggcctgtaagccctgacagttttgcttcgaaatcccaatcctgctggttgactcacctagcagctgcattgctgctcattctagtgatgtagagcattgtaaccatgtcgcattttggatgagatacccgtcatttatcgtggatcttgtcattagatactgtagggcatatttgttttagtgtactcaggtagacgccttgtaatcttatccccaaatttgttgttctaggaatcaacattgcgagctgtgacaaacagcttacctggaacgctggaggttccaaatgatctgtcccccctgcatatggtttaaggagaaatttgcaaaaatgggactgcaaacattggccttgggcaattttttcatggtttaagtggt

SEQ ID NO: 14539 - protein, 492 aa, Panicum virgatum
  misc_feature: Ceres CLONE 1777040
  misc_feature (25)..(346): Pfam Name: Glyco_hydro_17 Pfam Description: Glycosyl hydrolases family 17
  misc_feature (362)..(447): Pfam Name: X8 Pfam Description: X8 domain
  misc_feature: SWISSPROT Homolog: EC 3.2.1.39 Glucan endo-1,3-beta-D-glucosidase
  misc_feature: Useful for making plants with altered carbohydrate content
  misc_feature: Useful for making plants with altered cell wall content and/or composition
MLPKRPHGVVMLLMLMVFDVSGAFVGITIGNEMSNLPSATDIVAILKEKKIQHVRLIDSNHQMLTALANTGIEVMVGVPNDQLLCVGQSRSTAADWINKNVAAYVQATNITYIAVGDEVLTNIPNAALVLVPALQFLQSALLAANLNTQVKISSPHSMDMISKAFPPSTATFNSTWNTVMSQYLRFLKDTGSSFMLNAQPYYGYVGGQGVFPLEYALFRSLNPNSQISDPNTNLFYTNMFDAIIDATYNSIQAMNFTEIPVLVTASGWPWRGGPNEKAATVDNALAYNTNLIRHVLNNSGTPSQPTNQSSTYIFELFNEDLRSGPESEKSWGIMFPNATTVYSLSFEDVATTIPESPALRGMFCVANSSAPHSALKHSLDWACGPGSANCSAIQPGQPCYESDNIVAVASYALNDYYHRTQASGGTCSFNGTAMMTSTDPSHDSCIFAGSTGANGSNGGTASGPVSPDSFASKSQSCWLTHLAAALLLILVM

SEQ ID NO: 14540 - DNA, 1016 bp, Panicum virgatum
  misc_feature: Ceres CLONE 1777043
  misc_feature: Encodes the peptide sequence at SEQ ID NO. 14541
gcatctaactaccgcgggggccaacgaacattgcttctccttcccgcatgttctcgtcttcctcctccactcggcgtccatcacttgcgagccctcctcctgcagctccggatctggaaggccggggggaagtcgcgcgctggcagaagggaaacggcgcgattgagtcggaggagtacggggccgttgagtcgcaggcaagtgagtcgcgattgaattcgggacagaggcatcgcgcagctgccattgggggaagctcgaggagaagacacacgacatggattggttgcctggagagctgtgcctcaagatcttccagctcctggatcaccagtccctcgcctccgctccccaagtttgcaggaaatggagggcgttgacctccgacgatgagctgtggcgcaagctgttcaccgacaggtgggggccggacgccgcggcgttctacgcgccggagggctccaagccctggaaggacgtcttcgtcgtgcaggaccgatgtgaccgatacggactgggtgtcaggatcatcagggaagggaaggactactacctgatctaccagggcgagatccagaggtacttgggctcgcgccaggacacggacggtgacggcgccaaggacgcgccgcggcaggacgctcaagacgacgggcagcggctgatatcgaaccggatcctgttcttcctgggggatctggaggcagcctgcgcggacgccaaacgggtcaaggcgtgaacgtgttatcctgtgcggcggcgccccttgtccagaagcacatcgctgcctgtatgcatagctcgtgcatagtgttgtccttacactacgtgtatagtttttttaaaaaaaaacttaaacactacgtgtatagtgcttcaccagttcatcctcaatttatttgagttgagattcttatagtcattttggattgtaagtggacttgatcatatgctttggttgtatgacacttttgtctgtcaatgcgcactcataataagttcaaccgttttttttc

SEQ ID NO: 14541 - protein, 153 aa, Panicum virgatum
  misc_feature: Ceres CLONE 1777043
  misc_feature (1)..(46): Pfam Name: F-box Pfam Description: F-box domain
MDWLPGELCLKIFQLLDHQSLASAPQVCRKWRALTSDDELWRKLFTDRWGPDAAAFYAPEGSKPWKDVFVVQDRCDRYGLGVRIIREGKDYYLIYQGEIQRYLGSRQDTDGDGAKDAPRQDAQDDGQRLISNRILFFLGDLEAACADAKRVKA

SEQ ID NO: 14542 - DNA, 1934 bp, Panicum virgatum
  misc_feature: Ceres CLONE 1777061
  misc_feature: Encodes the peptide sequence at SEQ ID NO. 14543
gcttccccgaacactactactagttctagcattcctccaccaagcgactcaagcagcggccgcggttcgcttccccgaacactactactagttctagcattcctccaccaagcgactcaagcagcggccgcggcggccgcagcgcgaactggcgaaccctgctgcttccagccgcctcctccggtgatcaccggacggccggagtaggaaccaacgagagcgcagcccagatcccacctccttccgctgctgctggttttcgacggagatggaaggtgttctgcaagcgggagatgccaaggactgggtttacaaaggggagggcgctgcgaatctcatcctcagctacacgggctcatccccttccatgcttggcaaggtactgcgggtcaagaagattctaaaagacaagtcgcaaccggcaccaagttgtatggtcttctcaagttatgagcaactcctgtggggccacatcccggaattacttgactctgtcaaacaagattgcttggctcaagcctatgcagtgcatgttatgagcaaacatctcggagctaatcatgtcgacagcggggttcgtgtaggtgtctcttgggattttctggaacttgttgaaaagaatgttcttaacagccgtcctgcttggagagtgaatgcaagttcaattgataacactgctgatgctgctcttctaatagcagatcattctttattttctggtaatcctagaggcagcagttgcatagctgtggagataaaggccaaatgtgggtttctgccatcatcagaatatatatcaaaagaaaattccatcaagaaacaagtaacacggtataagatgcatcagcacctcaaatttcatcagggccagatatcgaagactagtgaatacaaccctcttgatctattttctgagtcaaaagaaaggatatgcatggccatcaagtcatttttctcaactcctcagaacaacttcaggatttttgtcaacggttctttagtttttggtggcatgggaggtggtgcagataatgttcatcctgctgaaaaagacaagtgtcttgaagatctcagcaaggttagtggcctagaactacccgacttcattgagctcctgtcagaggcgatttttagatctggagtactaggtaaactgttggccacccaaaagctggacgatcatgacattgaaggggcaattcatttgtactacaacataatttcgcagccttgtttggtgtgcaaaaatatagctgatgtagagctcttggggaagtacactctcttgcattctctttcgttggacaagagcttgaagattgtcagggactttcttgtttctgctactgcaaaggactgtagcctgatgatcagctttcggccaagagagggaggaactacagattctgtgtatgattcagtatttcttgaatcagtgaagcaaacctatgagtacaaggcatatttcgttgatctggatgtgaaacctctggataagatggaacattattttgatctggatcagaagatagtcaatttctacacaagaaatcaggaggtcgtgccatctccaaaggtcagtaacactaaagacacttcacccattcagctccaacaatgaggagcctcgtccaatgtatgcctggagaagggcgcatctcggagtgtcgattgttatttgttgttgctgttgttgtaacttcatgagtacagtcccaaggttgggaggcttgttccttaggcctggaaagggtacacaaggagctgttgttcgtcgttgctgttgtaactctactagtgcatagaccttggcttgtcaccgcaaatctgcagagatgttcaatgtttgttgagaaactgagatgattgatgcttaccgtggcaaccactcattgtaaaatcccagttgaaatgagggctgaaagttccctcgc

SEQ ID NO: 14543 - protein, 450 aa, Panicum virgatum
  misc_feature: Ceres CLONE 1777061
  misc_feature: SWISSPROT Homolog: EC 2.7.1.158 Inositol-pentakisphosphate 2-kinase
MEGVLQAGDAKDWVYKGEGAANLILSYTGSSPSMLGKVLRVKKILKDKSQPAPSCMVFSSYEQLLWGHIPELLDSVKQDCLAQAYAVHVMSKHLGANHVDSGVRVGVSWDFLELVEKNVLNSRPAWRVNASSIDNTADAALLIADHSLFSGNPRGSSCIAVEIKAKCGFLPSSEYISKENSIKKQVTRYKMHQHLKFHQGQISKTSEYNPLDLFSESKERICMAIKSFFSTPQNNFRIFVNGSLVFGGMGGGADNVHPAEKDKCLEDLSKVSGLELPDFIELLSEAIFRSGVLGKLLATQKLDDHDIEGAIHLYYNIISQPCLVCKNIADVELLGKYTLLHSLSLDKSLKIVRDFLVSATAKDCSLMISFRPREGGTTDSVYDSVFLESVKQTYEYKAYFVDLDVKPLDKMEHYFDLDQKIVNFYTRNQEVVPSPKVSNTKDTSPIQLQQ

SEQ ID NO: 14544 - DNA, 1951 bp, Panicum virgatum
  misc_feature: Ceres CLONE 1777066
  misc_feature: Encodes the peptide sequence at SEQ ID NO. 14545
ggataggatttaggcagctggtaggtaggtttcagagagagagagagagagaggagccagattgggtctcggataggtcataggagtcgagagagtggagtgagagagattggccgctgccagattctgaatctcctcctacaatccgtgctcccaccatcgctgagtctcaggccagcctatcaagtcagtagtcagcataagaaaaatgagctcccagagtgttgctactggggagcagattattgctcctaaccaaatagtacacgcctgcacatccacacaaacttcagttcataagctgtttgatgctaaactggaccacgggttcttgatagatgacactttgtcatccacaagtcaatcatcaaacatcaagactgaattgatccggacatcgagcttgtcaaggagcctatcagttaaccttcagaaaagaagccctgaatctgatccagaaagcccgctgtctcacgtttcacatcccaaattttctgacccaatattgtcaaactcgtcaacgttctgcacaagtttgttttcttcgtcttcaaaaaacacagatccatgccggcaaatgggcactttacctttcctgcctcaccctcctaagtgtgagcagcaggtttcagctgggcagtcatcgagctcctctcttctcttaagtggtgatactggcaatgctttagatgaagctggacagtcagatgatcttaaagattttctcaatctttctggagatgcttctgatgggagcttccatggagagaacaatatcttggcttttgatgaacagatggaatttcagtttctgtctgagcagctgggaattgccatcactgacaacgaggaaagtcctcatttagatgacatatacggcacaccaccacaactgtcatcgcttccagtgtcatcttgctccaaccagagtaaacagaatctagggtcaccagttaaagtccagcttagctcatctcggtcatcttctgactctgcaacaactaacaagtcgagattgaggtggacacttgagcttcatgagcgttttgtggaggctgtgaacaagcttgaaggaccagaaaaagcaactcctaaggctgtgctgaaacaaatgaaggtagaaggcctaacaatttatcatgtaaagagtcatctgcagtatcgacttgcgaaatatcttcctgagcctaaagaagacaagaaggcttcctctgaggataagaaagcacaattgggtagcagcagcagtgattccagcaaaactaagaatttacaagtagcagaagctctaaggatgcaaatggaggttcagaaacagcttcacgaacaattagaggtccaaaggcaattgcagctacggatagaggaacatgcaagatacttgcagaaaatactggaagagcaacagaaggctggcaacttgtcgatgaaagcgccaaccgaagcacaagcaggatcacctgagacgacttcaaaggagaagcgaatctgagggaggcaccacttcgccgcggccatccaagaacagaaacccagacgtagacgcagaatgcaagtcgcctggagggagcaagagaacaaaggttcaggttgatcctgagagagtggccccgtgctcgtagccgtgcggccgaggccaatgactctgaatgtttgccccccgttctatcttctttcaggagctacttgctactgtctgtagcttgcacaaccgtagtatctctagactctagtcacctgttgatatcttggcatgaattgtggaatgatgtttggtacggacttcaggtctttgccattgtatcatatagctccactttggaatggaaattggaagttaatgactctctgaatgtattgttgccgctatattttggcggtagcctcgatttggaacatcaaaaaaaaatatagatacgtagctatgtggaattcgccaggtagcttgtcg

SEQ ID NO: 14545 - protein, 427 aa, Panicum virgatum
  misc_feature: Ceres CLONE 1777066
  misc_feature (269)..(320): Pfam Name: Myb_DNA-binding Pfam Description: Myb-like DNA-binding domain
  misc_feature: Useful for making plants with modulated oxidative stress sensitivity
  misc_feature: Useful for making plants with altered lignin content
  misc_feature: Useful for making plants with altered terpenoid content
  misc_feature: The sequence is a functional homolog of SEQ ID NO 1589 in the 11/479,226 US patent application
  misc_feature: The sequence is a functional homolog of SEQ ID NO 762 in the 10/412,699 US patent application
  misc_feature: The sequence is a functional homolog of SEQ ID NO 2000 in the 11/479,226 US patent application
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: The sequence is a functional homolog of SEQ ID NO 1999 in the 11/479,226 US patent application
MSSQSVATGEQIIAPNQIVHACTSTQTSVHKLFDAKLDHGFLIDDTLSSTSQSSNIKTELIRTSSLSRSLSVNLQKRSPESDPESPLSHVSHPKFSDPILSNSSTFCTSLFSSSSKNTDPCRQMGTLPFLPHPPKCEQQVSAGQSSSSSLLLSGDTGNALDEAGQSDDLKDFLNLSGDASDGSFHGENNILAFDEQMEFQFLSEQLGIAITDNEESPHLDDIYGTPPQLSSLPVSSCSNQSKQNLGSPVKVQLSSSRSSSDSATTNKSRLRWTLELHERFVEAVNKLEGPEKATPKAVLKQMKVEGLTIYHVKSHLQYRLAKYLPEPKEDKKASSEDKKAQLGSSSSDSSKTKNLQVAEALRMQMEVQKQLHEQLEVQRQLQLRIEEHARYLQKILEEQQKAGNLSMKAPTEAQAGSPETTSKEKRI

SEQ ID NO: 14546 - DNA, 1637 bp, Panicum virgatum
  misc_feature: Ceres CLONE 1777068
  misc_feature: Encodes the peptide sequence at SEQ ID NO. 14547
gactgagcttaacgaatagagccattctacatggccgtggtagctgccgccgctatgcttcatccgagagcatggacaccggtcgtcagctacggcggcgagctcgccagctcgctgactagtagcccagttcgcgtcctgatggcggccgtgatcctgtgcgccggcgccgtggcggttctgcggcgcgcacgccggctgcgggacgtgtacctcgtggactacggctgcttcctgggcgagccacagcaccgggtgccgaccgcgacggccacggagcacgcgcgcctgatgccctacctcgtcgacggcgagagcctcgacttcatgctccggctgcacgagcggtcgggcatcggcgaggagaccagtatcccggactcgctgcgctacatgccgcccgaccgcggcgtcgcggcgtcctgcgcggaggccgagctggtcatcttcgccgccgtcgacagcgcgctcgcccgggccgcccccgccctgccgcgcggtgccgcggacatcgacgcgctcgtcgtcgcctgcagcttcaccacgctggcgcccgagttcgcggacctcgtcgtgaaccggtacggcctgcgcgccgacgtgcggaccgtgaacctgtccgggatggggtgcagcggcgcgctcatctgcgtcggcctcgctaagaacctcctgcaggtggcgccgccggggacgcgcgccctggtcgtgaccaccgagctcctgtcgtcgatgttctaccccgggaccaagcgcgagatgctcgtgcccaacgtgctcttccgcatgggcgccgccgccatcgtcatgtccaactcgccggaacgtgcccgattccggatcggccatgtcgtgcgcacgctcaccgccgcgcgggacagggactaccgctgcgcgttccaggaggaggacgaccagggagtgacgggcatcaacctctccaaggagctgccggccgccgccgccagggcgctccaggaaaacctactcgccttcgcccccgccgtgctgccggcgtcggagcttctccgggtggccttctcctccctccggcgcaagttcctgggcgaggccgcgaagcgctaccggccggcgttcgggcgggcgttccagcacttctgcatccaccccggcgggagccgggtgctgaacgaggtgcagcgggggctcggcctctccgacggcgacatggaggcgtcgcgcatgacgctgcaccggttcggcaacatgtccggcagctcgctgctgtacgagctggcctacatcgaggccaagggccggatgaagaagggcgaccgggtgtgcatgatcggcttcagccccggcatagactgcagcagcgtggtgtgcgagtgcatcaggccggcggcgcgccccgacgacggaccctgggccggctgcatccaccgctaccctgtcccttggaatatttagccatggagatcttcgttcgccacgggtggagatttggcaatatattgttgagctcttgatgaagaacttctgtttcaattcgcttggtgtgaactttgtttgcttgagactgtcaagtctagtgaaactctggaataatcaaacattcttggatgtagagaccggggtattttattttcttaatgatagagctccctttatac

SEQ ID NO: 14547 - protein, 467 aa, Panicum virgatum
  misc_feature: Ceres CLONE 1777068
  misc_feature (52)..(344): Pfam Name: FAE1_CUT1_RppA Pfam Description: FAE1/Type III polyketide synthase-like protein
  misc_feature (359)..(442): Pfam Name: ACP_syn_III_C Pfam Description: 3-Oxoacyl-[acyl-carrier-protein (ACP)] synthase III C terminal
  misc_feature: SWISSPROT Homolog: EC 2.3.1.119 Icosanoyl-CoA synthase
MAVVAAAAMLHPRAWTPVVSYGGELASSLTSSPVRVLMAAVILCAGAVAVLRRARRLRDVYLVDYGCFLGEPQHRVPTATATEHARLMPYLVDGESLDFMLRLHERSGIGEETSIPDSLRYMPPDRGVAASCAEAELVIFAAVDSALARAAPALPRGAADIDALVVACSFTTLAPEFADLVVNRYGLRADVRTVNLSGMGCSGALICVGLAKNLLQVAPPGTRALVVTTELLSSMFYPGTKREMLVPNVLFRMGAAAIVMSNSPERARFRIGHVVRTLTAARDRDYRCAFQEEDDQGVTGINLSKELPAAAARALQENLLAFAPAVLPASELLRVAFSSLRRKFLGEAAKRYRPAFGRAFQHFCIHPGGSRVLNEVQRGLGLSDGDMEASRMTLHRFGNMSGSSLLYELAYIEAKGRMKKGDRVCMIGFSPGIDCSSVVCECIRPAARPDDGPWAGCIHRYPVPWNI

SEQ ID NO: 14548 - DNA, 2002 bp, Panicum virgatum
  misc_feature: Ceres CLONE 1777071
  misc_feature: Encodes the peptide sequence at SEQ ID NO. 14549
actttccagaccagagcccatcatggccatgggagctgtgctctccagtagaagcttcgcctctccgccctcttcagtaaagagacatgagctgaaatattccacaacaacacagagcaactgtgtgtgttcatcggttcctggacacagattccatcaacacgttactgggagcactcttttcccggcccaaagtcattcaagaagcactgtatcggcaagacatttgatatctgggcgattcatcaagaatagagttctatccagggttgagtgctttctcacttcagacccagcaagcggtggttggctaaaaccacggaggtggcagaattccactgctactacagagagatcttgtgtccaaccagagtacagactgcccatcagaagacgtgctgacttcaaagccgagcagtatgaaatcacaggatcatcgttcagcccttctgatggccctgatgcaattctggttggagatacgagcaacatttctccctggtggcagcagttcccaaagcgatggacgatcgtcctcctctgcttctttgcgttcctcctctgcaatatggaccgcgtcaatatgagtattgctatactaccaatggcgtcagagttcagctggagcccagcaaccgttggcctaatccaatcatctttcttttggggctatcttcttactcagattcttggaggtatttgggctgataggtttggtggcaaggttgtgctaggatttggtgttgtatggtggtcaattgcaacagttgttacaccccttgctgccaagattggacttccatgcttgctcatcacacgtgccatcatggggataggcgagggtgttgccatgcctgctatgaacaacatcctttccaaatggatcccagtttcagagaggagccgatctcttgctttagtttacagtggaatgtaccttggttcagtcaccggcctcgctttctcacctgtgttaatcagcagattcggttggccttctgttttttatgcgtttgggtccctaggaagcatctggtttgcactttggcgattcaaagcacacagctctccagatgatgatccagaactgagcaaagctgaaaagaggcacatactaggtggtaatgctttaaaggagcctatcacttcgataccatggagactaattctatcaaaggctccagtatgggctctaataatatcacatttttgtcataactggggaacattcattcttctaacatggatgcccacatactataaccaggttctgaagttcaatctcaccgaatccgggctgctgtgtgtcttgccatggctgacaatggctatttttgcaaatatcggtggttggattgccgacactcttgttcagagagggatttctataacaaatgttcgtaagatcatgcaatctattggtttccttggacctgccctgttcttgacgctgctgagcaaagtccaaactccagccatggccgtgttgtgcatggcatgcagtcagggtagtgatgctttttcacaatctgggctgtattccaaccaccaagatataggaccacgttatgcgggtgtacttcttggactgtcaaacactgccggcgtgcttgcaggagtttttggtactgcggccactggctacattcttcagaaaggttcttgggatggtgtgtttaaggtgtctgttgtgctgtacatagtaggaacagtggtgtggaatgtcttttcaaccggagaaaaaattcttgaatgatctgtgctgtgaataaaaattagctgctttttagattcattttgcgtaaaatacgctgtggcagggaaggctcttcacgagatgtagctgaaaggtgaaagctcccttgttagctatatagggatacggtgtttagcctacttagaggatgaactgcaaattaaagtgtgatgcagttagaaggtgagccaaataaatctcttatgcagcatgaagctgcagcaacggcgcgcacgccagattttg

SEQ ID NO: 14549 - protein, 577 aa, Panicum virgatum
  misc_feature: Ceres CLONE 1777071
  misc_feature (174)..(536): Pfam Name: MFS_1 Pfam Description: Major Facilitator Superfamily
MAMGAVLSSRSFASPPSSVKRHELKYSTTTQSNCVCSSVPGHRFHQHVTGSTLFPAQSHSRSTVSARHLISGRFIKNRVLSRVECFLTSDPASGGWLKPRRWQNSTATTERSCVQPEYRLPIRRRADFKAEQYEITGSSFSPSDGPDAILVGDTSNISPWWQQFPKRWTIVLLCFFAFLLCNMDRVNMSIAILPMASEFSWSPATVGLIQSSFFWGYLLTQILGGIWADRFGGKVVLGFGVVWWSIATVVTPLAAKIGLPCLLITRAIMGIGEGVAMPAMNNILSKWIPVSERSRSLALVYSGMYLGSVTGLAFSPVLISRFGWPSVFYAFGSLGSIWFALWRFKAHSSPDDDPELSKAEKRHILGGNALKEPITSIPWRLILSKAPVWALIISHFCHNWGTFILLTWMPTYYNQVLKFNLTESGLLCVLPWLTMAIFANIGGWIADTLVQRGISITNVRKIMQSIGFLGPALFLTLLSKVQTPAMAVLCMACSQGSDAFSQSGLYSNHQDIGPRYAGVLLGLSNTAGVLAGVFGTAATGYILQKGSWDGVFKVSVVLYIVGTVVWNVFSTGEKILE

SEQ ID NO: 14550 - DNA, 2059 bp, Panicum virgatum
  misc_feature: Ceres CLONE 1777083
  misc_feature: Encodes the peptide sequence at SEQ ID NO. 14551
agcaagcaagcgcagcgttcgatcgctcgagctactactagctgagccacacgtacgccttgtggtgccttgtgttcttctgctcggcagttagctgcacactgttgctagctagctgatacagtccaagctcatggacgggaagaaggtgcagcaggagcgggcggcgtggggcgccggcgacggccgcggcaacctggtgcaggacgcggtggactacaggggctgccgggcggacaagtccagcacgggcggctgggtggcggcggcgctggccctcgggatcgagctctgcgagcgcctctccaccatgggcatcgccgtgaacctcgtcacctacctcacgggcaccatgcacctgcaaagcgccgcggccgccaacgtagtcaccgacttcatgggcacctccttcctcctctgcctcctcggcggcttcctcgccgactccttcctcggccggtacctcaccatcgccatcttcgccctcgtccaagccatcggaacggggctcctggcggtgtcgacggaggtgcggcagctgcggccgccgccgtgcggacccggagctgccggaccgtgcgagcaggccacggggctccagatgggcgttctctacgtgtgcctctacctcatcgcgctcggcaccggcgggctcaagtccagcgtctcgggcttcggcaccgaccagttcgacgagcgcgacgcccgcgagcgcgccgccatgggcctcttcttcaaccgcttcttcttcttcatcagcgtcggcacgctcctcgccgtcaccgtcctcgtctacgtccaggaccacgtcggccggagctgggcgtacggcatctgcgccggcgccatgctcgtcgccgtcggcgtcttcctctccggcaccaggcgctaccgctacaggcgcagctccgggagccccatcgtgcacatcctccaggtcctcgtcgccgccgcccggaagcggggcatcaagcagccgctcaccgcctccgcgctctatgaggaccgccccgaccacgcgcgcatcccccacaccgcccagttcgcgtgcctggacagggcggccgtgatggccggcgacgacgacaacgaggtggggagcgacggccggccggtgcccaacccgtggaagctgtgctccgtgtcccgcgtcgaggaggtgaagatggtggcgcggctgatgccggtgtgggcgacgacgatcctgttctggaccatctacgcgcagatgatcaccttctccgtggagcaggcgaccaccatggaccggcgcatggacggcttcgagatcccggccgcctcgctcaccgtcttcttcgtcggcgccatcatgctcactctcgccgtctacgaccgcgtgttcgtgccactctgccggagcctcatgacgggccggcaggggctcaccaacctggagaagatcggcatcggcctggtcctctccatcgtcggcatggccgccgccgccagctgcgagaagaagcgcctcgccgtggcagccacgagcgcggcggcggcggcggggcacgagccgctgcccatcagcgtgttcatgctgacgccgcagttcctgctggtgggcgccggcgaggcgttcatctacacggggcagctggacttcttcatcacgcggtcgcccaagggcatgaagaccatgagcacgggtctcttcctcaccacgctctcgctcggcttcttcctcagcagcgcgctcgtctcgctcgtcaagggctgcacgcggtggctcggcgacaccatcaacaacagccgcctcgactacttctactggctgctcgccgtgctcagcgtcgtcaacctcgtcgcctacctcgtctgcgccatgtgggccacgccgccggccagcagccaggcggagcagccacagatcgcgatgacagccgacgagaaatgctagcaacatctctgctacagacctctactgcaccaatataatccccgttagttatagatttgactatttgagtgtggatgcagtttatatgctagttaaaaccaggtcacctctgtttactgaaaaataagaaaaaggctttagatc

SEQ ID NO: 14551 - protein, 593 aa, Panicum virgatum
  misc_feature: Ceres CLONE 1777083
  misc_feature (110)..(517): Pfam Name: PTR2 Pfam Description: POT family
  misc_feature: Useful for making plants with modulated carbon-nitrogen partitioning
MDGKKVQQERAAWGAGDGRGNLVQDAVDYRGCRADKSSTGGWVAAALALGIELCERLSTMGIAVNLVTYLTGTMHLQSAAAANVVTDFMGTSFLLCLLGGFLADSFLGRYLTIAIFALVQAIGTGLLAVSTEVRQLRPPPCGPGAAGPCEQATGLQMGVLYVCLYLIALGTGGLKSSVSGFGTDQFDERDARERAAMGLFFNRFFFFISVGTLLAVTVLVYVQDHVGRSWAYGICAGAMLVAVGVFLSGTRRYRYRRSSGSPIVHILQVLVAAARKRGIKQPLTASALYEDRPDHARIPHTAQFACLDRAAVMAGDDDNEVGSDGRPVPNPWKLCSVSRVEEVKMVARLMPVWATTILFWTIYAQMITFSVEQATTMDRRMDGFEIPAASLTVFFVGAIMLTLAVYDRVFVPLCRSLMTGRQGLTNLEKIGIGLVLSIVGMAAAASCEKKRLAVAATSAAAAAGHEPLPISVFMLTPQFLLVGAGEAFIYTGQLDFFITRSPKGMKTMSTGLFLTTLSLGFFLSSALVSLVKGCTRWLGDTINNSRLDYFYWLLAVLSVVNLVAYLVCAMWATPPASSQAEQPQIAMTADEKC

SEQ ID NO: 14552 - DNA, 2550 bp, Panicum virgatum
  misc_feature: Ceres CLONE 1777086
  misc_feature: Encodes the peptide sequence at SEQ ID NO. 14553
atcaatggtctttatgcgattccgcccccagctcatcttctcctcactcccccgctccatccctaaacccagaacctcgcccgccacaaccctagccgccgccgccgccgccacctccatggccgcgacgtcggaggacgcgctgcggcgcgcgctcgccgagcgccaggccgccgtggacgcgcaggccgaggccgtgcgcgcgctcaaggccggcggcggcgcgtccaaggccgacgtggacgcggcggtcgaggcgctgaaggcgctcaaggtcgaggccggcgccgccgcgcgccggctgcagcaggccgtcggggcgggcgcgggcggcgccgcgagggaggagctgcggcaggccgtggtgaacaccctggagcggaagctgttctacataccctcgttcaagatctaccgcggggtggcggggctttacgactacgggccgcctgggtgccgcgtcaaggcaaatgttctttccttctggcgccagcactttgttctggaagagaacatgttggaggttgactgcccctgtgtcacacctgaaatcgtcctgaaggcatctggccatgttgagaagtttactgacctcatggttaaagatgagaagacaggcacatgctaccgtgctgatcacttgttgaaagatttttgcaaggaaaagcttgagaaagaccttaccttgccccaagagaaggctgatgaatttaagcgtgttcttgccatcttggatgacctctcagcagaggagcttggtgcaaagattaaggaatatggcatcattgcccctgatacaaagaacccgctttctgatccctacccattcaatcttatgttccagacatctattgggcccactggtcttagcgtggggtatatgcgacctgagactgcacagggcatttttgtaaacttcaaggacctgtactactacaatggacaaaagcttccctttgcagcagcccaaattgggcaggcttttagaaatgagatctcgccacgacaaggtcttctccgagtgcgtgaattcacattggcagagattgagcattttgtggatccagaggataaatcacatccaaagtttgttgatgttgctgatttggagttcttgatgtttccaagagagctgcaactctcaggggagtcagccaagttaatgaagcttggtgacgcagtttcaaagggaactgttaataacgagacacttggttacttcattggaagggtctatcttttcctgacacgcttgggaattgataagggtcagctgcgcttcaggcagcatctacctaatgagatggcccattatgctgctgattgttgggatgctgaaatagagtgctcttatgggtggatagagtgcgtcggtattgctgatagatcggcatatgatttgcgagcacactctgagaaaagtggtgtcccacttgttgcacatgaaaagttttccaagcctagggaggttgagaaacttgtgatagttccctcaaagaaagacctggggcttgcttttaaggggaaccaaaagatggtcgttgaagcattggaggctatgagtgagaaggaagctttagagatgaaatctgctctagaaaccaagggggagacaagctttaaagtctgcacacttggaaaagatgtggtgattaccaagaaaatggtgtcaatcggcatggagaagaagctggaacatcagcgagtcttcaccccttcggtcattgaaccatcatttggcataggcaggatcatctactgtttgttcgagcattcgttttacacaaggcctagcaaatcagaagaggaacagcttaatgtcttccggttccctcctctagtggctcctattaagtgcactgtgttccccctggtgaagaaccaagagtttgatgctgctgccaaagtgattgctaaagcattaacaactgctggtatatcccacattattgacactactgctatatccattgggaggaggtatgcaaggacagatgagattggtgttccatttgctgtaacagttgattccacaacaaacgtgactatccgggagagggacagtaaggaacagatccgggtggacatcaccgaagtggcatccgtggtgaagcaactgacagaaggccaaagcacctgggccgatgtttctgcaaagtatcctgcccatgttggcccccaaggtgaccaggagtaaaaattctggccaaccaccaccatgtccagccatctctcaagaagtcgtcttcatcattctccagttgtccagaatctgactagctaaacacagccagttttggtattgacgcaatccagcaaggcagttttcccctcatacatacatgatacgtgctatagcggttggatggaccgaaatttgcatatttccccattgtttttgctccttttaatggccgtaacagcaatatgtggcctcacccatacaaaacttgaccatttgagaagcttctgaacctaagtccttgtaaggtcatactgagaattgctcagctacctacagttgtaattggaatttcagttacttgtccc

SEQ ID NO: 14553 - protein, 730 aa, Panicum virgatum
  misc_feature: Ceres CLONE 1777086
  misc_feature (153)..(450): Pfam Name: tRNA-synt_2b Pfam Description: tRNA synthetase class II core domain (G, H, P, S and T)
  misc_feature (617)..(705): Pfam Name: HGTP_anticodon Pfam Description: Anticodon binding domain
  misc_feature: SWISSPROT Homolog: EC 6.1.1.14 Glycine--tRNA ligase
MVFMRFRPQLIFSSLPRSIPKPRTSPATTLAAAAAATSMAATSEDALRRALAERQAAVDAQAEAVRALKAGGGASKADVDAAVEALKALKVEAGAAARRLQQAVGAGAGGAAREELRQAVVNTLERKLFYIPSFKIYRGVAGLYDYGPPGCRVKANVLSFWRQHFVLEENMLEVDCPCVTPEIVLKASGHVEKFTDLMVKDEKTGTCYRADHLLKDFCKEKLEKDLTLPQEKADEFKRVLAILDDLSAEELGAKIKEYGIIAPDTKNPLSDPYPFNLMFQTSIGPTGLSVGYMRPETAQGIFVNFKDLYYYNGQKLPFAAAQIGQAFRNEISPRQGLLRVREFTLAEIEHFVDPEDKSHPKFVDVADLEFLMFPRELQLSGESAKLMKLGDAVSKGTVNNETLGYFIGRVYLFLTRLGIDKGQLRFRQHLPNEMAHYAADCWDAEIECSYGWIECVGIADRSAYDLRAHSEKSGVPLVAHEKFSKPREVEKLVIVPSKKDLGLAFKGNQKMVVEALEAMSEKEALEMKSALETKGETSFKVCTLGKDVVITKKMVSIGMEKKLEHQRVFTPSVIEPSFGIGRIIYCLFEHSFYTRPSKSEEEQLNVFRFPPLVAPIKCTVFPLVKNQEFDAAAKVIAKALTTAGISHIIDTTAISIGRRYARTDEIGVPFAVTVDSTTNVTIRERDSKEQIRVDITEVASVVKQLTEGQSTWADVSAKYPAHVGPQGDQE

SEQ ID NO: 14554 - DNA, 1444 bp, Panicum virgatum
  misc_feature: Ceres CLONE 1777087
  misc_feature: Encodes the peptide sequence at SEQ ID NO. 14555
acatcgccatcatcccgtcccaagcttgtcactagctcggcgcgttgcctgctgaccttgttgtgccttggagccactcgagcgctcgaccccgtcgccgagccgtccaccgtagaattaagctagcgcaggcccgggcatggcgatgacgaccgccgccgccgccgccgccgccaccaccttggaggacctccccgccgacgtgctggcctgcgcgctgcgccgcctcgacggccgctccctggccgccgccagctgcgccaccgcggggctccgggcgctcgccgctgacccggacacgtggcgcgcgctctgcctcgcgcgctggccctccctgctgcagctgcaagcccgccccggcctcctcctcgactcgcagcgcctcttcgccgacgccttcccgttcccctccctgccggcggacaacctcgcgggagccgaggcgcctggtgacgcgctccagcggcggctccccgccgagctcgtctcggccgtggacgtctaccaccgcggcgcggcgctgctctcccgcgccgtggagacccccgcgtcgtcgtcctggttcctcagctcgccgttccgcgtcgacgccgtggagtgcgggaggagccccgccgcgcccgccggcggcgcccgcggcgtgccccccgcggagctcgagctcagctgggtcgtggtcgacccccgcaccggccgcgcagtcaacgtgtccagccgccgccccgtggccgtcgacaggcactggtacacgggcgaggcgctggtgcgctacgcggtggtgcttggcggctgcaagctcgaggccaccgtcacctgcgccgaggacgccgggagcatcagggagatcagcctggcggccgaggacgccgacggcgcggccctcagcggcgagggcgccctgcggctcctcgcggcggcgatggcggggcccaggaagggaggggaggaccaggaggaggcggccaagcgggggtacgaggagttcgtgaggagcaagaggggcaggaaggagtccaaggccaggaaggaggtgctcgtcgacctctgctgctccgccgtcagcgccgtcgccgttctcagcttcatcgccgccgtcgtgctccggtagtcgtagagcccctgttccggccgatccatcatcatctcatcgatcagcatcgacgagtccttaagatgtacatgctgcatacatctgggagagtatagtgcaagagttcattttctttccatttggctataatttagtactaggcactaaagtaagtcatacatgatacatgtatgggaaattttttagagttttgtatgggaaatttttaagtgaagaaaaagagagagaaagatacatgactctcacggaactaaattgattcctgtgagatttctgtaaaattcctatgaaatctcgatcaatatttgttccaaagagggtgccttaaaatct

SEQ ID NO: 14555 - protein, 322 aa, Panicum virgatum
  misc_feature: Ceres CLONE 1777087
  misc_feature (13)..(60): Pfam Name: F-box Pfam Description: F-box domain
MAMTTAAAAAAATTLEDLPADVLACALRRLDGRSLAAASCATAGLRALAADPDTWRALCLARWPSLLQLQARPGLLLDSQRLFADAFPFPSLPADNLAGAEAPGDALQRRLPAELVSAVDVYHRGAALLSRAVETPASSSWFLSSPFRVDAVECGRSPAAPAGGARGVPPAELELSWVVVDPRTGRAVNVSSRRPVAVDRHWYTGEALVRYAVVLGGCKLEATVTCAEDAGSIREISLAAEDADGAALSGEGALRLLAAAMAGPRKGGEDQEEAAKRGYEEFVRSKRGRKESKARKEVLVDLCCSAVSAVAVLSFIAAVVLR

SEQ ID NO: 14556 - DNA, 1544 bp, Panicum virgatum
  misc_feature: Ceres CLONE 1777091
  misc_feature: Encodes the peptide sequence at SEQ ID NO. 14557
ccaacagttctagaactcctcccatcgccaccctcgccgcagatcgagcctcaaaaccctagctccccctctccgtctccgtcgccggccacacccttcaaccccttccctccggctacctgcgccagggagacgcacgaagccatggagagcgccctcgcgagcgcggcggcgatcgccgaccagcgccagaagatcgagcagtatcgccacatcctcgcctccgtcctctcgtcctctccgccagacatcgcccaggccaagcgcttcctcgaccacatggtgtcggatgaggtgccgctcgtggtgtcgcgccagctgctgcagacgtttgcgcaggaccttgggaagctggagtccgacgcgcagaaggaggtcgcccactacgcgctgacgcagattcaaccgcgcgtggtctccttcgaggagcaggttgtagtgattagagagaagcttgcagaactatatgagtctgaacagcagtggtcaaaagcagcgcaaatgcttagtggtattgatttggactcaggaataaggatgcttgatgacaccaacaaattatccaagtgtgtccagattgcacgactctatttagaggatgatgatgcagtgaatgctgaggcttttatcaacaaggcttcatttttggtcaccaacagtcagcaggaagttctaaacttacagtacaaggtctgctatgcaaggattttggatctgaaaagaagattcctggaagctgcgcttcgatattatgatatctctcagattgaacagcgcaagatcggagacgaagagattgatgaaaatgctctagagcaagctcttagtgctgccgtaacgtgcacaatattggctggtgctggtccacaacgctcccgtgttcttgctacgctgtacaaggatgaaagatgctcaaagctgaagatatacccaatactgcagaaggtctatcttgaaaggattttgaggaaaccagaaatcgatgcgtttgcagaggagctgaggccacatcaaaaagctttattgcaagacaagtccactgtgcttgaccgggcaatgattgagcataatctccttagtgccagtaaactttacacaaatatcagctttgatgagcttgggacattattgggcattgatccaaggaaggctgagaagatagcatctcggatgatttatgaggatagaatgcggggttcaattgatcaggttgaagctgtgatacattttgacgatgacaccgaagagctacaacaatgggatcaacagatttctgggctgtgccaagctctgaacgacatccttgacagcatgtcaagcaaagggatagctattccggtgtgagtcaagtcttctcgtcctggcggtggatggtacttgtccgaactgcttcaacggctccagaattgacagaactgctttatcggctccagaattgacattttgtacagtttgctgctgctgcaaatgctcgccatgtgcttgtgcaaccaatttttaccatacaatcgtctggcgcaaaatctggggtaccgtgcttgttc

SEQ ID NO: 14557 - protein, 399 aa, Panicum virgatum
  misc_feature: Ceres CLONE 1777091
  misc_feature (265)..(364): Pfam Name: PCI Pfam Description: PCI domain
MESALASAAAIADQRQKIEQYRHILASVLSSSPPDIAQAKRFLDHMVSDEVPLVVSRQLLQTFAQDLGKLESDAQKEVAHYALTQIQPRVVSFEEQVVVIREKLAELYESEQQWSKAAQMLSGIDLDSGIRMLDDTNKLSKCVQIARLYLEDDDAVNAEAFINKASFLVTNSQQEVLNLQYKVCYARILDLKRRFLEAALRYYDISQIEQRKIGDEEIDENALEQALSAAVTCTILAGAGPQRSRVLATLYKDERCSKLKIYPILQKVYLERILRKPEIDAFAEELRPHQKALLQDKSTVLDRAMIEHNLLSASKLYTNISFDELGTLLGIDPRKAEKIASRMIYEDRMRGSIDQVEAVIHFDDDTEELQQWDQQISGLCQALNDILDSMSSKGIAIPV

SEQ ID NO: 14558 - DNA, 728 bp, Panicum virgatum
  misc_feature: Ceres CLONE 1777094
  misc_feature: Encodes the peptide sequence at SEQ ID NO. 14559
atctgccgtactacgccatttcctgagcgctctcctttcgctcgagcttgcagtgaaggtcacagtctcacagagatggagggcgctatccccaatccccccaacgcaaggattgcggtggtcaccggcgggaacaaagggatcgggctggaggtgtgccggcagctcgccggcgccggcgtcaccgtcgtcttgacggccagggacgagacgaggggcgcagccgccgtggagaagctcagagaagcagggctctccgatgtcatgttccatcagctggacatcaccgacgctccgagcatcgctcggttggctgatttcttgaaggctcgtttcgggaagcttgacatcctgataaataatgctgcaatcgttggtgttgagtacctcctagatccttttgatagttcaccgaccagcgaggaaaaggtgagctttacatcctcagcttgttaggggattaaaaagaacaagaaaaagtccaatttacacctttaaactatcgcaaaagtttgattttaaacattcaactataaaaccgaataatagagaccatccaactgttaaaattgagcaaatttgacccttggaaggtttcaaatgcggttttatatttttttttaaaaatataaaaattctaattagatctaaaaaatcaaaactaatccattttaaatcgaacaaatatgaaactagtaccaaattttttctcaaaatgtaacctatct

SEQ ID NO: 14559 - protein, 126 aa, Panicum virgatum
  misc_feature: Ceres CLONE 1777094
  misc_feature (12)..(126): Pfam Name: adh_short Pfam Description: short chain dehydrogenase
  misc_feature: SWISSPROT Homolog: EC 1.1.1.184 Carbonyl reductase (NADPH)
MEGAIPNPPNARIAVVTGGNKGIGLEVCRQLAGAGVTVVLTARDETRGAAAVEKLREAGLSDVMFHQLDITDAPSIARLADFLKARFGKLDILINNAAIVGVEYLLDPFDSSPTSEEKVSFTSSAC

SEQ ID NO: 14560 - DNA, 597 bp, Panicum virgatum
  misc_feature: Ceres CLONE 1777096-R
  misc_feature: Encodes the peptide sequence at SEQ ID NO. 14561
actgctccagagatctacaggcacgaaccatttgacagaagtgtagatgtatttgcattcggtctcattctttatgagatgatcgaaggaaatcatgctttccacccgaagtcacaagaggaagcagctaagatgatttgtttggagggactgagaccaccattcaagaataaacccaaaaactatcccagtgatgtgaaagagctgattcaagaatgctgggatctggtgccttccgtgaggccaaccttcgcggagataattgtgcggctgaataagatacacgcgagctgcgctaagcaggctcgttggagagacaccttcaaacttccatggaaacatgctggagatagatagctgtaaagacataaagttctgcgaggccgtccgccgtagtcaaagatttcctcccttccgtttagcaaaagcaaatgtgagtaaactcgagtgagaaatcgcaccgagttacgaagtagaagtagaagtagttccttctcaagttctttacgctcccaaaaggagaatacagtttgtgtagcctgtatgactgtctaggcttatgcctccggcccaatttctcttgagctgtcttcatcc

SEQ ID NO: 14561 - protein, 118 aa, Panicum virgatum
  misc_feature: Ceres CLONE 1777096-R
  misc_feature: SWISSPROT Homolog: EC 2.7.11.1 Non-specific serine/threonine protein kinase
TAPEIYRHEPFDRSVDVFAFGLILYEMIEGNHAFHPKSQEEAAKMICLEGLRPPFKNKPKNYPSDVKELIQECWDLVPSVRPTFAEIIVRLNKIHASCAKQARWRDTFKLPWKHAGDR

SEQ ID NO: 14562 - DNA, 122 bp, Panicum virgatum
  misc_feature: Ceres CLONE 1777096
ctggaggcgagctactgtcctccggcctcggctccaaaaagatggctcggtgcgtcaccgccaaggtgtcgctgagcgtggctccgctttggggctgcgtttcgttcacactcttccctccc

SEQ ID NO: 14563 - DNA, 671 bp, Panicum virgatum
  misc_feature: Ceres CLONE 1777099
  misc_feature: Encodes the peptide sequence at SEQ ID NO. 14564
acgggtagcgcccccgccgcagctcagttcagttcacggccccgagcccgcccgcccagccgctccaagttctttccctgcccagctcgactccgcgcgccaattccgggggccgggtttcccaggctcggccatggcggggtgggcctgcgcggttcttgcggcgctgctgccgcttctcgcggcgggggcggcggaggcccccgggaggtaccgcgcggtgttcagcttcggggactcgctggtggacgccggcaacctcatcaccgacggcatcccggactacctcgccaccgcgcgcctgccctacggccggacctacttcggctaccccaccgggcggtgctccgacggccgcctcgtcgtcgatttcatcgcgcaagagctcggcctcccgttcctgccgccttccaaggccaggaacgccagcttcgcgcagggcgccaacttcgccatcaccggcgccaccgcgctcgacaccgacttcttccagaagcgcgggctcggcaagaccgtctggaactccggctccctcttcacccaaatccagtggctgcgtgacctcaagccctcgctctgcaactccgcccaagaatgcaaggagttcttcggcatgtgcttgttcatcgtgggtgaatttggcggaaatgactacaacgcgcccctgttcg

SEQ ID NO: 14564 - protein, 179 aa, Panicum virgatum
  misc_feature: Ceres CLONE 1777099
  misc_feature: SWISSPROT Homolog: EC 3.2.1.51 Alpha-L-fucosidase
MAGWACAVLAALLPLLAAGAAEAPGRYRAVFSFGDSLVDAGNLITDGIPDYLATARLPYGRTYFGYPTGRCSDGRLVVDFIAQELGLPFLPPSKARNASFAQGANFAITGATALDTDFFQKRGLGKTVWNSGSLFTQIQWLRDLKPSLCNSAQECKEFFGMCLFIVGEFGGNDYNAPLF

SEQ ID NO: 14565 - DNA, 607 bp, Panicum virgatum
  misc_feature: Ceres CLONE 1777099-R
  misc_feature: Encodes the peptide sequence at SEQ ID NO. 14566
gtgcacaatgcgatgctcaagcgcgctctggaaaagctccgtgcgaagcatcctggagtgagggtcgtgtatggtgattacttcacgccaatcatccagttcatacttcagccagagaagtttgggttttacaaacaactgccaagagcatgctgtggtgctcccggtaggggtccttacaacttcaatctaacagcaaaatgcggtgagcctggtgcctcagcatgtgccgatcctaagacacactggagctgggatggtatccacttgacagaggcggcatatggacatatcgccagaggttggctgcatggaccgtttggagatgaacctatcgtgcagtcgtcctgagcacacacagttgtccacttctgttgtacctctagagtgtaccaaaatagcacaccaaatcggagctgataagtgataaggtagttgaatatagttgagtgtatatgttttggattccattgcagtcaggtaaaaagagatgagataggggctattaaagcatgatttattcattcatgatggtggtacaagtacagattgtaatgcagaatatagttcaatgcgatacacagatccttgctctgtggtccatgcc

SEQ ID NO: 14566 - protein, 116 aa, Panicum virgatum
  misc_feature: Ceres CLONE 1777099-R
  misc_feature: SWISSPROT Homolog: EC 3.2.1.51 Alpha-L-fucosidase
VHNAMLKRALEKLRAKHPGVRVVYGDYFTPIIQFILQPEKFGFYKQLPRACCGAPGRGPYNFNLTAKCGEPGASACADPKTHWSWDGIHLTEAAYGHIARGWLHGPFGDEPIVQSS

SEQ ID NO: 14567 - DNA, 2330 bp, Panicum virgatum
  misc_feature: Ceres CLONE 1777107
  misc_feature: Encodes the peptide sequence at SEQ ID NO. 14568
agtgatcttcctttgcaccgcgcttattgattagattcttctcagacatgaaggccatgtcttcctccctgctgtgtgccatcttcactagtgtcctttgctttgcaaccattgctgctggcggtgacgatcaatttctcttctcaggatttgctggagctaacatcactcttgatggcgtagccaccatcacaccagatggcctagtcgacctaaccaacgctcatgagaggttgataggtcacatgttctacccgactgctttgcacttccgcaagtctcccaattccatagtgcaatccttttctgtatcttttgcatttggcatccacccaaactaccgacccagccaaggctttgcctttttcattgcgaaaagcatgaatttctcatccgccattgatctacagtactttggcatcttcaacaccatgaaccaaggcaacttaagcaaccacatatttgctattgagattgacaccctcttaaacagtgagttaagagacattgatgccaaccatattggaatagacatcaacagtgtcatttcaaacgagtcccacacagctggtttctatgatgacaataatggtctcttcaaccccttgaatctcactactggtgaagcaatgcttgtttggatcgattacagtgaggaaacttcacaaattaatgtgtcgatgtcttcactttatatgtccaaaccaggaaggccacttatctcaaccatctacaacctctcgacagtgatcaccgaggttgcataccttggcttcgcatctggagctggcaaggataacacccgacactacatacttgggtggagctttggtatgaatagaccagcaccaattattgacataagaaagctgccaaagctgcctcgtgttggcccaaagcctcaaccaaaggtccttgtggttgttttaccgattgcaacaggaactttggttttcactgtggggctcacggtttttctacttgtacgaagaaacaagaagtatgctgagctacgagaagattgggagacggagtttgggcctcaccggttctcctacaaagatctgtattattctacaggaggattcaagactaagaatctcttgggagttggtggatttggaagagtgtacaaaggtatgcttccaaaatctaatgttgaaatagcagtaaagagggtatcacatgagtcaaaacaaggcatgaaggaatttgttgcagaaattgttagtattggccgccttcaacatcgtaatattgcgcatttacttggttattgtcgacggaaaggcgaactctttttggtttatgagtacatgccaaatggaagtctggacaagtacttgcatagtcaagacaacaagcccacactcagttggccccataggtttcagataatcaaaggaattgcatctgggctactatacctgcatgaggagtgggagaaggttgttatccacagagatattaaggcaagtaacatactgcttgataatgaaatgaatgcgcggctaggtgactttggtcttgctagattatatgaccatggccttgttgattcttcaaccacccatgtggttggcaccatagggtacttggctcctgagctagcatgcactagaaaggcaaccccgcttacagatgtattttcctttggtatattcattcttgaggtcgtttgtggacggaggccgataaggcaaaatgcacaagaaaaacaagtcatgctggttgattgggtgcttgagcattggcacaacagaaccatcactgacacagtggatgctgcactacatggtgactacaatgttagtgaggcttgcttagcgctgaagctaggattgttatgctcgcacccgtttgtggatcgaagacctactatgagacaagtagtgaaatatcttgagggagatgctgaatcacctgagctaacgcccacacatatgaactttgagatgctcgccatgatgcaaaatgaaggatttgatccatatatcatgtcatatccttcatcaatgacaagccatggctcagtatcagacatctcaactactggaactggaagatgaatacgtgccaagctactgatgagagagtcctcatatacctgttctacctcatgtgtatagtaggtaaagtcccatattttctggtgcgaaacatggtgtcaatttattatgtaatgtaaacagctagctaggagtatagggaaggactactctgtggcggccatatatagaatacctattgtgtatatatggctacctaggtttaccacaatgaatgtacttatttacgatattgtgaatacaaatatatttacgatgcag

SEQ ID NO: 14568 - protein, 673 aa, Panicum virgatum
  misc_feature: Ceres CLONE 1777107
  misc_feature (26)..(262): Pfam Name: Lectin_legB Pfam Description: Legume lectin domain
  misc_feature (347)..(619): Pfam Name: Pkinase Pfam Description: Protein kinase domain
  misc_feature: SWISSPROT Homolog: EC 2.7.11.1 Non-specific serine/threonine protein kinase
MKAMSSSLLCAIFTSVLCFATIAAGGDDQFLFSGFAGANITLDGVATITPDGLVDLTNAHERLIGHMFYPTALHFRKSPNSIVQSFSVSFAFGIHPNYRPSQGFAFFIAKSMNFSSAIDLQYFGIFNTMNQGNLSNHIFAIEIDTLLNSELRDIDANHIGIDINSVISNESHTAGFYDDNNGLFNPLNLTTGEAMLVWIDYSEETSQINVSMSSLYMSKPGRPLISTIYNLSTVITEVAYLGFASGAGKDNTRHYILGWSFGMNRPAPIIDIRKLPKLPRVGPKPQPKVLVVVLPIATGTLVFTVGLTVFLLVRRNKKYAELREDWETEFGPHRFSYKDLYYSTGGFKTKNLLGVGGFGRVYKGMLPKSNVEIAVKRVSHESKQGMKEFVAEIVSIGRLQHRNIAHLLGYCRRKGELFLVYEYMPNGSLDKYLHSQDNKPTLSWPHRFQIIKGIASGLLYLHEEWEKVVIHRDIKASNILLDNEMNARLGDFGLARLYDHGLVDSSTTHVVGTIGYLAPELACTRKATPLTDVFSFGIFILEVVCGRRPIRQNAQEKQVMLVDWVLEHWHNRTITDTVDAALHGDYNVSEACLALKLGLLCSHPFVDRRPTMRQVVKYLEGDAESPELTPTHMNFEMLAMMQNEGFDPYIMSYPSSMTSHGSVSDISTTGTGR

SEQ ID NO: 14569 - DNA, 1542 bp, Panicum virgatum
  misc_feature: Ceres CLONE 1777115
  misc_feature: Encodes the peptide sequence at SEQ ID NO. 14570
agcgctccccatcgccacgccacgccacgcgcaccgcccgcccgcccgcctcgctcccccaaatccacctcgccggccggccctcgctcgcgcgcgcgcggcggcgtcactccgatcccggatcgatcgcccggccccggacctagcccgcacgccaccggccgcctcgattcgatcgggggacccgcggggaagcgaggcctcgatcgcggctgggggacccgatgccccgcccccgggcccctccagcggcggcggcggaggtatgagccggcggggacccgcacggagctgccagccatggacgccaccgcgcgcccggccatcgtcatcgacaacggcacggggtatagcaagcttggattttctggtaactctgagccgtctttcactctccctactgtcgtagcagtgaatgagtcttttctagaccagaaagagctgttgagtagtgcaaactggatagcacagtataatgcaggcgtcatggctgatcttgattattttattggagatgaggctctgtcgcgtttaagatctagtgggctatacacttcaagaagtccaattcgtcatggtcaggttgatgactgggatacaatggagagattttggcagcaatgcattttcaactatctgcgttgcaatcctgaggaacattatttcctccttacagatagtcctgttggttcacccgaaagtcgcgaatgtactggagaaataatgtttgagaccttcaatgtccctggtctatatatatctgttcaatctgtcctcagcctttctgctggatacgcctatctgaaaagtatttctggtgaagattcagatcctccgtctgatatgacaggtgtagttgttgatattggggatggtgctccacacatcgtgccagttgtaaacggctatgtaattgggagtagcataaagtcttttcctttttctgggagtgatgtaactcagtttgtttcgcagctgttacaggaaagaggtgagcttctgccacctgaggattctttagatatatctcgcaaggtgaaagaaatgtattgctatacttgttcagacattgtcaaggaattcaagaagcatgacaagaagcttgataagtacgtcaaacattggtcagctattaaaccaaagactggggtcccatatacaattgacatcggatatgagcgttttcttggcccagagatcttcttcaatcctgagatttactccgctgatttctccactcctttacctgaattgattgatagctgtgttcaatctgcaccaattgacacaaggagagctctgtacaagaatatagtattatctggtggatctaccatgtttaaagacttccacaagagactccagaatgatataaagaagatagtagatgatcgtgttgctgcaactaatgcccgccattgtgtggaagtgagacctattgaagtcaacgtggttgcccatcctatacagagttacgcagtttggtttgggggttcagtagctgcatctacaccagaattctatgagtattgccacacaaag

SEQ ID NO: 14570 - protein, 413 aa, Panicum virgatum
  misc_feature: Ceres CLONE 1777115
  misc_feature (3)..(413): Pfam Name: Actin Pfam Description: Actin
  misc_feature: SWISSPROT Homolog: EC 2.7.10.2 Non-specific protein-tyrosine kinase
MDATARPAIVIDNGTGYSKLGFSGNSEPSFTLPTVVAVNESFLDQKELLSSANWIAQYNAGVMADLDYFIGDEALSRLRSSGLYTSRSPIRHGQVDDWDTMERFWQQCIFNYLRCNPEEHYFLLTDSPVGSPESRECTGEIMFETFNVPGLYISVQSVLSLSAGYAYLKSISGEDSDPPSDMTGVVVDIGDGAPHIVPVVNGYVIGSSIKSFPFSGSDVTQFVSQLLQERGELLPPEDSLDISRKVKEMYCYTCSDIVKEFKKHDKKLDKYVKHWSAIKPKTGVPYTIDIGYERFLGPEIFFNPEIYSADFSTPLPELIDSCVQSAPIDTRRALYKNIVLSGGSTMFKDFHKRLQNDIKKIVDDRVAATNARHCVEVRPIEVNVVAHPIQSYAVWFGGSVAASTPEFYEYCHT

SEQ ID NO: 14571 - DNA, 149 bp, Panicum virgatum
  misc_feature: Ceres CLONE 1777115-R
tgtgtatagccagcagcttggttcctgttcgaggtgcatgattgtagccagaaccttggacagttgggaggaaatattggttttccttttctattagtttgtccaggcaaatttatgaatttttgttaataaggattcaggttaaattt

SEQ ID NO: 14572 - DNA, 695 bp, Panicum virgatum
  misc_feature: Ceres CLONE 1777127
  misc_feature: Encodes the peptide sequence at SEQ ID NO. 14573
agacgcatcaaaccgctctcctcctgtctcccctcgcaaccccaaagaagccgcactcgcaaaggcagcaaacgcgccgcgcaccggaagatcccagagagcggcacgagggggcccccattgcggcatggctgctgtggccgccggcgctggcgtcgggctccagctcattggcgcagccgcggccacgctcctagcggcggtccttgttgccgccgtgcttgggcgccgccgccggccgctggcccgggcgcctctggtggaagggaagcccgcgccggaggatggctgcgcggtcggcgacggcaagggcgccgccggtgacggtgggacggatgccatcatcgttggcgctggagtagctggatctgcgctggcatatacgctcggaaaggatggccgtcgggtacatgttattgagagagatttgacagaacctgacagaattgtgggtgaactgttgcaacctgggggttacttgaaattaattgagttgggcctcgaagattgtgtggaagaaattgacgcccaatgtgtccttggttatgctttattcaaagatgggaggaacacaaagctcgcttaccccctggagaaattccattccgatgttgctggtaggagctttcacaatggaaggtttatacaaaggatgcgtcaaaaagccgcgtctttgcccaatgtccaattagagc

SEQ ID NO: 14573 - protein, 189 aa, Panicum virgatum
  misc_feature: Ceres CLONE 1777127
  misc_feature: SWISSPROT Homolog: EC 1.14.99.7 Squalene monooxygenase
MAAVAAGAGVGLQLIGAAAATLLAAVLVAAVLGRRRRPLARAPLVEGKPAPEDGCAVGDGKGAAGDGGTDAIIVGAGVAGSALAYTLGKDGRRVHVIERDLTEPDRIVGELLQPGGYLKLIELGLEDCVEEIDAQCVLGYALFKDGRNTKLAYPLEKFHSDVAGRSFHNGRFIQRMRQKAASLPNVQLE

SEQ ID NO: 14574 - DNA, 739 bp, Panicum virgatum
  misc_feature: Ceres CLONE 1777136
  misc_feature: Encodes the peptide sequence at SEQ ID NO. 14575
ttttttcctcaacgctttcccttctccattccctcgcccccacttctctctgccgccaacgccgtcgcggaccagcaccaaggcaaggaagccgatcagatcaaagaacatcgattggtcccatgggaaggcgggagatgagcgggcggctgtcggccgagtaccagggcctggaggtgaaggtgcccaacctcttccggtgccccatctcactggacgtcatgcggtcgccggtgagcctctgcaccggcgtcacctacgagcgcgcctccatccagcgctggctcgactccgggaacaccacatgcccggccaccatgctccaactcccttccaccgacctcgttcccaacctcaccctgcgccgcctcatcgctctctgggcgtccactgccgcgcccgcctctccctcctcatcgtcgtcgccccccgcgccgtccgccgtcgggcccacgccggccgccgccgcggccgagctccttcgccgggtcgccgcgcccggcgccgacccctgccccccgctccggaagctcgcggctttcctaaacgacgacgacgtggacgagttcgacaagaacgcgttcgcgagggcggccggcgccgcggagaccgtggcgtccgtcctccggcgggcggagaaggaggagggcctcgaggcagcggaggccgccgtgcgcgtcctggccgcaatcgcggcgtccgacagcatcgaggagggagacaagcggcgcgtgcccgc

SEQ ID NO: 14575 - protein, 205 aa, Panicum virgatum
  misc_feature: Ceres CLONE 1777136
  misc_feature (20)..(94): Pfam Name: U-box Pfam Description: U-box domain
MGRREMSGRLSAEYQGLEVKVPNLFRCPISLDVMRSPVSLCTGVTYERASIQRWLDSGNTTCPATMLQLPSTDLVPNLTLRRLIALWASTAAPASPSSSSSPPAPSAVGPTPAAAAAELLRRVAAPGADPCPPLRKLAAFLNDDDVDEFDKNAFARAAGAAETVASVLRRAEKEEGLEAAEAAVRVLAAIAASDSIEEGDKRRVP

SEQ ID NO: 14576 - DNA, 1500 bp, Panicum virgatum
  misc_feature: Ceres CLONE 1777137
  misc_feature: Encodes the peptide sequence at SEQ ID NO. 14577
tccctgctcattttctcctcctcgtgaagcgagcgagcgagcgagcgccgcgattccatttccatcccggaacggcttcgcaacggccgcggcgcagatccacacacaacccacggacagacaaaaccccgccgcagaggttttcaaatcccggggcggatttccgggcagagagagagagagagagagagagagagagagagacaccccgcgctgcgccgagatcccgtcttcgaattcgtcgtcacgccccgacggcgagcgagcgagccagctaggccgcggtagcagaaggcggccatggggaacagcatataccggttcctgtgcggcctgtgcgcgccctcgccggcggagcacgggctccacggcgcgcaccccgccgtcgccgcgctcggccgcgacatcctcagcttcggggccaactcgcaggttccggacgggctgagccggcacgtcgtctcctccaagaaagcgcagtcgaattggtacaagaagctgctggtggcatggaagcaagcccgtccgcctccgaagacgcccgaggaagccgcgcgcttcgttgtgcggacgctcaagaaccaccagaaagcagatgtcgagggcttcttggcgttctacggcctgccacatccgaacgcggcagcaggcgctcccgctgctcctgctcacccgccgcccaaacctcagggcgccaagttcgagctgcacacgctgcccattgaccccaagtctgtggccgacggcgacaccatcaacgtgtacgtggacacggccgacccccgggagtccggcagcgtgccccgggaggtgcagaaggcggcagcggagcgggccaaggcgcgggccgccaagaactaccagaaggccgacgcgctgcagaaggtcatagtggacgcaggatacaggccagttcctaacgcgagaggcgaagaggtgctcgccaagaagtacaggatcaggctaaggggcatcgatgcgccggagagcgcgatgccttacggcaaggaggccaaagaggcgctgctgaagcttgtccagggaaagagcctgaaggtctacgtgtacgacgaggaccggtacggtagatgcgtcggagacatctactgcgacggcgtattcgtgcaggagcaaatgctgaagaaggggtttgcgtggcactacaccgcctatgaccaacgcccggagctagccaagtgggagaaacaagcacagactggccggaagggactgtgggcgtcgtcgaagccgcagaaaccatgagagtggcggaaggacaagcgcaacgggacggcatgaacattgaacggacctcggggtgccgcgcgcgcgcgcaatgtattgtatgttagatttatgggcttggcccatatgaataatcataataaatctcaaagacccattagcactaagagaagatacaccatctattagtcccgtattgctaacggacgagggtgtaaggggtttttctccctttaaatatggaccacctccctc

SEQ ID NO: 14577 - protein, 320 aa, Panicum virgatum
  misc_feature: Ceres CLONE 1777137
  misc_feature (137)..(314): Pfam Name: SNase Pfam Description: Staphylococcal nuclease homologue
  misc_feature: SWISSPROT Homolog: EC 3.1.31.1 Micrococcal nuclease
  misc_feature: Useful for making plants with altered terpenoid content
MGNSIYRFLCGLCAPSPAEHGLHGAHPAVAALGRDILSFGANSQVPDGLSRHVVSSKKAQSNWYKKLLVAWKQARPPPKTPEEAARFVVRTLKNHQKADVEGFLAFYGLPHPNAAAGAPAAPAHPPPKPQGAKFELHTLPIDPKSVADGDTINVYVDTADPRESGSVPREVQKAAAERAKARAAKNYQKADALQKVIVDAGYRPVPNARGEEVLAKKYRIRLRGIDAPESAMPYGKEAKEALLKLVQGKSLKVYVYDEDRYGRCVGDIYCDGVFVQEQMLKKGFAWHYTAYDQRPELAKWEKQAQTGRKGLWASSKPQKP

SEQ ID NO: 14578 - DNA, 737 bp, Panicum virgatum
  misc_feature: Ceres CLONE 1777138
  misc_feature: Encodes the peptide sequence at SEQ ID NO. 14579
gtcacttgttttcgtctagaacccagacgccagaccgttggcacagcgagtgagcaatggcaaccatcagcgcggccgcatccgccgccctctttgccggcgccggcgtcgccaggccgtctcaggctcacgggctgcctcagctgagagcgagagccggcaaggtgcggtgcggcgcctgctcgaagcagcacgacggcaacggcaaggcgccagcggcggctccggccggcgcgtccctgctggccgtggcgagcgcgatgacgacgtcgccggcgctggctctggtggacgagcggatgtcgacggagggcaccgggctcagcctggggctgagcaacaacctactggggtggatcctgctgggcgtgttcggcctcatctggtccctctacaccgtctacacctccacgctcgacgaggacgaggactccggcggcctctccctgtgaaatccttttgattaccagctattttcttcagccctgacctgtgcgagttcgacgatctgtggttgcaactgcaagtctgcgactgaaggcatggtttgtatgcgactgtgaattgtgattgggagtttcactttcacagtcgacacgatcacacgaagcaaatgctgcttcaattcctccctggttgcttgcttgcatcgccattgccggcttgcctcccatctccacacatctagccagccacgaggagtcctccagcttcctcatgcgtgcaagccatcaccg

SEQ ID NO: 14579 - protein, 131 aa, Panicum virgatum
  misc_feature: Ceres CLONE 1777138
  misc_feature (1)..(131): Pfam Name: PsbW Pfam Description: Photosystem II reaction centre W protein, PsbW
MATISAAASAALFAGAGVARPSQAHGLPQLRARAGKVRCGACSKQHDGNGKAPAAAPAGASLLAVASAMTTSPALALVDERMSTEGTGLSLGLSNNLLGWILLGVFGLIWSLYTVYTSTLDEDEDSGGLSL

SEQ ID NO: 14580 - DNA, 1897 bp, Panicum virgatum
  misc_feature: Ceres CLONE 1777149
  misc_feature: Encodes the peptide sequence at SEQ ID NO. 14581
gcaaggaagcaggcaggcaggcaggaaactagcagggatatttggtggcgcgggcggtgtgagcccgcagcgagcagccagcgacagcagccgacccggcgccggccagcgacaggcgacaggcgacagcgaggcacctgccctccatctggaaccccgcgcgggtttcgccggccgcggcccggtgcgacgacgactcggcacgcgccgtttcccgcccgccccccaccatcttgccggcctcgcgcgggagatgatgattcctagggaacctctgcggccggagcccccgtccgactcctgatcccggaccccccgccgatcgtagcggcgtctccgctgcagtgtccagactagaagatggagactcctcaaatcgagatgggtggtttcaaggtcaacaccccgcaagtgcccaatggtgggctacggccgaccatggctgggtcctggaactcgcgggggacaatcgagatgacactcaggagcatcaggatcgtcattttcacctccaagctcaacttgctgatgccattcgggcctgcatccatcattctgcacttcacttctaggaggcatggattggttttccttttcagcatgctaggaataacaccattagcagagcgtttgggatatgctactgagcagcttgcaatatacactggtccaacagttggtggccttctgaatgctacatttggaaatgcaactgaaatgatcatcgcaatatatgctttgaaaaatggaatgattcgagtagtgcagcagtcactattgggttccatattatcaaatatgctgttagttttgggatgtgctttctttgctggtggtttaattcatcgtaataaagaccaagtcttcagtaaggcaactgcagttgtcaactcaggtttattgttgatggctgtcatgggattgatgtttcctgctgtccttcacttcacacattcagaagtgcgccaaggagcatccgaggttgttctttcaaggttcagtagttgcattatgctcgtggcatatgcaagctatctctatttccaactaagtggtcggagcaacatttacagtccaattggcagtgaagaggtacctaatgaggatgcaacggaagaggaggaagaagctgagattagcatgtgggaggccgttacctggcttgcagtgctaacactgtgggtgtcagtcctttctgaatacctagttaacgctattgagggagcatctgattcattgaacctaccggtggcttttatcagtgttattttgcttcctattgtgggcaatgcagctgaacatgctagtgcaataatgtttgccatgaaagataagcttgacataacgctaggtgttgcaattggctcatcaacacagatatcaatgtttgtgattccattttgtgttgttattggttggatgatggggcaaaagatggacttgaattttcaactttttgagacagcaactctcttcataactgtacttgtggtggcatttatgctacaggatggcactgcaaactacttgaaaggacttatgctgatcttgtgttatctgatcgttgcggccagtttctttgttcatgttgatccgcaatcgagtgatggttgaggtcatagatgctgtaagtaatgtaccaaataccttggaggatttgctaatccttttctgttgagatgcaccaccataggtccatagcaatgttcagcctgtcttaagcagcattttggcactggaacatcacccatcgacggttccttcatgaactgctgaaggaaattcttggatttatgtggatactgaggggtactaggggtagtcccaatgtatacaaaaacaagaaatgccagcctgttatatcaattaattgagtgaatgtggccctttttcctgt

SEQ ID NO: 14581 - protein, 417 aa, Panicum virgatum
  misc_feature: Ceres CLONE 1777149
  misc_feature (273)..(406): Pfam Name: Na_Ca_ex Pfam Description: Sodium/calcium exchanger protein
  misc_feature (82)..(229): Pfam Name: Na_Ca_ex Pfam Description: Sodium/calcium exchanger protein
METPQIEMGGFKVNTPQVPNGGLRPTMAGSWNSRGTIEMTLRSIRIVIFTSKLNLLMPFGPASIILHFTSRRHGLVFLFSMLGITPLAERLGYATEQLAIYTGPTVGGLLNATFGNATEMIIAIYALKNGMIRVVQQSLLGSILSNMLLVLGCAFFAGGLIHRNKDQVFSKATAVVNSGLLLMAVMGLMFPAVLHFTHSEVRQGASEVVLSRFSSCIMLVAYASYLYFQLSGRSNIYSPIGSEEVPNEDATEEEEEAEISMWEAVTWLAVLTLWVSVLSEYLVNAIEGASDSLNLPVAFISVILLPIVGNAAEHASAIMFAMKDKLDITLGVAIGSSTQISMFVIPFCVVIGWMMGQKMDLNFQLFETATLFITVLVVAFMLQDGTANYLKGLMLILCYLIVAASFFVHVDPQSSDG

SEQ ID NO: 14582 - DNA, 2827 bp, Panicum virgatum
  misc_feature: Ceres CLONE 1777154
  misc_feature: Encodes the peptide sequence at SEQ ID NO. 14583
agcgcagcccactctcccacctaggctaattaatcacgtcacgagatccccttctccgcccatccctcctccgcctcagtcgcacgcctcggcgcctcgcctcgcctcgctcccaccgcccccgccactcgcgcgccccccgcagcgccggaccgggctcgcttccgcgcggccgtgcaccgggggacagggggggatatcccgcggcgagcccccgccgcccgcgccacagggtggccttgaaggatgataattgaagcaaaatgattctatatttccacatattttggagatggatgatctgccaggggatgaagggagatcccagacacaatcttcagatccaaattggccctcccatttggatcacaagttccagtccctttccctgactaaacaggaaaaaaatttggattctgcatattcttcccttgattctagggaagctggtcattcattgcaggctgctcagacattgtggtctactggatctctatcaggtccaatacccaatggtttttattccattattccggaaaagaggctcaaggagcgttttgacaccataccttctccagatgacctttattcccttggaatagaaggatttaaggcagagattatccttgtggacatagaaagggataaaaagatatctgctttaaagcagctatgcacagcgctggtaaaaggattgaattcaaatcctgctgccatgataaagaaggttgcaggtttggtttctgacttttacaagcgaccaaacccgcatctcagtcctgcaagaacttcctccgaagaactttctcatttcttagaaaacaggggagttcaatttctgggacagataagacatggatcatgcaggccgagagctatattatttaaagttcttgctgactctgttggtatagactctaaactgctggtgggcattccaaatgaagaacctcatggttatgatgattcgtccaaacatatgtctgttgtggtcacgatgaaatctgcagagtttctagtggacctgatgcgttttccaggacaattagttccattttcatccaaggctgtcatcacatcccatatatctgcggctggagagagcgattcagctgactatgattcctgcgattctcctcttgaaccgaacagtcccctatgtgctcaacggcaagagcaagatgacagtaacagatcttttaaagccacctctctaagaaacatcatgctcaaatcaacaaattctatggagggtaaaatgaagtgttcatcacatagtgacccaaatgttgccaacgccttctatggtcgcagtcggaagaaagttgtggatgaacatcaaagaactgcaagttcaagtccagagcatccattgtccagagttcgtgggcgctcaatgctgggtgacaaacagggtaacggtgtagctgtgtcaaggtcagatggcgcatcaacatcaaatgcacgtatagcacggagccgaagtataagtatcacccctgaaatcagtgatgatattgtgagggcagttcgagcaatgagtgaaagtatgagacagaatcgcctttcaagggggcagaatgatggtactcttgtatcctcaaatgattcacagaaacatgaacctgctggtgacccccatgacgatgaagtatctacaagacgaccaagcgcactggagggtttgagaagacaaattaatagtcagaaagcagtgtcattaccttcgtcaccccataggtcaagtatccttgcctctgaccttaggggcccatctgacttcacagaagctgatctgatgtcaacctggaataaggttttgcagtcttcaccatttctgaacaagcctttattgccatatgaggaatggtgcattgagttttcagagattactgttggtattcgtgtgggagtagggttctttggagaagtctttcgtggcctctggaatggaacagatgtagctataaaagtattcctggagcaagatttgacaacagagaatatgaaagatttctgcaacgagatctcaatacttagccgacttcgacatcccaatgtcatactcttccttggtgcatgtatgaagcctcctcacttatccctagtcactgagtacatggaattgggttctttgtacagtctgattcattcaaaaacgcataaaacgaagctccattggaagaggaggttaaagatgctccgtgatatctgtaggggcctcatgtgcatgcaccgactgaagattgttcatcgtgatctcaagagtgcaaattgccttgttaacaaatactggacagtcaagatatgtgattttgggctctctcaaataatgtcagattctgcaatgaatgacaactcacctgcggggactccagagtggatggctcctgagctcattcgcaatgagccattcacagaaaaatgcgatatcttcagctttggggttatcatgtgggagctttgcactctgagtagaccatgggaaggaataccacctgttcagatcgtttattctgttgccaatgatggggcgagactggaaataccagaaggacctcttggaagcttgattgcggattgctgggcagagccggagaggcgtccaagctgccagaagatcctgactcgccttcttgattgcgagtatactctatgctgaaatttttgcctctagtctgtatagtggttttaggggcaccaaattggtccggcttatacatgaattttcatttcccgttttacatcattgaggatgtaaattagaaatatatactataataaacaaacttttttgtacctctttaatgccacatatgattccctg

SEQ ID NO: 14583 - protein, 789 aa, Panicum virgatum
  misc_feature: Ceres CLONE 1777154
  misc_feature (533)..(781): Pfam Name: Pkinase_Tyr Pfam Description: Protein tyrosine kinase
  misc_feature: SWISSPROT Homolog: EC 2.7.11.1 Non-specific serine/threonine protein kinase
MDDLPGDEGRSQTQSSDPNWPSHLDHKFQSLSLTKQEKNLDSAYSSLDSREAGHSLQAAQTLWSTGSLSGPIPNGFYSIIPEKRLKERFDTIPSPDDLYSLGIEGFKAEIILVDIERDKKISALKQLCTALVKGLNSNPAAMIKKVAGLVSDFYKRPNPHLSPARTSSEELSHFLENRGVQFLGQIRHGSCRPRAILFKVLADSVGIDSKLLVGIPNEEPHGYDDSSKHMSVVVTMKSAEFLVDLMRFPGQLVPFSSKAVITSHISAAGESDSADYDSCDSPLEPNSPLCAQRQEQDDSNRSFKATSLRNIMLKSTNSMEGKMKCSSHSDPNVANAFYGRSRKKVVDEHQRTASSSPEHPLSRVRGRSMLGDKQGNGVAVSRSDGASTSNARIARSRSISITPEISDDIVRAVRAMSESMRQNRLSRGQNDGTLVSSNDSQKHEPAGDPHDDEVSTRRPSALEGLRRQINSQKAVSLPSSPHRSSILASDLRGPSDFTEADLMSTWNKVLQSSPFLNKPLLPYEEWCIEFSEITVGIRVGVGFFGEVFRGLWNGTDVAIKVFLEQDLTTENMKDFCNEISILSRLRHPNVILFLGACMKPPHLSLVTEYMELGSLYSLIHSKTHKTKLHWKRRLKMLRDICRGLMCMHRLKIVHRDLKSANCLVNKYWTVKICDFGLSQIMSDSAMNDNSPAGTPEWMAPELIRNEPFTEKCDIFSFGVIMWELCTLSRPWEGIPPVQIVYSVANDGARLEIPEGPLGSLIADCWAEPERRPSCQKILTRLLDCEYTLC

SEQ ID NO: 14584 - DNA, 2385 bp, Panicum virgatum
  misc_feature: Ceres CLONE 1777165
  misc_feature: Encodes the peptide sequence at SEQ ID NO. 14585
aaattccccacgcgcagcggcgcaggtgttgccttcgcttggcgtccgtccgccgaaaccaaagtcgccgccctcttctccccctccgcccgtccgccgtcacctcccctccacctctccacccgccgtttgaccccatcccctgctcactttccccttccgttcccctcccccgcctgctcctccgccagccgccccgtcctaggtttatcgcgttccccagaatccaaccgccttcttccgggccgcccggtggccgcacgccgcgggccctcgcatggtggcccccgtgacggcgtgaggggctgcgcgcgctcgtggtgtgcatcggggagatagagagatagatagatgaggccctcggccgctgccggccgcagcggcgccgtgatgagggccgctgctgtggggctcgtgctggtcggcgtcgccctggccccgccgctggccgcggcgttgcggccgctccgggaacgtgtcgcgtccgctggagccgcggcctccgccggttcgtggggcgatgagcacgccttcttcaaaagggatgaaaatgatataggcccctattcatggaatattacgggaacgtataaagggagctgggcctttgctggtgccacaaatggttcatctaggtttcttgagtttgtgaaatctaaaggtgattcggttctggaattgttgagcactccaacaaagataagcggggtgcactatgttcagggatcaattacattccatgatgtcattgacaatgcccatgatcatggagtggctcaaataaggttggaaggagtgtacatatggccttttagacaacttcggatggtagcaaacagtggtgcagatggtgagccacttcaagaagaggattactttttgtcaaatccataccatttgctgcgaattttctcctctcaagtattccaagaatcttctgaagataagaaccgaaggaagaattctctcacatatgacatggagaaacactgtaacacagaaatagctgctaaggtggttcgcttgtcatctaacccaaatgatggagagcatgagaagtaccggttggagggtttgatggagagtccagccgtcgatgatgatggagagtgcttctcacctatcttactaaatgcgacttctttgaatgttgaagtctattacaacaaagcagtcaactacacactgatggtcacttttatctctttccttcaagttttgctgttgattagacaaatggagcatagcaacactcaatccggagctgctaaggtttctattttaatgattgaccaacaagctatcatggatgcatatctctgtctgctccatctgactgctgggatattggttgagtcactgtttaacgccttcgcaacggctgcattcttcaaatttgttgtattttctatttttgaaatgaggtaccttcttgccatatggaaagcaagtaggcctttaaacagtggagaaggttgggagataatgaggcgagaactatctgttctttacagccgcttttatggtattcttttgggaggaatccttctaatgtatgagctgcacaatttcttacgcccacttcttctcctgatgtactccttttgggtaccccaaattgttacaaatgtcatcaaggatacaagaaaacctctgcacccacagtatattttaggcatgacagttacccgcctcgctattccactgtatatatttggttgccctagtaacttcatgcgcattgagcctgacaagaaatggtgcatagctgttacggcattcatgggtatccaagcagcagtgcttttgcttcagcactatcttggttctcgctgctttattcctcgccagatcctgcctgagaaatactgctaccacaggaaggttgaggatagcacgaatcagcccattgattgtgttatttgcatgactacaatcgatcttacccaaagaacaagtgaatacatggtggcaccttgtgagcatatattccactcaggctgtttacaacgatggatggacatcaagatggagtgcccaacttgcaggcgttccctaccaccagcttagatgagggctttgtaccagagttaacaagaagtaggtagctcagcctatacaaggtggaaactgaggtacaaaaaggcaaggctgcaactgcatgaaagcaatcgacataactgtagagaagttttatgctattgattttaagtggtcttgtgttgtacaaactattgtatcaagcgccccacggagaaatcgttctcagctgcccttgcggttttctctgtcgtatgcctttgcctgctacaagtatttcagtcctgcattttggtttgagcgttgtacaaaagggtgttgacaatttgaaagagttccagatgc

SEQ ID NO: 14585 - protein, 572 aa, Panicum virgatum
  misc_feature: Ceres CLONE 1777165
  misc_feature (522)..(565): Pfam Name: zf-C3HC4 Pfam Description: Zinc finger, C3HC4 type (RING finger)
  misc_feature: SWISSPROT Homolog: EC 6.3.2.19 Ubiquitin--protein ligase
MRPSAAAGRSGAVMRAAAVGLVLVGVALAPPLAAALRPLRERVASAGAAASAGSWGDEHAFFKRDENDIGPYSWNITGTYKGSWAFAGATNGSSRFLEFVKSKGDSVLELLSTPTKISGVHYVQGSITFHDVIDNAHDHGVAQIRLEGVYIWPFRQLRMVANSGADGEPLQEEDYFLSNPYHLLRIFSSQVFQESSEDKNRRKNSLTYDMEKHCNTEIAAKVVRLSSNPNDGEHEKYRLEGLMESPAVDDDGECFSPILLNATSLNVEVYYNKAVNYTLMVTFISFLQVLLLIRQMEHSNTQSGAAKVSILMIDQQAIMDAYLCLLHLTAGILVESLFNAFATAAFFKFVVFSIFEMRYLLAIWKASRPLNSGEGWEIMRRELSVLYSRFYGILLGGILLMYELHNFLRPLLLLMYSFWVPQIVTNVIKDTRKPLHPQYILGMTVTRLAIPLYIFGCPSNFMRIEPDKKWCIAVTAFMGIQAAVLLLQHYLGSRCFIPRQILPEKYCYHRKVEDSTNQPIDCVICMTTIDLTQRTSEYMVAPCEHIFHSGCLQRWMDIKMECPTCRRSLPPA

SEQ ID NO: 14586 - DNA, 1665 bp, Panicum virgatum
  misc_feature: Ceres CLONE 1777166
  misc_feature: Encodes the peptide sequence at SEQ ID NO. 14587
acagagaggcagaggagaggcaccctctcaagcctcaaggcttcacgagacctcccctctgctgccatctcctctcctcccctcctctcctctgctgctgctgtgtgtgtgcaagaaaccccaagggagaggtgaaagcaagaggctaggcttcctcgacggagatgggggcgcagaggtacaggttcttcttctgcgggtgcggcgccaatgcggcggccggcgaccgtgagggcgacgacgacggggatttcggcgcgttcggggagaaggccgagaagggggcggaagccggcccgcgggggctgtcgtgggcgcaggtggaggcgatgaccggcgggttcacctccgccgtggtcggcgagggcgggttcagcaccgtgtacctggcgcgcctctccagcgcgctcgccgccgtcaaggtccaccgcagcagcgagcgcctccaccgcgtgttccgccaggagctcgacgcgctccagcgcgtccggcacccgcacatcgtccgcctcctcgccttctgcgagcagcaagaggaaggcgtgctggtgctcgaattcgcggcgaacgggaacctgcacgagcggctccacggcgggggcaaggcggcgggggctatgccgtgggcgcggcggatgtcggtggcgctgcaggtggcgcgggcgctcgagtacctgcacgaccagtgcgagccgcaggtggtgcacggcgacgtcaaggcctcgaacgtgctcctggacgcgtccatggccgccaagctctgcgacttcgggtcggcgcggatggggttctccgccgccgtccgcccgcggccgtcggcgcgcaccatgctgggctccccgggctacgtcgacccgcactacatccgctcgggcgtggtcaccaagaagagcgacgtgtacagcttcggcgtcctgctcctggagctcctcacggggatggaggccttctgcgcggcggagggccggctcctcaccgccgtcctcgcgccgcggctcagggccgactgcgacgcgcgcgggctggtcgacgagcgcctcggcaccgcctacgacgccgccgaggccgccgcggtggcggcgctcgccgcggcctgcgtcggcgagaaccccagcctccggccgtccatggccgacgtggtgcgcaccctggagcagggcgcgcagggatccatctccgccgtcgggaggggatcggacggccacgggaaggtctgagtcaccaggtgggggaagtcgtcgctcgccccgaggcgctcagatctggcattctggatttttttttgggtaatgatctggcattctggattgccgagttgttaacttgcggcgaagtgcgggcgcccgcacacgtggcgcccggctactggttgctaggagaacaaagcgttgttagtgggcgagcatctcaaaaagaacgcctcaaaaaaaaaggagagaagagattatttaggggaaaagatttggaggagataaaaaggcgactactcctagctaggccagggttcgtgtgctaatggggaatttcaatcatattaagccaaagtgggcatcgatctgggggagaccaaaaaagaatggatcgtacatcgcacgattctaagattttgttgattcttgatttcttttgttattttttgtaaagtacaatgtgtgctcttggctc

SEQ ID NO: 14587 - protein, 350 aa, Panicum virgatum
  misc_feature: Ceres CLONE 1777166
  misc_feature (59)..(329): Pfam Name: Pkinase Pfam Description: Protein kinase domain
  misc_feature: SWISSPROT Homolog: EC 2.7.11.1 Non-specific serine/threonine protein kinase
MGAQRYRFFFCGCGANAAAGDREGDDDGDFGAFGEKAEKGAEAGPRGLSWAQVEAMTGGFTSAVVGEGGFSTVYLARLSSALAAVKVHRSSERLHRVFRQELDALQRVRHPHIVRLLAFCEQQEEGVLVLEFAANGNLHERLHGGGKAAGAMPWARRMSVALQVARALEYLHDQCEPQVVHGDVKASNVLLDASMAAKLCDFGSARMGFSAAVRPRPSARTMLGSPGYVDPHYIRSGVVTKKSDVYSFGVLLLELLTGMEAFCAAEGRLLTAVLAPRLRADCDARGLVDERLGTAYDAAEAAAVAALAAACVGENPSLRPSMADVVRTLEQGAQGSISAVGRGSDGHGKV

SEQ ID NO: 14588 - DNA, 726 bp, Panicum virgatum
  misc_feature: Ceres CLONE 1777171
  misc_feature: Encodes the peptide sequence at SEQ ID NO. 14589
aaaaaaaaagaccaagaactcattcgaaaaacagagcactagcagagcggagcagaggagcaagaggggcagccatggagatgggagacagcttcgagtactactgggagatgcagcgcttattcgaatccgacgagctcaggtacgccctcgccgccgccattgcttcgggacttgacgccggggatgctgtgattgctgatccgaacgccgcaatggcagcgtctacctgaatggcgcgcaggacgacgcgctgtcctgctacgactccagctcgccggacgggtccatgtccaactcgtcctgggcgccggcgccggcggcgaccgcggcggacgacgccaagggacccggcgcggacgcggccgcggccgagggcggcgcggcggaggcggcggccaggaacatcatcatggagcgcaaccgccggcgcaagctgaacgagaagctctacgcgctgcgcagcgtcgtgcccaacatcacaaagatggacaaggcgtcgatcatcaaggacgccatcgagtacatccagcagctgcaggcggaggagcggcgggcgctgcgggagctcgaggccgccggcggcgcgcagcgtatggacgagtacgggtacgacgagggcgtcctcctgcaggcggagcgggcgaagagactgaggcgcgcgcggcccgtcgccccggcggggcccgtggaggtcctggagctgcgcgtggcggaggtgggcga

SEQ ID NO: 14589 - protein, 145 aa, Panicum virgatum
  misc_feature: Ceres CLONE 1777171
  misc_feature (37)..(84): Pfam Name: HLH Pfam Description: Helix-loop-helix DNA-binding domain
MSNSSWAPAPAATAADDAKGPGADAAAAEGGAAEAAARNIIMERNRRRKLNEKLYALRSVVPNITKMDKASIIKDAIEYIQQLQAEERRALRELEAAGGAQRMDEYGYDEGVLLQAERAKRLRRARPVAPAGPVEVLELRVAEVG

SEQ ID NO: 14590 - DNA, 637 bp, Panicum virgatum
  misc_feature: Ceres CLONE 1777171-R
atccagaaaccatgagctcgctggtcactgctgctgattggctgttttaattatgtgcatgattaattcatttcaaaaaaattatgtgcatgactagcgcgtggttgactcagggattcggatggaaccatactatatgttgttcgttgcgacgtttactactccaattcacatgacgatctggatctggacagaggttgacttgtataaatatcgtcttgttaatttgtttttgcaggtggatcaaggggacgaccgtgctcggatgaagcgcaccatcgaggccgccctcgcgcagctcgacgccgggagccccctgagtgtgatgagctactagttctttcatcaactgacgtcatcaagaagatacaatcatattaattccaccggttgagtcagccgccgatgcttttttttttcttaagggtgtgttttttttgtgtggtaccctactaccctttcatcagcgccctccatgtacatagaaggtgaccgagcgagcgaggcagcagcaggccaggagtttacactaggagagatgcatgcagtgatcgaccttgggctcatctcaaacaacaagtggtttcatttttgcctaaatctcaagaaataacacttatcttgacggctacaacgg

SEQ ID NO: 14591 - DNA, 2749 bp, Panicum virgatum
  misc_feature: Ceres CLONE 1777176
  misc_feature: Encodes the peptide sequence at SEQ ID NO. 14592
atgctggcgatcagattctattccccttccccctagctaccaccacggccgccctgtgctctgctgttgctcacagcgaccaacaccgacgcaccgactgcttcttcttccctcccaatcttacgccgacgccgcccaccatccccgtttggagtcacagagagcggccgaggcaagcgtagcaatgctgggagccaggccgaaatctgcggcggccgaaggcaagagcggcaaggtcacgccgccgacgcccaaggggagcagggcgagcaagccggcctccgccaagccggccaatggcaccccgccgcaagcgccgcgcacagccgacaggtcccccaggtcggcggacaagccgctgtcgggcgaccgacgcacgcccaaggtcttcgaccggcttagcacgcccccggccgagaagcaaagcagcgccgtgaagctgtcccaggagctgcaggcgcagctcgccgcggtccaggaggagctcgtgaaggccaaggagcagctggtggagaaggagaaggagaaaggcaaggtccttgaggaactagaggatgccaaacggctggccgatgaggccaatgccaacctgatggtcgcgcttgccgcgcggaagaaggcggaggaggcctccgagaccgagatgtttcgggcagtcgagctggagcagacgagcatcgagtcgatgcagaagaaggaggaggagctgcagaggaagctggagagcatgcggagccagcaggagtctgatgcggctgccctgcggtcgactgtggagcagctcgagaaggcgaggtatgagctggctgacgcaatcgacgccaagaacttggcgctcaaccaggtggatgatgcggcccggcttagtgaagtgaatgctcacaaggtggagctcctcagtgcagaggttgctcgcctgaaagatttgcttgacactgagctggagagcaaagagaaagaaggtgctgagcgaatcatgaggctcgaggcagaggtctccacactgaagattgagctccagaaagcaaaggaggctgaagagaaggtagctgaattaggagatgttatcgaagagcttagagttgatgtcgccaatgctacaaaggccacaactgaggcagaggagctggctgatgaatggaaacaaaaggctgaaatactggaaattaaattggaggcagccaaccagtcttacatgtcgaaggttgattccttgaattcagtaatgaaagaattagatgcagcaagcaccttgctcgctgagaaagaatctgaactttctgaccttcagaacaagctgcaagccttagaagatgaggtagctaggcagaatgaagatattattgtgtcaaatgagcgtcttgatgttgcagagaaagaagcaactgaattgagggaagagatcaatgatctccagtcgaagctccaagcacttgaagaggagaagatggatgctatcaacaacgagaacaatgcaagctcacaaattgattcaatatatgaagagaaggagaagctggctcaggaactagaagctagcaaagatgaatatgagaaagttaagaaggctatggaagatctagcttcagcattgcatgaaatgtccggtgaagcgagagaggcacgggaaaggtacctcaacaaacaagaagagattgagcgtgccaaagcacagatagaggagctcaacatgaatctcaagaacacccaggagaactatgaggttatgctcgatgaagcaaactacgagagagtctgcttgaagaagacggtggagcgaatggaagcagaagcgaagaacacatctgaggattggcaatccaaggaggccagctttgtaagctccattaaaaagtctgaagaagaaattagtgcaatgagagttgagatggataaggtaacagaaacagcgagagactgggagaacagaaatgctgaattggaggagaggctgaaggagctggaagctcaggtggaggaagctaacagagccaaggatgaagcaaaagctgaagcactaggctggaaagagaagctattggacaaagaaaatgagctgcagaacataaaacaggagaatgatgagctacaggttaaagaatcgaccgcctccgagaaactcaaggagatatcttccatgcttggcaatgcaaaaggtagaatgctaaatggcacaggtttgaaagatgagaacgaaatggcaaataccaaggacgacgatcctgtgatggtagttgctaagatgtgggagaacagcaaggtcaccgactataacttgtctaccgagaaggagaaagatgacgaatcagaacttgatctggagtctaacaggggagatgctgcctctgactgccacaggttgtccacagacaccaggatgaacagcaacaccaagctggcaatcaagcagcagcaacccaaaaggcctttgatgaaaaaatttggtggtttgttgaagaagaaaagccagcattagaacaaattgagctatttcgaagaaaaaatatcgatgtacactatggatgactatttctctagcttcacattcactttggtcctgcagagttggaagtaaagataatagtataagaagtctcagaagagaacagaagggtgctgtatttgcttccctttttctgtctaattccttgtattgtgtatgtttgaggagcattcgtcatactctagttcatgtatttcttggtctgctggggtaatgttaatgtaaaaatgtgaggtttcgattcag

SEQ ID NO: 14592 - protein, 763 aa, Panicum virgatum
  misc_feature: Ceres CLONE 1777176
  misc_feature: SWISSPROT Homolog: EC 2.7.11.1 Non-specific serine/threonine protein kinase
MLGARPKSAAAEGKSGKVTPPTPKGSRASKPASAKPANGTPPQAPRTADRSPRSADKPLSGDRRTPKVFDRLSTPPAEKQSSAVKLSQELQAQLAAVQEELVKAKEQLVEKEKEKGKVLEELEDAKRLADEANANLMVALAARKKAEEASETEMFRAVELEQTSIESMQKKEEELQRKLESMRSQQESDAAALRSTVEQLEKARYELADAIDAKNLALNQVDDAARLSEVNAHKVELLSAEVARLKDLLDTELESKEKEGAERIMRLEAEVSTLKIELQKAKEAEEKVAELGDVIEELRVDVANATKATTEAEELADEWKQKAEILEIKLEAANQSYMSKVDSLNSVMKELDAASTLLAEKESELSDLQNKLQALEDEVARQNEDIIVSNERLDVAEKEATELREEINDLQSKLQALEEEKMDAINNENNASSQIDSIYEEKEKLAQELEASKDEYEKVKKAMEDLASALHEMSGEAREARERYLNKQEEIERAKAQIEELNMNLKNTQENYEVMLDEANYERVCLKKTVERMEAEAKNTSEDWQSKEASFVSSIKKSEEEISAMRVEMDKVTETARDWENRNAELEERLKELEAQVEEANRAKDEAKAEALGWKEKLLDKENELQNIKQENDELQVKESTASEKLKEISSMLGNAKGRMLNGTGLKDENEMANTKDDDPVMVVAKMWENSKVTDYNLSTEKEKDDESELDLESNRGDAASDCHRLSTDTRMNSNTKLAIKQQQPKRPLMKKFGGLLKKKSQH

SEQ ID NO: 14593 - DNA, 1373 bp, Panicum virgatum
  misc_feature: Ceres CLONE 1777201
  misc_feature: Encodes the peptide sequence at SEQ ID NO. 14594
gtaccagcagctcgaggcgcgagtcagagaccagcaggcagctgccacagccactagacctcgagagcagaggagcgcggcgcttggagcgggatggcgagaatggcgctggcggcggcgctggtggtggtggcggtggccggcgtcctcgccggcggtgcgcgggcgcagctggttgaggggttctacgcgcaaagctgcccgcaggcggagaagatcatcaaggactacgtggcagagcacgtcccacgcgtgcccaccatcgccgccaccctcctccgcacccacttccacgactgcttcgtcaggggctgcgacgcgtcgctgctgctcaacgcgacgggcgggaaggaggcggagaaggacgcggcgcccaacaagacgctgcgcggcttcggcttcatcgaccgcatcaaggagatcctcgagaaggagtgccccggcgtcgtctcctgcgccgacgtcctcgcgctcgccgcccgcgactccgtcgtcgtcaccggcgggccgtcctggagcgtgccgacggggcggcgcgacggcacggtgtccctcaagcaggaggcgctggacaatatccccgcgcccaccatgaacttcaccgagctcctccagaacttccagaacaagagcctcaacctcgccgacctcgtctggctctcaggggctcacaccatcggcatcgggcactgcaacaccttcagcgagcgcctctacaacttcaccggccgcggcggccccagcgacgccgacccgtcgctggacccggcgtacgcggacaacctgcggcggaccaagtgcaagacgctgacggacaacaccaccatcgtcgagatggacccgggcagcttccggaccttcgacctgagctactaccggggcgtgctcaagcaccggggcctgttccagtcggacgcggcgctgctcaacgacgcgacggccaaggccgacatcctcttcgtggtgaactcgccgcccgaggtgttcttccaggtgttcgcggcgtccatggtgaagctgggcgccgtcgaggtcaagacaggctccgagggcgagatcaggaagcactgcgccgtcgtcaacaagcactaggcgccattgggggacccggacaaacggttccatttcttcagagatccttgggacactggtggtggatacctggattgtggtgtctctacgttcgttttttttcttggttgttgtattcttttgttacctttgtgctgatcattggggtgatcttttttttggtttctctgtaactatgtgatttacgcattttgttcttattattcctgcaactgtaagttaattcagtgatcgatgattgatatacatgaaggtgaaataaaaaggtgggtcattctgtc

SEQ ID NO: 14594 - protein, 332 aa, Panicum virgatum
  misc_feature: Ceres CLONE 1777201
  misc_feature (43)..(292): Pfam Name: peroxidase Pfam Description: Peroxidase
  misc_feature: SWISSPROT Homolog: EC 1.11.1.7 Peroxidase
  misc_feature: Useful for making plants with altered carbohydrate content
  misc_feature: Useful for making plants with altered cell wall content and/or composition
  misc_feature: Useful for making plants with modulated phosphate use efficiency
  misc_feature: Useful for making plants with modulated nitrogen use efficiency
MARMALAAALVVVAVAGVLAGGARAQLVEGFYAQSCPQAEKIIKDYVAEHVPRVPTIAATLLRTHFHDCFVRGCDASLLLNATGGKEAEKDAAPNKTLRGFGFIDRIKEILEKECPGVVSCADVLALAARDSVVVTGGPSWSVPTGRRDGTVSLKQEALDNIPAPTMNFTELLQNFQNKSLNLADLVWLSGAHTIGIGHCNTFSERLYNFTGRGGPSDADPSLDPAYADNLRRTKCKTLTDNTTIVEMDPGSFRTFDLSYYRGVLKHRGLFQSDAALLNDATAKADILFVVNSPPEVFFQVFAASMVKLGAVEVKTGSEGEIRKHCAVVNKH

SEQ ID NO: 14595 - DNA, 688 bp, Panicum virgatum
  misc_feature: Ceres CLONE 1777210
  misc_feature: Encodes the peptide sequence at SEQ ID NO. 14596
tcaagggatccacccacccgagccgccgccatgccgcgctgctgcccctgcgcgacctcctcctctcccgccctcttcctcctccccaccgttcccgcctcttccacttccaaaaccaccagcagcagcagggttgccttggccccgtgcgatggcgccttcagctgtgtcagcgggaggctgcggtgggggacgagaccgagaggcaggtacgccatagtcgcggcgagcggcaaggacgggagtggtacggcggaagaggagaaggaaaaggacgagccggggttcaatccgttcgggttcgtcacagacaacccctccagccgcagcgccatccagctccccgcggttcccgccgaggacggcaatatcggccagatgctctacaggatcgaggacaaggggaaggagtacggttcgtatgtcagatcaagagagtttcgatggtttgtgagggaaacaggttcacctgatgcacgacgtggtactattgtgttccttcacggagctcctactcaatcatttagttaccgtgtggttatggctcagatggcagatgctggctaccactgctttgcacctgactggatcggatttgggttcagtgagatgccacaacctggatatgggttcgactttaaagaggaggagttccacaaggcatttgatgatcttcttggtactctaa

SEQ ID NO: 14596 - protein, 219 aa, Panicum virgatum
  misc_feature: Ceres CLONE 1777210
  misc_feature: SWISSPROT Homolog: EC 3.8.1.5 Haloalkane dehalogenase
MPRCCPCATSSSPALFLLPTVPASSTSKTTSSSRVALAPCDGAFSCVSGRLRWGTRPRGRYAIVAASGKDGSGTAEEEKEKDEPGFNPFGFVTDNPSSRSAIQLPAVPAEDGNIGQMLYRIEDKGKEYGSYVRSREFRWFVRETGSPDARRGTIVFLHGAPTQSFSYRVVMAQMADAGYHCFAPDWIGFGFSEMPQPGYGFDFKEEEFHKAFDDLLGTL

SEQ ID NO: 14597 - DNA, 1918 bp, Panicum virgatum
  misc_feature: Ceres CLONE 1777214
  misc_feature: Encodes the peptide sequence at SEQ ID NO. 14598
accgctccccgcgtagtactcgtgctgggagatcccatctctctcctcctctcccatcctccgctcgcctagggtttcgcgccctcgtcacccggcgaggcccagcccggcgtagggcggtcgtctgcatcgccggccagagagatggctggcgggtttcgagtactgcatcttgtcaggccctttctggctttcttgccagaagttcagagtgctgataggaaaataccattcagagagaaagtgatctacaccgtcatttctctctttattttcctggtctgcagccagctcccgctctatggcattcattctactactggggcagaccctttctactggatgcgtgttattcttgcatcaaaccgtggtactgttatggagctgggtatcactccaattgtgacatctgggatggtgatgcaacttctagtgggatcaaagattattgaagttgacaacagtgtgagggaggatcgtgctctgctaaatggtgctcagaagttgcttggtatcctcattgctattggagaagctgtggcatatgttctctctggaatgtatggcagtgtgagccaacttggcactgggaatgctattctcattatacttcagcttttctttgctggcatcattgtcatctgtctggatgaactcctacagaaaggctatggtttgggttctggtatctctctgttcattgctactaatatctgtgagaacatcatctggaaggcatttagcccaacaaccatcaacagtgggcgtggtgctgaatttgaaggggctgtcattgctttgttccatcttttgattactcgaactgataaagtccgtgctctacgcgagactttctatcgtcagaatcttccaaatgtgaccaatttacttgctactgtcttggtcttcctcatagttatctacttccaaggcttccgtgttgtgcttccagtgagatcaaagaatgctcgtggtcaacaaggctcgtacccaatcaagctattctacacttccaacatgcctatcattctgcactctgcactgattaccaacctctatttcatatcccagcttctctacaggaaatacagtggaaatttccttgttaaccttcttgggaaatggaaggaatccgagtactctggtcattctgttcctgttggtggtcttgcttactatgttactgcaccatcaagcttggctgatgttctggcaaatccattccatgcattgttctatgtggtcttcatgctgtcagcttgtgctctcttctcaaagacatggattgaagtttctggttcatcagcaaaggatgttgctaagcagctgaaggaacaacaaatggtgatgccaggccatcgtgagtcaaacctgcagaaggaactgaacagatacatccccactgctgctgcatttggtggagtatgcattggtgcattgactgttctagctgatttcatgggcgcaattggctcaggaacgggtattctgcttgctgtcaccatcatataccagtactttgagacattcgagaaggaaagggcaaccgagcttggtttctttggtttctaatctccttagcagcaggagccgtaatatgggtataggcttaatcttcctgcaagtcacagtactgtttggccggctgtttattgttgtaatcggagagcttatagtcagcttaggttgcagactaatttacagaggggatcaaggaaactagtagcaggttctgcatgcgttttgaggccagtatggtggcataagttctgccaaagtacagccgcagtcatcatcaagtatggtggcataagttctgccaaagtacagccgcagtcatcatcagttggcctttttcagtctttttatgttttgactatagtgacctggatgattttggatgaatttagttatcgtg

SEQ ID NO: 14598 - protein, 475 aa, Panicum virgatum
  misc_feature: Ceres CLONE 1777214
  misc_feature (77)..(461): Pfam Name: SecY Pfam Description: eubacterial secY protein
MAGGFRVLHLVRPFLAFLPEVQSADRKIPFREKVIYTVISLFIFLVCSQLPLYGIHSTTGADPFYWMRVILASNRGTVMELGITPIVTSGMVMQLLVGSKIIEVDNSVREDRALLNGAQKLLGILIAIGEAVAYVLSGMYGSVSQLGTGNAILIILQLFFAGIIVICLDELLQKGYGLGSGISLFIATNICENIIWKAFSPTTINSGRGAEFEGAVIALFHLLITRTDKVRALRETFYRQNLPNVTNLLATVLVFLIVIYFQGFRVVLPVRSKNARGQQGSYPIKLFYTSNMPIILHSALITNLYFISQLLYRKYSGNFLVNLLGKWKESEYSGHSVPVGGLAYYVTAPSSLADVLANPFHALFYVVFMLSACALFSKTWIEVSGSSAKDVAKQLKEQQMVMPGHRESNLQKELNRYIPTAAAFGGVCIGALTVLADFMGAIGSGTGILLAVTIIYQYFETFEKERATELGFFGF

SEQ ID NO: 14599 - DNA, 2008 bp, Panicum virgatum
  misc_feature: Ceres CLONE 1777229
  misc_feature: Encodes the peptide sequence at SEQ ID NO. 14600
cttgagctaagcatagcatctcgagccttcccttcctcgctccccgctcccattccctgccagctcgcccgcccatcctttcttcttcggagggagcacagagcagcaggtcaaagggagctgcgaaaggcggccgctttgggcgcggcgcgccagatctgggccgggtgggggctccggccggcaggcggcgcgaggaggaggaggaggaggacggcgagatgaagccgtcgctgcggagccggcaggagccgcggcgggtcagcaacagcgtcatcatcggcgcgatgctgctctcgctctgcgtcctcagcatcgtcaaggccagatactgcgccacccccttcggcaaggcggaggaccagctccaggagcagatgaacgccagcatccggatggagacggaggagtcgccggccaggacgcccggagaggaggaggaggaagaggaggtagccacaacggcgcccgcggtgaccacgccggccgtcgtggccacctccggctccggcggcgggaaaggcaaaggcaagaaggggtccaaggcgaagccgacgtgctacatgacgagcaagcggtcggagcggtgcgacgcgtcgggcgacatccgggtggacgggaaccgctccaccatctacgtcagcgggatagaccgggagtggcggaccaagccgtacgcgcgctaccacgaccccgtcgccatggcccacgtccgcgagtacaccctcaagccgctccccgccggcgacgccgcgccggcgtgcaccaggaaccactcggtcccggggttcctcttctccaacggcggcttctccggcaacctctaccacgactacactgacgtgctggtgccgctcttcatcagcacccaccagttcaagggccgggtgcagttcctgctcaccgggatgaagccgtgatgggtggccaagttcacccccttcttccagcagctcacccggttcgacgtcatcggcgtcgacaacgaccgggaggtccactgcttcccccggatcgtggtcggccccaccttccacaaggacatgggcgtggacccgcggcggtcgccggggcacgtctcggtggtggacttcaagcgcgcgctccggcgcgccttcgggctggggcgcgaggcggcgtcccgcggcggcgcggcgggcgccggccggccgcgcctcctcatcatctcccggcgcgggtcgcggcggttcctgaacgagcgcgagatggcgcgcgccgcggcggcggccgggttcgaggtgcgcgtggcggagcccgaccagcacacggacatggcgaccttcgcgcggctggtgaactcggcggacgtgatggtcggcgtgcacggcgccgggctgaccaacatggtgttcctgccccgcggcgccgtgctgatccaggtggtgcccttcggcgggctggagtggctcaccggcgtgacgttcaaggacccggcggcggacatggaggtgagctacatggattacaacgtgaagctggaggagagctcgctgatcgaccagtacccgaggaaccaccaggtgctcaccgaccccgacgccgtgcacaagcagggctgggacgcgctcaagacggcctacctggacaagcagaacatccggatggacctcgacaggttcagggccacgctgcaggaggccatgagccggctgccatcgccatgacgggtactccgggaggaggtagataggttggtgtatctatcggacaggaggacacatccgtgccttgtggtcgctcgctcaacttcgagtcccctttttttttttcgagcttcgatcgatcctttttagcaagattcattggatgatccattgttttgttacataaaggaggatgggaaaatggtgaacaggcagaagcaagaacattgttttgtttatatactactactgtactgtagagaggccagctcaatccagcccagtgcccagatgatgatttgttaattgcttaatttatagaaacccttttgtgattattggcg

SEQ ID NO: 14600 - protein, 213 aa, Panicum virgatum
  misc_feature: Ceres CLONE 1777229
  misc_feature: Useful for making plants with altered carbohydrate content
MGVDPRRSPGHVSVVDFKRALRRAFGLGREAASRGGAAGAGRPRLLIISRRGSRRFLNEREMARAAAAAGFEVRVAEPDQHTDMATFARLVNSADVMVGVHGAGLTNMVFLPRGAVLIQVVPFGGLEWLTGVTFKDPAADMEVSYMDYNVKLEESSLIDQYPRNHQVLTDPDAVHKQGWDALKTAYLDKQNIRMDLDRFRATLQEAMSRLPSP

SEQ ID NO: 14601 - DNA, 1716 bp, Panicum virgatum
  misc_feature: Ceres CLONE 1777241
  misc_feature: Encodes the peptide sequence at SEQ ID NO. 14602
atttcagtccatccccacctcctccaacaaccccgtcaccaccacctcctcctcctgccatccttcgtccgtacacctctccctccctctcccctcgcccttccctcccctcctccccaagccatccccgacaaggggagaaccaacctctccggcggccgaagccgatggaggcgaactccggcgagggcgctcccaagcgcaaccccctcacgtccgccctcgtctccaacctcgagtccgtgctcgccgcgcgccgcgcccccccggccgaggaggtcagcaccgccgccgcatcgggcgaggcggaggctcccgatgccccgccgaccgatggagcgccgtcgaggcccgtcgtgctgttgacctgcgccggggggatccggtcggcgggtctcgcggcgctcatcgacgccctcgtcgccggcggccgctgcgacgtccacgtgtgtgcccccgaatcggacaagccagcctgcggtcactcaattaccgtccgtgagaccatcactgcgacatccgtggatttcaaaggggctaaagcttttgagatatccggcactctggttgactgcgtctcattggcgttatctgggaagctgtttccttggtctgcacctgctttggtgatcagcggtattaacgcgggaccaaattgtggatatgagatgttccactcttctgccattgctgctgcaagggaggccttagtgcatggggtgccttcaattgcagtctcattgaattggaagaaggatgaaagcaaagacaaggacttcaaggatgcagctcaggcctgtttgccattgataaatgctgccttggctgacattgagaaaggaattttcatcaaagggtgcctactgaatattgggattccaagctcaccatctgcaaacaagggtttcaagttgaccaaacagagtggatacactcctgctcaaagttggcaagctgtgtcaacaaacaggccttcatctgctgtgcactttatgggcatgcatcaaagtctcggcattcagttggcgcagcttgggaaggatgcatctgcagcaggagctgcacgtagagttagtgctcagcgaaagacagtcgaggttgagtctgttgcagctgctggtaaagaagaggctcgtgaagtagtgaagaagttattccgtgctgagtttgttgagaagcaacatgaagatttaaatgaagatatcgatttgagagctatggagaatggatttatatctgtcactcctctgaatgtacatgggcaagtggaggctgaaattgtagccccagtttcagattggctctcagcagttgtatctctaggcaaagaaaaggaagctgctccagctacagctgaccagcaaattgctgctgaggaaaaagaagatccatcagcaacctaacaaacttgcagacatgtacacactttataggtgtcttagttcttgcagtgatggcagtcttttctctcctctttattgggtttgatttgtttagtctttttgcgcttgatattgttcagtgcaatttcaattttttttgttcacctttcttggccgtgcaaaatgatttgatgcagatgcctctacattttggatgtaaccatgtaggctacggcatctaacatatgaatactgcccagcccccactattttttcagtgtggtttgttctaggaaggtgttttattcagcatgggatatgtggttgattgtct

SEQ ID NO: 14602 - protein, 411 aa, Panicum virgatum
  misc_feature: Ceres CLONE 1777241
  misc_feature (62)..(259): Pfam Name: SurE Pfam Description: Survival protein SurE
  misc_feature: SWISSPROT Homolog: EC 3.1.3.5 5'-nucleotidase
MEANSGEGAPKRNPLTSALVSNLESVLAARRAPPAEEVSTAAASGEAEAPDAPPTDGAPSRPVVLLTCAGGIRSAGLAALIDALVAGGRCDVHVCAPESDKPACGHSITVRETITATSVDFKGAKAFEISGTLVDCVSLALSGKLFPWSAPALVISGINAGPNCGYEMFHSSAIAAAREALVHGVPSIAVSLNWKKDESKDKDFKDAAQACLPLINAALADIEKGIFIKGCLLNIGIPSSPSANKGFKLTKQSGYTPAQSWQAVSTNRPSSAVHFMGMHQSLGIQLAQLGKDASAAGAARRVSAQRKTVEVESVAAAGKEEAREVVKKLFRAEFVEKQHEDLNEDIDLRAMENGFISVTPLNVHGQVEAEIVAPVSDWLSAVVSLGKEKEAAPATADQQIAAEEKEDPSAT

SEQ ID NO: 14603 - DNA, 2020 bp, Panicum virgatum
  misc_feature: Ceres CLONE 1777253
  misc_feature: Encodes the peptide sequence at SEQ ID NO. 14604
cctctggttctgctgtcccacacatctttcctatcgataggcgaggggcgacgacgcaaaggcgagtggcgccgcccctgccagttcttcgtctcgtcgccggccgacaaagcccatatcctgtactggattcgacgtttgcgattgattgagttgggatggctcgtcgcctcattagccccgcggcggcgtgccgaggctgcggtttcgctaacgccggctttctcggcgccgtctcctccttccattatcaaagcttgccatcgtgctcaacctcatccaagcgggggtcatcggtgaagaattgctttagcttccgtgctcatttaaggaaagagggttcacgctggataaggtctgagcctttcttgtcagcaaatagtgcaaagttcgtcggcaagaggacatcctgttcagttgcaacagagccgcctcctgctgcaaccgaaaaaccagagatggatgctcccaaggaaatattcttgaaagattacaggaaacctgattatttgtttgacaaggtggatttgcaatttcaacttggtgaagaaaagacaatagttacaactaaaatagttgtatctcctggtgttgaaggaagcatctcagctccactagttcttcatggttgtgacctgaagctgttgtcaatcaaagttaatggcaccgagctaaagggcgaagagtatacagttgattcacgccatctgacggtttcaacaccgcctgctggtgtattcaacttggaaattgttacggaaatatatcctcagctaaacacatctttggaggggctgtacaagtcaactggtaacttctgcactcagtgtgaagcagaagggttccggaagattacctactttcaggatcgtccagatgttatggcaaaatatacttgccgcattgaagctgataaaactttgtatccagtattgttgtccaatgggaatcttattgagcagggagacctcgaggatggaaagcactttgcattgtgggaagatcccttcaagaaaccaagctacctgtttgctctagttgctggtcagttgggatgccgggaggattcatttgttacatgctccggccgcaatgtaacactcagaatttggactcctgcccaagatttgccaaaaacagcacatgctatgtattctcttaaagcagcaatgcagtgggatgaggaggtttttggtcttgagtatgatcttgatttgttcaacattgtcgttgttcctgatttcaatatgggagcgatggagaataagagcttgaacatatttcagtctagacttgtgcttgcatcacctgagactgccactgatggtgattacgctgcaattttgggtgttgttggacatgagtatttccacaactggactgggaatagagtaacctgccgtgattggttccagctaaccctgaaagaaggactgaccgtcttcagggatcaggagttctcatcggatcttggttgtcgaacagtaaaacgcatcgctgatgtctccaaactcagaatctatcaattccctcaggatgctgggcctatggcacatcctattcggccccattcctatatcaagatggacaacttctataccgtcacggtttacgagaagggtgctgaagttgtaagaatgtacaagaccatgtttggagcatcagggttccgaaagggcatggatctttatttccaaaggcatgatggacaagctgtcacttgtgaagacttctatgcagccatgtgtgatgcaaataatgcacaactgccacactttttacaatggtactctcaagcaggcacacctacagtcaaggtgtcatcttcatatgatcctagttctcagaccttctctttgaaatttagccaagaagtgccacccactcctggccaaccagttaaggagcctatgttcatacccgttgctgttggacttgttgactctactggaaaagatatgcccctaacttccgtttacagcgatggaactctccaaactcttgctagtgatgacaagcc

SEQ ID NO: 14604 - protein, 620 aa, Panicum virgatum
  misc_feature: Ceres CLONE 1777253
  misc_feature (128)..(488): Pfam Name: Peptidase_M1 Pfam Description: Peptidase family M1
  misc_feature: SWISSPROT Homolog: EC 3.4.11.2 Membrane alanyl aminopeptidase
MARRLISPAAACRGCGFANAGFLGAVSSFHYQSLPSCSTSSKRGSSVKNCFSFRAHLRKEGSRWIRSEPFLSANSAKFVGKRTSCSVATEPPPAATEKPEMDAPKEIFLKDYRKPDYLFDKVDLQFQLGEEKTIVTTKIVVSPGVEGSISAPLVLHGCDLKLLSIKVNGTELKGEEYTVDSRHLTVSTPPAGVFNLEIVTEIYPQLNTSLEGLYKSTGNFCTQCEAEGFRKITYFQDRPDVMAKYTCRIEADKTLYPVLLSNGNLIEQGDLEDGKHFALWEDPFKKPSYLFALVAGQLGCREDSFVTCSGRNVTLRIWTPAQDLPKTAHAMYSLKAAMQWDEEVFGLEYDLDLFNIVVVPDFNMGAMENKSLNIFQSRLVLASPETATDGDYAAILGVVGHEYFHNWTGNRVTCRDWFQLTLKEGLTVFRDQEFSSDLGCRTVKRIADVSKLRIYQFPQDAGPMAHPIRPHSYIKMDNFYTVTVYEKGAEVVRMYKTMFGASGFRKGMDLYFQRHDGQAVTCEDFYAAMCDANNAQLPHFLQWYSQAGTPTVKVSSSYDPSSQTFSLKFSQEVPPTPGQPVKEPMFIPVAVGLVDSTGKDMPLTSVYSDGTLQTLASDDK

SEQ ID NO: 14605 - DNA, 632 bp, Panicum virgatum
  misc_feature: Ceres CLONE 1777253-R
  misc_feature: Encodes the peptide sequence at SEQ ID NO. 14606
tgacagagcagtttgctgccttattagcactatctcaaaatccaggcaaagttcgggatgatgcccttttggatttctataaccagtggcagaacgactatttggttgtcagcaagtggtttgctcttcaagctacttcagacattcctggaaacgtggtaaatgttcagaagctgctctctcatcctgcttttgacatgaggaatcccaacaaggtctactcactaatcggtggattctgtgggtcacctgtgaacttccatgcgaaagatggttcagggtacaagttcttgggtgaagttgttttgcagcttgacaagataaaccctcaggtggcttcccgcatggtttcagcattctctcggtggaggcggtacgacgagaacagacaagcccttgctaaggcccagctggagatgatcgtgtcggccaatggtctctcggagaacgtgtacgagatagcttccaagagcttggcagattagtttgggggctttggtcgaggaaatgaattggacatggcagtgggtacggtagctgctgcaaagcgtgcgtaactgaaatgataatctattggcatgatgctaaatggggtattggtaataataaataaacctgcctgcttttgaatg

SEQ ID NO: 14606 - protein, 160 aa, Panicum virgatum
  misc_feature: Ceres CLONE 1777253-R
  misc_feature: SWISSPROT Homolog: EC 3.4.11.2 Membrane alanyl aminopeptidase
TEQFAALLALSQNPGKVRDDALLDFYNQWQNDYLVVSKWFALQATSDIPGNVVNVQKLLSHPAFDMRNPNKVYSLIGGFCGSPVNFHAKDGSGYKFLGEVVLQLDKINPQVASRMVSAFSRWRRYDENRQALAKAQLEMIVSANGLSENVYEIASKSLAD

SEQ ID NO: 14607 - DNA, 685 bp, Panicum virgatum
  misc_feature: Ceres CLONE 1777256
  misc_feature: Encodes the peptide sequence at SEQ ID NO. 14608
aacaaacatttggactccgaattttgcagagctagcctccctcctaccatcccccggagagacagagagagagaggcagggctttgattcgatcgatacgatggccacggacaagcagcgaggggacgaggaggacgcgtcccgggtggcgctgctgcacgcggacgtgaggaaggaggagcggcaggtggcggcggcgggcaccggcgatctcgggcagagggtgtgggaggagtcgaggaagctgtgggtcatcgtggcgccggccatcttcagccgcgtcgtcacctacagcatgaacgtcatcacgcaggccttcgcggggcacctcggcgacctcgagctcgccgccatctccatcgccaacaccgtcgtcgtcggcttcaacttcggcctcatgctgggcatggcgagcgcgctggagacgctgtgcggccaggcgttcggcgcccgcaagttccacatgatgggcgtgtacatgcagcggtcctggctcgtgctcctcatgtgcgcggtggtgctgctgcccatgtacttcttcgcggaggaggtgctgctcctgacggggcagccgccggagctgtcggcgatggcggggcgggtctccgtgtggttcatcccgctccacctgtccttggccttcctcttcccgctgcagcggttcctgcagtgccagatgaagaac

SEQ ID NO: 14608 - protein, 194 aa, Panicum virgatum
  misc_feature: Ceres CLONE 1777256
  misc_feature (55)..(193): Pfam Name: MatE Pfam Description: MatE
MATDKQRGDEEDASRVALLHADVRKEERQVAAAGTGDLGQRVWEESRKLWVIVAPAIFSRVVTYSMNVITQAFAGHLGDLELAAISIANTVVVGFNFGLMLGMASALETLCGQAFGARKFHMMGVYMQRSWLVLLMCAVVLLPMYFFAEEVLLLTGQPPELSAMAGRVSVWFIPLHLSLAFLFPLQRFLQCQMK

SEQ ID NO: 14609 - DNA, 620 bp, Panicum virgatum
  misc_feature: Ceres CLONE 1777256-R
gggaatctgggcgggcatgatcggcggaaccgccgtccagacgctcatcctggccatcatcacggtccgctgcgactgggaaaaggaggccataatcgcgagcacgcgcatggacaagctgtcgcaagttcggtgatggcctgtgtcaccgatttttttgctgaatggaagaacaagaagctcctcaagggaagcaatgtaacggggaggacagcttccggcgtaaagaccgaggttggcttggctctaatgcctgatctattgttggctttgcttgtttcgctgatgagttctgtaaccatcatcttctggttaggcgagaacatttctcgtctttgcgccagcacaacgtgcgagcatgtcccatccaaaagaaaaaaacatcaagcacgccaaactagacgtatagcccgtgcatttgcgcggctagtattgaaaattcaaaaatttacatgtcgttgtatccttacttaaaaattatactatttttcaccatacatcattctgttcattatcgtaaattatgtcttattgttggttaaaacaattcaaatatgatatacctgtaataacaatttgattttttgagatttaataatattatgcatataattattctt

SEQ ID NO: 14610 - DNA, 1714 bp, Panicum virgatum
  misc_feature: Ceres CLONE 1777258
  misc_feature: Encodes the peptide sequence at SEQ ID NO. 14611
aatttgctttggccccggtgattcggaaagatggcgtgacgcatggcatgctcgtgggagccaggccgccatggtccctctctcgctttcagtgacgcccatgggccatcgtccatgggccggcagcacttttctgacgaactgctgaatcatgatgattcgtggcgttcgctgcctcggccttttcaggctcaggcttgcaattggcatgtgcgcgtgccactgcttgcttcgaaatgatggcaatggaactgtgaactgacggctcaatctgtggttggtctcgcagcaactgtcgatgaagggcttcgcgggcgacacggccaaggcgcacgccaagacgagcatgatcgccggggagggcgtgagcaacatccgcacggtggcggccttcaacgcgcaggacaaggtcctgtccctcttctgcggcgagctgcgcgtcccgcaggcgcacagcctccgccgcagccaggtctcgggcgcgctcttcggcctctcccagctcgccctctacgcctccgaggcgctcatcctctggttcggcgcgcacctcgtccgcgcccgcgcctccaccttctcccgggtcatcaaggtcttcgtcgtcctcgtcatcaccgccaactccgtcgccgagaccgtcagcctcgcgccggagatcgcgcgccgcggggagtccatccgctccgtcttcgccatcctcaacagccggacgcgcatcgacccggacgacccggacgcggagccggtggaggcggtgcgcggcgacatcgacctccggcacgtcgacttcgcgtacccgacgcgccccgacgtgatggtgttcaaggatttcagcctgcggatccgggccgggcagagccaggcgctggtcggcgcgagcgggtccgggaagagcaccgtcatcgccctcatcgagcgcttctacgacccgctcgccggcaaggtgatgctcgacggcaaggacatccggcggctgaacctccggtccctgcgccgccgcatcgggctggtgcagcaggagcccgtgctgttcgccgccagcatcatggagaacatcgcctacggcagggaggacggcgcgacggaggaggaggtcgtggaggccgccaaggccgccaacgtgcacggcttcgtcagcgtgctgcccgacgggtaccgcacccccgtcggggagcgcggcgtgcagctttccggcgggcagaagcagcgcatcgccatcgcgcgcgcggtgctcaaggaccccgccgtgctgctgctggacgaggccaccagcgcgctggacgccgagtccgagtgcgtgctgcaagaggcgctggagcgcatcatgaagggccgcaccgccgtgctggtggcgcaccggctctccaccatccgcggcgtcgactccatcgccgtcgtgcaggacgggcgcgtggtggagcaggggacgcacggggacctcgtgtcccgccccgacggcgcctactcgcggctgctgcagctgcagctgcaccacggctgattgatcactctcgctagtaaacgacggtgtatatactctggaaggcggtgttgcgtggcgggcactggcctagtagccgtggccggaaggcgtaaacacgatcaggatagtaccggcgagtgatgctgcattgtgcttggcggctccggcgattttagatcatcctaattctcattctcagatgaaatgtttttagagttgaactcggatcag

SEQ ID NO: 14611 - protein, 400 aa, Panicum virgatum
  misc_feature: Ceres CLONE 1777258
  misc_feature (185)..(370): Pfam Name: ABC_tran Pfam Description: ABC transporter
  misc_feature: SWISSPROT Homolog: EC 3.6.3.44 Xenobiotic-transporting ATPase
  misc_feature: The sequence is a functional homolog of SEQ ID NO 3 in US patent 7041874
MKGFAGDTAKAHAKTSMIAGEGVSNIRTVAAFNAQDKVLSLFCGELRVPQAHSLRRSQVSGALFGLSQLALYASEALILWFGAHLVRARASTFSRVIKVFVVLVITANSVAETVSLAPEIARRGESIRSVFAILNSRTRIDPDDPDAEPVEAVRGDIDLRHVDFAYPTRPDVMVFKDFSLRIRAGQSQALVGASGSGKSTVIALIERFYDPLAGKVMLDGKDIRRLNLRSLRRRIGLVQQEPVLFAASIMENIAYGREDGATEEEVVEAAKAANVHGFVSVLPDGYRTPVGERGVQLSGGQKQRIAIARAVLKDPAVLLLDEATSALDAESECVLQEALERIMKGRTAVLVAHRLSTIRGVDSIAVVQDGRVVEQGTHGDLVSRPDGAYSRLLQLQLHHG

SEQ ID NO: 14612 - DNA, 1704 bp, Panicum virgatum
  misc_feature: Ceres CLONE 1777274
  misc_feature: Encodes the peptide sequence at SEQ ID NO. 14613
attttcccaacaccggccacagaacccgcttgtcctcttcgccgaggtctaggccacgcacatggcgctgccccccatcctcctcatcctcccggtgctcctgctcggctcgctagaggcctggtcggcgcagcaggccgccacgctgcacgagcgcgacacggcggcgctcagggacctccgcgcggggctgcgggacctccctggctcccggttcttcgactcttgggacgacgcgcgcagcccctgcgcctacgctggagtcgtgtgcgcggccgacgaggacgaacgtgcgtcgagcgcggtgcgcatctccgtcctcacgcttggcaccggcctcgctgattcccccggcctggcggggacacttccggcctcgctctccagcctctccgcgctcacggacctcgtgctctacccgggcagcgtctcgggggccatccccgccgacattggctccgggctccgccgactccggctcctctcgctctccggcaaccagctcaccgggccggtgccagagtctctcgccggtctgcccgatctgcacacgctcgacctcggtaacaaccacctcgagggagccatccccaccggcttgctgctgccgtcttcgccgagcctcaaggtgctcatcctggccaacaatgccggcctctccggggagattcctgccctattctccagctcgcagctgttccacgtcaatctcagcaggaacgccatcaccggcactctcccgccgctgccgccgaccatccggtacttctccgtggctgccaacgaaatgcagggcagcctcgacggcgtcttcggcgaccgttgcgccccagccgacctggccttcctcgatttgtccatgaacaacttctcgggctccatcccgccggacgtgtttgctctcccgagcgcgtcctcgctgctcctgtcccgaaacaacttcaccgggccgctcactgtgcgagccgccccgctgccgtgggccgtggtggacgtcagccacaatggcatctcaggcgaggtcccggaggcgctggcggtggcggggagcctgtacgtgaacaacaaccggatgtcaggcgaggttccccgggcggtggcaagcagcgtgttcgctggccgcatgacgaccttctacgcgcagcacaacttcctgaccggcttcccggcgccgccgctgccgctgccggactccgcagtactctgcctatcgtacaactgtatggagctgccgtccgcttccgccgccgacgggtgccccaccatcggcggcccccttgaggccaggccggcagtccagtgccgcggcgccgacgtcggcaacagcggaggcgacggctgagccgcctgccggcgtgacatctccgtggatgacaggtggggcacactcgccgctcggcacgggcggagctgcggtgtaggagtaggttggttggcgacggaacaccagcaggctggggctggcctcacattttttttttcctttgtacgtttgtttagctgtggtttaattttcttctgattggtttgaattcattgcggctggcttgaggtcccacggcaacggccacataggaatctgtgtgcacctttgcgcatgtgtgctaggagtactcaaaagattatgacctgtttgttttcagggattttctgtttgttttcagagatttctttttagtccggtcatatcaaaaatattttact

SEQ ID NO: 14613 - protein, 426 aa, Panicum virgatum
  misc_feature: Ceres CLONE 1777274
  misc_feature (30)..(71): Pfam Name: LRRNT_2 Pfam Description: Leucine rich repeat N-terminal domain
  misc_feature: SWISSPROT Homolog: EC 2.7.11.1 Non-specific serine/threonine protein kinase
MALPPILLILPVLLLGSLEAWSAQQAATLHERDTAALRDLRAGLRDLPGSRFFDSWDDARSPCAYAGVVCAADEDERASSAVRISVLTLGTGLADSPGLAGTLPASLSSLSALTDLVLYPGSVSGAIPADIGSGLRRLRLLSLSGNQLTGPVPESLAGLPDLHTLDLGNNHLEGAIPTGLLLPSSPSLKVLILANNAGLSGEIPALFSSSQLFHVNLSRNAITGTLPPLPPTIRYFSVAANEMQGSLDGVFGDRCAPADLAFLDLSMNNFSGSIPPDVFALPSASSLLLSRNNFTGPLTVRAAPLPWAVVDVSHNGISGEVPEALAVAGSLYVNNNRMSGEVPRAVASSVFAGRMTTFYAQHNFLTGFPAPPLPLPDSAVLCLSYNCMELPSASAADGCPTIGGPLEARPAVQCRGADVGNSGGDG

SEQ ID NO: 14614 - DNA, 2460 bp, Panicum virgatum
  misc_feature: Ceres CLONE 1777286
  misc_feature: Encodes the peptide sequence at SEQ ID NO. 14615
atccacacccattccccgctgccgccgccgccgccgccgccgcgaacgagatggcggcagccctcctgctccgcggtctccgctcgtcggcgagccgggcacacacccactcgctctcccatgcatcgtccccatcggcgctggggtcatccctcctgcgccggctctactcctccgcggcagcgtccgccgctgcgtcgcctgctttaacacccagcggcgtcatggacccgtcccgcatccgcaacgtggcggtgatagcccacgtcgaccacgggaagactacgctcatggaccggctcctgcggcagtgcggggccgatatcccccacgagcgcgccatggactccatcagcctcgagcgcgagcgcggcatcaccattgcctccaaggtcacttctgtttcttggaaggaaactgaactcaacatggttgatacccctggccacgctgatttcggtggtgaggttgaacgagttgtgggaatggtggaaggagctgtcttggttgttgatgctggagagggacccttagcacaaactaaatttgtgctttcaaaggctttaaagtatggcttgcacccaattctcctcctcaacaaggttgataggccttcagtttctgaagaaacctgcaatgaggtagagagcttggtttttgatctttttgcaaaccttggtgctacagaagaacagttagatttcccagttctttatgcatccgctaaagaagggtgggcttccttaactttcaccaagaaccctcctgatgatgcaaagaatatgtcttcgttgctcgattccattatacagcatgttccttcaccaaaagctgatcttgagtccccattccaaatgttggtttccatgatggaacgtgatttttatctaggacgaatactcactgggagagtaagatctggagttctccgtgttggtgacaaagtgcatggtcttcgcagcacagatgatggagttcaaaagattgaagacggaaaggttatcaaactcatgaaaaagaaaggcacaagtatggtaacagtagaggctgcaggggctggtgatattatttcaatggctggattggctgctccagcaattggacatactgtggcaaattcagaggtattgactgctctgcctacaattgagttggatcctcccacaatatctatgacatttggtgtgaatgattcaccattggctggtcgtgatggcactcatctaactggagcaaaaattggtaaccgcctgatggcagaggcagaaacaaacttggcaattaatgttctccctggaccattatcggaatcgtatgaagttcaaggaagaggagagcttcagttaggaatattaattgaaaatatgcggcgcgagggatttgagctttcggtttcacccccaaaagtgatgtataaaacagagcgtggagaaaggttggaacctattgaagaagtaactgttgaggtggatgaagagcatgttggatttgtcttggaaacacttacacacaggaaaggtgaaataattgacatgggtccagttcctgggacaactgaaagaacaaggatcttcatgacctgtccatctaggggtttggtgggtgttaaaggaattttcagcagctttacacgtggaactggatttatgcaccgtgcttttcaggcgtatgctaaatacagaggtccgctgggcagtgttagaaaaggagttctgatatccgttggtaagggacttatcacttcacatgcgcttatgagtttagaagctcgtgggatcctctttgtatctcctggaatggaggcatatgaaggcatgatagttggtgagcactcacgtgacagtgatcttgaggtgaatcctgttagaactaaagaactgacgaacatccgagcccctgggaaggatgaaaacgtccggctgtctccacctcgattgatgactttggaagaggcaattggatatgttgctgcagatgagcttattgaggttactcccaaggtcatacggcttcggaagaagtacttggattccactaaacgtaagatgatgaaaaacaagcccatggcttaaaggctccagtgacaccaaattatatcgagcactgctagtgctactgtaactgagttggcatccaaaaggcacatcatatttatgtataggttggtgttcaatgttcaagttcaagtgtgaccagagttcttcaccagatcacagattttgccggcgtttcattcagattttacacagcacacacaggattcggatgatgtctcatgtggttgggtactgataaataagccccaatttaggagctaccgcagtttaagattcccgctgtaagttgattatatctatttatagcttttttgacggtgaattttgaaatacctgaaaactggaggtatagtattcttgtaagttcaactgttcaagaaatgaaagggaaagaatcaggtcc

SEQ ID NO: 14615 - protein, 673 aa, Panicum virgatum
  misc_feature: Ceres CLONE 1777286
  misc_feature (62)..(258): Pfam Name: GTP_EFTU Pfam Description: Elongation factor Tu GTP binding domain
  misc_feature (461)..(551): Pfam Name: EFG_C Pfam Description: Elongation factor G C-terminus
  misc_feature (281)..(355): Pfam Name: GTP_EFTU_D2 Pfam Description: Elongation factor Tu domain 2
  misc_feature: SWISSPROT Homolog: EC 2.7.7.4 Sulfate adenylyltransferase
MAAALLLRGLRSSASRAHTHSLSHASSPSALGSSLLRRLYSSAAASAAASPALTPSGVMDPSRIRNVAVIAHVDHGKTTLMDRLLRQCGADIPHERAMDSISLERERGITIASKVTSVSWKETELNMVDTPGHADFGGEVERVVGMVEGAVLVVDAGEGPLAQTKFVLSKALKYGLHPILLLNKVDRPSVSEETCNEVESLVFDLFANLGATEEQLDFPVLYASAKEGWASLTFTKNPPDDAKNMSSLLDSIIQHVPSPKADLESPFQMLVSMMERDFYLGRILTGRVRSGVLRVGDKVHGLRSTDDGVQKIEDGKVIKLMKKKGTSMVTVEAAGAGDIISMAGLAAPAIGHTVANSEVLTALPTIELDPPTISMTFGVNDSPLAGRDGTHLTGAKIGNRLMAEAETNLAINVLPGPLSESYEVQGRGELQLGILIENMRREGFELSVSPPKVMYKTERGERLEPIEEVTVEVDEEHVGFVLETLTHRKGEIIDMGPVPGTTERTRIFMTCPSRGLVGVKGIFSSFTRGTGFMHRAFQAYAKYRGPLGSVRKGVLISVGKGLITSHALMSLEARGILFVSPGMEAYEGMIVGEHSRDSDLEVNPVRTKELTNIRAPGKDENVRLSPPRLMTLEEAIGYVAADELIEVTPKVIRLRKKYLDSTKRKMMKNKPMA

SEQ ID NO: 14616 - DNA, 1853 bp, Panicum virgatum
  misc_feature: Ceres CLONE 1777303
  misc_feature: Encodes the peptide sequence at SEQ ID NO. 14617
ctgtccccagagccagccagacccccacccaccggccccggcctgctcggtccagcgccgaggggggccaccgtcgtcccggctgctcccaccgcccggtcctccaccccgatcggccgccccggatcgccggcgcccgcggcccccaccctggcctcgatcgattggcggcggcggcggcggcggagggcgtgctccgggaggcccaaaggcaaaccaatcgccaggcttctggggggctgtgctggggagtagggaggaggtggagtgattgtggaagctaggattctagtcgttgagtgatggcgcaaggcgccaacttccctggcttcattggtgatgcgggtggccatgatggtggcgtgaactttggtgggggcttctgcgacatagccttctaccagaagctaggggagggctccaacatgtccatggacagcctcaacagcatgcagaccagcatgcacggcggctccatcgccatgtctgtggacaacagcagtgtcgggtctaacagtgactcgcgtaccgggatgctcggccatcctggtctcaagggccccgttgttgtcggcagctattcggtcgggaacagcatcttccgtccagggagagtgtcgcatgccttgagtgaggatgcgctggcacaggctctgatggacaataggttcccgacagagacactccagaattatgaggagtggacaattgatctgggcaaacttcacttggggatgccctttgcccaaggcgcctttggtaagctgtacaagggaacatacaatggtatggatgttgccataaagcttttggagcggccagaggctgacccagagaaagctcaattgcttgagcagcaattcgtgcaggaggttatgatgcttgcaaccttaaggcaccccaacattgtcaaattcattggtgcttgcaggaaaccattggtttggtgcattgtcacagaatatgcaaagggcgggtcgctcaagaatttccttagccggaggcagaacaggtctgttccgctgaagttagcggtgaagcaggcattagatgttgcacatggcatggcctatgtccatggacttgggttcatccacagagatctcaagtcagataacctcctgatttctggtgataagtccattaagattgctgactttggagtggctaggattgaagtgaagactgaggggatgacacctgaaacaggaacatatcgttggatggctcctgagatgatccagcacagaccatacaaccagaaggttgatgtctacagctttggcattgtcctgtgggagcttgtaactgggaatgttccttttgcaaacatgaccgcggtgcaagctgcatttgctgtggtgaacaagggtgtccgtccgaccatacctcatgactgcctccccgccctaggggagatcatgaccaggtgctgggactcaaaccctgaagtccgccccccattcactgatattgtcaggatgctggaacaggtggagatggaggtcctgcgcactgtccgtagggcccgcttccgctgctgcatcgcgcaaccgatggccctggactgagctgtccagaatccaggaaaagaacctggagagaggtttagtcctgtgtatttatcatattataatagacctgcgcttcagaatcagaaagccaactctcgacagtctcgagtgtgccttctgtcgttgacatgtttatcgtagattgcacctagtttctgtcatcagagtggttgtaatagaagtagttttatccttgactccatacccttcctgttgtaacaagtgcatgttcctgctgcgcgctctgtttttctgtttatcatcatgcggctacatgtg

SEQ ID NO: 14617 - protein, 422 aa, Panicum virgatum
  misc_feature: Ceres CLONE 1777303
  misc_feature (141)..(395): Pfam Name: Pkinase_Tyr Pfam Description: Protein tyrosine kinase
  misc_feature: SWISSPROT Homolog: EC 2.7.11.1 Non-specific serine/threonine protein kinase
MAQGANFPGFIGDAGGHDGGVNFGGGFCDIAFYQKLGEGSNMSMDSLNSMQTSMHGGSIAMSVDNSSVGSNSDSRTGMLGHPGLKGPVVVGSYSVGNSIFRPGRVSHALSEDALAQALMDNRFPTETLQNYEEWTIDLGKLHLGMPFAQGAFGKLYKGTYNGMDVAIKLLERPEADPEKAQLLEQQFVQEVMMLATLRHPNIVKFIGACRKPLVWCIVTEYAKGGSLKNFLSRRQNRSVPLKLAVKQALDVAHGMAYVHGLGFIHRDLKSDNLLISGDKSIKIADFGVARIEVKTEGMTPETGTYRWMAPEMIQHRPYNQKVDVYSFGIVLWELVTGNVPFANMTAVQAAFAVVNKGVRPTIPHDCLPALGEIMTRCWDSNPEVRPPFTDIVRMLEQVEMEVLRTVRRARFRCCIAQPMALD

SEQ ID NO: 14618 - DNA, 655 bp, Panicum virgatum
  misc_feature: Ceres CLONE 1777320-R
  misc_feature: Encodes the peptide sequence at SEQ ID NO. 14619
gaggtgcatctggtggagtggctcaaaatgatggttggcacaagaagagctgaggaagtagtggatcctgacatggagttgaaaccagccactcgtgctctgaggcgtgctcttctagttgcattgcggtgtgttgacccagatgctgagaaaagacccactatgggtcaggttgtccggatgcttgaggcagaaggtgtcccttcacgggaggaccgtcggagccggaggggccacagcagcaacgcggacagtgagtccaaggcaagctcaagcgagttcgagataagcagtgatcgaagagagtcaggactgtctgcgaggtttcagtcctaactcctgatgagagcacagcgaattgagaatcggagggaacggggtggatggatttggggattggttgtggtagagttctagagttagggaagggcattgcattttgtactgtaggtattccttggtggtagccagcttagaatgcagagccagatcgatgattcagacttgttgtgaatcgtaagtggcattctgttctgttggtccagtagcagcttgtacagaatttccttttctttttctttttggctaggacttgtcttggctggtagaaaagaagatggtctatttcctaatgtgatgagtgacttgaactacc

SEQ ID NO: 14619 - protein, 111 aa, Panicum virgatum
  misc_feature: Ceres CLONE 1777320-R
  misc_feature: SWISSPROT Homolog: EC 2.7.11.1 Non-specific serine/threonine protein kinase
EVHLVEWLKMMVGTRRAEEVVDPDMELKPATRALRRALLVALRCVDPDAEKRPTMGQVVRMLEAEGVPSREDRRSRRGHSSNADSESKASSSEFEISSDRRESGLSARFQS

SEQ ID NO: 14620 - DNA, 155 bp, Panicum virgatum
  misc_feature: Ceres CLONE 1777320
agcccggccgtgcaatccactcgccgatccgcttcccatgcacaccccggcccgggcaggacccggccacgcatccggaggcgccggcacgttcatgagctgatactaccactcgctacgtattcaaaaccaactcctgccccagcgacctccgc

SEQ ID NO: 14621 - DNA, 2186 bp, Panicum virgatum
  misc_feature: Ceres CLONE 1777323
  misc_feature: Encodes the peptide sequence at SEQ ID NO. 14622
attcaattcaattcaattcaattcaattgcttcggatctgatctcgatttcgctcccgcaccgccgtccgccggccgtctatcacccaccacggctgcggcagaggccatgcctgcgcgtgtggcggcggagatcgccgcgctcccggagccgcgcgggcccatgcgccgcctctgcggcgacctcgcgcgccgcatccgcctcctcgcgcccctcctccagcagctccagggcaccttgcctctcgccgacgcactcggggcagcgcgcgacctcctccgcgcagttcacgacggcagcaagatctaccaggcgatgcggggggatggcctgctcgaccgcttcgcaagcgtcaacaggcagattcagctggccctggatgccttgccttaccacaccttcgacatgcctgaagaagtgcaggagcaggtcgcgcttgtgcattctcagttcaaaagggctgccaccagaacggatccaccagacgtgcagctttcaaaggatatatcctccgccctcgctgacaagacctttgaccctctggttttcacaaggatctcagagaagctgcaattgcagaccatggccgatatcaagaaagaatccgtcgccctgcacgagatggtcatctccagtggcggcgaacctgatggctgcgtcgaggagatgtcttccttgctcaagaagctcaaagactgtgtcatcactgaaaaagctcccacaccagagacactcaccgccaggtctgcctccataaagcacacatctccaatcatccccgatgaattcagatgcccgatatcccttgagctcatgcaagaccctgtcatcgtctccagcggacagacatacgagcgatcatgcatccagaaatggcttgattctggacataagacatgccctaagacgcagcagcctctctcacatacctcactgacaccaaacttcgtcctcaaaagcctaatagctcagtggtgtgaagccaacggcattgagcttccaaagaacaaggcaaattccagagataggaaatcagcaaaaagctctgactatgaccatgctggtctagtctcactaatgaccaggctgaggggtgggaaccaagatgagcagcgggctgctgctggtgagatccgtttgcttgcaaagagaaatgtcaacaaccggatatgcattgccgaagcaggagcaattcccttgcttgtcaatctactctcctcttcggatccaagaacgcaggaacatgctgtcactgcgctccttaacctctccatccatgagaacaacaaggcaagcattgtagcctctcatgctatccctaagattgtggaagtgcttaaaactggaagcatggaagccagagagaacgcagccgctacactattcagcttgtcagttgttgatgaaaacaaggttacaattggtggtgctggtgcaatacctccactcattaatcttctgtgcgatgggagcccaagaggcaagaaagatgcagcaacagcaatttttaatctgtgcatatatcagggaaataagatccgagtagtcaaagctggaattgtcatccatctgatgaacttcttggtggatcctactgggggaatgactgatgaggcactcactcttctggctatccttgctggtaaccctgaagccagggctgtaattgcgcagtcagatccaatccccccacttgtagaggtaattaaaacagggtctcctcgcaacagagagaacgctgcagccattctgtggtcgctttgttgtgctgatgttgagcaaacgagggctgcaaaagctgctggagcggaggatgcactcaaggaactgttggagtctggcacggaccgtgcaaagagaaaatcttctagcattctggaactcatgcggcaagctgaagaagcatgaacctgaccattgtagattttctgaattgaggttgtggctttgctatattgtacacaaaaatactaaatgcctctgaatagtgttgacatttgagactatatgtaggcaggtgtgttaagattttaagaattttctgtaaacatgtaaattggttgtataacattgaaagtcagcacaagatgtacttttttattttttctaaaaaaaaggatactgtagtaaatacatctgtatgtgattcaatttggtggttattattgtttcaggttccatgcatg

SEQ ID NO: 14622 - protein, 599 aa, Panicum virgatum
  misc_feature: Ceres CLONE 1777323
  misc_feature (349)..(389): Pfam Name: Arm Pfam Description: Armadillo/beta-catenin-like repeat
  misc_feature (431)..(471): Pfam Name: Arm Pfam Description: Armadillo/beta-catenin-like repeat
  misc_feature (513)..(553): Pfam Name: Arm Pfam Description: Armadillo/beta-catenin-like repeat
  misc_feature (390)..(430): Pfam Name: Arm Pfam Description: Armadillo/beta-catenin-like repeat
  misc_feature (223)..(296): Pfam Name: U-box Pfam Description: U-box domain
MPARVAAEIAALPEPRGPMRRLCGDLARRIRLLAPLLQQLQGTLPLADALGAARDLLRAVHDGSKIYQAMRGDGLLDRFASVNRQIQLALDALPYHTFDMPEEVQEQVALVHSQFKRAATRTDPPDVQLSKDISSALADKTFDPLVFTRISEKLQLQTMADIKKESVALHEMVISSGGEPDGCVEEMSSLLKKLKDCVITEKAPTPETLTARSASIKHTSPIIPDEFRCPISLELMQDPVIVSSGQTYERSCIQKWLDSGHKTCPKTQQPLSHTSLTPNFVLKSLIAQWCEANGIELPKNKANSRDRKSAKSSDYDHAGLVSLMTRLRGGNQDEQRAAAGEIRLLAKRNVNNRICIAEAGAIPLLVNLLSSSDPRTQEHAVTALLNLSIHENNKASIVASHAIPKIVEVLKTGSMEARENAAATLFSLSVVDENKVTIGGAGAIPPLINLLCDGSPRGKKDAATAIFNLCIYQGNKIRVVKAGIVIHLMNFLVDPTGGMTDEALTLLAILAGNPEARAVIAQSDPIPPLVEVIKTGSPRNRENAAAILWSLCCADVEQTRAAKAAGAEDALKELLESGTDRAKRKSSSILELMRQAEEA

SEQ ID NO: 14623 - DNA, 1896 bp, Panicum virgatum
  misc_feature: Ceres CLONE 1777325
  misc_feature: Encodes the peptide sequence at SEQ ID NO. 14624
gaattattatacctgctctgctgctcctccctgctctcccgtacccccgacggcctcctttcccccacccacccagaccccccctccccggccggcggcggcgccatgccgccgcgcacggcggctgcggcgccccccgcgcacaaggtgcccctccgcaagctgctccgcgcggcgtctgtggcgtgcggggtgcagttcggctgggcgctgcagctgtcgctgctcaccccctacgtgcaggagctcggcatcccgcacgccttcgccagcctcgtctggctctgcggcccgctctccggcctcctcgtccagcccctcgtcggccacctctccgaccgcatcgccccggccgcctccccgctcggccgccgcaggcccttcatcgccgcgggggccgcctcaatcgccgcggctgtcatcacagtcggattctccgccgacctcggccgcatcttcggcgacgacatcaccccggggagcacgcgcctcggggccatctgcgtctacctcgtcggattctggctgctcgatgtcggcaacaacgccacgcaggggccctgcagggccttcctcgcggacctcaccgagaacgacccaaggaggactcggattgctaatgcatacttttcactcttcatggccctgggaaacatacttggatatgccaccggagcatacagtggctggtataggatatttcctttcactgttacaccatcctgcagcatcagttgtgccaacctcaagtctgccttccttcttgacattattattctggtgattacaacctacattactgtagcatcagtgcaagagccgcaaacttttggaggtgatgaagcagaacatccaggtaccgaacaggaagctttcctctgggagctttttgggtcattcagatacttcacgctaccagtttggatggtcttaattgtcactgcccttacgtggattggatggtttccttttatcctctttgatactgattggatgggccgagagatctaccgaggaagcccagaaaacccaggagagacccaaatataccatgatggtgtgagaatgggttcttttggtctaatgctcaactctgtccttcttggattcacctctgttgtactagaaaagttatgtaggaagtggggagctggactagtatggggtgtctccaatatactgatggcgttatgctttgtggctatgcttgttataacatatgtcgcaaagaacatggattatcctcccgatggagtacctccaactggcattgtcattgcttctgtggtggtttttacaattttaggagcacccctggcgattacatacagtataccatatgcaatggctgctagtcgtgttgaaaatctgggtcttggccaaggtctagcgatgggcattctaaatttagctatcgtcataccgcaggttattgtgtcacttggtagtgggccatgggatcaactgtttggcggtgggaatgcgccggcttttgcagtggcagccggtgcatcgttcatcggtgggctggtagctattcttgggcttccacgagctcgcattgcatcatcgaggaggagaggcgggacacaccgataaggtgcttagtacctacctacataatgtgtatgctgtggaagtgttgcaacctgcgacaattctttgcggggaaatttatggggttttggagaagagcaggaattaagctcttgaatgatgtccttttcctttcctttttggtggtttgccctgttgagctatttttgcccttatttgtctacgatccatcatcatttgttgtctgtaatttatgtatgtatgtgtatgtatgtacgtctgtcatctgtagagagacagcaggttaattaatgaataaaagttacaggagttactttt

SEQ ID NO: 14624 - protein, 497 aa, Panicum virgatum
  misc_feature: Ceres CLONE 1777325
  misc_feature (21)..(458): Pfam Name: Sugar_tr Pfam Description: Sugar (and other) transporter
MPPRTAAAAPPAHKVPLRKLLRAASVACGVQFGWALQLSLLTPYVQELGIPHAFASLVWLCGPLSGLLVQPLVGHLSDRIAPAASPLGRRRPFIAAGAASIAAAVITVGFSADLGRIFGDDITPGSTRLGAICVYLVGFWLLDVGNNATQGPCRAFLADLTENDPRRTRIANAYFSLFMALGNILGYATGAYSGWYRIFPFTVTPSCSISCANLKSAFLLDIIILVITTYITVASVQEPQTFGGDEAEHPGTEQEAFLWELFGSFRYFTLPVWMVLIVTALTWIGWFPFILFDTDWMGREIYRGSPENPGETQIYHDGVRMGSFGLMLNSVLLGFTSVVLEKLCRKWGAGLVWGVSNILMALCFVAMLVITYVAKNMDYPPDGVPPTGIVIASVVVFTILGAPLAITYSIPYAMAASRVENLGLGQGLAMGILNLAIVIPQVIVSLGSGPWDQLFGGGNAPAFAVAAGASFIGGLVAILGLPRARIASSRRRGGTHR

SEQ ID NO: 14625 - DNA, 655 bp, Panicum virgatum
  misc_feature: Ceres CLONE 1777330-R
  misc_feature: Encodes the peptide sequence at SEQ ID NO. 14626
gacagcgaggagatgaaggcgaagaagacacagctgttcggcgccgatcccccggtcctctatgttctccactacctgggcctgaagccgtggctgtgcttcagggactatgactgcaactggaacaaccccccgatgcgcgaattcgctagtgacgtcgcgcacgcccggtggtggaaggtgcacgacaggatgccccggaagctccagccctactgcctcctgaggtcacggcagaaggccgggctggagtgggaccggaggcaggctgagaaggccagctctgaagatggccattggcgccgcaacatcactgaccccaggctgaagacctgctttgagaagttctgcttctgggagagcatgctctggcattggggcgagaacaataacaggacgaagggcagccccgcgacggtgacgacggcgagcttggcaagctcatgatctgtacatataaaaacaagcaacttcccataaggcaaccatacatgcatagcaatagtttgtataggtacctgtgcttcttaggtctttgctatacaaaatacacccctccctgttgctgtcatggctgcagctctatgtcagctgccggcctgcctcgatggctaacgattcttttgggttggctgagataataagttacttttac

SEQ ID NO: 14626 - protein, 148 aa, Panicum virgatum
  misc_feature: Ceres CLONE 1777330-R
  misc_feature: Useful for making plants with altered carbohydrate content
  misc_feature: Useful for making plants with altered cell wall content and/or composition
DSEEMKAKKTQLFGADPPVLYVLHYLGLKPWLCFRDYDCNWNNPPMREFASDVAHARWWKVHDRMPRKLQPYCLLRSRQKAGLEWDRRQAEKASSEDGHWRRNITDPRLKTCFEKFCFWESMLWHWGENNNRTKGSPATVTTASLASS

SEQ ID NO: 14627 - DNA, 299 bp, Panicum virgatum
  misc_feature: Ceres CLONE 1777330
ccttaaggacccccacttcctttcccagacctcctctgtgaacggggccgcccgggccctcccctcccaccaccaataaaccaccaccccccccccgttgcaggggggatgtggggcggctccatccgctccggtttcgtcgggcagggggggccgggggccaagatacagccccgccggctactgtgacgccacccccgcggggacgaggtctaattgctggggccggggcccgtcaggaagggagcccccgtggggaatgacttcaaggccgatttccagtagttcttggtcgggat

SEQ ID NO: 14628 - DNA, 702 bp, Panicum virgatum
  misc_feature: Ceres CLONE 1777339
  misc_feature: Encodes the peptide sequence at SEQ ID NO. 14629
tcttccccaacctgcacgagctctcgtctccggcggcggaagcggaaggaagcaggcggccaccatggtgaagggacgcacggggcagcgcgtcaggctctacgtccggggcactatcctcggatacaagaggtctaagtcgaaccagtacgagaacacgtcgctggtgcagatcgagggggtgaacaccaaggaggacgtcgcgtggtacgccggcaagcgcttggcgtacatctacaaggccaagaccaagagcagcgagacccgctacaggtgcatctggggcaaggtcacccgcccgcacggcaactccggcgtcgtccgcgccaagttcaagtccaacctcccgccggagtccatgggacgcaaggtcagagtgttcatgtacccgagcagcatctaaggttagcatcgaaaaatggctgatccgctcatatttttttatgctggttgctagtgaattgtttgtgtgtgatcgaatgttgtgggaatgttctcattacctttagaatgcatttaccattttgctcttagagcctaggcctagggctatgctttgttgtggttgattaggaggcacattatggtttttattgagtctgtatgtagcagcattagatggcctgggttctgtgagtgtaaagttcctttgctgaggaaacaattcactgagtattgtttgaacttcgtgctgccattcag

SEQ ID NO: 14629 - protein, 112 aa, Panicum virgatum
  misc_feature: Ceres CLONE 1777339
  misc_feature (12)..(106): Pfam Name: Ribosomal_L35Ae Pfam Description: Ribosomal protein L35Ae
MVKGRTGQRVRLYVRGTILGYKRSKSNQYENTSLVQIEGVNTKEDVAWYAGKRLAYIYKAKTKSSETRYRCIWGKVTRPHGNSGVVRAKFKSNLPPESMGRKVRVFMYPSSI

SEQ ID NO: 14630 - DNA, 625 bp, Panicum virgatum
  misc_feature: Ceres CLONE 1777357
  misc_feature: Encodes the peptide sequence at SEQ ID NO. 14631
attccgcctccaagcctctgccttcctcgctccttgcatccccggattccagtttggttgctcgtggctagggttggaccggcggcctcggcgatgtcagcgccgtggtgggactccgactggaaggaccgctccggcccggagtaccgatgcttcgtgggcaacctcccctacggcaccagcgagagctccctcaaggacgctttctccaactacgcccccctctactccgagatcgcggtggatcctgagacggggaggtcccgcggcttcgggtgggtgcagttcgaggaccagaagtcgatggacaacgccatccagggcatgaacggccagcaggtcggcggccgcagcgtcaccgtcaaccaggccaaccaccgcccgcgccgctggagggcgtgaacggccggccggcacgccggtggccatggcctgctgcgcgcgtacaacagattagttggttatctcccccaatcgttaggcctttagctaattagtactagtggtggtgttaatcgtcctaagtaatccgagattgctatgtcatgaactcatgatgttctagaccttgtgttggtcttcgttggtttgttatggattgtgtgctcgatcggtgagttatctt

SEQ ID NO: 14631 - protein, 102 aa, Panicum virgatum
  misc_feature: Ceres CLONE 1777357
  misc_feature (20)..(90): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with altered lignin content
  misc_feature: Useful for making plants with modulated nitrogen use efficiency
  misc_feature: Useful for making plants with modulated flowering time
  misc_feature: Useful for making plants with altered alkaloid content
MSAPWWDSDWKDRSGPEYRCFVGNLPYGTSESSLKDAFSNYAPLYSEIAVDPETGRSRGFGWVQFEDQKSMDNAIQGMNGQQVGGRSVTVNQANHRPRRWRA

SEQ ID NO: 14632 - DNA, 633 bp, Panicum virgatum
  misc_feature: Ceres CLONE 1777367
  misc_feature: Encodes the peptide sequence at SEQ ID NO. 14633
aaccaacccaagtagccgccctcctctctccgccactccagtaggcagcgccccccgcacgccgccgccgcgagacgtcgccggagaagaatccgccgccgccgcgagacgtcgcaggaaagtacccttaggatggcgaccctgaggaacttgaagatcaagacgtcgacgtgcaagaggatggtcaaggagctgcgctcgtacgagaaggaggtggagaaggaggcggcaaagaccgccgacatgaaggacaagggcgccgatccctacgatctcaagcagcaggagaatgttttagccgagtcaaggatgatggtcccagactgccacaagcgccttgaaactgcactggcagacttgaaagcaacgctggctgaactgaaggagtcaaatgaacaaggcgctgagatcggagaagccgagagtacaattgcagaggtcgaagctgtggtcaagccaacagaagaatgaattctgaactcccaagtctcaattgctgaactactagcaagcatccttattgatctcgttgagaccttgtgagctcgttagtaagatgtgtttgatgtaaactcatgtaccagtatcttgacttggaaattctaagactgcgcacggaattgtgtttgctcg

SEQ ID NO: 14633 - protein, 112 aa, Panicum virgatum
  misc_feature: Ceres CLONE 1777367
  misc_feature (6)..(99): Pfam Name: TBCA Pfam Description: Tubulin binding cofactor A
MATLRNLKIKTSTCKRMVKELRSYEKEVEKEAAKTADMKDKGADPYDLKQQENVLAESRMMVPDCHKRLETALADLKATLAELKESNEQGAEIGEAESTIAEVEAVVKPTEE

SEQ ID NO: 14634 - DNA, 675 bp, Panicum virgatum
  misc_feature: Ceres CLONE 1777371-R
  misc_feature: Encodes the peptide sequence at SEQ ID NO. 14635
cccccggttcgtcgcggcgctccagcggctcggcggcgcgcaagttgccacgccgaagcagatcagggagctgatgaaggtggacgggctgacgaacgacgaggtgaaaagccacctgcagaagtaccggctgcacacgcggcgggcgtcgtcgtcggacggcggcgacctcgcggcggggctgtgggccgagccggagcagcagtacgcgacgtcgcagcacagcacgtcgcagtcggggtcgccccaggggtccctgcagctgacggtgtcgagccgggccatgtcggcgaccgccggggacagctgcgacggcgacgaggcggagggcggcaggtccgagagctacggcttcggggcgcagcacgggaccaaggcctcgtcgtactgaaaatcctctgctggatccttccttgggacagcagcagtatagaagaagaagatggatgcagcagagatatgatcagatgatggaaaccacaaacactgcagatgagaggcattttgtgtacagtcgttgagaggattcttttctttttgcagatgaactgatgcgagtgatttgtcgagggttgtttgtaggtgtgagataagagatgagatgttgctacattacatcgcagaaatcttcaggttgagtcgaatcagcttggtcgagaggccgatggattttac

SEQ ID NO: 14635 - protein, 129 aa, Panicum virgatum
  misc_feature: Ceres CLONE 1777371-R
  misc_feature: Useful for making plants with altered lignin content
  misc_feature: The sequence is a functional homolog of SEQ ID NO 2000 in the 11/479,226 US patent application
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: The sequence is a functional homolog of SEQ ID NO 1999 in the 11/479,226 US patent application
PRFVAALQRLGGAQVATPKQIRELMKVDGLTNDEVKSHLQKYRLHTRRASSSDGGDLAAGLWAEPEQQYATSQHSTSQSGSPQGSLQLTVSSRAMSATAGDSCDGDEAEGGRSESYGFGAQHGTKASSY

SEQ ID NO: 14636 - DNA, 222 bp, Panicum virgatum
  misc_feature: Ceres CLONE 1777371
accccacaacagaacaacccccccccgccaagaaggccggcagccgcggacccagcggcaaccgcggccccaacagcaagggcggcaagaaggaccccgaccaagaagaaaagaacagcggcggcgcccaggccaccaacggccccggcggggccccggaaaaaaagaccggccaggacgaggcggcagcggagaccggcgagaccgcccacgccagcaaga

SEQ ID NO: 14637 - DNA, 558 bp, Panicum virgatum
  misc_feature: Ceres CLONE 1777423
  misc_feature: Encodes the peptide sequence at SEQ ID NO. 14638
accctaaccccctccagaaccttaaacccttctccccggcggcggctacaagctcctcgtcgactcggaaccatgaggccaccagctggaggacgcggcgggaggggagggagattcgatggcggcggtcgtggcggcggtggccggggctttggtggcggtagaggaaggggggacaggggtggcagaagtggcggcggtggcaggactccgaggggtggcagccgcggtggaaggggcggtcgtggtggtggcatgaagggcgggagcaaggccgtcgtggttccgcacaagcacgccggcatcttcatctccaagtccaaggaggacgccctctgcactaagaacatggtcccgggcgagtccgtctattcagagaagcgcgtctccgtccagaatgaggatgggacaaaggttgaatacagggtgtggaaccccttccgttccaagctggctgctgctgtgctaggtggtgttgacaacatctggattgctcctggtactcgagtgctgtatcttggtgctgctttgtgttgtattttatgaccctgtcatctg

SEQ ID NO: 14638 - protein, 157 aa, Panicum virgatum
  misc_feature: Ceres CLONE 1777423
  misc_feature (67)..(156): Pfam Name: Fibrillarin Pfam Description: Fibrillarin
  misc_feature: Useful for making plants with altered alkaloid content
  misc_feature: Useful for making plants with altered lignin content
  misc_feature: Useful for making plants with altered terpenoid content
MRPPAGGRGGRGGRFDGGGRGGGGRGFGGGRGRGDRGGRSGGGGRTPRGGSRGGRGGRGGGMKGGSKAVVVPHKHAGIFISKSKEDALCTKNMVPGESVYSEKRVSVQNEDGTKVEYRVWNPFRSKLAAAVLGGVDNIWIAPGTRVLYLGAALCCIL

SEQ ID NO: 14639 - DNA, 832 bp, Panicum virgatum
  misc_feature: Ceres CLONE 1777437
  misc_feature: Encodes the peptide sequence at SEQ ID NO. 14640
aggccaccaccactcactcgggcggctctccgttcctgccacccctcctccgtcctcgcgccgcgccgggccgcgccctcccctcgccagctgctccgatccggatggcgcccaccgagtccggcccggcgccggcctagcgcagctcgggctcggcccgggcccaggctcccgccgcgtcgtcagctcgagccccccgaggtctttctgttcagctaagggatatgcttctgcgtctctaggagcccctttttttggtacttcggcagtgttctttccttttttgagtagatgtcatttcgtagcattgtgcgcgatgtaagggatggctttgggagtttatctaagaggggattcgaggtcaggcttctgggtcatcgcagagggaaatctcatggtgctgtccatgagctgcacgacccagtgcctgtggtacagaacagctgctgggctagcttgcctcctgaattacttcgagatgtgattgagaggttggaagccagtgaggatacatggccttctaggaagaatgtagttgtttgtgcatctgtctgcagaacatggagagaggtgtgtagagagattgtcaagaacccagagttttctgggaagatcacttttcctgtttctctgaaacagcctgggcctcgagatggaactatacagtgtttcattaagagggataaatctacacagatctactacctgtacctttgtcttagctcaagtaagtttattgctgtgtggactatggacacttgataaaaatctggtatctgtataagtgtatttcgttttgtacttataagttgaaactcatggtgttctgcgg

SEQ ID NO: 14640 - protein, 156 aa, Panicum virgatum
  misc_feature: Ceres CLONE 1777437
  misc_feature (51)..(106): Pfam Name: F-box Pfam Description: F-box domain
  misc_feature: The sequence is a functional homolog of SEQ ID NO 458 in the 10/666,642 US patent application
  misc_feature: The sequence is a functional homolog of SEQ ID NO 130 in the 10/225,068 US patent application
  misc_feature: The sequence is a functional homolog of SEQ ID NO 2896 in the 10/374,780 US patent application
  misc_feature: The sequence is a functional homolog of SEQ ID NO 460 in the 10/666,642 US patent application
MSFRSIVRDVRDGFGSLSKRGFEVRLLGHRRGKSHGAVHELHDPVPVVQNSCWASLPPELLRDVIERLEASEDTWPSRKNVVVCASVCRTWREVCREIVKNPEFSGKITFPVSLKQPGPRDGTIQCFIKRDKSTQIYYLYLCLSSSKFIAVWTMDT

SEQ ID NO: 14641 - DNA, 651 bp, Panicum virgatum
  misc_feature: Ceres CLONE 1777447
  misc_feature: Encodes the peptide sequence at SEQ ID NO. 14642
aagagcttctcagatcttgcagtcccagctcactcactcaaagtggtagtctctcccgttccatttccatccgtcatctatcctcttcgtcggcgagaaccaaggagacgccctccatggagctcttcgccgccgaggagaagccttgcaaccggctgttcaggaagcgggccggcggcaagggcgccatgggcgtgcgcggcgacggcggcagcggcaagggccggtccttctccgggcggtgcgcgcggctcgtcaaggagcagcgcgcgcggttctacatcatgcgccgctgcgtcgcgatgctggtgtgctggcgcgagtacgcctgaggcgagcagggcaaggagccaaggacatgccgccgccgccgcggtgccgcaggagcagacgaacgaacaaggccgatcgatcgcctacgttaggaggaactgagagccatgtgtaaaaaggagagggttttttttctttctttttcagtctcctttcttctttgctttctgccctccggtttcttatcaagagctagtactagcagagctcagtactgcttggatccgatgatcaccgcaccgcgcattcagttgagtcgtcctcgatgagatgtgagcgtgtctaatacagaggaactgacttgtgaaattcctcatc

SEQ ID NO: 14642 - protein, 71 aa, Panicum virgatum
  misc_feature: Ceres CLONE 1777447
  misc_feature (48)..(66): Pfam Name: DVL Pfam Description: DVL family
  misc_feature: Useful for making plants with modulated biomass
MELFAAEEKPCNRLFRKRAGGKGAMGVRGDGGSGKGRSFSGRCARLVKEQRARFYIMRRCVAMLVCWREYA

SEQ ID NO: 14643 - DNA, 615 bp, Panicum virgatum
  misc_feature: Ceres CLONE 1777464
  misc_feature: Encodes the peptide sequence at SEQ ID NO. 14644
gccatcacacgtacactccctcccgaccacccaagcgagccacagccaccggagcagagcgccgagccccaggcaggatcccatggccgccaccgccgtcgcggcgtctctgcccgtggcccgggggctcgggaagcccctccgcgccggcggcagcagcggcgcgtcgtcgctccgcgtcgtctcgccccgtggcagggtggccgtcgtccgggcgtcgtcgtccgcgcagagcccggccaaggagtgggcggccgcggcggccgtcgcggcggcgctggtgctgccggaggtcgcggaggccgcgcagccggggatctcaccctcgctcaagaacttcctcctcagcatcgtctccggcggggtcgtgctcgtcgccatcatcggcgccgtcgtcgccgtctccaacttcgaccctgtcaagcggggctgagctccaccacaagcacggccgccggccgcgccatggctgtgcgtatacctatgtactgatgagactgagagcggtcggtctggtctcttctccgtgtgcttccgaacgaaacacagtgtctgatgcgtccatcttttgccgtgtaaatttcatttcctgctcgtgaaatctcgtgttcatcg

SEQ ID NO: 14644 - protein, 116 aa, Panicum virgatum
  misc_feature: Ceres CLONE 1777464
  misc_feature (79)..(116): Pfam Name: PsbX Pfam Description: Photosystem II reaction centre X protein (PsbX)
  misc_feature: Useful for making plants with modulated nitrogen use efficiency
MAATAVAASLPVARGLGKPLRAGGSSGASSLRVVSPRGRVAVVRASSSAQSPAKEWAAAAAVAAALVLPEVAEAAQPGISPSLKNFLLSIVSGGVVLVAIIGAVVAVSNFDPVKRG

SEQ ID NO: 14645 - DNA, 363 bp, Panicum virgatum
  misc_feature: Ceres CLONE 1777467
  misc_feature: Encodes the peptide sequence at SEQ ID NO. 14646
  misc_feature (99)..(99): n is a, c, t, g, unknown, or other
gcccaagccccgcagccccgccgccgccgcccgccgcaggcacagcaggagcaagcccgcccccgccgcccacagcgccggcgcgggcacggacgccgncgagcgcaggaagagcgggaacgagcagcacaagacccaggacaacgacaagaagccggagcaggccgagccgcgcaaggccggccaaccccccagggacagggcgcccgcccgcttttttttccgctgctgcccgtcggtgaccctgggcctgcagcccggcgaggccttcaccatgcgcaacatcgccgccatggtcccgccctacgacaagaacaagtacgccggcatcggggccgccatcgagtacgccgtctgcgccct

SEQ ID NO: 14646 - protein, 120 aa, Panicum virgatum
  misc_feature: Ceres CLONE 1777467
  misc_feature: SWISSPROT Homolog: EC 4.2.1.1 Carbonate dehydratase
  misc_feature (33)..(33): Xaa is any aa, unknown, or other
PKPRSPAAAARRRHSRSKPAPAAHSAGAGTDAXERRKSGNEQHKTQDNDKKPEQAEPRKAGQPPRDRAPARFFFRCCPSVTLGLQPGEAFTMRNIAAMVPPYDKNKYAGIGAAIEYAVCA

SEQ ID NO: 14647 - DNA, 1436 bp, Panicum virgatum
  misc_feature: Ceres CLONE 1777472
  misc_feature: Encodes the peptide sequence at SEQ ID NO. 14648
atccgtctgcataaatacctgacaagcaatcgtcgtgttcacccatcggcgcctcactcacctgcagatcatcaaagcattgctcccttgcctgctcgctcgccaaggaagcaaggaaccagcaggaacaatcttttgagcaatggcggcggcagggctgcaggtgttcggacagccggcgtccaccgacgtggcgagggtcctgacctgcctcttcgagaagaacctcgagttcgagctcgtccgcatcgacaccttcaagaagtcgcacaagctccccgagttcatcaagctacgggatccaactgggcaggtgacattcaaacatggtgacaaaaccattgtcgattctagggccatctgccgctacctgtgcaccagtttcccggaggacggcaacaggacgctctacggcacggggtcgctggagcgggcgtcgatagagcagtggctgcaggccgaggcccagagcttcgacgctccgagctcggagctcgtcttccagctggcgttcgcgccccacctcaaggacgtgcaccccgacgaggcccgcatcgcggagaacgagaagaagctgcagaacatgctgggcgtctacgacgagatgctgtccaagcacaagtacctggccggcgacgagttcaccctggccgacctgtcccacctgcccagctcgcactacatcgtcaactcctccgacaggggccggaagctcttcaccgccaagaagcacgtggccaagtggtcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgc

SEQ ID NO: 14648 - protein, 208 aa, Panicum virgatum
  misc_feature: Ceres CLONE 1777472
  misc_feature (4)..(79): Pfam Name: GST_N Pfam Description: Glutathione S-transferase, N-terminal domain
  misc_feature (111)..(202): Pfam Name: GST_C Pfam Description: Glutathione S-transferase, C-terminal domain
  misc_feature: SWISSPROT Homolog: EC 2.5.1.18 Glutathione transferase
MAAAGLQVFGQPASTDVARVLTCLFEKNLEFELVRIDTFKKSHKLPEFIKLRDPTGQVTFKHGDKTIVDSRAICRYLCTSFPEDGNRTLYGTGSLERASIEQWLQAEAQSFDAPSSELVFQLAFAPHLKDVHPDEARIAENEKKLQNMLGVYDEMLSKHKYLAGDEFTLADLSHLPSSHYIVNSSDRGRKLFTAKKHVAKWSVYSFDL

SEQ ID NO: 14649 - DNA, 492 bp, Panicum virgatum
  misc_feature: Ceres CLONE 1777472-R
  misc_feature: Encodes the peptide sequence at SEQ ID NO. 14650
cagcgcggtgctgggactctgactggaaggaccgctccggcccggagtaaagatgtttcgtgggcaacctcccctgcggcacgagggagagctccctccagcacgctttctcccattacgccgccgtttactgcgagatcggggtggatcctgagaaggggagatcccgcggggtggggtgggtgcagtttgaggcccagaattggatggacaacgctattcagggcatgaatggccggcaggtaggcggccgcagcgtcaccgtcaaccaggccaaccaccgccggcgccggtggagggtgtgaacggccggcgggcacgccggtggccatggcctgatgcgcgggtacaccagattagttggttatctcccccaattgttagtcctttagctaattagaactagtggtggtgttaatggtcttaagtaatccgagattgttaggtcatgtactcatgatgttttaggccttgtgttggtcttggttggtt

SEQ ID NO: 14650 - protein, 32 aa, Panicum virgatum
  misc_feature: Ceres CLONE 1777472-R
  misc_feature: Useful for making plants with altered lignin content
  misc_feature: Useful for making plants with modulated nitrogen use efficiency
  misc_feature: Useful for making plants with modulated flowering time
  misc_feature: Useful for making plants with altered alkaloid content
  misc_feature: Useful for making plants with modulated biomass
MDNAIQGMNGRQVGGRSVTVNQANHRRRRWRV

SEQ ID NO: 14651 - DNA, 720 bp, Panicum virgatum
  misc_feature: Ceres CLONE 1777484
  misc_feature: Encodes the peptide sequence at SEQ ID NO. 14652
acaacagctcaaagcagcagagcactcttcaccttctacgcaggccggctgcaagcgcgaggaagaagcaccagcgcagaagtcgtcgaccgccatggctcagggaaggggcagtgcgacgacacggtgcctcgccgtcggcggcctgctcgccgcgtgcctcctccttggcgccgccgacgcggccacccacagcgtcgtctggtcgttcaacgcggacacctggccccggggcaagagcttccgcgccggggacgtcctcgagttcaactacgacccctccctgcacaacgtgatggccgtggacgccagcggctacaacagctgcggctcctccggcaggacctacagctccgggagggatcgcatcacgctcggccccgggaccaactacttcatctgcagcctcaacgggcactgcgggatggggatgaagatggccgtcaacgccagctgaaggctgaagcccccacgctgcttgcagagcaccaataagtgatgcgcaataactcaatcgttttggcagcgcacgcccggccctgtgcgggatacgcgccgatacaggtctcatgtgtcatgtactggcagggtatgtgtggtgtggagtggagtggtagtcgaggcatggtgtgtgtatggtttactggcagggcagtgaagcgttacctatagctttgttgtttgtttggacttcgaagcagtagcctgttttctttgttc

SEQ ID NO: 14652 - protein, 120 aa, Panicum virgatum
  misc_feature: Ceres CLONE 1777484
  misc_feature (37)..(113): Pfam Name: Cu_bind_like Pfam Description: Plastocyanin-like domain
MAQGRGSATTRCLAVGGLLAACLLLGAADAATHSVVWSFNADTWPRGKSFRAGDVLEFNYDPSLHNVMAVDASGYNSCGSSGRTYSSGRDRITLGPGTNYFICSLNGHCGMGMKMAVNAS

SEQ ID NO: 14653 - DNA, 563 bp, Panicum virgatum
  misc_feature: Ceres CLONE 1777488
  misc_feature: Encodes the peptide sequence at SEQ ID NO. 14654
  misc_feature (224)..(224): n is a, c, t, g, unknown, or other
agagcgcgggcgccgcacgccgcccccgccggcggcaaggacaggcgcgccggcggcagcagccccgcgccggccaagcgggccgccgccgcgccgcgggccggcggccgcgccgccacgcggcggccgcggcacgcccgccagaccaagaacgccgacgacgaagggcgggaggcggacgagaagaaccgggacgggacggggacggcgcgcgagacgccggngcaggaggattttttggcgccgcagggcgggccgagccggatgatcgcgccggagatcgacgagctggccaaggactacgccggccagatcaagtgctgcaaggtgaacacggacgactgccccaacgtggcctccacctacggcatccgcagcatccccaccgtgctcatcttcaagggcggcgagaagaaggagagcgtcatcggcgccgtgcccaagaccacactcaccaccatcgtcgacaagtacatcggcagctcgtgagccagacaactataaatacatacgtgtccgtgctcgcgcgtacacacaccatgtatgtgtatctcttgtttcga

SEQ ID NO: 14654 - protein, 162 aa, Panicum virgatum
  misc_feature: Ceres CLONE 1777488
  misc_feature (66)..(158): Pfam Name: Thioredoxin Pfam Description: Thioredoxin
  misc_feature: SWISSPROT Homolog: EC 1.8.1.8 Protein-disulfide reductase
  misc_feature (75)..(75): Xaa is any aa, unknown, or other
RARAPHAAPAGGKDRRAGGSSPAPAKRAAAAPRAGGRAATRRPRHARQTKNADDEGREADEKNRDGTGTARETPXQEDFLAPQGGPSRMIAPEIDELAKDYAGQIKCCKVNTDDCPNVASTYGIRSIPTVLIFKGGEKKESVIGAVPKTTLTTIVDKYIGSS

SEQ ID NO: 14655 - DNA, 904 bp, Panicum virgatum
  misc_feature: Ceres CLONE 1777523
  misc_feature: Encodes the peptide sequence at SEQ ID NO. 14656
tttttagtcctctctccaggcggcgcctccacatctcgtctctcggatcgggaggcgaaaccaaggaggaagcggagcagaagcagccaggccagcccaccgccgccaccatgggtatctcgcgtgactcgatgcacaagcgccgggccaccggtgggaagcagaaggcctggaggaagaagcgaaagtacgagcttggccgtcagccagccaacaccaagttgtcaagcaacaagacggtgaggagggtccgtgtcagagggggtaatgtgaagtggagggctctccgcctggatactggtaactactcctggggaagtgaggctgttacccgcaagacccgtatccttgatgtggtctacaacgcgtcaaacaatgagctcgtgaggactcagacccttgtgaagagcgccattgtgcaggttgatgttgccccattcaagcagtggtacctaacacactatggagtggatatcggtaggaagaagaaggcagctgctgccaagaaggatgctgctgagggacaagagggtgaggctgcagctgaggaagcaagcaagagcaaccacgtccagaggaagcttgagaagcgtcagcaaggacgcacacttgacccccacattgaagagcaatttggcagtggaaggctgttggcgtgcatttcttcccgccctgggcagtgtggcagagctgacgggtacatccttgagggtaaagagctggagttctacatgaagaagctccagaggaagaagggcaagggtgctgcagcttagaggcattcttatggatgttctacactgagggtggcttttttgttagtattgtcaagcgcagtgtttaacgagcacaatattttctaaattgaatcaactaaactagctaagaattaagaattttcacc

SEQ ID NO: 14656 - protein, 221 aa, Panicum virgatum
  misc_feature: Ceres CLONE 1777523
  misc_feature (1)..(199): Pfam Name: Ribosomal_S8e Pfam Description: Ribosomal protein S8e
MGISRDSMHKRRATGGKQKAWRKKRKYELGRQPANTKLSSNKTVRRVRVRGGNVKWRALRLDTGNYSWGSEAVTRKTRILDVVYNASNNELVRTQTLVKSAIVQVDVAPFKQWYLTHYGVDIGRKKKAAAAKKDAAEGQEGEAAAEEASKSNHVQRKLEKRQQGRTLDPHIEEQFGSGRLLACISSRPGQCGRADGYILEGKELEFYMKKLQRKKGKGAAA

SEQ ID NO: 14657 - DNA, 583 bp, Panicum virgatum
  misc_feature: Ceres CLONE 1777535
  misc_feature: Encodes the peptide sequence at SEQ ID NO. 14658
ccccaccaacgaatccccaaatcaccaccgagctctctcgatttcaatctcaccaccacctccgagctaggagccatgtcgggccgcggcaagggaggcaaggggctgggcaagggcggcgcgaagcggcaccgcaaggtcctccgcgacaacatccagggcatcaccaagccggcgatccggaggctggcgcgcaggggcggggtgaagcgcatctccggcctgatctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggccgcaccctctacggcttcggcggctgagatccgccttgggtcccaggctggtcgatggtgctagggttagcaacggtgtggtgtttggcgttcgttccatctgatgtgatgtctggaggtgtctccgactccgtgtctgttttgtgcaaagtagtaatgtgtctctgtgattggaaatggagtccgaagcttatgaatgaaatcgatctgtgtttacttttct

SEQ ID NO: 14658 - protein, 103 aa, Panicum virgatum; identical to SEQ ID NO: 12044
  misc_feature: Ceres CLONE 1777535
  misc_feature (25)..(94): Pfam Name: Histone Pfam Description: Core histone H2A/H2B/H3/H4

SEQ ID NO: 14659 - DNA, 558 bp, Panicum virgatum
  misc_feature: Ceres CLONE 1777536
  misc_feature: Encodes the peptide sequence at SEQ ID NO. 14660
cagccccggcacgaggcgcgccgccgccaggccgccgcgccgcgccggggccggcgcccgcgcccgccgccccgcccgcaggccccgcggcgccgccggggaggccaagaacggcgacaagagcggcgacgacgaccacgacgacaccggcaacaccaccgggcagagggaccgcgacggcgccgacgcacccacgcccaacaacccgcaccagagcaaggccgccgagacgggcgcgttttttttcaccaagaggggcctgctgctcaagttcctgctggtgggcggcgggtcgctgctagcctacgtcagcgcgtcggcgtcgccggacctgctgccgatcaagaaggggccgcagcagccgccgcagccggggccgcgcggcaagatctaagttcagttgttccttctcctcatccatctgtctctactagctgcttgcttgtaccgccgctagctccggacgccatggatcgtccttgcctgtcgttgtgctgctgatattcgatcgcgctgcctgtttatcaatgttcataatgttgtattcatatatactct

SEQ ID NO: 14660 - protein, 130 aa, Panicum virgatum
  misc_feature: Ceres CLONE 1777536
  misc_feature (5)..(130): Pfam Name: PSI_PsaH Pfam Description: Photosystem I reaction centre subunit VI
SPGTRRAAARPPRRAGAGARARRPARRPRGAAGEAKNGDKSGDDDHDDTGNTTGQRDRDGADAPTPNNPHQSKAAETGAFFFTKRGLLLKFLLVGGGSLLAYVSASASPDLLPIKKGPQQPPQPGPRGKI

SEQ ID NO: 14661 - DNA, 530 bp, Panicum virgatum
  misc_feature: Ceres CLONE 1777543
  misc_feature: Encodes the peptide sequence at SEQ ID NO. 14662
agagcgggggcgccgcacgccgcccccgccggcggcaaggacaggcccgccggcggcagcagccccgcgccggccaagcgggccgccgccgcgccgcgggccggcggccgcgccgccacgcggcggccgcggcacgccagccagaccaagaacgccgacgacgaagggcgggcggcggacgagaagaacagggacgggacggggacggcgagcgagacgccggagccgttttttttctgggcgccgtggtgcgggccgtgccggatgatcgcgccggtgatcgacgagctggccaaggactacgccggccagatcaagtgctgcaaggtgaacacggacgactgccccaacgtggcctccacctacggcatccgcagcatccccaccgtgctcatcttcaagggcggcgagaagaaggagagcgtcatcggcgccgtgcccaagaccacgctcaccaccatcgtcgacaagtacatcggcagctcgtgagccagacaacttataatacatacgtgtccgtgctcgcgcgt

SEQ ID NO: 14662 - protein, 162 aa, Panicum virgatum
  misc_feature: Ceres CLONE 1777543
  misc_feature (66)..(158): Pfam Name: Thioredoxin Pfam Description: Thioredoxin
  misc_feature: SWISSPROT Homolog: EC 1.8.1.8 Protein-disulfide reductase
RAGAPHAAPAGGKDRPAGGSSPAPAKRAAAAPRAGGRAATRRPRHASQTKNADDEGRAADEKNRDGTGTASETPEPFFFWAPWCGPCRMIAPVIDELAKDYAGQIKCCKVNTDDCPNVASTYGIRSIPTVLIFKGGEKKESVIGAVPKTTLTTIVDKYIGSS

SEQ ID NO: 14663 - DNA, 718 bp, Panicum virgatum
  misc_feature: Ceres CLONE 1777562
  misc_feature: Encodes the peptide sequence at SEQ ID NO. 14664
agtcctcccaactcaaacagaattaagcacagccgatctagcctctccaatggcgtcatcgtccgtcgcctccctcttctctgcggcctcggctctccccgccggcgttggcgggcgccaacagcagcggcagccgaggcggctggtggtggcggcggcggcgaagcgccggtacaaggggacggtgaggagggaggcggcgctggcagagctggtggagcggaaggtggcggaagcgatggaggcgtgcgcggggcgcgaggcggaggccgggtgccgcgtggcgtgggacgaggtggaggaggtgagccgggccagggccgacctccgccgccgcatcgccgaggcccccggcgacccgctcgagcccttctgcgcgcacaaccccgacgccgacgactgcgccgtcgtctacgtcgacgactgactgcgccatgcgtccgccgcggctcgcttcttcaatctggctctgaatcaccatgggcgtggttctttgtttactgcgtgcagatcgatcgaggctccagaaagagaacatgtttcagctttcagctttgcattgaattatcacagacacgttagtagtaacaatggtatgattaggcaccattagctttgcttcatcaatcagagagtgaacaagaatttacttcagttcttggcggtttcatctgccccctgtatgctaaatctgaatgcgacgagcatttctgatcgt

SEQ ID NO: 14664 - protein, 125 aa, Panicum virgatum
  misc_feature: Ceres CLONE 1777562
  misc_feature (52)..(124): Pfam Name: CP12 Pfam Description: CP12 domain
MASSSVASLFSAASALPAGVGGRQQQRQPRRLVVAAAAKRRYKGTVRREAALAELVERKVAEAMEACAGREAEAGCRVAWDEVEEVSRARADLRRRIAEAPGDPLEPFCAHNPDADDCAVVYVDD

SEQ ID NO: 14665 - DNA, 238 bp, Panicum virgatum
  misc_feature: Ceres CLONE 1777569
  misc_feature: Encodes the peptide sequence at SEQ ID NO. 14666
  misc_feature (105)..(105): n is a, c, t, g, unknown, or other
cagggcggccaccaccagccaggcgagcccccacccccagaagcagcacagagaccccgccaagcacccgggggaggggggcgcggccgggcaggacgacgacancaaaggcggcgaggggcaggccaccagcaccggcccgccagacacccgagaagagggagggaacccaaacgcgagaacgagccccccacaaaaccacccaaacagcccaccgacagccagacccaccacagaa

SEQ ID NO: 14666 - protein, 78 aa, Panicum virgatum
  misc_feature: Ceres CLONE 1777569
  misc_feature: SWISSPROT Homolog: EC 6.3.2.19 Ubiquitin--protein ligase
  misc_feature (35)..(35): Xaa is any aa, unknown, or other
RAATTSQASPHPQKQHRDPAKHPGEGGAAGQDDDXKGGEGQATSTGPPDTREEGGNPNARTSPPQNHPNSPPTARPTT

SEQ ID NO: 14667 - DNA, 795 bp, Panicum virgatum
  misc_feature: Ceres CLONE 1777603
  misc_feature: Encodes the peptide sequence at SEQ ID NO. 14668
cttatccccgggcttcctcccgccgccgctgctcactcccgaggcccgagctccccagcggcaggttcccccatggcgtccaccaccctctcctccgccttcaccctcctctcccgcccctcctcttccccgtgcccctccgccccgctcccgaggtcctccctcgccgtgccccacggccgccggggccgccgctccgtagccgtcgcgtcgaccgccaccgagtcccccaagatcctcgagctcggggacgccatcgccgggctcacgctcgaggaggcccgcagcctcgtcgaccacctgcaggagcgcctcggcgtcaccgccgcggccttcgcgccggccgccgtcgtcgcggcgcccggggcgggcggcgcgggggccgcagaggaggcggcccccgtcgagaagacggagttcgacgtcgtcatcgatgaggtgcccagcagcgcgcgtatcgccaccatcaaggtcgtgcgcgcgctcaccagcctagcgctcaaggaggccaaggacctcatcgagggcctccccaagaagctcaaggagggcgtcagcaaggacgaggccgaggacgccaagaagcagctcgaggatgtcggcgccaaagtgtctgtcgtgtgacactagattgtgagatgacactggcagttcatgatggtggacattgtgcttcccttgtatgagagtttgttcaggagcaatctttatagtggtttgcattgtgcttgctattgagcattacgcttgttattaagaaatggaaggggttttgattaaaaatcatatttaccg

SEQ ID NO: 14668 - protein, 183 aa, Panicum virgatum; identical to SEQ ID NO: 12098
  misc_feature: Ceres CLONE 1777603
  misc_feature (115)..(183): Pfam Name: Ribosomal_L12 Pfam Description: Ribosomal protein L7/L12 C-terminal domain

SEQ ID NO: 14669 - DNA, 1154 bp, Panicum virgatum
  misc_feature: Ceres CLONE 1777606
  misc_feature: Encodes the peptide sequence at SEQ ID NO. 14670
taaataacccagaccaaacaggcggggttccgcaacctctcccggatctccagccagcctcctccgcgtcgccgccgtcgagcgccgcagcgatggccaccccggacctgctcttcaacctgcggaacctcttctacctgggcgcctaccaggcggccatcaacaacagcgacgtcccgggcctcgacgccgacgccgccgccgagcgcgacgccatcgtcttccgctcctacatcgccctcggctcctaccagctggtgatcagcgagatcgactccgccgccgcgacgtcgctgcaggccgtgaagctgctcgcgctgtacctcaccggggacaaggaaggtgcaatctccagtctcaaggaatggttgagcgattcagcaattgggagcaatcctgttcttcgattgattgctggaattatatttatgcatgagcaggactataatgaggccctcaagcacacacactctggaggaactttggatttgcatgcattgaatgtgcagatcttcattaagatgcatcgttcagactatgctgagaagcaattgaagaccatgcaacaaattgatgaagaccatacactgacacaacttgcaagcgcatggttggacattgctgttggtggctctaagatccgtgaagcttacctcatattccaagactttgctgaaaagtacccaatgacagggatggttctgaatgggaaagcagtttgctgtatgcacatgggaagctttgaggaggctgaaactctattgcttgaagcattaaacaaggatgcaaaagatccagaaactcttgccaatctcattgtatgtagtctccaccttggcaaaccatcatcacggttcctcagccagctgaagctatcgcatcctgatcatgtgctagtgaagaactcagcatcgtcggaagcaaacttcgagagggccctccaagccgttgcttgagcacgacaaactgcatccagattacagaaagcagcacattgatcccgtttcccatttgttgtgtgttaacgcagtggagtggtggttctgtttgtctaatttcctcggtggtaattagtaaagttacttggccaatcctgtaccggaacaactgctgtataaacagatatgtagaatatggatttgttactttttgtc

SEQ ID NO: 14670 - protein, 287 aa, Panicum virgatum
  misc_feature: Ceres CLONE 1777606
  misc_feature (3)..(287): Pfam Name: Coatomer_E Pfam Description: Coatomer epsilon subunit
MATPDLLFNLRNLFYLGAYQAAINNSDVPGLDADAAAERDAIVFRSYIALGSYQLVISEIDSAAATSLQAVKLLALYLTGDKEGAISSLKEWLSDSAIGSNPVLRLIAGIIFMHEQDYNEALKHTHSGGTLDLHALNVQIFIKMHRSDYAEKQLKTMQQIDEDHTLTQLASAWLDIAVGGSKIREAYLIFQDFAEKYPMTGMVLNGKAVCCMHMGSFEEAETLLLEALNKDAKDPETLANLIVCSLHLGKPSSRFLSQLKLSHPDHVLVKNSASSEANFERALQAVA

SEQ ID NO: 14671 - DNA, 621 bp, Panicum virgatum
  misc_feature: Ceres CLONE 1777624
  misc_feature: Encodes the peptide sequence at SEQ ID NO. 14672
acatctccccattctcgccgccccgctccgtgctcgccgttctcccctcgctccgttggattcctctgctcgccggagctccgagttcgcccccccccccccccccaatggcggatgaggaggtatctgatccaaaggcgctcctagaggaacgctcaaaggctaagtgtgtgtcacagtggtacgaatatcagaaatgtgtcaagagaattgaaaatgacgagactggacataagcactgtactggccagtactttgattactggaaatgtgttgacaagaatgttgctgagaaactctttgatctgctaaaatgacaaggaaaatgtcctctttcagttttctactcaaaattggtaataattgtatcgcctgtgcaccatatagactattcaggtgcttaatatttgtcggagaagttttgcctcttgggtaacacaacaaattttccactgccagtttacgtttcatttctgtcagtagtattgaactttacagcaggtttcctcctgcataaagcattgttgtataaagaaattcaatgggttattccaagaatgtggctgagcattaaatgctcttatttacctttattgctttttatggtgcatttttacgagc

SEQ ID NO: 14672 - protein, 69 aa, Panicum virgatum
  misc_feature: Ceres CLONE 1777624
  misc_feature (7)..(69): Pfam Name: UCR_hinge Pfam Description: Ubiquinol-cytochrome C reductase hinge protein
MADEEVSDPKALLEERSKAKCVSQWYEYQKCVKRIENDETGHKHCTGQYFDYWKCVDKNVAEKLFDLLK

SEQ ID NO: 14673 - DNA, 755 bp, Panicum virgatum
  misc_feature: Ceres CLONE 1777651
  misc_feature: Encodes the peptide sequence at SEQ ID NO. 14674
acggacggcactgcgaagccagaaagaactacacgaggaagaaggttctagcgactcggtagcaacgaagcaagcgccatggggaacaagcggcagctgatctgcctcgccgccgccgccgtcgccgccgcggccatcctcctgacagcgtcggcaaagaagaccggcgacgtcaccgagcttcagatcggcgtcaagtacaagccagagtcatgcaccctgcaagcgcacaaaggtgataaaattaaggtccattatcgtgggacactcactgatggatcagtatttgattctagctatgacagaggtgacccatttgaatttactcttggaaatggccaagtgataaaaggttgggaccgaggattactaggtatgtgcgtcggtgaaaagcggaagctaaagatacctgcaaagatgggttatggtgagcgaggctccccaccgaagattccaggtggagcaactctgatcttcgacacggagcttatcgctgtcaatggaaagacatctggtgatgcaaaggcagaaagcaatagcgagctttaacacattgaagagtttcatcttgaacgtgtagcagcttcactaatagtggctcgcgcgagttcacttgatgaaagggttgttgtgttatgatttagatgttacaaatgcaagtctggttaagctctatgatctatgtcagcgactgttcatatactgtggaaacttttttcgcttggttggatgagaattcgatttgcgttgttgcc

SEQ ID NO: 14674 - protein, 156 aa, Panicum virgatum
  misc_feature: Ceres CLONE 1777651
  misc_feature (44)..(138): Pfam Name: FKBP_C Pfam Description: FKBP-type peptidyl-prolyl cis-trans isomerase
  misc_feature: SWISSPROT Homolog: EC 5.2.1.8 Peptidylprolyl isomerase
MGNKRQLICLAAAAVAAAAILLTASAKKTGDVTELQIGVKYKPESCTLQAHKGDKIKVHYRGTLTDGSVFDSSYDRGDPFEFTLGNGQVIKGWDRGLLGMCVGEKRKLKIPAKMGYGERGSPPKIPGGATLIFDTELIAVNGKTSGDAKAESNSEL

SEQ ID NO: 14675 - DNA, 873 bp, Panicum virgatum
  misc_feature: Ceres CLONE 1777661
  misc_feature: Encodes the peptide sequence at SEQ ID NO. 14676
accaaacaggtcagctaggcaaggcgccaagaaggcaagaactcgagataatccttccctcagacagacttcgcctcctccctcctcctcctccggcgaatcccacgctggtttcgggatgtcgacggaactcctgacgaaattcctcacgttgctgtttgggtacgcgatgccggcgctggagtgcttcaaggcgatcgagcagcggcctggccgggctgaccagctccggttctggtgcgagtattggatcatcctagtgctcctggccatgttcgacgaaattgctggtgttctgatttccaagattccaatgtactacgagctcaagcttgccttcctcgtgtacctgtggtacccaaagacaaggggaacagacatagtgtatgagaccttcctccagcccctggtgatgcagtaccagcccagcatcgaggcgagactgcagtacctgcgcgccaatgccggtgatatccttgtcttctacctcaagaacttcaccgagaggggctacgacctcttcctccgggtaatggactacgtccggtcgcaggcgtccagaggatcaagaacaaggagtttcttctcgttcagaggggaccgggctgacaggccgagcttcaccgacgactacgcaattggtggcgaccggagggatggggggaggcaccggcgaccgcgtagtggctactagcagaccaaaaaattagcaagttgatgcatatggtgtgcacagaaactgaaatgattactggcataggcgtaggtaggaacaagcaaatcattgtgaagctggttgatttaaaacacaggtggattatgtacaaaacttgtaggtttgactacaaacatagatctctacaaacttcttgt

SEQ ID NO: 14676 - protein, 191 aa, Panicum virgatum
  misc_feature: Ceres CLONE 1777661
  misc_feature (2)..(98): Pfam Name: TB2_DP1_HVA22 Pfam Description: TB2/DP1, HVA22 family
MSTELLTKFLTLLFGYAMPALECFKAIEQRPGRADQLRFWCEYWIILVLLAMFDEIAGVLISKIPMYYELKLAFLVYLWYPKTRGTDIVYETFLQPLVMQYQPSIEARLQYLRANAGDILVFYLKNFTERGYDLFLRVMDYVRSQASRGSRTRSFFSFRGDRADRPSFTDDYAIGGDRRDGGRHRRPRSGY

SEQ ID NO: 14677 - DNA, 582 bp, Panicum virgatum
  misc_feature: Ceres CLONE 1777676
  misc_feature: Encodes the peptide sequence at SEQ ID NO. 14678
aattcccatggcgactcgcgcgccgccgccgtactcgtcgtcagccggatccgtgaccgtgaccgtgaccgttgacccctccccctcttcgtcctcctcggccccgccaccggcgacggccgcgccgccgccggcggaggcggtggtgctgcggctgaagcggcggggcaagaaggtgtcgtggaaggagggaacggtggacaacgagggcctcggccgcaagagctccaagaagtgctgcatcttccacaaggaggtccccttcgacgaggactgcagggacgatgaggcccccggcggagggcaccagtgcccgcggggagatgctggcgagggcaccagcggcagcggcggtggcggatgcccgtcctcctcccacgaccacagccatcaccacccctgatctcggtgcggattgaggcttcttgatccctcgttgcttatattcaatctgctgtgatgaaattttgtgatctgatgatgtaattagttgagtggaaatgctgaattcgtgctcaattgttggggagactctgttcttctgggcgattcactggtcaatatataatccttgttgacttc

SEQ ID NO: 14678 - protein, 131 aa, Panicum virgatum
  misc_feature: Ceres CLONE 1777676
  misc_feature (47)..(96): Pfam Name: PPI_Ypi1 Pfam Description: Protein phosphatase inhibitor
MATRAPPPYSSSAGSVTVTVTVDPSPSSSSSAPPPATAAPPPAEAVVLRLKRRGKKVSWKEGTVDNEGLGRKSSKKCCIFHKEVPFDEDCRDDEAPGGGHQCPRGDAGEGTSGSGGGGCPSSSHDHSHHHP

SEQ ID NO: 14679 - DNA, 860 bp, Panicum virgatum
  misc_feature: Ceres CLONE 1777688
  misc_feature: Encodes the peptide sequence at SEQ ID NO. 14680
agcggacacgacacgaacagcgagcgcctcctctcccgctctccctccgcgccctcggcttccctccaatgccgccacccatggcgctgcccctccccacctccgcctccaccacgcacccgcactttcgcccctgccctcccgcaccgctgcgcctcacctccgcccgcgcccgcacggtctccgccggctacgcggcgtccttctacggcggctcggcgtccgcgaccggcggcgccgaggacgaggagggctccgcctcggggttcggctccgggctggggctcggcggcggcgggctcgggatgtcggccgcggaggcggcgctggcgctggaggagcgggagatgccgccctgcccgccgggcctgcgccagtacgagaccatggtcgtgctgcggcccgacatgtccgaggaggagcgcctcgcgctcatccagcgctacgaggagctgctcgtcgccggcggcgccatgtacgtggaggtcttcaaccggggcgtcatcccactggcatacagcatcaggaagaggaacagccggaccgggctgccgtccacctactacgacggcatatacctcctcgtcacctacttcaccaagcccgactccctgtccaccctgcagcagaggctcaacgccgacgatgacgtcatccggtcgaccagcttcaaggtccgcccgcggaaggccttctagacggcggacaggcctggactcatggggctcaagatttggtttcttctgggatcaaaagtttcaggttttgaatattttgttcatatcatacaagtactctgcagtattgcgagtagatgcatgcctcctttgccattgttgagagggaaatggttatccttt

SEQ ID NO: 14680 - protein, 205 aa, Panicum virgatum
  misc_feature: Ceres CLONE 1777688
  misc_feature (98)..(199): Pfam Name: Ribosomal_S6 Pfam Description: Ribosomal protein S6
MALPLPTSASTTHPHFRPCPPAPLRLTSARARTVSAGYAASFYGGSASATGGAEDEEGSASGFGSGLGLGGGGLGMSAAEAALALEEREMPPCPPGLRQYETMVVLRPDMSEEERLALIQRYEELLVAGGAMYVEVFNRGVIPLAYSIRKRNSRTGLPSTYYDGIYLLVTYFTKPDSLSTLQQRLNADDDVIRSTSFKVRPRKAF

SEQ ID NO: 14681 - DNA, 792 bp, Panicum virgatum
  misc_feature: Ceres CLONE 1777703
  misc_feature: Encodes the peptide sequence at SEQ ID NO. 14682
atcactgaccacacctaagccctcctgcaacattgttcttgaagctgtcatcatgactggcgctgcagttatcgccggcctggtgctcctcgccgccgccgccgctccggcgttcgccacggatcacgtggtcggcgactcgtccgggtggaccagcggcgtggactacaccacctgggcgaaaggcaagaccttcagtgttggggacaacctggtgttccagtacagcgcgatgcactcggtggcggaggtgagctcggcggactacagcgcgtgctcggccagcaactccctccagtcgtacagcgaccagaacaccaagatcccgctcaccgcgcccggcacgcgctacttcatctgcggcaccgtgggccactgcagcagcggcatgaagctcgccgtcaaggtgtccgcggccgccgccacctccccggcggcgtcgtccccgcccgccgacgacggcactcccccggagacgaccacgccttccgcgtcgacaccccccgcgacgacggcggcgcccacgaccaagtccacctcgagcagcaccgccggggaggccccgctggcgatgggcgtactggccggcgcagcggtgctcgtcagcctcgccctgatggcctaggcaagaggcagtgctgtcgttcccgtgccttttccgtttggttgtagtcggctgtttcacgcgctctccattcacgtctctgcgtcgcgaacgtcttggttcgagactcgtgttgtgtacctgtacctgtacgatcattcttgatttagagaaactactgttctctg

SEQ ID NO: 14682 - protein, 190 aa, Panicum virgatum
  misc_feature: Ceres CLONE 1777703
  misc_feature (33)..(113): Pfam Name: Cu_bind_like Pfam Description: Plastocyanin-like domain
MTGAAVIAGLVLLAAAAAPAFATDHVVGDSSGWTSGVDYTTWAKGKTFSVGDNLVFQYSAMHSVAEVSSADYSACSASNSLQSYSDQNTKIPLTAPGTRYFICGTVGHCSSGMKLAVKVSAAAATSPAASSPPADDGTPPETTTPSASTPPATTAAPTTKSTSSSTAGEAPLAMGVLAGAAVLVSLALMA

SEQ ID NO: 14683 - DNA, 683 bp, Panicum virgatum
  misc_feature: Ceres CLONE 1777708
  misc_feature: Encodes the peptide sequence at SEQ ID NO. 14684
aaccgcgccgccatcgcgtcgaaggggattagccgatcaggagagaggcacaaaaccctcctcccttcctcgccgcctcgcccgctcgcagccgcaggtccagctagggtttgctctccccgcccccgccgcgcgcgcgcgcctcgcctccagacgctcagagaaggggaagggaagctcccgccgccgcatcagccatggcgtccaccaaggtccagcgtatcatgacccagcccatcaacctcatcttccggttcctccagagcaaagcgcgcatccagatctggctgttcgagcagaaggacctccggattgagggtcgcatcatcggatttgatgagtacatgaacttggtccttgatgatgctgaggaaatcaatgtaaagaagaacactaggaaatcattgggtcggatacttctgaaaggtgacaacataactttgatgatgaacactggcaagtgaagctggaagatgtttggagcctagtatttccgtgaggcatttgtaatccatccagactgaaatgtagaattgtcattgtgcgcgagatatgtactccatccaaactgagattgtagcatgtcgttatgagagtgagatagttgtcgctgttgacttcctgaggtttaactcttatgtacttctagatgtgataatgagctgctcacttgtgctctgaag

SEQ ID NO: 14684 - protein, 88 aa, Panicum virgatum
  misc_feature: Ceres CLONE 1777708
  misc_feature (19)..(85): Pfam Name: LSM Pfam Description: LSM domain
MASTKVQRIMTQPINLIFRFLQSKARIQIWLFEQKDLRIEGRIIGFDEYMNLVLDDAEEINVKKNTRKSLGRILLKGDNITLMMNTGK

SEQ ID NO: 14685 - DNA, 725 bp, Panicum virgatum
  misc_feature: Ceres CLONE 1777738
  misc_feature: Encodes the peptide sequence at SEQ ID NO. 14686
cccccgcccgtgcccacctcacctcgatttgcccaatccaaggtcgcggtcgcgcgcatcgatctcgctcggggggagttcgggatctcacctgcgccccgtcgatttggaccccgtccatccaccccgcgtagcgcaagagagcggcggcggcggagatgtccaaggtctacaccctcgaggaggtcgccaagcacaactccaaggacgactgctggctcatcatcggcggcaaggtgtacgatgtgacaaagtttttggaagaccacccaggaggtgacgatgttctgctttcctcaactgccaaggacgcaactgatgatttcgaagatgtcgggcacagcaccactgcccgtgcgatgatggatgagtacttgttgggtgaaatcgactcatcaacgatccctgctaggacgaagtatgttccccccaagcaaccgcactacaaccaggacaagaccccagagttcattatcaagatcctccagttcttggttcccctggcaatcctgggcttggctgttgctgttaggatctacaccaagtcagagtctgcttagctttgctgccctcgcccccttggggattataagagtccaaacttgttgaataagttagcaagagttctgtgaggttttacatgtgtaacatgtcatgaattcgtcgaatgatctgagctattgtgggttatgtggtcctggagtgcttaaagtaggattgaaatt

SEQ ID NO: 14686 - protein, 133 aa, Panicum virgatum
  misc_feature: Ceres CLONE 1777738
  misc_feature (4)..(78): Pfam Name: Cyt-b5 Pfam Description: Cytochrome b5-like Heme/Steroid binding domain
MSKVYTLEEVAKHNSKDDCWLIIGGKVYDVTKFLEDHPGGDDVLLSSTAKDATDDFEDVGHSTTARAMMDEYLLGEIDSSTIPARTKYVPPKQPHYNQDKTPEFIIKILQFLVPLAILGLAVAVRIYTKSESA

SEQ ID NO: 14687 - DNA, 560 bp, Panicum virgatum
  misc_feature: Ceres CLONE 1777768
  misc_feature: Encodes the peptide sequence at SEQ ID NO. 14688
ggtcctccgctgctgctagggtttcgtctcgaggagaaggccgggcgaagctcccgcaggtcccttcacctgtcccgcgttcgaggctaggtagccgccatgagccgatcggggcagcctccggatctcaagaagtacatggacaagaagcttcagatcaagctgaatgcaaaccgtgtcgttattggcacacttcgaggatttgaccagttcatgaatctggtggtggataacactgttgaggtcaatggaaatgacaagactgatattggaatggtggttataaggggaaacagtgttgtcatgatcgaggcgctggagcctgttgccaagtctcagtgaatcatcattctgattcagcagatgtaggcaccaactgcatgaaaactgatgtaaatgatatcagtcaacctgttgtactttaacagtatttgcacagtaatataactttgaatgcgggagagtcgtgccctgtgcatactccttgattgtgactatgtaatcatctggcgatgcttatgataaatacttaatttaactcaagcttaattggttgggcg

SEQ ID NO: 14688 - protein, 80 aa, Panicum virgatum
  misc_feature: Ceres CLONE 1777768
  misc_feature (8)..(72): Pfam Name: LSM Pfam Description: LSM domain
MSRSGQPPDLKKYMDKKLQIKLNANRVVIGTLRGFDQFMNLVVDNTVEVNGNDKTDIGMVVIRGNSVVMIEALEPVAKSQ

SEQ ID NO: 14689 - DNA, 630 bp, Panicum virgatum
  misc_feature: Ceres CLONE 1777793
  misc_feature: Encodes the peptide sequence at SEQ ID NO. 14690
attgccgcgcgaactcttccctcctagcagctacctagctagctagctttatttcagcagcagctgctgcagctctagctaacaataattaagcagcaatggccaccgccctcagcagcctccgcgcgccggccagcagcttctcctccggcgtgcgcgccgccccggcgcccggcgtcgtcgccatgcccgccgccaagcaggttgttgcccgcggcgccaggctgcgcgcgcaggccacctacaacgtgaagctgatcacgcccgacggcgaggtggagctgcaggtgcccgacgacgtgtacatcctggaccaggccgaggaggaggggatcgacctgcccttctcctgccgcgcggggtcctgctcctcctgcgccggcaaggtcgtctccggctccgtcgaccagtccgaccagagcttcctcgacgacgaccaggtcgccagcagctgggtgctcacctgccacgcctaccccgcctccgacgtcgtcatcgagacgcacaaggaggaggagctcaccgcttaagctccatcatcacatcatcatcatatcccatgcataaaattaaagctgctagcttgtaataaaatgttaatgcagaaattggtctgctagcttgtgtctt

SEQ ID NO: 14690 - protein, 143 aa, Panicum virgatum
  misc_feature: Ceres CLONE 1777793
  misc_feature (54)..(129): Pfam Name: Fer2 Pfam Description: 2Fe-2S iron-sulfur cluster binding domain
  misc_feature: SWISSPROT Homolog: EC 1.14.13.7 Phenol 2-monooxygenase
MATALSSLRAPASSFSSGVRAAPAPGVVAMPAAKQVVARGARLRAQATYNVKLITPDGEVELQVPDDVYILDQAEEEGIDLPFSCRAGSCSSCAGKVVSGSVDQSDQSFLDDDQVASSWVLTCHAYPASDVVIETHKEEELTA

SEQ ID NO: 14691 - DNA, 456 bp, Panicum virgatum
  misc_feature: Ceres CLONE 1777808
  misc_feature: Encodes the peptide sequence at SEQ ID NO. 14692
ctggaggaggatgaagactttctcgacaatctcaatccttgcactcggcgtgagaccccagcccttggagacgcaaacatgaggaacctcaagctcggagaagtcatacagctcgagaggaaaggctactacaggtgtgatgccccgtttatcaggtcgtcgaaacctgtggtcctatttgcgatcccagatggtcggcagcaggcttcgctgaactaggtagcatgctactgatgagcacatggaattcctgagatgtcaagcttggcaatcaatattgttgtatacacttaatctggtactgtgattaggcttaccgccgtagattttgttcactactatatggccaggcccatcctgccaaccaagcagcacaggcattttgattttggttgattatacttgcctcagtttgaacatactggtacttttctagcaatactgtttgcatcctgc

SEQ ID NO: 14692 - protein, 72 aa, Panicum virgatum
  misc_feature: Ceres CLONE 1777808
  misc_feature: SWISSPROT Homolog: EC 6.1.1.17 Glutamate--tRNA ligase
LEEDEDFLDNLNPCTRRETPALGDANMRNLKLGEVIQLERKGYYRCDAPFIRSSKPVVLFAIPDGRQQASLN

SEQ ID NO: 14693 - DNA, 769 bp, Panicum virgatum
  misc_feature: Ceres CLONE 1777809
  misc_feature: Encodes the peptide sequence at SEQ ID NO. 14694
caccacagttcttccacaaatctcagatacacttcgccttccacaagaccgcacctctaacgcacaacttcttgaattcacacagaagttccttccccatacgctcgatctggtatacaatacaaagagaaacacgagggcctagacgtttgatctcatcgcaggtgacgcagccgacggccacgccaaccccgccgtcttcgtcaacggggccggcgacgccaaccttcacattgttgtgccgaccggcgaccgcctcgttcacgcctctccgccggccacttaccgagatccaaagtgatcccagcttcctgtaacagatggatatagtgaatcacatggtggtgcaatggcttgggggctttgctacaaccatgaattgagccccagtcagagctactctcatgattgcaatgagtactatggcagaggcactattcctgtttacaggtcaaattgatatgtcactttgttgataatcttggatccgcttgttgatgttcaccaggaatcacaactatggtatctcattaccaacagttggccctgagcactctggacacaacttggattgtggtgatcaggtggctttcaatccatcatcagagagttccgacttctaagaaactgttttaaaaatcagtgtgtctggggccgagggcccactaactgggttccccaagctattgtgatcatgtctgagaaacaacagttgtttgccctatggcatatgtaatatgtactatgatgcttaatattttaccaccgc

SEQ ID NO: 14694 - protein, 36 aa, Panicum virgatum
  misc_feature: Ceres CLONE 1777809
  misc_feature: Useful for making plants with modulated water use efficiency
  misc_feature: Useful for making plants with altered cell wall content and/or composition
MAWGLCYNHELSPSQSYSHDCNEYYGRGTIPVYRSN

SEQ ID NO: 14695 - DNA, 732 bp, Panicum virgatum
  misc_feature: Ceres CLONE 1777876
  misc_feature: Encodes the peptide sequence at SEQ ID NO. 14696
cgagcgagcggaaaaaaggagaggccgagaacgaagccgcttcggctagccgtcgtagcgataagggtagctgctgccgagctagctggtgctccggcgtgatggcggccacggcgtactccgtggcgctcctcggcggcgcgcgcctccccgccgccccgcgctccgccctcctcccgcgccgcagcgcctgccagctccgcctccagcaagatgcgccgaggctctccctgctccgcgtgaaggccgcctccgaggacacctcctcggcctccgccgacgagctcatcgaggacctcaaagccaagtgggacgccgttgaggacaagcccaccgtgctcttgtacggcggcggcgccatcgtcgccctctggctgacctccgtggtcgtcggcgccatcaacgccgtgccgctgctgcccaagatcatggagctcgttggcctcggctacaccggctggttcgtctaccgctacctcctcttcaaggaaagtcggaaagacttggctagcgacattgagaccttgaagaagaagatcaccggaacagaataaacacacgctcttggagagttttgagtggttctttcatcttggggggaaaatatgtaatgggagaaccgtctgcttgagtactactgccgatttgtgctatatatctggatacaaaggaagctttgttatgttgtgcagtaacattgtagtttgaatatatcgcactaccagtttgttt

SEQ ID NO: 14696 - protein, 150 aa, Panicum virgatum; identical to SEQ ID NO: 11928
  misc_feature: Ceres CLONE 1777876
  misc_feature: SWISSPROT Homolog: EC 6.1.1.9 Valine--tRNA ligase

SEQ ID NO: 14697 - DNA, 879 bp, Panicum virgatum
  misc_feature: Ceres CLONE 1777911
  misc_feature: Encodes the peptide sequence at SEQ ID NO. 14698
gaggcggcctgcctggctgcctgtttcgtgtgtctgaggatctcctgatctcctccctgtccatcgtcatccccttctttactccatcccccctcccctccgtcgctcgatgctcctcctgccgtctcccatgatctgagctctccgacggcctcctccccggagacgctacggggtagcaccgagactctgcagaagctgacaagccctccaagaattcaggcgcatcacgccagcaacaagacgacgaagcggcggaggtaaagggagaggggaggagcgagcgcatcggtttccgtcatggagggcggcgagacgacgctgtcggggttcggcggcggcggcggcggcggcgcggggcccggcggggacaccaaggtgctgcacgcgttccagacgagcttcgtgcaggtgcagagcctgctggaccagaaccgcgtcctcatcaacgagatcaaccagaaccacgagtccaaggtgcccggcgacctctcccgcaacgtcggcctcatccgggagctcaacaacaacatccgccgcgtcgtcgacctctacgccgacctctcctcgctcttcgccgcctccgacgccgccgccgccgccggcggcggccgcgcggcgtccgagggcggatccgtcggcaccgtccggcaggccggcgccggccacaagcggatcaggtccggcctcgactgacgacttcatcatcactcttagctagccagccagggaccgacctccttcctctccccttctttgaccttagctgttcttgtatctatcgacatatttatctaccttatttactatccattacgactgctactgttacatatgagcaagagcaaatccacccaactcatgacattcttgtagctg

SEQ ID NO: 14698 - protein, 131 aa, Panicum virgatum
  misc_feature: Ceres CLONE 1777911
  misc_feature: Useful for making plants with altered lignin content
MEGGETTLSGFGGGGGGGAGPGGDTKVLHAFQTSFVQVQSLLDQNRVLINEINQNHESKVPGDLSRNVGLIRELNNNIRRVVDLYADLSSLFAASDAAAAAGGGRAASEGGSVGTVRQAGAGHKRIRSGLD

SEQ ID NO: 14699 - DNA, 790 bp, Panicum virgatum
  misc_feature: Ceres CLONE 1777917
  misc_feature: Encodes the peptide sequence at SEQ ID NO. 14700
aacgccgtccccgtccttccggcccaaccacacctcccgcagccaccgcaggtccgcagccaaatcacgtgccctcccggagctcgaaccgaagccaccagcagcacgaccaccccaccggcgagggagagggcgggaagcggcgcggccggaggagtgggggaacgatggcgttcacgatgcgcgcggtgaaggttcccccgaactcggcctcgctggaggaggcgcggcaccgcgtgttcgacttcttcaagcaggcctgccgctccatccccaccgtcatggagatctacaaccttgacgacgtcgtcactccctcccagctccgctccaccatcgccaaagagatccgcaagagccagaacatcaccaaccccaaggttattgatatgcttctgttcaaggggacagaggagctgaacaacatagttgagcacgcaaagcagcgccatcatgtgattgggcagtatgtgattggccaagagggcctggtgcatgagctgggctcaaaggaccaagggagctctgatttcctgaagaaattctacagtagcaattacttctgatcataattacagattttcaccttctgtaatactcaagaggtgcttcaaataagatgctgaggacttacccagacccagttatttcgccgctggaggttttgatttatttggtcgaatcctctgctcaatatgatgctgctgttagtagtttcactttgtggattgttgttgtacttacagaattgatgtttataaatcgatcctatgaagatcgagccttttgt

SEQ ID NO: 14700 - protein, 132 aa, Panicum virgatum
  misc_feature: Ceres CLONE 1777917
  misc_feature (19)..(89): Pfam Name: Complex1_LYR Pfam Description: Complex 1 protein (LYR family)
MAFTMRAVKVPPNSASLEEARHRVFDFFKQACRSIPTVMEIYNLDDVVTPSQLRSTIAKEIRKSQNITNPKVIDMLLFKGTEELNNIVEHAKQRHHVIGQYVIGQEGLVHELGSKDQGSSDFLKKFYSSNYF

SEQ ID NO: 14701 - DNA, 741 bp, Panicum virgatum
  misc_feature: Ceres CLONE 1777927
  misc_feature: Encodes the peptide sequence at SEQ ID NO. 14702
atcgttatctcctcccacccacgcccctaccggacccgtaacaccaaacagtctcaggccccaggcccccaaccactggcgcaggcccccgcgacgagaacatcaggaggacgaacaaggaaaaagtatggccgccgccgctgccacggtgacggcggtgtcgagctgcggcaagcgcgagctcgacatagtggacgccgccggcatgccgaacaaggggaagagagggaggccgccgccgccgccggaggaggtggaggcgttcctcgccgccgcggagagcaccttggcgcggcgcttcgcggccaagtacaactatgacgtcgtcaaggacgctcccatggacggccggtacgagtgggtccgcgtgggcccgtgacacgatcgcgcaacgggcgggcactcggccagtcaaccgccagatcgaagagaagcctggccgcgcccgtgtctgcttcggtgttgatttcccttgtactgtagcttacttaccgtgtgtgcaacacttgttctagctgtgcctgtaattatgctcacgagatggctaatcatgtgaaagcctcgaccttgtacgtcgctacgtcagtggatgttccgcttgtaacttagcgtttggttaacatgtcgttatgtgtagtgtagtgtagcccagggaaaaacaaagttgtaacttgtcgctgtgttcgatttgttggttccccgttcataccaatgaatgaatgaaacagagtattcaggccc

SEQ ID NO: 14702 - protein, 83 aa, Panicum virgatum
  misc_feature: Ceres CLONE 1777927
  misc_feature (35)..(82): Pfam Name: CDI Pfam Description: Cyclin-dependent kinase inhibitor
  misc_feature: The sequence is a functional homolog of SEQ ID NO 2 in US patent 7256280
MAAAAATVTAVSSCGKRELDIVDAAGMPNKGKRGRPPPPPEEVEAFLAAAESTLARRFAAKYNYDVVKDAPMDGRYEWVRVGP

SEQ ID NO: 14703 - DNA, 878 bp, Panicum virgatum
  misc_feature: Ceres CLONE 1777941
  misc_feature: Encodes the peptide sequence at SEQ ID NO. 14704
attagggtttccagccaaactcgctacctataaacactcctctcacacccacgggcgccgtcttcgcccgccgccgccgcctcccctcgtcctcctccgcgccgccgtaggctaggttaggctagagtctcgacgagctcgcggaaatggtggccttcaggttccatcagtaccaggtggtggggcgcgcgctgccgacgcccggcgatgagcaccccaagatctaccgcatgaagctctgggccaccaacgaggtccgcgccaaaagcaagttctggtacttcctgaggaagctgaagaaggttaagaagagcaacggccagatcctcgccatcaacgagatcttcgagcgtaacccaactacgatcaagaactatggcatctggctccgctatcagagcagaaccggctaccacaacatgtacaaggagtaccgtgacaccaccctgaacggtgccgtggagcagatgtacagtgagatggcttcacgccaccgcgtgagggccccttgcatccagatcatcaagactgcgatggtccacttcaagctgtgcaagagggacaacaccaagcagttccacaactccaagatcaagttcccccttgtgtcccgcaagatcaggcccccaaccaggaagctgaagaccacgttcaaggcatcaaggccgaacctgttcatgtgattcagttgtgcctgtgttgtggtcaatgtttgggagcataagagtccgtaagttttatgttttaagttttgacgtgcttagacctcagtggttgattcatcccgttttgaaacgtgcttggtgaaccatttgagtatcgtattatgaatagctggaagacttcaatggtattggtgatctgtttggagtttggtc

SEQ ID NO: 14704 - protein, 178 aa, Panicum virgatum
  misc_feature: Ceres CLONE 1777941
  misc_feature (5)..(178): Pfam Name: Ribosomal_L18ae Pfam Description: Ribosomal L18ae protein family
MVAFRFHQYQVVGRALPTPGDEHPKIYRMKLWATNEVRAKSKFWYFLRKLKKVKKSNGQILAINEIFERNPTTIKNYGIWLRYQSRTGYHNMYKEYRDTTLNGAVEQMYSEMASRHRVRAPCIQIIKTAMVHFKLCKRDNTKQFHNSKIKFPLVSRKIRPPTRKLKTTFKASRPNLFM

SEQ ID NO: 14705 - DNA, 681 bp, Panicum virgatum
  misc_feature: Ceres CLONE 1778007
  misc_feature: Encodes the peptide sequence at SEQ ID NO. 14706
ctcccccggcccactggtcctacgccacaccaaaccgatcagaaggagcaggagctgagagctagcccacacggcgtggaggccgtcgttgctcggagatcatggcggactgggcgccggtgttcatcgggctggtgctgttcatcctcctctccccgggcctgctgttccagatccccggcaagggccggatcatcgaattcggcaacttccataccagcggcctctccatcctcatccacgccatcatctacttcaccctcatcgccatcttgctcctcgccgtcggcgtccacgtgtacctcggctagccgtcagttgaccgcagcggcggcctcctccatctctgaccggcaagattaggtacagtggtagaggcatgttcacctccattggtggttggctgcttggtatactagtatagggtggtcaatgtgtcttgggcatttgttaaaggctcactactgttattctgcaaaatgtagtcttatctcttatgtacctgcagtactactagctctgcttctcatgatggcagtcatcgtcttttttttcagcatgtgtctcctttagcatgagttgttagtactggctgactcagcttggatttgctagagatgttaatcatcatgagggtcgattatatttgccacactttgttctgaacttttttgctgctct

SEQ ID NO: 14706 - protein, 69 aa, Panicum virgatum
  misc_feature: Ceres CLONE 1778007
  misc_feature: Useful for making plants with altered cell wall content and/or composition
MADWAPVFIGLVLFILLSPGLLFQIPGKGRIIEFGNFHTSGLSILIHAIIYFTLIAILLLAVGVHVYLG

SEQ ID NO: 14707 - DNA, 746 bp, Panicum virgatum
  misc_feature: Ceres CLONE 1778012
  misc_feature: Encodes the peptide sequence at SEQ ID NO. 14708
agcagctctagcaataatggccaccgccctcagcagcctccgcgcgccggccagcagcttctccggcgtccgcgccgccccggcgctgcgggcgacggcgagttctacctccggtactacgtggggcacaagggcaagttcgggcacgagttcctcgagttcgagttccgccccgacagcaagctccgctacgccaacaactccaactacaagaacgacaccatgatccgcaaggaggtcttcgtctccccctccgtcctccgcgaggccaggaggatcatccaggagtccgacattatgaaggaggacgacagcaactggccggagcccgaccgcatcggccggcaggagctcgagatcgtcatgggcaacgagcacatctccttcaccacctccaagatcggctccctcgtcgatgtccagtccagcaaggaccccgagggcctccgcatcttctactacctcgtccaggatctgaagtgttttgtgttttcgctcatcaacctccacttcaagatcaaaccaattcagtcctgagctccattccatgctgttccgtgactgtgttatgaaactgcgagtgtttaagagagaaccctgtaccatgtaagatcctatttagcttgtgatgatgcactcgggttgtgtggagcattgggtggaagtggaactttgagtttgcctgagattgctgtttggatgtgcaaactgcgagtaatgatatttctgcttctttccttgtttcc

SEQ ID NO: 14708 - protein, 178 aa, Panicum virgatum
  misc_feature: Ceres CLONE 1778012
  misc_feature (34)..(176): Pfam Name: Mago_nashi Pfam Description: Mago nashi protein
SSSSNNGHRPQQPPRAGQQLLRRPRRPGAAGDGEFYLRYYVGHKGKFGHEFLEFEFRPDSKLRYANNSNYKNDTMIRKEVFVSPSVLREARRIIQESDIMKEDDSNWPEPDRIGRQELEIVMGNEHISFTTSKIGSLVDVQSSKDPEGLRIFYYLVQDLKCFVFSLINLHFKIKPIQS

SEQ ID NO: 14709 - DNA, 587 bp, Panicum virgatum
  misc_feature: Ceres CLONE 1778014
  misc_feature: Encodes the peptide sequence at SEQ ID NO. 14710
aggtgagagcagttggacacaccctgcaggagggctcacccgtagagggctcgccacaccaccaccaagtattaagaggcgagaggttgacgtacaagcagctagctagaggtcgtttcaggggaaaaggagaagagaagacaagatgcaggactgggcgccggtgttcatctcgctggtgctcttcatcctgctgtcgccgggcctgctgttccagatccccggcaagtgccggatcatcgagttcggcaacttccacaccagcgcgctctccatcctcgtccactccatcctcttcttcgcactcatcgccatcttcctcatcgccatcggcgtgcacatgtacctcgggtcctagcttgtagcttttgttagcctgatgatgcctacctgcctgcccgacgatggggtgtttgtcgatcagtttgcagctcgatcgtgttcttctctgctagtcgcccatctctaattaagggttctttttttctatacacatgtgttgaataacaatgtatgtaccatccatgttcatttctttcttcttctaataataataataataacaaagttcttcaatttgctttggc

SEQ ID NO: 14710 - protein, 70 aa, Panicum virgatum
  misc_feature: Ceres CLONE 1778014
  misc_feature: Useful for making plants with altered cell wall content and/or composition
MQDWAPVFISLVLFILLSPGLLFQIPGKCRIIEFGNFHTSALSILVHSILFFALIAIFLIAIGVHMYLGS

SEQ ID NO: 14711 - DNA, 716 bp, Panicum virgatum
  misc_feature: Ceres CLONE 1778018
  misc_feature: Encodes the peptide sequence at SEQ ID NO. 14712
accacaagtccacaaatacccaggcacgcgccaccgagctggcctggcctgcttcgttccactccggcagcaccagcagccgagctgaccagaggaaggagtagtacgcgcgcgcgtgcgagagagtgggtggcgtcagctgttgggcggtggtcggcgcgcgggagggcttggtgatcatcgataggaagatgagcaggaacagcggcaaggtcgggtcgaagctgcaggagctgcggctgagcctgtcgtcgcggtcgcgcggggccccgtcatcgtcggggggcgcgaccggtggccagcgcggcggcgtgggcggcggcgggggaggggcctcgccgaggcggctgtcgtcgtcgtcgtcgtcgaccgcgtccccgccgagctcgtgcgtgtcatcggaggggagccccgaggccgccggcgcgccgccgccgatgatcctggcagggtgcccccggtgcatgatgtacgtgatgctgtcgcgggaggacccccggtgccccaagtgccacagcaccgtcctcctcgacttcaacgacggcggcggccccgccggcgccgccaagagcaagggcaggcgcggctgatcgccggcgcgcgccgccggagccatgcgttcgccgcggccggacctgctgctctgccgctaccatcatcgtcagtagtcctagtaccaagctaccagttgcgcgtccgtgttcgagttggatcag

SEQ ID NO: 14712 - protein, 132 aa, Panicum virgatum
  misc_feature: Ceres CLONE 1778018
  misc_feature: Useful for biocontainment applications
MSRNSGKVGSKLQELRLSLSSRSRGAPSSSGGATGGQRGGVGGGGGGASPRRLSSSSSSTASPPSSCVSSEGSPEAAGAPPPMILAGCPRCMMYVMLSREDPRCPKCHSTVLLDFNDGGGPAGAAKSKGRRG

SEQ ID NO: 14713 - DNA, 672 bp, Panicum virgatum
  misc_feature: Ceres CLONE 1778022
  misc_feature: Encodes the peptide sequence at SEQ ID NO. 14714
aaaaaccctaataaaccctcgccgcctcccccttcccgcgccgccaaagtcctccacctcctccctctcccacccacccagctctccccgagcgagcccgagggcggcaccacacgcgccatgcggccaccgagagggcgcggcggaggcggccggttcggcggcggcgggggccagttcggcggcggtggcggccgcttcggcggtgggcgcggcggcggcggcgggttccgcgacgagggcccgcccgccgaggtcgtcgaggtgtcgacgttcctgcacgcgtgcgagggggacgcggtgacgaagctcacgaacgagaaggtgccctacttcaacgcgcccatctacctccagaacaagacccagatcggcaaggtcgacgagatcttcggccccatcaacgaatcgtatttctctgtaaagatgatggaagggatcattgcaacctcctacaaggaaggcgacaagttctacatcgaccccatgaaattgttgcccctctcgcgcttcctgccacagccaaaggggcaatctcaaggagcaccgagaggtggtggccgtggtggaagaggtggtggccgaggccggggtggttcattccgtggtggaagaggaccaccgagggggcgtggtgggcctccaaggggtggagggcgtggcggctttaga

SEQ ID NO: 14714 - protein, 183 aa, Panicum virgatum
  misc_feature: Ceres CLONE 1778022
  misc_feature (39)..(140): Pfam Name: Gar1 Pfam Description: Gar1 protein RNA binding region
MRPPRGRGGGGRFGGGGGQFGGGGGRFGGGRGGGGGFRDEGPPAEVVEVSTFLHACEGDAVTKLTNEKVPYFNAPIYLQNKTQIGKVDEIFGPINESYFSVKMMEGIIATSYKEGDKFYIDPMKLLPLSRFLPQPKGQSQGAPRGGGRGGRGGGRGRGGSFRGGRGPPRGRGGPPRGGGRGGF

SEQ ID NO: 14715 - DNA, 785 bp, Panicum virgatum
  misc_feature: Ceres CLONE 1778049
  misc_feature: Encodes the peptide sequence at SEQ ID NO. 14716
atagttcttgctttgacacacgcatcatccatccggcaaaacagtgtgctagcagctgatcaatcgatcgaatccatccatccgtcatgagctaccaagcaggctacccgccgccgggccagcaggcctacgacggcgcgcccccgccgccggcctacgtcgcgccgccgccggcgtacccgcccacccaggatggcgggtaccagcagcagcagcagccggagaccaccagccgcggcggcgacggcttctggaaaggatggtgagctgaatttcttgctgatccttcaggcttcagcttattcctgacatgcatgtggcctctgatctctttcgatgtgtttgctaaccctgctgcctgctgctgtccctgatgtctcagctgcgccgccgtctgctgctgctgcctcctcgacatgtgcttctgaggacgacgacgagtggcgacaccagctagttgctcatcacgatgattcattgctcaatttgtgtggttgtacctttgttcagttgttattgttccatttattggtagtatgactactaggagcgtcacgggtgatttgttgatttcgagtatgtgctggctcaatgttttgaaggtgtttgtagcggtagaatgatgtgtgtatttaccagagtgagtgtacgtgcgtgtttgcgagtttctacgtgtgtttctataaaaaaaaaattcacagggcaccgggatgaatggcatgtgtgtacgtctggctctgtagtccactacgtgtacaaacttctttttaaaagaattttctctt

SEQ ID NO: 14716 - protein, 59 aa, Panicum virgatum
  misc_feature: Ceres CLONE 1778049
  misc_feature: Useful for making plants with altered carbohydrate content
  misc_feature: The sequence is a functional homolog of SEQ ID NO 252 in the 10/714,887 US patent application
  misc_feature: The sequence is a functional homolog of SEQ ID NO 252 in the 11/435,388 US patent application
  misc_feature: The sequence is a functional homolog of SEQ ID NO 568 in the 10/666,642 US patent application
MSYQAGYPPPGQQAYDGAPPPPAYVAPPPAYPPTQDGGYQQQQQPETTSRGGDGFWKGW

SEQ ID NO: 14717 - DNA, 628 bp, Panicum virgatum
  misc_feature: Ceres CLONE 1778053
  misc_feature: Encodes the peptide sequence at SEQ ID NO. 14718
acacgagctcacgcagtgaaagcaaggcaacatgtcgtcgttgaccacccgaggtcacactacttcgttctgttagtcgtatttggggtgccccagccagggtggtacagggtttattacagcattaataatattcaagagttagtaactgctctgacccaagaccatccggtggtgctgatgttctgggcggactggaaccaagcaagcaatgtcatgaagcgaccgtactttaatatggccgttgctaaaaaggatgaggccgtattctgccggctggacttcgacaagtttaaagatgttgtagagaagttcagagtgaagtatctgccaacgttcgtgctgatcaaggagggcgaggagcagcgcagggtcgttggcgccaaggtggaggagctcaacacgactatcaagaacaacatctgatgcgacccatgcatccagaataaaggcatacacgtacccaggatgtacaactacctcattcaccgcagtaacgggggtgcatgtgcgaatcgatcgaccgtgtcttatactccgtccgtcctaaattaagtctgttacctgtgtatccattataaaagatgcatgttaccagtgtgccatcgaatttttgaaaattttctct

SEQ ID NO: 14718 - protein, 141 aa, Panicum virgatum
  misc_feature: Ceres CLONE 1778053
  misc_feature (44)..(140): Pfam Name: Thioredoxin Pfam Description: Thioredoxin
  misc_feature: SWISSPROT Homolog: EC 1.8.1.9 Thioredoxin-disulfide reductase
TRAHAVKARQHVVVDHPRSHYFVLLVVFGVPQPGWYRVYYSINNIQELVTALTQDHPVVLMFWADWNQASNVMKRPYFNMAVAKKDEAVFCRLDFDKFKDVVEKFRVKYLPTFVLIKEGEEQRRVVGAKVEELNTTIKNNI

SEQ ID NO: 14719 - DNA, 813 bp, Panicum virgatum
  misc_feature: Ceres CLONE 1778054
  misc_feature: Encodes the peptide sequence at SEQ ID NO. 14720
ctctcgacgctcgacccgggaaaaaaaattctccgcggggggaaggggaaaggtcgcgtggtgtctcgcccacagcccatctgtagcaatggcacaggagagctggaaacaggagtccgaggagactggagtccatgcgcctgaggccccaattctgtgcataaacaactgtggtttcttcggcagcagcatgacgaacaatatgtgctcgaagtgctacagggacttcatcaagttgatggaagcccctgtggttgagaagaaggtgatcacggtggcatcttcttctgcggcaccaatggagacagcaaatcaagatgatgtgcctgcagctgctgccgctgaagctgttgcggagaagcaagcagagcaggagccgccaaagccgcccagcaaccggtgcctgacctgccgcaagaaggttgggctgaccggctttctctgccgctgtgggggcaccttctgctccatgcaccgctacaccgactcccaccagtgcacctttgactacaagaaggtggcacaggagcagattgccaagcaaaatccagttgtgatggcagagaagatcaacaagatatgatgcatggtcgtgtgtagggattgctgaattcatgcctgagttcctgagtcctcaagttcactccaaacgataggttccttcaggtggtggtctgggttagcgtggtagggggtctcaattgtgtctatccttctcctttatcatggtttcattctctcgattgtgtaataatgtaaatatattcaaactgtaatttaatcatattgcttcctacgacgattgctgggttt

SEQ ID NO: 14720 - protein, 164 aa, Panicum virgatum
  misc_feature: Ceres CLONE 1778054
  misc_feature (105)..(145): Pfam Name: zf-AN1 Pfam Description: AN1-like Zinc finger
  misc_feature (21)..(45): Pfam Name: zf-A20 Pfam Description: A20-like zinc finger
  misc_feature: The sequence is a functional homolog of SEQ ID NO 20 in US patent 7161063
MAQESWKQESEETGVHAPEAPILCINNCGFFGSSMTNNMCSKCYRDFIKLMEAPVVEKKVITVASSSAAPMETANQDDVPAAAAAEAVAEKQAEQEPPKPPSNRCLTCRKKVGLTGFLCRCGGTFCSMHRYTDSHQCTFDYKKVAQEQIAKQNPVVMAEKINKI

SEQ ID NO: 14721 - DNA, 774 bp, Panicum virgatum
  misc_feature: Ceres CLONE 1778098
  misc_feature: Encodes the peptide sequence at SEQ ID NO. 14722
accttagctcccagcgcccagcggcggcgagaagcgattgggcggagggcccggcggggttgggttcccgcgggagcgacggcggcacgatgccgcggcgcgggcgcgtggagctgcggcggatcgaggaccgcgtcagccggcaggtgcgcttctccaagcgccgcgcggggctcttcaagaaggccttcgagctctcgctgctctgcgacgccgaggtcgcgctcctcgtcttctcccccgccggcaagctctacgagtacgcctccgcaagcatacaagatacgtacgaccgctatcagcaattcgccggaccagcaggagacgagaatggagatcgaaatggaaacgatcgatctgatctttcaaaaaaaaaagggaacgatcaaaagatctcgaacagggatgaagcttcttcagatttgcagtcgacgctcagagagattgtaacctggtgtctccagagcaatgctgacgaatcagatgccaatgagctagacaagttggaaaatcttttgagaaatgctttgagggatacgaaatccaagaagatccagcttctggcgaaacaaaatggtggagacggagcaagcggccagagctgcaatgtaggcatgtagctataaggcaggagcatggaacagcgtgagcacggatttgttatgcattttaaacaaacaaatttagttttacatttttagtatttttccttaatttgttctgcattttacacgccccagtttacacaatttttttaaaaaataatccttatat

SEQ ID NO: 14722 - protein, 176 aa, Panicum virgatum
  misc_feature: Ceres CLONE 1778098
  misc_feature (10)..(60): Pfam Name: SRF-TF Pfam Description: SRF-type transcription factor (DNA-binding and dimerisation domain)
  misc_feature: Useful for making plants with modulated flowering time
  misc_feature: Useful for making plants with modulated biomass
  misc_feature: The sequence is a functional homolog of SEQ ID NO 1701 in the 10/412,699 US patent application
  misc_feature: The sequence is a functional homolog of SEQ ID NO 1949 in the 10/412,699 US patent application
  misc_feature: The sequence is a functional homolog of SEQ ID NO 1955 in the 10/412,699 US patent application
  misc_feature: The sequence is a functional homolog of SEQ ID NO 1967 in the 10/412,699 US patent application
  misc_feature: The sequence is a functional homolog of SEQ ID NO 1965 in the 10/412,699 US patent application
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
  misc_feature: The sequence is a functional homolog of SEQ ID NO 1963 in the 10/412,699 US patent application
MPRRGRVELRRIEDRVSRQVRFSKRRAGLFKKAFELSLLCDAEVALLVFSPAGKLYEYASASIQDTYDRYQQFAGPAGDENGDRNGNDRSDLSKKKGNDQKISNRDEASSDLQSTLREIVTWCLQSNADESDANELDKLENLLRNALRDTKSKKIQLLAKQNGGDGASGQSCNVGM

SEQ ID NO: 14723 - DNA, 550 bp, Panicum virgatum
  misc_feature: Ceres CLONE 1778186
  misc_feature: Encodes the peptide sequence at SEQ ID NO. 14724
cgcatctgtctcgctccccttacttgcacacaatcatcttagattctagtaaacaagacttatcgacgtcgaagatgagctccgtggacgcccccggcggcgagaagaagacgtcgtggccggaggtggtgggcctgccggcggaggaagccaagacgatcttcctcaaggagatgcccgacgcccacgtcgtcatcctgcccgccggctctccggtgaccgtggactggaggtccagccgcgtccgcgtcttcttcaacaccgtcactcgtaccccgacagtgggctgaatggtccacgtgccggctgtgtgctggatcctggctgctacctcgcgcctactgccttgatgttccttcctgattgcccttactggtttagctttgagctcgtagacttgaagacggtgcatgtagagatcgaatacttgtcgctcgtcttctgattgggcgaatggagctaggtgctgtctaaaatggtgctgatggattgcatgaatatgcagtgctgcacgtcctgagtgtgttatgtgtttgaattggtgttcttc

SEQ ID NO: 14724 - protein, 71 aa, Panicum virgatum
  misc_feature: Ceres CLONE 1778186
  misc_feature (12)..(71): Pfam Name: potato_inhibit Pfam Description: Potato inhibitor I family
MSSVDAPGGEKKTSWPEVVGLPAEEAKTIFLKEMPDAHVVILPAGSPVTVDWRSSRVRVFFNTVTRTPTVG

SEQ ID NO: 14725 - DNA, 412 bp, Panicum virgatum
  misc_feature: Ceres CLONE 1778190
  misc_feature: Encodes the peptide sequence at SEQ ID NO. 14726
gtgctctctcagaggtgggttggcttcttctccccctccggttcgcggttcaattcggtccgggttcgtgaggttcttgggggtgagaggaagagatggcggcgtcggatgttgagtaccgctgcttcgtcggcggccttgcctgggccacctacgacaactcgctccacaacgacttcggccccttcggcgaggtcctctactccaagatcatcctcgatcgtgacaccaagaggtcctgcgtcttcggcttcgtcaccttctctagcgaccacgagatgcgcggtgccgtcgatggaatcaacagccaggagctggacaggcgcagcattgccgacaacgaggcccaatctcgcggcttccctccctcttgcggcggatgaagacgttaccggcgacgctcgggcggcgg

SEQ ID NO: 14726 - protein, 95 aa, Panicum virgatum
  misc_feature: Ceres CLONE 1778190
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with altered lignin content
  misc_feature: Useful for making plants with modulated nitrogen use efficiency
  misc_feature: Useful for making plants with modulated flowering time
  misc_feature: Useful for making plants with altered alkaloid content
  misc_feature: Useful for making plants with modulated biomass
MAASDVEYRCFVGGLAWATYDNSLHNDFGPFGEVLYSKIILDRDTKRSCVFGFVTFSSDHEMRGAVDGINSQELDRRSIADNEAQSRGFPPSCGG

SEQ ID NO: 14727 - DNA, 781 bp, Panicum virgatum
  misc_feature: Ceres CLONE 1778234
  misc_feature: Encodes the peptide sequence at SEQ ID NO. 14728
ctgacaggcccagctgcagcccaaaagccaaacccacccaaaagcttttctgctcctgcgcgtcgcgacccagcacgccaagatagggtcggagagccccgccgccgacggcgccgcccgcaagcggcccggcggcggcgatgcccccgccccggcgcccgccgacaagcgccgccgcccggagcccccgtcgtcctccggctcccgcgaccgccgcccgcccccggccgaggagaaggtgcgcgcctcccacatcctgatcaaacacgagggctcccgccgcaaggcctcgtggagggaccctgagggcgtcgccatctccgccacgacccgcgacgacgccgccgacctcgcgcgcgcgctccgcgaccagatcgtctccggggagcgcaagttcgaggacatcgccgccgagaactccgactgcaattcggccaagcgcggcggtgacctcggttcatttgggaggggtaagatgcaaaaggcttttgagaaggctgcgtttgctctgaaggtgggggagataagtgacgtgattgatacagagagcggggtgcacatcatcaagaggactggctaattgcgacagtgtcctccggtctcagtccatatagctggaaaatgcccgaagaagctcgatggtttcttgcttcattgaagaccttgtgtgtattctcttatgagcttgataattgatttttttatgcttccgtgacagacatgtagttttaaacggttatcacggcaaggcaagacggaatcagattgtcttgaatgtgac

SEQ ID NO: 14728 - protein, 34 aa, Panicum virgatum
  misc_feature: Ceres CLONE 1778234
  misc_feature: SWISSPROT Homolog: EC 5.2.1.8 Peptidylprolyl isomerase
MQKAFEKAAFALKVGEISDVIDTESGVHIIKRTG

SEQ ID NO: 14729 - DNA, 571 bp, Panicum virgatum
  misc_feature: Ceres CLONE 1778246
  misc_feature: Encodes the peptide sequence at SEQ ID NO. 14730
ccctacagccgccgccgcctctcccagcctccgcgcctccgtcgccgccgccgcttcctcagccatgggtaaggtgcacggatcgttggcccgtgccgggaaggtccgcggccagacgcccaaggtggcgaagcaggacaagaagaagaagccccgcggccgcgcgtacaagaggatgcagtacaaccgccgattcgtcaccgccgtcgtcggcttcggcaagaagcgcgggcccaactcatccgagaagtaggcgccgcgccgcgcagccgccggctcgccccgctccggttcctcctttccgttctcagtatgcttatgctcttgttggtagtagtttcgttgtgcaagcaaaggaagaaccttttgtagtttcagtttcgttgttcatgtgatgtgatgggaacttgagatggtatgtttaccccgtttaagagtttgagatgtgatgatatgagcccataactttattgtgcttgtggctgcgcgttttggtatgtggatgtgccactctgctttttcatgtttctttgtgaatcatcagtttaattctacctagtattagttttgt

SEQ ID NO: 14730 - protein, 62 aa, Panicum virgatum; identical to SEQ ID NO: 10043
  misc_feature: Ceres CLONE 1778246
  misc_feature (3)..(61): Pfam Name: Ribosomal_S30 Pfam Description: Ribosomal protein S30

SEQ ID NO: 14731 - DNA, 733 bp, Panicum virgatum
  misc_feature: Ceres CLONE 1778270
  misc_feature: Encodes the peptide sequence at SEQ ID NO. 14732
acctcttctaccatttttgcaggaaggaagagctgctagctccttgtgtgtgggagataggaagagggtcgagatggctacggcgtacgctcccatggcgagccaggtgatgaagagcagcttgatgcactccaggccgagaggcctctctggcgctgcgctgacgaggcggccccgcttcaccgtgaaggccatccagcccgagaagccaacgtaccaggtggtgcagcccatcaacggcgaccccttcatcggcagcctggagacgcccgtcacctccagcccgctcgtcgcctggtacctctccaacctcccggcctaccgcaccgggctcgtcaccatcctcagcgtctgcctcaccatgtacggcgtcgcctcgttcaacgagggggacccgtccacggcgcccacgctcacgctcacgggacgcaagaaggaggccgacaagctgcagaccgctgacgggtgggccaagttcaccggaggcttcttcttcggcggcatctccggcgtgctctgggcctacttcctcctctacgtgctcgacctcccctactacttcaagtagacgggatccataagcaaattccctcctctctacgtgtgggtaggtgatgtgtttgtggttcttgattgagcagtgagcacgtgtataaatgtattactttctctggacatgcatgggtggatggatgggttgtaacttggaacggttaatttcttacttggatgg

SEQ ID NO: 14732 - protein, 164 aa, Panicum virgatum
  misc_feature: Ceres CLONE 1778270
  misc_feature (48)..(162): Pfam Name: PsaL Pfam Description: Photosystem I reaction centre subunit XI
MATAYAPMASQVMKSSLMHSRPRGLSGAALTRRPRFTVKAIQPEKPTYQVVQPINGDPFIGSLETPVTSSPLVAWYLSNLPAYRTGLVTILSVCLTMYGVASFNEGDPSTAPTLTLTGRKKEADKLQTADGWAKFTGGFFFGGISGVLWAYFLLYVLDLPYYFK

SEQ ID NO: 14733 - DNA, 1435 bp, Panicum virgatum
  misc_feature: Ceres CLONE 1778273
  misc_feature: Encodes the peptide sequence at SEQ ID NO. 14734
aaagccgcctcccctagtcacgaaccgattcaaaaaaatcaccgggcaacgaaaaccccacccactaggcttctgtatggaggctgtttcgattcctttcacctgataaactgtggggagtatatataaaatctccctcagccctcccccacagttcacgactccacccacactttcccctcctctcgtcctccggagagcaccttcgcctcgctctcatggcctcagagcctatagagtgccaggtcctggtgttgagggtgtccatccactgtgagggatgcaagaagaaggtgaagaaagtgctccaaaacgttaatggcgtgtaccgatgcgagatcgatgcccggagcaacaaggtcatggtgacggcctcgacgaagctcgatccctacaccctcgttgccaagctgcgcaagtccggcaagcaggccagcctgtggccggagcagccgatgcagcagcagccaccacctgctgacagccagagccaagagcccaagagccaagctgacgagcagagcaaacccaacgaagccgccgagaagccgggcgccgacaaggccgacgccgccacggcagagccgagcaaccaccaacccccaccggagcctaagcagagcaccgccggcgagaccccaaaacaggagagcaaggaaacctccggtgccaatgcgaatgccagcggcgaggccgcggcggcagcagagacgccgccgccgccgcaacccaaggaaccaaaggggaaggcgatgcagcagcctccggagctggagaagcagccggtcgacgcccgggtgacggtggagtacgaccgaggcgtcggcggcagctacgggaaccacatgccgccgccgcagcatgtggtcatgagctacaaccaggcgcggccgagcatgagcgcgtcctactacgcccccgcgccggcgccggcgccggcaccgacggcgaggccggggccgtcgcagggctacatcgacgagcagtacacgccgtcctactacggccggccctcgccgtacgagccctactactacaacgctcctcagccgtcgccgtatcgctaccagtaccagtccgctccgtcggaggactactactacagcgcgccgccgcagaggagcgccttctcgccgccgcgtgacggctacggcgacatgttcaacgacgagaacgccaattcttgcagcgtcatgtgaagggagaggaaggaagctagtagctcgccgtcccgtgatcgagcacggctatatgttactagaggttagaattagtacacgtaaccagtatgtattagcactgctcgggcttcatggcgctacgctacaataagatgagctgaggttgaatgcttggcgcacgagtgttcatccatcagagcaattttgtaacatttgacttggttaaactggaggtatccaatccaatctcttag

SEQ ID NO: 14734 - protein, 326 aa, Panicum virgatum
  misc_feature: Ceres CLONE 1778273
  misc_feature (12)..(74): Pfam Name: HMA Pfam Description: Heavy-metal-associated domain
MASEPIECQVLVLRVSIHCEGCKKKVKKVLQNVNGVYRCEIDARSNKVMVTASTKLDPYTLVAKLRKSGKQASLWPEQPMQQQPPPADSQSQEPKSQADEQSKPNEAAEKPGADKADAATAEPSNHQPPPEPKQSTAGETPKQESKETSGANANASGEAAAAAETPPPPQPKEPKGKAMQQPPELEKQPVDARVTVEYDRGVGGSYGNHMPPPQHVVMSYNQARPSMSASYYAPAPAPAPAPTARPGPSQGYIDEQYTPSYYGRPSPYEPYYYNAPQPSPYRYQYQSAPSEDYYYSAPPQRSAFSPPRDGYGDMFNDENANSCSVM

SEQ ID NO: 14735 - DNA, 640 bp, Panicum virgatum
  misc_feature: Ceres CLONE 1778283
  misc_feature: Encodes the peptide sequence at SEQ ID NO. 14736
agtacaccggtcatacgcagcaccaaccgccatggcctccctcgccgccgtctccgtgcagccggtcgccgtgaagggcctcgccggcagctccatctccggcaggaggctcgccgccgtcaggccgtcgcgccgcgccggggccggcgcctgcgcctgccgctccgcccgcaggccccgcggcgccgccgtggtggccaagtacggcgacaagagcgtctacttcgacctcgacgacatcggcaacaccaccgggcagtgggacctctacggctccgacgctccctcgccctacaacccgctccagagcaagttcttcgagacgttcgcggggccgttcaccaagaggggcctgctgctcaagttcctgctggtgggcggcgggtcgctgctagcctacgtcagcgcgtcggcgtcgccggacctgctgccgatcaagaaggggccgcagcagccgccgcagccggggccgcgcggcaagatctaagttcagttgttccttctcctcatccatctgtctctactagctgcttgcttgtaccgccgctagctccggacgccatggatcgtccttgcctgtcgttgtgctgctgatattcgatcgcgctgcctgtttatcaatgttcataatgttgtattc

SEQ ID NO: 14736 - protein, 151 aa, Panicum virgatum; identical to SEQ ID NO: 12116
  misc_feature: Ceres CLONE 1778283
  misc_feature (5)..(151): Pfam Name: PSI_PsaH Pfam Description: Photosystem I reaction centre subunit VI

SEQ ID NO: 14737 - DNA, 413 bp, Panicum virgatum
  misc_feature: Ceres CLONE 1778286
  misc_feature: Encodes the peptide sequence at SEQ ID NO. 14738
  misc_feature (113)..(113): n is a, c, t, g, unknown, or other
  misc_feature (265)..(265): n is a, c, t, g, unknown, or other
cacagcccagcccccacccccgccggcgccgccgcgcccggaagccgcaccagccgccgggcagcgccccgcgcccgcccgccccgcgcgcgcccgcggcgccgcgacaccgncggcggcagcggcgccgcagcggcagccgaggccgcggaagcggcggcgcccgccgagaagccccggcacgacaacccgggcccgcagaaggggccccggcggcggcccaagcggaaggggcgcggtttttcggcgggccagggcgcgagcngcgggaacggaacgcgagggcagaaaacgcgcgcggggcccggcggccggcgcgggagcgagggagggcagacgccgcgccaccgccggacacccaagcgacgcggcagagccggcggaaagcacagaggggagccgaagcacgcgcc

SEQ ID NO: 14738 - protein, 137 aa, Panicum virgatum
  misc_feature: Ceres CLONE 1778286
  misc_feature (59)..(137): Pfam Name: Ribosomal_L15 Pfam Description: Ribosomal protein L15 amino terminal region
  misc_feature (38)..(38): Xaa is any aa, unknown, or other
  misc_feature (89)..(89): Xaa is any aa, unknown, or other
HSPAPTPAGAAAPGSRTSRRAAPRARPPRARPRRRDTXGGSGAAAAAEAAEAAAPAEKPRHDNPGPQKGPRRRPKRKGRGFSAGQGASXGNGTRGQKTRAGPGGRRGSEGGQTPRHRRTPKRRGRAGGKHRGEPKHA

SEQ ID NO: 14739 - DNA, 604 bp, Panicum virgatum
  misc_feature: Ceres CLONE 1778293
  misc_feature: Encodes the peptide sequence at SEQ ID NO. 14740
acgtacgttctccccggaacactagctagcaccggtcacagcaccaaccgtaccgccttggtctccctcgccgccgtctccgtgcaggcggccgccgtaacgggcctccccggcagcgccttctccggcaggaggttcgccgcccctaggccgtcccgcgccggcgcctgccgctccgcccccaggccccgcggcgccgccgtggtggccaagtacggagacaagatcgtctacttctacctcgacgacatcagcaacaccaccgggcagtgcgacctccacggctccaacgcgccccccccctacaacctgctccagaccaagttcttcgacacgttcgcggggccgttcaccaagaggggcccgctgctcaagttcttgctgctgggtggcgggtcgctgctggcctacgtccgcgcgtccgcctggccagacctgctgccgatcaacaacggcccccaacagccgccgcacccggggcctcgcgtcaagatctaacctcacttgctccttctcctccatctgtctatactaactgcttgcttgaaccaccactggctcccgacgccatggatcggcgtccctggtggctgatgtgctactg

SEQ ID NO: 14740 - protein, 165 aa, Panicum virgatum
  misc_feature: Ceres CLONE 1778293
  misc_feature (24)..(165): Pfam Name: PSI_PsaH Pfam Description: Photosystem I reaction centre subunit VI
TYVLPGTLASTGHSTNRTALVSLAAVSVQAAAVTGLPGSAFSGRRFAAPRPSRAGACRSAPRPRGAAVVAKYGDKIVYFYLDDISNTTGQCDLHGSNAPPPYNLLQTKFFDTFAGPFTKRGPLLKFLLLGGGSLLAYVRASAWPDLLPINNGPQQPPHPGPRVKI

SEQ ID NO: 14741 - DNA, 674 bp, Panicum virgatum
  misc_feature: Ceres CLONE 1778298
  misc_feature: Encodes the peptide sequence at SEQ ID NO. 14742
agatcatagttcttgctttgacacacgcatcatccatccggcaaaacagtgtgctagcagctgatcaatcgatcgaatccatccatccgtcatgagctaccaagcaggctacccgccgccgggccagcaggcctacggcggcgcgcccccgccgccggcctacgtcgcgccgccgccggcgtacccgcccacccaggatggcgggtaccagcagcagcagcagccggagaccaccagccgcggcggcgacggcttctggaaaggatgctgcgccgccgtctgctgctgctgcctcctcgacatgtgcttctgaggacgacgacgagtggcgacaccagctagttgctcatcacgatgattcattgctcaatttgtgtggttgtacctttgttcagttgttattgttccatttattggtagtatgactactaggagcgtcacgggtgatttgttgatttcgagtatgtgctggctcaatgttttgaaggtgtttgtagcggtagaatgatgtgtgtatttaccagagtgagtgtacgtgcgtgtttgcgagtttctacgtgtgtttctataaaaaaaaaattcacagggcaccgggatgaatggcatgtgtgtacgtctggctctgtagtccactacgtgtacaaacttctttttaaaagaattttctcttaatc

SEQ ID NO: 14742 - protein, 73 aa, Panicum virgatum
  misc_feature: Ceres CLONE 1778298
  misc_feature: The sequence is a functional homolog of SEQ ID NO 252 in the 10/714,887 US patent application
  misc_feature: The sequence is a functional homolog of SEQ ID NO 252 in the 11/435,388 US patent application
  misc_feature: The sequence is a functional homolog of SEQ ID NO 568 in the 10/666,642 US patent application
  misc_feature: Useful for making plants with altered carbohydrate content
MSYQAGYPPPGQQAYGGAPPPPAYVAPPPAYPPTQDGGYQQQQQPETTSRGGDGFWKGCCAAVCCCCLLDMCF

SEQ ID NO: 14743 - DNA, 809 bp, Panicum virgatum
  misc_feature: Ceres CLONE 1778338
  misc_feature: Encodes the peptide sequence at SEQ ID NO. 14744
gattggaatttggattggattccccagcaaacaagcagccaaaagcaacaagcaagcaagggaataataagctggaggagctggcggcgtctactaggagtaataagctggaggaggagcccctcggccgcctcggcgacgacccagcagctgccgagacagaggagcagcgcaacaagttcctggtgctccgcctgtacgaggcgctcaacggccgcgaccacgccgccgtgcaggccctcctcgcccccgacctcgagtggtggttccatggcccgcccaagcaccagcaccacatgatgcgcgtgctcaccggcggatcatccaacaacaacaagaagcagaatagtaatttcagcttcgtgccgcgctccgtcgacgccttgggctgcagctcccccgtgatcgccgagggacagggacctgcaggtgtgtactgggtgcacgcctggaccgtgggcccggatgggctcgtcacccagctgcgggagtacttcaacaccgacctcaccgtcacccgcctcgccgccgccaccaagtgcaagtgcgtctggcagagccgccgacccgacagggcaacaaactcgctgccaggcctcgtcctcgtcctcgccctctagtctttcttggcggcttggcccatccatcatcttctagcgtttatttgttattacgcctgccatcatcacctagctagatccataaccatgaatgatgatgcggcatggtcatcgtcatcctctgtattactactactacgcttcatcatcaccatcaccaataatagaaacaaaagtactattgtgttt

SEQ ID NO: 14744 - protein, 205 aa, Panicum virgatum
  misc_feature: Ceres CLONE 1778338
  misc_feature (100)..(203): Pfam Name: WI12 Pfam Description: Wound-induced protein WI12
LEFGLDSPANKQPKATSKQGNNKLEELAASTRSNKLEEEPLGRLGDDPAAAETEEQRNKFLVLRLYEALNGRDHAAVQALLAPDLEWWFHGPPKHQHHMMRVLTGGSSNNNKKQNSNFSFVPRSVDALGCSSPVIAEGQGPAGVYWVHAWTVGPDGLVTQLREYFNTDLTVTRLAAATKCKCVWQSRRPDRATNSLPGLVLVLAL

SEQ ID NO: 14745 - DNA, 1016 bp, Panicum virgatum
  misc_feature: Ceres CLONE 1778373
  misc_feature: Encodes the peptide sequence at SEQ ID NO. 14746
aaaagccgaatcggataagcccctcttccccctcgcgcaggcgaggcgagagatcggagtaagtaatggagtctaccgcgctaatcgcaccattaccgctactaacctctcgctcccgttccaaacccctctcccctgcccccaccagagctcgccgccccgcctccattcccttctcctacggcagaggccgcgtcgtcctattttcccgccgcggccgcgtgtacgccggcgttggctccttggtctccgccgccgcagcgactggggaggcagcagatggcggatctgaggccatcctgctcagtgtccagggtatgatgtgcgacgggtgcgcggcgagcgtgaagcggattctggagagtcaaccagaggttacatctgctaccgttgattttaaggaagcaaatgcagttgtgtggacaacagctgaagctcgggcatcagataattggcagaagcagtgtggagagaaacttgctaaacacctcggcacttgtggatttgagtctcggctgcaaggtaattaggtaacagccatgtgttttccccctatccttgcggtggccaatgaataaattgagttatttgaatccttacactacaaagttcttgctgtcttcatttttcagctatggaaattaccatttcaaagactgattgcaatgcagatatttccttggaaatttgaagttctaggatctatagaccatgtttcagaatcattgtactgagtagatcagaaaagagtcagcttgctataatttggttagaagtatatcaatctattagatgagtatcctaattcaattgaacaatgcaacatttccatgtttcatatctgaattcttaaatacacattcctagcatataggcatatagttacggaaagaagtcaagtttttttaggttgaagtatgtttggaattcacagttactgcaacagcttctttagcgttttgaaacgtcttatgtactgtgaactccactaatactattttttttattcatagagt

SEQ ID NO: 14746 - protein, 70 aa, Panicum virgatum
  misc_feature: Ceres CLONE 1778373
  misc_feature (1)..(67): Pfam Name: HMA Pfam Description: Heavy-metal-associated domain
  misc_feature: SWISSPROT Homolog: EC 1.16.1.1 Mercury(II) reductase
MMCDGCAASVKRILESQPEVTSATVDFKEANAVVWTTAEARASDNWQKQCGEKLAKHLGTCGFESRLQGN

SEQ ID NO: 14747 - DNA, 748 bp, Panicum virgatum
  misc_feature: Ceres CLONE 1778376
  misc_feature: Encodes the peptide sequence at SEQ ID NO. 14748
ccggatcggattcaactcacctaccctcccacccttcaatcccgagctcggcctgcttcctacgctaccgcggcgggctccgacctccccgctcctcgagcaagctgccatggcggccgccgcgctgagggagcagctcaacgccctcctctcctccatgttcgcctcgggtctggtggacgagcagttccagcagctgcagatgctgcaggatgacgggggcaccccgggcttcgtcgccgaggtcgtcaccctcttctgcgacgacgccgacaggatcatctccgagctcgccgccctgctggagcagcccgtagtggacttcgataaggtggacgcctacgtgcatcagctaaaagggagcagcgccagtgttggtgctcagaaagtgaagtttacttgcatgcagttccgtcaattatgtcaagacaagaacagagacgggtgcatcatggcattagccgttgtgagaaatgagttctatgatctgcgcaccaagttccagactatgcttcagcttgagcagcaaatccaggctcaacaataaattgaataagaaagagtgtagttgcatgtgatctcacatgataagtgtatctctggagatgtagaccatgttcattgttcgctggattcccgcaacgcgtgtgcaatcattgacattgaggttttcgtgcttacaaaactttggctcacaaagcttcctgttagcggcaacaacgactgtctagcgttgtggctctgttgc

SEQ ID NO: 14748 - protein, 145 aa, Panicum virgatum
  misc_feature: Ceres CLONE 1778376
  misc_feature (45)..(130): Pfam Name: Hpt Pfam Description: Hpt domain
MAAAALREQLNALLSSMFASGLVDEQFQQLQMLQDDGGTPGFVAEVVTLFCDDADRIISELAALLEQPVVDFDKVDAYVHQLKGSSASVGAQKVKFTCMQFRQLCQDKNRDGCIMALAVVRNEFYDLRTKFQTMLQLEQQIQAQQ

SEQ ID NO: 14749 - DNA, 650 bp, Panicum virgatum
  misc_feature: Ceres CLONE 1778379
  misc_feature: Encodes the peptide sequence at SEQ ID NO. 14750
agctagccaccgaaaacggcaacaaagattcctccaacccgggtcgagctcgcctcgccatggattactactacccgatggaggaggtgcaccagcactcggggggctccggccgctgcagctgccgtggcactggcagtggcgccttttcaccctcctgtcctctccggcggcgctgcagcaccagcagccgcgccgggcggcgaaccacgtcagctgggaggaggccgccgccgcgcacctcttctccgccagcctcccgggcgtgcggaaggaggagatcagggtggaggtggaggacgcgaggtacctcgtcatccgcacggagctggccgccgccgccgcggcgacggcggaagaggacggccggaggaggagcttcgacaggaagttccggctgccggggatggtggacgtggacggcatctcagcggagtacaccgacggcgtgctcaccgtgacggtcccgcggatgcacacccgggcccgtcccgccgtcggcctcctcggcgccggcccgacccacgaatccacggcccgggccgcctgaaattgaatttttattttagccttctactacctataaaaaaagatgtactagtattgattggtttgcggaactaaggagatttatcccaatttgtatggtc

SEQ ID NO: 14750 - protein, 182 aa, Panicum virgatum
  misc_feature: Ceres CLONE 1778379
  misc_feature (72)..(166): Pfam Name: HSP20 Pfam Description: Hsp20/alpha crystallin family
ASHRKRQQRFLQPGSSSPRHGLLLPDGGGAPALGGLRPLQLPWHWQWRLFTLLSSPAALQHQQPRRAANHVSWEEAAAAHLFSASLPGVRKEEIRVEVEDARYLVIRTELAAAAAATAEEDGRRRSFDRKFRLPGMVDVDGISAEYTDGVLTVTVPRMHTRARPAVGLLGAGPTHESTARAA

SEQ ID NO: 14751 - DNA, 917 bp, Panicum virgatum
  misc_feature: Ceres CLONE 1778387
  misc_feature: Encodes the peptide sequence at SEQ ID NO. 14752
attcccgcacggccgcaccccccatctagggttggggacagcacgccgcgccgccgtccagagctcccccgcggcgcctccctgtgccgctgtccgggccaccccgcgcctccgtccggcacatgcccgagccaccggccctcccctcgcctctccgcgccgccgttgggggctccctgcgccgccttccgggccaccccgcacctccgttcgggtctcctgcgccgctgttcggggcaccccgcgcagcgtcaggcggagccaccggcggagccacggtcttccctccagcgtccatccccttcggctgccttctctccggttactggatgaagagatagaggcaggccttttcgtggcagaggatggattggcaggaggaagctcacggagatgctgatgtaggtgctgcatgtggcgtcggccgtggcggcgttcctggcgggctacgtgcgcggggacttccagctcatgctgctcgtctatgccgccggcgtcgtgctcacgatgctcgtcaccatccccaactggcccttcttcaaccgcaacctgctcaagtggcttgacgccgccgatgccgagcgccacccgcgcctgcaggtcggcgccaccggcgcgggagcagggggtaagaagaagtccgggaagaacaagtaattggtctttcaaagatgagcaacaagatggggatatgtggtgcagtagacaattgtagagttcttgaacaaagtgatggtcgaggtggtgaagccagtgccgtgctatggcttcgatcgtggcccaaagctgattgtattatttaaatgagacttcagttcacaatgtttcgttattgatgtgatcactattttgaaagggatgttagattgaataatggattgatttattaataatatatatatatgtgtgttgcagcg

SEQ ID NO: 14752 - protein, 61 aa, Panicum virgatum
  misc_feature: Ceres CLONE 1778387
  misc_feature (1)..(44): Pfam Name: SPC12 Pfam Description: Microsomal signal peptidase 12 kDa subunit (SPC12)
MLLVYAAGVVLTMLVTIPNWPFFNRNLLKWLDAADAERHPRLQVGATGAGAGGKKKSGKNK

SEQ ID NO: 14753 - DNA, 868 bp, Panicum virgatum
  misc_feature: Ceres CLONE 1778410
  misc_feature: Encodes the peptide sequence at SEQ ID NO. 14754
gccactccccgcgccgttccgggttttctccccaccctccgccgccgcctcagccggtcccgccggagcgcagcgcgcgctgatctacggtcgccgcgggcccctcgcgggagcgctcctgttcctcagcatcggcgctgtcagcgccgccgtcgcctgcaggacggggtgctccttgttccactcccaccgccgcctccccttcctcggggcaagaggtctcagctctgctcgaatggagtttgcttccaccaccgtgccttccattgttgtatatgttacggttccaaatagagaagcaggcaagaagctgtcacagagcatcatcagcgagaagcttgctgcttgtgtcaatatagtacctggcattgagtctgtttactggtgggagggaaaggtgcaatcagatgctgaagaattgctcatcataaagacgagggaatcacttctagatgccttgactgagcacgtcaaagccaaccatgaatatgatgttcctgaagttatttctctgcccataaccggcggtaacagcaagtacctggaatggatcaagaacagcacccgggaaaactgatctgttttgcagctgtgagtgtgtaatgcagatcaaaacgcccaagaatatgaagtgatggcccaggtcttccagtggcttgcacgagggtgtttcttccgtcgaccctgtttatctcagttacattattgtaccacattaatacttaccatcttctctgtgccaaatgatctggtctggtgtcttgtgtgggtactgggtacgcaaatgcatgtattgctctgtttacagattgacgcgtgcaaatcaaaccaaatgatatttaagcatgtgtattgttgctcttgatcc

SEQ ID NO: 14754 - protein, 191 aa, Panicum virgatum
  misc_feature: Ceres CLONE 1778410
  misc_feature (88)..(189): Pfam Name: CutA1 Pfam Description: CutA1 divalent ion tolerance protein
PLPAPFRVFSPPSAAASAGPAGAQRALIYGRRGPLAGALLFLSIGAVSAAVACRTGCSLFHSHRRLPFLGARGLSSARMEFASTTVPSIVVYVTVPNREAGKKLSQSIISEKLAACVNIVPGIESVYWWEGKVQSDAEELLIIKTRESLLDALTEHVKANHEYDVPEVISLPITGGNSKYLEWIKNSTREN

SEQ ID NO: 14755 - DNA, 825 bp, Panicum virgatum
  misc_feature: Ceres CLONE 1778436
  misc_feature: Encodes the peptide sequence at SEQ ID NO. 14756
atctacatagccagccgctcttgccatcacacgtacacccccgaccaaccaagcgaaccacacaaccacgagagcggagcaccgagcccaggcaggatcccatggccgccaccgccgtcgcggcgtctctgtccgtggcccgggggctcgggaagcccctccgcgccggcggcagcagcagcgcgtcgtcgctccgcgtctcgccccgcggcaggccggccagcagcagggtggccgtcgtccgggcgtcgtcgtccgcgcagagcccggccaaggattgggcggccgcggcggccgtcgcggcggcgctggtgctgccggaggtcgcggaggccgcgcagccggggatctcgccgtcgctcaagaacttcctcctcagcatcgtctccggcggggtcgtactcgtcgccatcgtcggcgccgtcgtcgccgtctccaacttcgaccccgtcaagcggggctgagctccaccgcgagcacggccgcgccatggctgtgcgtatacctatgtactgagactgagagcggtcgtcgatctctttctccgtgtgcttccggacgaacagtactgtctgatctgatgctcaatcttttgccgtgtaaatctcattaatttcctgctcgtgaaatctcgtgatccctaagagcccccacacgttcatctaggatcgatcgatcagttcgattttagtttacggtgggtcgcctagagtttcgctttgcgacacatgccgtgtcggaattcaatcgggctatagactggaggagatcactgaagcgacgtttctttgaagaaataaaatgatgagcacaacattattgatc

SEQ ID NO: 14756 - protein, 120 aa, Panicum virgatum
  misc_feature: Ceres CLONE 1778436
  misc_feature (83)..(120): Pfam Name: PsbX Pfam Description: Photosystem II reaction centre X protein (PsbX)
  misc_feature: Useful for making plants with modulated nitrogen use efficiency
MAATAVAASLSVARGLGKPLRAGGSSSASSLRVSPRGRPASSRVAVVRASSSAQSPAKDWAAAAAVAAALVLPEVAEAAQPGISPSLKNFLLSIVSGGVVLVAIVGAVVAVSNFDPVKRG

SEQ ID NO: 14757 - DNA, 495 bp, Panicum virgatum
  misc_feature: Ceres CLONE 1778446
  misc_feature: Encodes the peptide sequence at SEQ ID NO. 14758
aaaaataaaaatccccaaagccacttctcctcctgctcccccctcccatgcctcctcccctcgccgccgccaccgccgcagccgtccagagaagtaggaccaccggcgagcggagccgtggcttcccccggagccgccgctgctccacgggtgcaggcggtagccgacgcggaggcgccttgtgacctgtgacccctgatcggtggcgggcgggggcggcgggccggtggacgggtggggcgtgggtgcgggcgatggcgccggccaagaggaagcgggcggcggcagcggccgccgcggcggccgcagccgcggccaagtggaaggtgggcgacctcgtgctcgccaagatgaagggcttcccggcttggccggccatgataagtgaaccagagcagtggggccagtcttctgctaaaaagaagccactggtctatttttatggtactaaacagattgctttctgcaattacactgatcttgaggcattcacgg

SEQ ID NO: 14758 - protein, 80 aa, Panicum virgatum
  misc_feature: Ceres CLONE 1778446
  misc_feature (22)..(80): Pfam Name: PWWP Pfam Description: PWWP domain
  misc_feature: Useful for making plants with modulated flowering time
MAPAKRKRAAAAAAAAAAAAAKWKVGDLVLAKMKGFPAWPAMISEPEQWGQSSAKKKPLVYFYGTKQIAFCNYTDLEAFT

SEQ ID NO: 14759 - DNA, 751 bp, Panicum virgatum
  misc_feature: Ceres CLONE 1778455
  misc_feature: Encodes the peptide sequence at SEQ ID NO. 14760
acgccacgcaacgcaatcttgcaatccagcccccgaaagagacctaaaaaccgccaccaggctttcgatcgcgccgagggaggaggacgagcaatggcggccgaggagggagtcgtgatcgcgtgccacaccaaggaggagttcaagagccagatgacaaaggccaaggatgccggcaagctggtgatcattgacttcactgcctcctggtgtggtccttgccgcatcatcgccccggtgtttgctgaattagccaagaagttcattgacactttcttcctgaaggtcgatgttgacgagctgaaggaagtagcctcagagtacgagatccaggcgatgccgaccttcctcttcatcaagaacggtgagaagatccacactgttgttggtgccaggaaggatgacctccagaccagcatcgagaagcacgcctccgccactgctgcttccgcctccgcctaaggcaatagcgccaccagttatcaataagggccagcccacggcgtggtagcagtgggcgtcgtaattttcagtttggtttgggtgaattgtgagctatgttcaaatatggagtcctgatatgtttggttcctgtgctggaccatagtcacaaagtccttgggtcgaccgggtcgaggaacagtgtcgagggtcgagggtagtcactttataaaattgtggtacgaagggggtatacctctatggaacgataaattactatatggaacacgaccctaattcatccgggtcg

SEQ ID NO: 14760 - protein, 122 aa, Panicum virgatum; identical to SEQ ID NO: 14073
  misc_feature: Ceres CLONE 1778455
  misc_feature (8)..(112): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase

SEQ ID NO: 14761 - DNA, 750 bp, Panicum virgatum
  misc_feature: Ceres CLONE 1778463
  misc_feature: Encodes the peptide sequence at SEQ ID NO. 14762
gccacctccttccgagtctcagctccgcactccccccccccccccccccgcgcgccgccgccgcctcgccgctcgccgcccgccgcgcagccatggcggaacagactgagaaggctttcctcaagcagcctaaggtattccttagcacaaagaaatctgccaagggtaagaagccaggcaagggaggcagccgcttctggaagagcattggcctgggcttcaagacccccagggaagcaattgaagggacctacattgacaagaagtgcccattcactggaactgtttccatcagaggcaggattattgctggaacatgccatagtgcaaagatgaacagaaccatcattgttcgcaggaactacctccacttcgttaagaaatatcagaggtacgagaagaggcactccaacattcctgctcacatctccccgtgcttccgtgtcaaggaaggtgactatgtcatcatcggccagtgcaggcccctctccaaaactgtgaggttcaacgtggtgaaagtcatcccagctggatccactggtggcagcggcgggaagaaggccttcaccgcagcctgagctttagactgttccatgagtagtctatagaatggtgtctttttgctaaaaattcctgctaggctggtgttttcaactatggtttggagattgttcgctgtctgaatggagtctcatcaccagaacatgttactctttatggaatcctctcgtgcaaagttttgttatgatc

SEQ ID NO: 14762 - protein, 161 aa, Panicum virgatum
  misc_feature: Ceres CLONE 1778463
  misc_feature (74)..(143): Pfam Name: Ribosomal_S17 Pfam Description: Ribosomal protein S17
MAEQTEKAFLKQPKVFLSTKKSAKGKKPGKGGSRFWKSIGLGFKTPREAIEGTYIDKKCPFTGTVSIRGRIIAGTCHSAKMNRTIIVRRNYLHFVKKYQRYEKRHSNIPAHISPCFRVKEGDYVIIGQCRPLSKTVRFNVVKVIPAGSTGGSGGKKAFTAA

SEQ ID NO: 14763 - DNA, 384 bp, Panicum virgatum
  misc_feature: Ceres CLONE 1778493
  misc_feature: Encodes the peptide sequence at SEQ ID NO. 14764
aggttgaggtgaacaggtcaccggagacggtggtgaggccagaggagccggagccggagggggccacgaacggcgccggctgcaccctcaagatctcgtccttggacagggttcgcgccttgacaacgatcacggccttgatcgggttccaccacccgatccgggacgcagccaagaccttgatcggagcgctttccccagcgttggtccgatacttccctctctcaggtcgctggggtgcacggcccgacgagggccacctggaccacgtatggtggcgaggccagggcgcggaattcctcccctcctccgcgaaccgtgtcttgaaggacgtagaattattcgttttttttccccgcccccccttgttgcaactggtggagg

SEQ ID NO: 14764 - protein, 127 aa, Panicum virgatum
  misc_feature: Ceres CLONE 1778493
  misc_feature: SWISSPROT Homolog: EC 2.3.1.166 2-alpha-hydroxytaxane 2-O-benzoyltransferase
VEVNRSPETVVRPEEPEPEGATNGAGCTLKISSLDRVRALTTITALIGFHHPIRDAAKTLIGALSPALVRYFPLSGRWGARPDEGHLDHVWWRGQGAEFLPSSANRVLKDVELFVFFPRPPLLQLVE

SEQ ID NO: 14765 - DNA, 579 bp, Panicum virgatum
  misc_feature: Ceres CLONE 1778493-R
  misc_feature: Encodes the peptide sequence at SEQ ID NO. 14766
gggatgcaagaacgctaaccctgatcaagacatatgtcacagagcgacctgttaatgctgttgacatctctccaactcatgatactgtggttctaggaggcgggcaggatgcaatgaatgtgactatgacagaccgccgagctggtaaatttgaggctaaattctatcataagattttgcaagaggaaattggtggtgtcaaaggacattttggaccaattaatgctttggcatttaaccctgatgggcggagcttttcgagtggtggtgaagatggatatgtaaggctgcaccattttgattccgactacttcaacatcaagatgtagataatggacatcacaaactaatccgaggttgtattcaagaggacccaacaggaacggagttacttttttggttcatttggtgctggttcgtgaggctcgcagagttggctcagatcttagctattggtgttgtgttgcttgttagacgctcttgttgctctaaacaggacaggcagctttttgtagatgcttgagaaatttgtacacttggcaatgaaaagatcgttggatcttcagttatttttctttt

SEQ ID NO: 14766 - protein, 108 aa, Panicum virgatum
  misc_feature: Ceres CLONE 1778493-R
  misc_feature (60)..(98): Pfam Name: WD40 Pfam Description: WD domain, G-beta repeat
DARTLTLIKTYVTERPVNAVDISPTHDTVVLGGGQDAMNVTMTDRRAGKFEAKFYHKILQEEIGGVKGHFGPINALAFNPDGRSFSSGGEDGYVRLHHFDSDYFNIKM

SEQ ID NO: 14767 - DNA, 870 bp, Panicum virgatum
  misc_feature: Ceres CLONE 1778494
  misc_feature: Encodes the peptide sequence at SEQ ID NO. 14768
aacctcagaaaaacaatctcctcctgtcctagacgccaaggcgacaaccctgctcagcagtgtcacttccactcagcttcgccatggccacgctcgccatgcacctcatcctctgctcctccacctcctcgtccccctcgcagcgccgccgccggcccctgcctcccggcggcaccgacgcgggcggctccgacaagtcgccgccgcagcagcagcagccggcgccgcagtccgccacgcggcggctggcggtggccgcgtcgacggcgctggccgccacggccgcgctcgccgcgcgccggcccgcggcgcccccgcccgcgatggccgcggaggcggcgttcgtgcccgcgccgacgccgccggggggcgtgccgcggtggggcaccaagtcgtacgtgcgggagcgcttcttcgagaaggagctcagcgccgaggaggccgccgcgcgcatccggcagaccgcggaggggatacgcacgctgcgccccatgctggagaccatgtcgtggaagtacgtgctcttctacgtccggctcaagtccaagtacctcgaccgcgacctcaccaccgccatggccggcgtccccgccgcccgccgcgccgactacgtccgcgtcgccaacgagctcgtcgacaacatgacagagttcgatcgcttcgtgcggactcccaaggtctacgagtcgtacctcttctacgagaagacgctcgagtcgctggatgacgtggcagagttcctcgcctgacgtacatatatactgtataagttgttctaggatatgcatgtggcactgtaatttgaccgtggatgaaggtttcgaacacaattttttttagaaaaaaaatacatgattgttttcgcgcagc

SEQ ID NO: 14768 - protein, 221 aa, Panicum virgatum
  misc_feature: Ceres CLONE 1778494
  misc_feature (15)..(221): Pfam Name: PsbQ Pfam Description: Oxygen evolving enhancer protein 3 (PsbQ)
MATLAMHLILCSSTSSSPSQRRRRPLPPGGTDAGGSDKSPPQQQQPAPQSATRRLAVAASTALAATAALAARRPAAPPPAMAAEAAFVPAPTPPGGVPRWGTKSYVRERFFEKELSAEEAAARIRQTAEGIRTLRPMLETMSWKYVLFYVRLKSKYLDRDLTTAMAGVPAARRADYVRVANELVDNMTEFDRFVRTPKVYESYLFYEKTLESLDDVAEFLA

SEQ ID NO: 14769 - DNA, 544 bp, Panicum virgatum
  misc_feature: Ceres CLONE 1778499
  misc_feature: Encodes the peptide sequence at SEQ ID NO. 14770
accccgcggcggagagggttcgagaaggccaaaaggggcgagcggatttgggaagccagccagcgagccggggcaggcatccatggcggactggggccccgtgatcgtggcgacagcgctgttcgtggtgctcaccccggggctgctctgcacgctgccggagcgcggccgggtggcggagttcggcagcatgcacaccagccccgtcgccatcatcgtccacgccgtcctctacttcgcgctcatcaccatcttcctcatcgccatcgggatccacatctacgccggctagccagcagccgccggccgatcgatcgagccggggggcggcgcaggcggcggccgtcggcgtgtgattccaaactagatctgtcttttcctctctctctctctctctctctctctctctctctctctctctctctcctgctgattaattgttcctccccccgctgcgggagggagtaggactccatgatttactactactgtggtctgtggttgtaatggatcaagacttcgaatgcaatcttctttgcctgcc

SEQ ID NO: 14770 - protein, 69 aa, Panicum virgatum
  misc_feature: Ceres CLONE 1778499
  misc_feature: Useful for making plants with altered cell wall content and/or composition
MADWGPVIVATALFVVLTPGLLCTLPERGRVAEFGSMHTSPVAIIVHAVLYFALITIFLIAIGIHIYAG

SEQ ID NO: 14771 - DNA, 654 bp, Panicum virgatum
  misc_feature: Ceres CLONE 1778504
  misc_feature: Encodes the peptide sequence at SEQ ID NO. 14772
tagcagctctagcaataatggccaccgccctcagcagcctccgcgcgccggccagcagcttctccggcgtccgcgctgccccggcacccgcggcgcccgccatcgtcgccatgcccgccgccaagcagcaggttgcccgcggcgccaggctgcgcgcccaggcgacctacaacgtgaagctcgtcacgcccgacggcgaggtggagctgcaggtgcccgacgacgtgtacatcctggaccaggccgaggaggaggggatcgaccttccctactcgtgccgcgccgggtcctgctcctcctgcgccggcaaggtcgtctccggctccgtcgaccagtccgaccagagcttcctcgacgacgaccaggtcgccagcggctgggtgctcacctgccacgcctaccccacctccgacgtcgtcatcgagacccacaaggaggaggagctcaccgcttaatatacaattaattaagctcgctccatcgtgcgtcgatatatatcatcatcatctagtatatctcaatctgcctgccttgcaagagatgttgtaatcgatcgagttgacgaagccggccgccggagaaattaatttcttcctagctttaatttgtatcatccatcatgcatgtcgatcaagcaagctaagcatcggcagc

SEQ ID NO: 14772 - protein, 145 aa, Panicum virgatum
  misc_feature: Ceres CLONE 1778504
  misc_feature (56)..(131): Pfam Name: Fer2 Pfam Description: 2Fe-2S iron-sulfur cluster binding domain
MATALSSLRAPASSFSGVRAAPAPAAPAIVAMPAAKQQVARGARLRAQATYNVKLVTPDGEVELQVPDDVYILDQAEEEGIDLPYSCRAGSCSSCAGKVVSGSVDQSDQSFLDDDQVASGWVLTCHAYPTSDVVIETHKEEELTA

SEQ ID NO: 14773 - DNA, 1047 bp, Panicum virgatum
  misc_feature: Ceres CLONE 1778509
  misc_feature: Encodes the peptide sequence at SEQ ID NO. 14774
accctctcggctgccaggagaagcagccgccgccgccgcttcgacagccaccgcagtgtaccgagatgtgattaattgggccaactgccgcgccaggttccatccaccggcccaagtctgaatcgcctctacccacacaagcggacgcgtcctctgatctctgcttccgccgccgccgccaccgccgcctcctcttccggcaacccttccacttgacatggctgcggcgccgccggcgttcaccggtaacctgaagaaagcacttgcaggtttaaggagaatcaatttagatgggctgcgttggcgtgtatttgatgcaaagggccaggtgcttggacggttggcatcccaaatagctgttgtgctacaagggaaggataaaccaacttatgcaccacatgtggaaaatggagacatgtgcattgtgctaaatgccaaggatatcagtgttacaggaagaaaaatgaccgataagatttactactggcacacagggtacattggccatctaaaggaaagaagactcaaggaccagatggagaaagacccaactgaggtgattcgcaaagctgtcctgcgcatgcttccccgcaacaggctgcgtgatgacagggatcgcaagctgaggatattttctggaaatgagcatccattccacgaccgccctcttgaaccgtttgtgatgccacccaggcaagtacgtgagatgcgccctcgtgcaaggcgtgcattgataagggcccagaaaaaaaagcaggcaaacagagccaaggaggaagaagatgctaagaatgccaaagctgaggtcactgcataggcacattctgatgtgtatttgcattcttcagatataccctatgatgttttcacattatctttgtttctttgacatgtagcctgtcgagccgaataggcactaaagccttaggaacttgcaaaacacattctgaatatcttttgtattttgttacagcatgtatcgcaaaacttgtctcgaggtcaaggctcagttgcttttctctagtgaataaggccctcttaatctcc

SEQ ID NO: 14774 - protein, 199 aa, Panicum virgatum
  misc_feature: Ceres CLONE 1778509
  misc_feature (29)..(156): Pfam Name: Ribosomal_L13 Pfam Description: Ribosomal protein L13
MAAAPPAFTGNLKKALAGLRRINLDGLRWRVFDAKGQVLGRLASQIAVVLQGKDKPTYAPHVENGDMCIVLNAKDISVTGRKMTDKIYYWHTGYIGHLKERRLKDQMEKDPTEVIRKAVLRMLPRNRLRDDRDRKLRIFSGNEHPFHDRPLEPFVMPPRQVREMRPRARRALIRAQKKKQANRAKEEEDAKNAKAEVTA

SEQ ID NO: 14775 - DNA, 951 bp, Panicum virgatum
  misc_feature: Ceres CLONE 1778532
  misc_feature: Encodes the peptide sequence at SEQ ID NO. 14776
agactcgtcattgcggcggcagttcgtcctctgcctcctcccatcccccaccccccattgacggaaccttatctgctctggaatctccctcgcccgctgcagctccaatccgtgctctgccaagtcaaagaatccaaaaaatcccagctttcctatggccgccggcgatttcccacctgccgaagaggcaacggcagcggcggccgcgaaggaggaggaggacctgatcgagatcgtggaggaagggtccggccggctggacatcgcccggtacgtggaccacgtccgggacctgtcggccggcgccatcgccacgttcgagggcacgacgcgggaccacttcgcggggcggcgcgtggtggagctccggtacgaggcgtacgcggcgatggcgcggcgccgcctggcgggcatcctgcgggaggcccggtcccggcacgcgcttcggcggctcgccgtggcgcaccgcctgggccctgtgcccgcgggggaggcgagcgtgttcgtggcggcctcggccacgcaccgcgccgacgccatggaggcttgccggtacgtgatagacgagctcaaagcgtccgtgcccatctggaagaaggaggtgtacgacgacggcgaggtgtggaaggagaaccgcgagttcttggaccgccactccggcgccgcggctccggctccggctccggcggcgaaggcgggcggttgctgcggcagcaaggtcagggtccaggaggcctgactgatggcagacgccgggagtggatctgcgagattctctgctgtactcgatcgatctccatggacttttcgtttcaatttttgctcagagatactactgtataccgaaaggcagatgcgtttaaagaacacgaggcacaggaaactcctgcttgtattgtgatgatggaaaccccatgagggaaaataatggaaacagtaaggatttggtat

SEQ ID NO: 14776 - protein, 194 aa, Panicum virgatum
  misc_feature: Ceres CLONE 1778532
  misc_feature (26)..(143): Pfam Name: MoaE Pfam Description: MoaE protein
MAAGDFPPAEEATAAAAAKEEEDLIEIVEEGSGRLDIARYVDHVRDLSAGAIATFEGTTRDHFAGRRVVELRYEAYAAMARRRLAGILREARSRHALRRLAVAHRLGPVPAGEASVFVAASATHRADAMEACRYVIDELKASVPIWKKEVYDDGEVWKENREFLDRHSGAAAPAPAPAAKAGGCCGSKVRVQEA

SEQ ID NO: 14777 - DNA, 616 bp, Panicum virgatum
  misc_feature: Ceres CLONE 1778565
  misc_feature: Encodes the peptide sequence at SEQ ID NO. 14778
gctggaggaggtctcgatcctgccctcgaagcgcctccgtaacaaggtggccggcttcaccacccacctgatgcgccgcatccagcgcggccccgtccgcggcatctcgctcaagctccaggaggaggagcgcgagcgccgcatggacttcgtcccggagaagtcggcgctcgaggtggaggagatccgcgtcgacgaggagaccatggagatgctcgcggccctcggcatgtccgacctcccggctcgtcagattgaatgctttgttacctgcgcttggtactgtattgaagtttagtgcttgtacatatatttcgttaattagtcttcgatataagaaatggatgtttatcatccagatttcaacctatgcagtccaatcttagctcttaggatacactatagtcagcgattggtcacgccgtcgtattattacattttttgcccattgcaacttcaaccgctagagtctgataaatgagaaaacgatcaaagcaaccacacagaagaatcatcatcgaacctgttacttatctgctttgattgttcagacgctgtcgattgccttttggaatcagcagtgtatctgagttacatgatagagctttcttcaagt

SEQ ID NO: 14778 - protein, 98 aa, Panicum virgatum
  misc_feature: Ceres CLONE 1778565
  misc_feature (2)..(88): Pfam Name: Ribosomal_S17e Pfam Description: Ribosomal S17
LEEVSILPSKRLRNKVAGFTTHLMRRIQRGPVRGISLKLQEEERERRMDFVPEKSALEVEEIRVDEETMEMLAALGMSDLPARQIECFVTCAWYCIEV

SEQ ID NO: 14779 - DNA, 769 bp, Panicum virgatum
  misc_feature: Ceres CLONE 1778590
  misc_feature: Encodes the peptide sequence at SEQ ID NO. 14780
aagctcgctcgccgtcgccgctgaacgagccggagccgcccgacccggtcgctgcccgtcgccagcacgtcagcttgacgcggatcggcggatgcatgtggcgtctcctccctctccggctataaaaaggacgggggagggagggatggaggcacaggcagcagcggatccgcgcacgtctctcccgagtgttcatcatctacttcttcttcggatcccgcagcgcgcggcggcgcgtgcaaccggagcaggacgtacgcgaggccgcaggcagagcaggggacaccatgctggaagggaaggcgatggtggaggacatgccggcgaagatgcaggcgcaggcgatggcggcggcgtccagggccctcgactgccggagcatcgcggctcacatcaagaaggagttcgacacgatacacggccccgggaggcaatgcgtggtgggctccagcttcggctgctacttcacgcacagcaaggggagctccatctacttccggctcgagtcgctcaggttcctcatcttcaaaggggcggcagcgtagcagcaggctactcacacctcacaccttcttttcctccggcttctgttgatcgagcaagactagggggcgccgcggcggatggcgtgtgctttctctgtgtgaaatcggctcgatgtacatgagggtagatgtgaacattggcaagattgcaaaacggtggatttcatcgctggtcgaattgcttttttgtgtatgaaatgaaatccatgtggatgaatttggtg

SEQ ID NO: 14780 - protein, 85 aa, Panicum virgatum
  misc_feature: Ceres CLONE 1778590
  misc_feature (1)..(83): Pfam Name: Dynein_light Pfam Description: Dynein light chain type 1
MLEGKAMVEDMPAKMQAQAMAAASRALDCRSIAAHIKKEFDTIHGPGRQCVVGSSFGCYFTHSKGSSIYFRLESLRFLIFKGAAA

SEQ ID NO: 14781 - DNA, 832 bp, Panicum virgatum
  misc_feature: Ceres CLONE 1778596
  misc_feature: Encodes the peptide sequence at SEQ ID NO. 14782
agcgaactctgaccaccctgacccgtcgtttccggggagcggatcacccgagctgcctccacccgccaggcgcgtccgccgccgtctgcctccagatccgctggtggctctcaggctatccttctctgcgaaccgactcttcgcgcgagtcagcagctcggcgcccgcgctcgaacagaagagtcgagaggagggaggagcggccggcggcggaagaggatgtcgtacctgctgccgcatctgcactcggggtgggcggtggaccaggccatcctcgccgaggaggagcgcctcgtcatcatccgcttcggccacgactgggacgagacctgcatgcagatggatgaagtgctggcagcagtagctgaaaccattaagaactttgcggtcatctaccttgtggacatcaccgaggtccctgacttcaacaccatgtacgagctgtacgacccatcaacggtgatgttcttcttccgaaacaagcacatcatgatcgatctcgggacgggaaacaacaacaagatcaactgggccctcaaagacaagcaggagttcatcgacatcgtggagacggcctacaggggtgcccggaagggccgtagtctggtgatcgcccccaaggactactccaccaagtatcgttactaagaagacaattcgcgctagcttcgctgctgctgctgctgttctgcagtacaagttgctagcctagtgccttccccttgtgttagggggatgtttactcagacagacaggcaaagggtgtttgatttgagtattgctctgtatcttgcatgtcgtaataaacctgtaaagttgtaactgtgagctg

SEQ ID NO: 14782 - protein, 142 aa, Panicum virgatum
  misc_feature: Ceres CLONE 1778596
  misc_feature (4)..(136): Pfam Name: DIM1 Pfam Description: Mitosis protein DIM1
MSYLLPHLHSGWAVDQAILAEEERLVIIRFGHDWDETCMQMDEVLAAVAETIKNFAVIYLVDITEVPDFNTMYELYDPSTVMFFFRNKHIMIDLGTGNNNKINWALKDKQEFIDIVETAYRGARKGRSLVIAPKDYSTKYRY

SEQ ID NO: 14783 - DNA, 771 bp, Panicum virgatum
  misc_feature: Ceres CLONE 1778598
  misc_feature: Encodes the peptide sequence at SEQ ID NO. 14784
gagaaccggagcaacagatcgcgcgcaggagggcgccggaagcggaagaggaggccgcggagagatggacgagatcatgaacaaggtgggcgcctactggctggggcagagggccaacaaggagatctcgtcggccggcgacgacatcgagtcgctctcgaccagcgtcggggagggcgcgaaatggctggtgaacaagctgaaaggcaagatgcagaagccgctgccggagctgctcaaggagcacggcctgccggtggggctcttcccgcgggaggccaccaactacgagctcgcgccggagacgcggcggctgacggtgtacatcccgtccccgtgcgaggtcggctaccgcgacggctccgagctgcggttcgacgccatggtgtccggcacgctgggcgagggccgcctcacggaggtggaggggatcaagaccaaggtgctcgtctgggccagggtcaccgccgtcaaggccgacgccgccaaggtccacttcacggccgggatcaagaggtcgcgcagccgggacgcctacgaggtcgtcaggggcggcatcatcgtcgacgatttctagctgtggctgcacgctgagatgcttgcagttgcaggaataaattctgctctttttttatagtgaaaataattttactgttagttagccaagagaattgtatgaccgtgtgcttttaccgtgcgacttgtgaagttttgatgcccgtcctttactgtacagtattaaaatttgaatgagaacattggcccaggcac

SEQ ID NO: 14784 - protein, 170 aa, Panicum virgatum
  misc_feature: Ceres CLONE 1778598
  misc_feature: Useful for making plants with modulated nitrogen use efficiency
MDEIMNKVGAYWLGQRANKEISSAGDDIESLSTSVGEGAKWLVNKLKGKMQKPLPELLKEHGLPVGLFPREATNYELAPETRRLTVYIPSPCEVGYRDGSELRFDAMVSGTLGEGRLTEVEGIKTKVLVWARVTAVKADAAKVHFTAGIKRSRSRDAYEVVRGGIIVDDF

SEQ ID NO: 14785 - DNA, 956 bp, Panicum virgatum
  misc_feature: Ceres CLONE 1778600
  misc_feature: Encodes the peptide sequence at SEQ ID NO. 14786
agagagccaccagacccgaccagcagaacaagaagctgaaccggctcccatctcctttccttccattcacaccggcgagcacagcgaaacgcggaagcagagagtgccccccgcgcccgccccctcctccctccggtccccgatggtggctcgcgtcgcggccctcgccgcgctcctcgccctcgccgccgccgccgcgcgggcgtccaacgacgagggggacgcgctctacgcgctgcggcagcggctcagggaccccaacggcgtgctgcagagctgggaccccacgctcgtcaacccctgcacctggttccacgtcacctgcaaccaggccagccgcgtcgtacgcctggacttggggaactccaatatctccggctccctcggccctgagctcgggcgccttgtgaacctcaaatacctggagctgtacaggaacaatttcgatggtgagatcccaaaggaattgggtaaactgaagaatctgatcagcttggatttgtacgccaacaagctcaccggagaaatccccaagtcaatttccaagctcaactcactcagattcatgcgcttgaacaacaacaagcttaccggatcaattccaagggagcttgccaagctttccaacctgaaagtcattgacctgtctaacaatgacctctgtggaaccattccagttgatggacctttctcaaccttccctcttcgaagcttcgagaacaacagcaggctcaacggtccagagctgcaagggttggttccctatgactccggatgttagatgcttctgttctggctgatgctgcgctgcaacaaaacaatcaacgatgtatcccattcctagttaaaagaaggaaaaacaagatagtagtacaaagaaacctagcttggagaatgtggtgataatatgtgtgttcagacaagatttgagggtatcaaaggaggtcctgatatat

SEQ ID NO: 14786 - protein, 212 aa, Panicum virgatum
  misc_feature: Ceres CLONE 1778600
  misc_feature (22)..(62): Pfam Name: LRRNT_2 Pfam Description: Leucine rich repeat N-terminal domain
  misc_feature: SWISSPROT Homolog: EC 2.7.11.1 Non-specific serine/threonine protein kinase
MVARVAALAALLALAAAAARASNDEGDALYALRQRLRDPNGVLQSWDPTLVNPCTWFHVTCNQASRVVRLDLGNSNISGSLGPELGRLVNLKYLELYRNNFDGEIPKELGKLKNLISLDLYANKLTGEIPKSISKLNSLRFMRLNNNKLTGSIPRELAKLSNLKVIDLSNNDLCGTIPVDGPFSTFPLRSFENNSRLNGPELQGLVPYDSGC

SEQ ID NO: 14787 - DNA, 985 bp, Panicum virgatum
  misc_feature: Ceres CLONE 1778611
  misc_feature: Encodes the peptide sequence at SEQ ID NO. 14788
acgcccgccttggttgtctctctcggtctcggcggcctttcctttccttgctagcgctagcggcgacgaccgggcgagtgccgccgtccgccacttcttcgtcggccgaccaccatctgaaaggggatgagtgaagaggacaagactgctgctgctgctgagcagccgaagcgagcccctaagctcaacgaaaggatcctctcttctttgtccaggagatctgtagctgctcatccatggcatgatcttgagatcggtcctggggctcccgctgtcttcaatgttgtcattgagatcacaaagggaagcaaagttaaatatgagcttgacaagaaaactggactgattaaggttgatcgagtcctgtactcatcagttgtataccctcacaattatggtttcattccgaggactctttgtgaggacaatgacccaatggatgttttggtcctgatgcaggagcctgttattccgggttcattcctccgggcaagagcaattggccttatgcctatgattgaccagggtgaaaaggatgacaagataattgctgtctgtgctgatgatcctgaataccgtcactacaatgacatcagtgagctgtctcctcaccgcctgcaagaaatcaagcgcttctttgaagattacaagaaaaatgagaacaaagaggttgctgttgatgcattcttgcctgcgacaactgctcgagatgccattcagtactccatggatctgtatgcacaatatattttgcaaagcttgaggcagtagaatgccagcaactatttattgtggcgtctttgattgtgtgtgattttaagtggacgcttgaattgtgtgcgaccattacaactgaatgatgttgctggctgttatttccttctgcttttcccaggtcttgtataactttgttgttaaattatgaataagcaactttgttgttaaattatgaataaacgaagttcttcgtttaccttgcccatcc

SEQ ID NO: 14788 - protein, 214 aa, Panicum virgatum
  misc_feature: Ceres CLONE 1778611
  misc_feature (52)..(206): Pfam Name: Pyrophosphatase Pfam Description: Inorganic pyrophosphatase
  misc_feature: SWISSPROT Homolog: EC 3.6.1.1 Inorganic diphosphatase
  misc_feature: Useful for making plants with modulated nitrogen use efficiency
MSEEDKTAAAAEQPKRAPKLNERILSSLSRRSVAAHPWHDLEIGPGAPAVFNVVIEITKGSKVKYELDKKTGLIKVDRVLYSSVVYPHNYGFIPRTLCEDNDPMDVLVLMQEPVIPGSFLRARAIGLMPMIDQGEKDDKIIAVCADDPEYRHYNDISELSPHRLQEIKRFFEDYKKNENKEVAVDAFLPATTARDAIQYSMDLYAQYILQSLRQ

SEQ ID NO: 14789 - DNA, 641 bp, Panicum virgatum
  misc_feature: Ceres CLONE 1778615
  misc_feature: Encodes the peptide sequence at SEQ ID NO. 14790
atcgcagctagggttttcggctccgatctcgcgccgccgccaggactctcggaaggacggaggcggaagctacagctcggcagccatggtgaacgttccgaaaaccaagaagacctactgcaagaacaaggagtgcaggaagcacaccctgcacaaggttacccaatacaagaaaggaaaggatagcctctcagctcaagggaagcgtcgttatgaccgcaaacagtcaggatatggtggtcagacaaagccagttttccacaagaaggccaagacaacaaagaagattgtgctgaagctgcagtaccagagctgcaagcactactctcagcacccaatcaagaggtgcaagcacttcgagatcggtggcgacaagaagggcaagggaacctctctcttctaaactgatgataaacttgttatttgcccccaagttgtctgccagaagttaccattaggaatgttctatgttatccttatagtgagatacatcagatgggaacccttatgctttgtatgttcttgagttgttctgttggataattttggtatgatatttgtacgggaccagatgacgaatatgttttattctgagccagcattattcaggttctcttacatagctagttcttgattctggc

SEQ ID NO: 14790 - protein, 105 aa, Panicum virgatum
  misc_feature: Ceres CLONE 1778615
  misc_feature (19)..(95): Pfam Name: Ribosomal_L44 Pfam Description: Ribosomal protein L44
MVNVPKTKKTYCKNKECRKHTLHKVTQYKKGKDSLSAQGKRRYDRKQSGYGGQTKPVFHKKAKTTKKIVLKLQYQSCKHYSQHPIKRCKHFEIGGDKKGKGTSLF

SEQ ID NO: 14791 - DNA, 725 bp, Panicum virgatum
  misc_feature: Ceres CLONE 1778632
  misc_feature: Encodes the peptide sequence at SEQ ID NO. 14792
atcggctcgccgtgttcgtacgaaggcgaccctccccctccttccccgtcgcactccctaccgccgccgacgccgacgccatggtgaagtactcgcaggagccgggcaaccctaccaagtcggccaaggccatgggcagggatctcagggtccatttcaagaacacaagggagacagcttttgcacttcgcaagctgcctttgaccaaggctaagcggtaccttgaggatgttatggcacacaagcaggcgattcccttccggagatactgtgggggtgttggtcgtaccgcacaagcaaagtctcgccactcaaatggacagggacgctggcctgttaaatcagccaggttcatattggatttgctcaagaatgctgagagtaatgctgatgtgaaaggtttggatgtggacaacctctatgtttcacacatccaggtgaaccaagcccagaagcagaggcgccgcacctaccgtgctcatggacgcatcaatccttacatgtcctcaccttgccacattgagctgatcctttcagagaaggaagagcctgtgaagaaagagcctgacaacatcgtcgcatcaaggaaacagtgaagtatgtaggcttgctgagcgaggctattctgtggaagaaattgtagctgtagcacttttatgtacgttttccagcagcctttcctaagatatttctactgccaatattttgaatcttgtttgttgcct

SEQ ID NO: 14792 - protein, 171 aa, Panicum virgatum
  misc_feature: Ceres CLONE 1778632
  misc_feature (17)..(153): Pfam Name: Ribosomal_L22 Pfam Description: Ribosomal protein L22p/L17e
MVKYSQEPGNPTKSAKAMGRDLRVHFKNTRETAFALRKLPLTKAKRYLEDVMAHKQAIPFRRYCGGVGRTAQAKSRHSNGQGRWPVKSARFILDLLKNAESNADVKGLDVDNLYVSHIQVNQAQKQRRRTYRAHGRINPYMSSPCHIELILSEKEEPVKKEPDNIVASRKQ

SEQ ID NO: 14793 - DNA, 503 bp, Panicum virgatum
  misc_feature: Ceres CLONE 1778637
  misc_feature: Encodes the peptide sequence at SEQ ID NO. 14794
gttcatctacggcctctgctcgtgctccaaggccaatcgccgactctcaactcgcgttgtacgatccgcgtcgagtcatcgacggcgtgcgggatccgctacgctcgggtgcgcgatggtggatcggttttggcggcaatttggcgatggtgtgcgatggcccccgcacccgcagcggtgccgctgctgcatctgcccgcggggtggaggcgtccatgaacctaatggccagaaacaagatgcgcctctacgatctgccctccaagctgccctgtcgtgtgctcaacgtcgagctcaaggttcctcttcctattgcagagaggtgctggtgagctcttcccgcaaccactgactagacgttatgtcaggggaacaatggaacgaatgcaacacctctttttttcaatcaagtgtcatttttattttgtcaagtgtaaactgataatggcatttgtttgttagactctcttccttttcaagtgtcaactgaaagtttatttgtg

SEQ ID NO: 14794 - protein, 61 aa, Panicum virgatum
  misc_feature: Ceres CLONE 1778637
  misc_feature: The sequence is a functional homolog of SEQ ID NO 108 in the 10/225,066 US patent application
  misc_feature: The sequence is a functional homolog of SEQ ID NO 296 in the 10/412,699 US patent application
  misc_feature: The sequence is a functional homolog of SEQ ID NO 692 in the 11/479,226 US patent application
  misc_feature: The sequence is a functional homolog of SEQ ID NO 84 in the 10/374,780 US patent application
  misc_feature: Useful for making plants with modulated seed size
  misc_feature: Useful for making plants with modulated biomass
MVCDGPRTRSGAAAASARGVEASMNLMARNKMRLYDLPSKLPCRVLNVELKVPLPIAERCW

SEQ ID NO: 14795 - DNA, 762 bp, Panicum virgatum
  misc_feature: Ceres CLONE 1778647
  misc_feature: Encodes the peptide sequence at SEQ ID NO. 14796
acttcctccattcgcgcttctcctctctctctctctctctcgctgcccgtctccactccctccgtcagatccctcgcccgggctaccatggcggaccagctcaccgacgaccagatcgccgagttcaaggaggccttcagcctcttcgacaaggacggcgacggctgcatcaccaccaaggaacttggaactgtgatgcgctcattggggcagaaccctaccgaggctgaactccaggacatgatcaatgaggttgatgcagatggcaacggaaccattgacttccctgagttcctcaacctgatggcacgcaagatgaaggacactgactctgaggaggagctcaaggaggccttccgtgtgtttgacaaggaccagaacggcttcatctccgcggctgagctccgccacgtcatgaccaaccttggcgagaagctgacagatgaggaggtggacgagatgatccgcgaagctgatgtggatggtgatggccagatcaactacgaagagttcgtgaaggtgatgatggccaagtgagatgtgctcttttaaagctagtttctctcctgatggtagtaactagtttagtgttgaaaactgactgcatttggttatcccttattccgatccgtgcgccaatgaacagatatgttgtttgttttcttccctgggatttcactgtatctgtaatttcttttggattcgtttgcgattgtattacatttatgttatctgggtacaatgatcatgccttccccttcc

SEQ ID NO: 14796 - protein, 149 aa, Panicum virgatum; identical to SEQ ID NO: 12456
  misc_feature: Ceres CLONE 1778647
  misc_feature (121)..(149): Pfam Name: efhand Pfam Description: EF hand
  misc_feature (85)..(113): Pfam Name: efhand Pfam Description: EF hand
  misc_feature (12)..(40): Pfam Name: efhand Pfam Description: EF hand
  misc_feature (48)..(76): Pfam Name: efhand Pfam Description: EF hand
  misc_feature: SWISSPROT Homolog: EC 2.7.11.1 Non-specific serine/threonine protein kinase
  misc_feature: Useful for making plants with modulated salt sensitivity

SEQ ID NO: 14797 - DNA, 833 bp, Panicum virgatum
  misc_feature: Ceres CLONE 1778693
  misc_feature: Encodes the peptide sequence at SEQ ID NO. 14798
aatccatccatccggcccggtccccttcgattcgatcaaccaagaggcaaacgaatcccccgctcggggtcgaggcggcggcggagggagagccgtgaatggcgctgccggtggcgaagctgggaaccttggcgctgcggaccctgtccaagcccatcgccagccgcctcaagagccaggccgccgtccattccaagttccgcaacttcatcatcgccatcgctcagatacaccatcgtatcaccacaaagattcaaaggcgcatttatgggcatacaacagatatggagatcagacctttaaatgagcagaaagcagtacaagctgctacagatctcattggagaagcctttatcttttcggtagccgttgctgctttaatttttgaggttcaaagaagtgcaaggtcagaggctaggaagaaggaagctcgtaaacaggaacttgaggaattgaaacaaagagaagagagtttagcaaaagaattggagaatcttaaattgaagctcaatgaaatcgagcagcttgctaaaggacgaggcctaacaggaatccttaacttcaaaggggtccatgtggcagaaggcggaaagacagcgacacctgcggcgtgattatgcatttcaactttggtgcggtaaagtaggattccatgttgctaagtggtgccctgaaacacctcgaaattgctgattgatttcccaattctttattgacagttgtgtttgcatgcccattctttggtgtttatattggatcataatttgtagttgctgatccatggacacccagaaataatagtgtgtaagaaagaagcaactagagtgcagcat

SEQ ID NO: 14798 - protein, 171 aa, Panicum virgatum
  misc_feature: Ceres CLONE 1778693
  misc_feature (4)..(136): Pfam Name: OPA3 Pfam Description: Optic atrophy 3 protein (OPA3)
MALPVAKLGTLALRTLSKPIASRLKSQAAVHSKFRNFIIAIAQIHHRITTKIQRRIYGHTTDMEIRPLNEQKAVQAATDLIGEAFIFSVAVAALIFEVQRSARSEARKKEARKQELEELKQREESLAKELENLKLKLNEIEQLAKGRGLTGILNFKGVHVAEGGKTATPAA

SEQ ID NO: 14799 - DNA, 918 bp, Panicum virgatum
  misc_feature: Ceres CLONE 1778694
  misc_feature: Encodes the peptide sequence at SEQ ID NO. 14800
ttcagcagccgccgccgccgccgccgccggggatggagaccacctacaagttcgggccctacaagatcgatgccagggaggtcttccacgccactcccctctcctacgccatggtcaacctccgccccctcctccctggtcatatccttttatttcagtaaagctgacaactaattaatggattgctggtacttcggtaaggttcatgaagagcacccgaaaacaaatatgactctagaaaataaactgagcagtggaagtttccgcgaaacctttgcattggttctcttctttttacacctgtttttcagctgttttagaggtcacatcacacacaagttttattcgacttgaagtttgatgcatcacatattaaagggcagacccagtgccaggcggctcccacttgagtggggttcatattgagaaaaaaaaattattctatatgcatcattttttccccttgacaatacatacatgttcttgtgtgccccaagcgtgaagtgaaaagatttgctgatctaagttctgatgagacgtgtgacttatgggttactgcaaaggaagtcggtgtacgtcttgagcagtatcataaagcatcttcacttacctttgctattcaggatggtcctcaagctggccaaacagttccacatgtccacattcatgtcatcccgaggaagaaaggggattttgagaaaaatgatgaaatatatgatgcgattgatgtgaaagagaaagaattgaaggagaagcttgacctggacattgagagaaaagatagaagcatggaagaaatggctcatgaggccaatgagtaccgtgctcttttctcctagaattaactcttctatagtagttagtttctaggttgatctgactgttttcataaataagccttgctgctgccttttctcc

SEQ ID NO: 14800 - protein, 42 aa, Panicum virgatum
  misc_feature: Ceres CLONE 1778694
  misc_feature: SWISSPROT Homolog: EC 3.6.1.29 Bis(5'-adenosyl)-triphosphatase
METTYKFGPYKIDAREVFHATPLSYAMVNLRPLLPGHILLFQ

SEQ ID NO: 14801 - DNA, 726 bp, Panicum virgatum
  misc_feature: Ceres CLONE 1778749
  misc_feature: Encodes the peptide sequence at SEQ ID NO. 14802
aggcgccaggccggcccttccccgcgccatggcgttgccacgcgccgcgattgtccatccgccattctcgccgtgtcccgcgctcccggcctgccgccttccgacctcgacgacaggctccggggctagctttgcgtacttccggacccagcatcccggcgtcggcgcgtaccccaggatcgaggcggcggcgaggcgcggcgcgcgcacggagaaccccagggtcaggaaccgacggctgcagaagaagttcaatggcacggcgacgaagcccaggctgtcggtgttctgctccagccggcagctctacgccgtgctcgccgacgaccacaacaagaagatcctcttctacggcagcaccctgcagaagtccatctgcagcgacccgccctgcggcaccgtggaagctgcccggagggttggggaggagctcgtcagggcgtgcgaggagcttggcatcgccgagatctcctacgaccgcaacggcttcgctcgaggcgagaagatgatggcgttcgaggttcccgtctcacagcacgggttcctgccaagataaggaggcaccaggcttgcactgacagttcaccaaagcagcttattcaggagacgagaaaaggaagtttgtcccattccatgtgatactgtaatttgtatgatccagcagtccttcaacatcatgtagttcatatttcacagcagtcactaagcaagtcaggcattgccagc

SEQ ID NO: 14802 - protein, 175 aa, Panicum virgatum
  misc_feature: Ceres CLONE 1778749
  misc_feature (59)..(165): Pfam Name: Ribosomal_L18p Pfam Description: Ribosomal L18p/L5e family
MALPRAAIVHPPFSPCPALPACRLPTSTTGSGASFAYFRTQHPGVGAYPRIEAAARRGARTENPRVRNRRLQKKFNGTATKPRLSVFCSSRQLYAVLADDHNKKILFYGSTLQKSICSDPPCGTVEAARRVGEELVRACEELGIAEISYDRNGFARGEKMMAFEVPVSQHGFLPR

SEQ ID NO: 14803 - DNA, 798 bp, Panicum virgatum
  misc_feature: Ceres CLONE 1778764
  misc_feature: Encodes the peptide sequence at SEQ ID NO. 14804
agccggccgcgcgcacccggcgttgcggctcctctcaggctcagctagggttcgcctctcctccgccgccctcgtcttcgttttgcagccgcgaccagagcgctccaagtcgagcgtttcgaccagatacgtttgggggaagccggtagggcggcgccatgaggttggagaagtgctggttctgctcctccaccatctaccccggccatgggatccagttcgtccgcaacgacgccaagatctttcgcttttgccgatcaaagtgtcataaaaatttcaagatgaagaggaatcctcgtaaggttaagtggacaaaagcatacagggccttgcatggcaaagacatgacccaggattcaacctttgagtttgagaggaagaggaacaggcctgagcgctatgatcggaatatgaccgagcaaactctaaaggccatccctgtcattataaaggctaggcatgaacgtctgaagaagcacattaaagacagacacgatcctggtaaaaagaaggcgctggagagagataacaaggagctggagcaggacatcaacatgcttcctaagaagcttttcagtaatgaggctccagctaagaaacaaaaggtcacggtcaaagttgttcagcagcagacagaagatcggatggaagagtagccggatggtattgtgttgcttgtgttcatgtcgtatgcagacctttacttttgagtttcttgagattgccctggtgccatgtagtccatggaagatgttaacatttgtggactgagtatcagagttttgcatgtggtggcag

SEQ ID NO: 14804 - protein, 165 aa, Panicum virgatum; identical to SEQ ID NO: 12186
  misc_feature: Ceres CLONE 1778764
  misc_feature (1)..(75): Pfam Name: Ribosomal_L24e Pfam Description: Ribosomal protein L24e

SEQ ID NO: 14805 - DNA, 570 bp, Panicum virgatum
  misc_feature: Ceres CLONE 1778765
  misc_feature: Encodes the peptide sequence at SEQ ID NO. 14806
acaccggccggatagggatcgagactcggactcctccctcctcgtacagtcgtagtgagtgaggggctgggggccggagagatggagcagttcgtgggcacggcggagggcggcgggctcggcgggggccgcggcgggaggaggcgccgggggggcggcagccgcgggagccccgtgttcgtgggcgccgcggggatctgcgacggcaccggccccggctgcagcggcggctacggcatctgcggaacctgcctcgactagccagcctctctccttcgcgccgagcgagcgtgtacatgtcgccaccgatcgacgctgtgctgtgtgtcgtggcgtcgatcgacttggcgtggctccggaggagagaaagggagggctcccctctgtgaaggccataagagggagatccaccaccagtctgtttaatttccatcttgcttcggttgcagaagctgagttcttagcttgcttttttttttacgtttccttcctctatctgcttgatcctctgtgtaaatatctccatattccgtttgtctccagtttaattaagctgcaaaagtacctgtc

SEQ ID NO: 14806 - protein, 59 aa, Panicum virgatum
  misc_feature: Ceres CLONE 1778765
  misc_feature: Useful for making plants with altered alkaloid content
MEQFVGTAEGGGLGGGRGGRRRRGGGSRGSPVFVGAAGICDGTGPGCSGGYGICGTCLD

SEQ ID NO: 14807 - DNA, 866 bp, Panicum virgatum
  misc_feature: Ceres CLONE 1778770
  misc_feature: Encodes the peptide sequence at SEQ ID NO. 14808
cacgccacctcgccgccggcgcgaacccccgtccgcggagatggggaacatcttcgtgaagaagcccaagatcacggacgtcgacagggccatcctcaccctcaagacgcagcgccgcaagctcgcccagttccagcagcagcttgagaaggtaatcgaagcagaaaaggaagctgcacggcagttggttcaacagaagaagagggacagagctttgattgctctgaagaagaagaaagctcaggaagagctgttgaaacaagttgacacatggcaaatgaatgttgaacaacagctgacagacattgaactagcaagtaaacaaaaggctgtatttgaaagcctgaaggctggaaatgctgcccttaagtctatacagaatgagataaacattgatgatgtccaaaagctgatggatgatacagccgaggctaaggcttatcaagatgaaataaatgctgttctaggcgagcagctatcggctgaggatgaagaagctgttatggctgagtttgagaatttggaagctcagcttgccgtcgagtctttgccagacgctcctgttactgaagtacggcctgaagagaaaatgaaagcaccagctgacacagaagctgcatctgaggacattgatgaggttattgagcttcctgatgtgcctacgaaagtgccagagagaccagaagctcctgaaaaaacgaaagttttggaagagccgctacctgcgtagtggatggagctgagatgaatagggcactctcggtttgcagttgtaacatacccatcatttcattgtaccaccccattttcagccatctcagaattttattctgtacagcatgaaaaaaaagttgttgctctcggct

SEQ ID NO: 14808 - protein, 229 aa, Panicum virgatum
  misc_feature: Ceres CLONE 1778770
  misc_feature (16)..(178): Pfam Name: Snf7 Pfam Description: Snf7
MGNIFVKKPKITDVDRAILTLKTQRRKLAQFQQQLEKVIEAEKEAARQLVQQKKRDRALIALKKKKAQEELLKQVDTWQMNVEQQLTDIELASKQKAVFESLKAGNAALKSIQNEINIDDVQKLMDDTAEAKAYQDEINAVLGEQLSAEDEEAVMAEFENLEAQLAVESLPDAPVTEVRPEEKMKAPADTEAASEDIDEVIELPDVPTKVPERPEAPEKTKVLEEPLPA

SEQ ID NO: 14809 - DNA, 714 bp, Panicum virgatum
  misc_feature: Ceres CLONE 1778779
  misc_feature: Encodes the peptide sequence at SEQ ID NO. 14810
ctgatccaaccctaataaaatcagcggggtacacggctccagagtatttatctagtgaacggcacctgacactaaagtgtgatgtgtatagctttggaatcatcttgatggagataattagtgggaaaaggaacacagacactccagcgctcctttctgacgcttgggaatcttggaatcaaggaatgatcagagaccttctagatccagctgtagcccaaccggagcctgagctcctgtttgagttggagagatgtgtacagattggccttctctgtgtgcaacaatcacctgatgacaggcctgccatgtctgcagtagttgcgatgctaaacagtaatagtttgcagattcgtgcacctaagaggccagtgttggacagcaaaaccgagcctcctctccatgaagccgcggatcgctcaacgcaggaagcatctggcacgtcacacagcagccattattcggtatatctcacatagtaggtggtaactttctagcacgtgtgaagttgcattgcggtgttgtgtgatttgtgagatagattgatctttttagctttggtattctagcaaaatcctttcagtttgaataacgtcacttagttcctcaatggtgtgtgattttgctccgatacacaaggatgtatcttgtttttttcccggactaaagagaaagctttatactgattaaggaataatgtcactatgatcacgt

SEQ ID NO: 14810 - protein, 158 aa, Panicum virgatum
  misc_feature: Ceres CLONE 1778779
  misc_feature: SWISSPROT Homolog: EC 2.7.11.1 Non-specific serine/threonine protein kinase
DPTLIKSAGYTAPEYLSSERHLTLKCDVYSFGIILMEIISGKRNTDTPALLSDAWESWNQGMIRDLLDPAVAQPEPELLFELERCVQIGLLCVQQSPDDRPAMSAVVAMLNSNSLQIRAPKRPVLDSKTEPPLHEAADRSTQEASGTSHSSHYSVYLT

SEQ ID NO: 14811 - DNA, 692 bp, Panicum virgatum
  misc_feature: Ceres CLONE 1778781
  misc_feature: Encodes the peptide sequence at SEQ ID NO. 14812
gtagtaggtaagcagcagctagtggtgcaggggagagcaaattaatcagcagctagtagctagcaatggcggctcatcagggaggaagaagaggcagcggtggtgtggtggtccttgcggcggcgcttgtcctctgcgtgctcctccacgaggcccaggtcgccgagtcggcggtgttcaccgtcagcgaccgcggcggctggagcttcaactccaacagctggaccaacggcaagcgcttcaaggccggcgacgtcctggtgttcaagtacgactcgtcggcgcacaacgtggcggcggtgagcgcggccgggtacaagggctgcagcgctccccggggcgccaaggtctacagctccggcaacgaccgcgtcaccctcgcccgcggcaccaactacttcatctgcagcatccccagccactgccagtccggcatgaagatcgccgtcaacgccgcatgatgaccatgaccatgatgatgattctctttcagtgtgccttatatgaatctgcttttgttattattaccacatatataggagtgctactgcatgcataaaaggttggtggttcagagtcgtgcttgatgatcgattattgtcagttgcagtggtgtgtgtggattgtgattggtgcgagtttcatatcgatatatgaatgaataaacacatatatacatcatgattctgctt

SEQ ID NO: 14812 - protein, 131 aa, Panicum virgatum
  misc_feature: Ceres CLONE 1778781
  misc_feature (46)..(124): Pfam Name: Cu_bind_like Pfam Description: Plastocyanin-like domain
MAAHQGGRRGSGGVVVLAAALVLCVLLHEAQVAESAVFTVSDRGGWSFNSNSWTNGKRFKAGDVLVFKYDSSAHNVAAVSAAGYKGCSAPRGAKVYSSGNDRVTLARGTNYFICSIPSHCQSGMKIAVNAA

SEQ ID NO: 14813 - DNA, 983 bp, Panicum virgatum
  misc_feature: Ceres CLONE 1778809
  misc_feature: Encodes the peptide sequence at SEQ ID NO. 14814
atccccttcctccggctcaccaccaccaccaccaccacctcccaccatcctcgcagccccacaccatggcagccacgctctcctccgtggctgccccgtccctccccaaccgcggctccattgtcagagctcagcggcaggcacctccttccgtcatctcggcttcaactaaaagcggcttccatggggtgtcgctggtggacacgaggtgggcggccggccaccggagaagcagcgggcggaggaggctgctgcaggtgaacgcgaggtcgaccgccgccaagaacatcgaggtggaggtcgacaagccactcggactggccctgggccagaagcccggcggtggcgtcgtcatcacttctgtggagtctggagggaatgcagcaagagccggtctgaaagtcggtgaccaggtgctgtacacaagcagcttcttcggagatgagctgtggcctgcagacaagctggggttcaccaagacagccatccaagcaaagccagactccgtctactttgtagtgagcaggggaggtgccgatgttgatgtgaagcgtctaccgaagaggccggcaccgccccggtttggacggaagttgactgagtcacaaaaggagagagcaacacacatctgccttgattgtggatacatatacttcctacccaagccttttgaagaacagcctgatgactacggttgcccacaatgcaatgcgccaaagaagcgatttgccaggtatgatgcggccacggggaagcccatcggtggtgcgctgccgcctattgcggtgatcgtaagtttggtaatcggcatcgccggagtaggggctcttcttgtgtatggcctgcaataggctgttcattcttcagaaccaaaatttttgctgtgcacatgaagctcagctgactgctactgtactccatctcatgaaacactgagtgataccatatatcaaagggaaagtaaatatactatgattggggtc

SEQ ID NO: 14814 - protein, 261 aa, Panicum virgatum
  misc_feature: Ceres CLONE 1778809
  misc_feature (186)..(221): Pfam Name: Rubredoxin Pfam Description: Rubredoxin
MAATLSSVAAPSLPNRGSIVRAQRQAPPSVISASTKSGFHGVSLVDTRWAAGHRRSSGRRRLLQVNARSTAAKNIEVEVDKPLGLALGQKPGGGVVITSVESGGNAARAGLKVGDQVLYTSSFFGDELWPADKLGFTKTAIQAKPDSVYFVVSRGGADVDVKRLPKRPAPPRFGRKLTESQKERATHICLDCGYIYFLPKPFEEQPDDYGCPQCNAPKKRFARYDAATGKPIGGALPPIAVIVSLVIGIAGVGALLVYGLQ

SEQ ID NO: 14815 - DNA, 707 bp, Panicum virgatum
  misc_feature: Ceres CLONE 1778814
  misc_feature: Encodes the peptide sequence at SEQ ID NO. 14816
acctcttctggttgtggtcttgtttttccgtgttgagacttgagagagagggagataggagctgccgtgtggggccagacagtcgcgaccgccagcgatagaaggcgatggcggggatcgggccgatcccgcacgagtgggagccggtggtggtgccgacgactgcgccctccgccccctcctagaaagatgacaaggccgtcaaccccgcccgtccctccggcgccgagatcgataccctgaacaagtacgacgctgggactaacacggccgcgtccagcggcacatccttcaacaccgagcggctccaccaccacactgagaatctagcccatgatcgcgtcccaagtgacctgaagatcaacctcatgcaaggcaggctggataagaagatgacccgagcgcttcttgctcagatgatcgatgacaatccacacgtgatccaggagtatgagtcgggcgaggccatccctacccagcatataattaccaagcttgacagggcactcggaacaaagctgcgtgggaagaaattactttcacacttgtgccccgtatcatcatgaatctgaatgagactaggcagtctgtctgcttattatctatgcttggttttcaatgtcatgctcactgtttctgtgtttggtacatgagtgaataacagtgtcgtggtggacctttgtatgccttgctgcttttatgtgtca

SEQ ID NO: 14816 - protein, 65 aa, Panicum virgatum
  misc_feature: Ceres CLONE 1778814
  misc_feature: The sequence is a functional homolog of SEQ ID NO 1 in US patent 7238857
  misc_feature: Useful for making plants with altered lignin content
  misc_feature: Useful for making plants with modulated heat sensitivity
MQGRLDKKMTRALLAQMIDDNPHVIQEYESGEAIPTQHIITKLDRALGTKLRGKKLLSHLCPVSS

SEQ ID NO: 14817 - DNA, 622 bp, Panicum virgatum
  misc_feature: Ceres CLONE 1778816
  misc_feature: Encodes the peptide sequence at SEQ ID NO. 14818
aattccagcttgcagcttcctccgccgttgggagagagcctaagccgggaggggaggccacggatccatgtccctcgcgaagcgctacgtgctgcgcctcttcatctcgctcaagtacgtgacggcgaacgtggtggaccggcagagcggccgcatcgtgacgaccgcctcgaccgcggagcggccgctgcgggaggggctggagtgcggccgcgcctgcaacgccaaggcggcggccgccgtcggggaggtgctctccatgcggctcaaggtagacggcctcgcgcgggagcccatacacgccgacgcggccaaggaggtcgccaagaaggggttcaagaaccagaccaaggtctgggccatcctcaacgcgctgcgcaaccacggggtcaacctccacatcgacgacgacggcgaccacaggcggcacgtctgaagcaatcatcagttcagctcaccagtttgttccttgaactctatctgtttttgctcttcgcctctttgtaacctcaatgtgtatgatagtacgaggatgaattgaagtttggaggttagtgtgtggcatggaacttctatatgtgattttcccttttgatatcatctcagctacttaatttaacct

SEQ ID NO: 14818 - protein, 122 aa, Panicum virgatum
  misc_feature: Ceres CLONE 1778816
  misc_feature (1)..(110): Pfam Name: Ribosomal_L18p Pfam Description: Ribosomal L18p/L5e family
MSLAKRYVLRLFISLKYVTANVVDRQSGRIVTTASTAERPLREGLECGRACNAKAAAAVGEVLSMRLKVDGLAREPIHADAAKEVAKKGFKNQTKVWAILNALRNHGVNLHIDDDGDHRRHV

SEQ ID NO: 14819 - DNA, 925 bp, Panicum virgatum
  misc_feature: Ceres CLONE 1778820
  misc_feature: Encodes the peptide sequence at SEQ ID NO. 14820
actgcagcctgcagtcggccggttctcgccacctctcgcacctccactgagcgcaccagccgcccccatcctcctctccctcccccggcgcaggctgagcacgcggatctctcgggcagcggaggcaaggcgcggcggcggcggcggccctcgaagcggcgcccccgggtggggcctcgcaggcggcggggagggaggcggaggcggagatgagccgggggcggtcgccggagccattggatttcttcatctggactgtgcaggatgtgggtttatggttggaggaaataaatctcggaagctatcgccagtcatttgaagaaaatggtgtgaatggagagtatctagaaagcctgtcgatgttcaccacagagcagattcttcgattcataagacggtgtcatatgaaatggggagattttattacgctctgtaaagagttgaggcgcatcaaagtcgcctgcctgaaaggggagcaggaagtccgcaggccgtggtgggcgccatcatgcctgtcggctgtgttcgtgcgggtggccaagcgcaaccggcagtcccgcgtcgtctccctgaagcttgaagcctagcaggcttgccatcacccgcccctgcagcagagccccgtgcaccgccaccggtgcgctccagggcgcctctctcactctgtaccatacagcactaggtctcggcggtcctggaacctgttctttgccttagaattatcatcctgctggatgaccagcgccatcgagctcgatgaccagtgcgtgtgtcgtgaatttgcttctttcccatatatatacacacatagggttgtggatggattgttttggagatggtaagatgatgtagacggagaacatgcctgtgtgcattacatccggctttcgcgtgctgtgcagatagtcgctttgtaaaagtgtct

SEQ ID NO: 14820 - protein, 125 aa, Panicum virgatum
  misc_feature: Ceres CLONE 1778820
  misc_feature: SWISSPROT Homolog: EC 2.7.10.2 Non-specific protein-tyrosine kinase
MSRGRSPEPLDFFIWTVQDVGLWLEEINLGSYRQSFEENGVNGEYLESLSMFTTEQILRFIRRCHMKWGDFITLCKELRRIKVACLKGEQEVRRPWWAPSCLSAVFVRVAKRNRQSRVVSLKLEA

SEQ ID NO: 14821 - DNA, 854 bp, Panicum virgatum
  misc_feature: Ceres CLONE 1778833
  misc_feature: Encodes the peptide sequence at SEQ ID NO. 14822
accacctccaacgcgcatattaaccattgtagagaaaaatggaggttgtggtgaaaaggtcaccggcaacggtggtgaggccagcggagccggagccggcggcggcgacgaacggcgccggcggcaccataaagctctcgtccttcgacagggtttgcgccatgacgccgatcacggcgttgctcgtgttcgagcacccgatccgcgaggccgccgagaccttgaagggagcgctttcccgagcgttggtcccctactaccctctttcaggtcgcttggttgcagggcccgacgaggtccacatggaccacatccggtgcagcggcgagggcgcggaattcgtcgccgcctccgcgaaccgtgccttgaaggacgtcgaattcttcgcccggtcgcctggcacgaccacgccgcagctggtggaggagctcatcgccatctaccacccggccgagcgctgcggccccgccgacccgttgctgctgatgcaggtgacggagttctcctgcggcgggttcgtcgtggccgtgacctggaaccatggcgtcgccgacggcgtcgggatggcccagttcctgcaggccttcggcgagctcgcgcgcgggtcgccgtcgccatcccttgctccggtcagatgggacgaatcgctcctcagcctccctccgcccaccgtccagagcaacaagccgttgggcctcgtctgcctcgacgtcaccgtcccctcgagcacgatcgagcgcatcagagctgagttccacgagcgcgccaactccaatggccgccaccggacttgcaccgagttcgaggcggtcgccaccgtgctatggcagtgccgcactcgcgcgatcgcctcc

SEQ ID NO: 14822 - protein, 271 aa, Panicum virgatum
  misc_feature: Ceres CLONE 1778833
  misc_feature (1)..(271): Pfam Name: Transferase Pfam Description: Transferase family
  misc_feature: SWISSPROT Homolog: EC 2.3.1.167 10-deacetylbaccatin III 10-O-acetyltransferase
MEVVVKRSPATVVRPAEPEPAAATNGAGGTIKLSSFDRVCAMTPITALLVFEHPIREAAETLKGALSRALVPYYPLSGRLVAGPDEVHMDHIRCSGEGAEFVAASANRALKDVEFFARSPGTTTPQLVEELIAIYHPAERCGPADPLLLMQVTEFSCGGFVVAVTWNHGVADGVGMAQFLQAFGELARGSPSPSLAPVRWDESLLSLPPPTVQSNKPLGLVCLDVTVPSSTIERIRAEFHERANSNGRHRTCTEFEAVATVLWQCRTRAIA

SEQ ID NO: 14823 - DNA, 741 bp, Panicum virgatum
  misc_feature: Ceres CLONE 1778876
  misc_feature: Encodes the peptide sequence at SEQ ID NO. 14824
acctcgatttgcccaatccaaggtcgcggtcgcgcgcatctatctcgctcggggagttggggatctcaccttcccccgtcgatctcgacccccatccattcaccccgcgtagcgcaggagagccgcggcggcggagatgtccaaggtctacaccctcgaggaggtcgccaagcacaactccaaggacgattgctggctcatcatcggcggcaaggtgtacgatgtgacaaagtttttggaagaccacccaggaggtgatgatgttctgctgtcctcaactgccaaggacgcaactgatgattttgaagatgtcgggcacagcaccactgcccgtgcgatgatggatgagtacctgttgggtgaaatcgactcatcaacgatccctgctaggacgaagtatgtcccccccaagcaaccgcactacaaccaggacaagaccccggagttcattatcaagatcctccagttcttggttcccctggcaatcctgggcttggctgttgctgttaggatctacaccaagtcagagtctgcttagctttgttgcccttgcccccttggggattataagagtcaaacttgttgaataagttagcaagagttctgtgaggttttacatgtgtaacatgtcatgaattcgtcgaatgatctgagatattgtgggttctgtgggtcttggatatccattttgtgcttaaagtaggattggaattcgtcgtactacactatttgctatctcat

SEQ ID NO: 14824 - protein, 133 aa, Panicum virgatum; identical to SEQ ID NO: 14686
  misc_feature: Ceres CLONE 1778876
  misc_feature (4)..(78): Pfam Name: Cyt-b5 Pfam Description: Cytochrome b5-like Heme/Steroid binding domain

SEQ ID NO: 14825 - DNA, 829 bp, Panicum virgatum
  misc_feature: Ceres CLONE 1778882
  misc_feature: Encodes the peptide sequence at SEQ ID NO. 14826
acagtcgtctctccctgcgccgcgtgagctgccaacgatggcccttgagacgtgcttcagagcgtgggcgctgcacgccgcccctgccggcggcaaggacaggctcgccgtcggcggcggcggcagcagcagcagcagcagcagcttcgcgccgtccaagcgggccgccgccgccgccgcgccgctgtccgtcggccgcgtcgccacgcggcggccccggcacgtctgccagtccaagaacgccgtcgacgaagtgctggtggcggatgagaagaactgggacgggatggtgatggcgtgcgagacgccggtgctggtggagttctgggcgccgtggtgcgggccctgccggatgatcgcgccggtgatcgacgagctggccaaggactacgccggcaagatcaagtgctgcaaggtgaacacggacgactgccccaacgtcgcctccacctacggcatccgcagcatccccaccgtgctcatcttcaaggccggcgagaagaaggagagcgtcatcggcgccgtgcccaagaccacgctcaccaccatcatcgacaagtacatcggcagctcgtgatcgagccaactggggttgatgggtgatgttgttgttggggatgaactaaatacatrbgtgtccgtgctcgcgcatacacaccatgcatctcttgttgggtaaggatgatgcgataactcaggcagccgtctgctcctgbtcccttatactatgtsgaatccaactccattaattagtttccagtgcatgatttcacagtgaatattataaattaagtcatgtgtgtatattattattattattattgttatt

SEQ ID NO: 14826 - protein, 179 aa, Panicum virgatum; identical to SEQ ID NO: 13067
  misc_feature: Ceres CLONE 1778882
  misc_feature (72)..(175): Pfam Name: Thioredoxin Pfam Description: Thioredoxin
  misc_feature: SWISSPROT Homolog: EC 1.8.1.8 Protein-disulfide reductase
  misc_feature: Useful for making plants with modulated heat sensitivity

SEQ ID NO: 14827 - DNA, 558 bp, Panicum virgatum
  misc_feature: Ceres CLONE 1778893
  misc_feature: Encodes the peptide sequence at SEQ ID NO. 14828
gcatctctcgctagccctccattatttcgttcagccagccttctccacgccgaaacccttcccctctttctccgggttccggcggcggcggcggcgaagatgatcatcccggtgcgctgcttcacctgcggcaaggtgattgggaacaagtgggacctctacctggacctcctccaggccgactatacagagggagatgctctggatgctttggaactggtccgctactgctacaggcgaatgctcatgacccatgttgatctcattgaaaagttgctcaactacaacacattggagaagactgatacaaactagagagaacacgccatgctccacaatcacctgctgtttcttagtatcagaatgtgtgtggtatgctgtttcttctgtaccaggagaggctggttgtgagatgataatgttaatttggtttgctcatgaacgaaggacgtttgatgtgtcggttgcatctatgctatgaacttgtgatgctgtcagatatttgaagcaatttaactgtcgaccaaaactactcgtacattggtgcggattggatcc

SEQ ID NO: 14828 - protein, 71 aa, Panicum virgatum
  misc_feature: Ceres CLONE 1778893
  misc_feature (1)..(60): Pfam Name: RNA_pol_N Pfam Description: RNA polymerases N / 8 kDa subunit
  misc_feature: SWISSPROT Homolog: EC 2.7.7.6 DNA-directed RNA polymerase
MIIPVRCFTCGKVIGNKWDLYLDLLQADYTEGDALDALELVRYCYRRMLMTHVDLIEKLLNYNTLEKTDTN

SEQ ID NO: 14829 - DNA, 750 bp, Panicum virgatum
  misc_feature: Ceres CLONE 1778914
  misc_feature: Encodes the peptide sequence at SEQ ID NO. 14830
atccaactcaaagttcacacttcaaacacccactgccatctggtaagcaaaacgaagcagaacatggctgccggctgggcagagagtatggtcaaactgttcgtgcatcaacctgtggggatgtttacagttttggaatagtacttctggagatgctaacaggcaaaaggccaaccgactctatgtttggggatgacctcagcattgttacctttgtggagaggaactttcaagatcagatgcttgttaagattgatcctcatctccaagaagaatgcaagggctctatacaagcaatgccagaagcagaaaatgagatctgtcgatgcttgctatcactcgtgcaagtcgctctttcttgcacacgtctgttcccaagagaacgaatgaacatgagagaagtatctattaatttgcatgcgatcaggagatcatatgttgcagcaatcaagcaagagtagcgcatgtttcaatggactaatgtccagcatgccatggtgcataactcagtatagtacgtctttggaggcaacaagcctaataaagacagttgcagagagccagagacatactcatacatgaattttctcaccttatgcatagagcaaagaaaaggtacttccctaggatctcggattggctgcaatccttattgtgatctcttttctgttgttttttttcctcttttcttccttccctcctctgtttaattgtaccaagcaaagcaatgaaaggtaaacctacccttgc

SEQ ID NO: 14830 - protein, 152 aa, Panicum virgatum
  misc_feature: Ceres CLONE 1778914
  misc_feature: SWISSPROT Homolog: EC 2.7.11.1 Non-specific serine/threonine protein kinase
PTQSSHFKHPLPSGKQNEAEHGCRLGREYGQTVRASTCGDVYSFGIVLLEMLTGKRPTDSMFGDDLSIVTFVERNFQDQMLVKIDPHLQEECKGSIQAMPEAENEICRCLLSLVQVALSCTRLFPRERMNMREVSINLHAIRRSYVAAIKQE

SEQ ID NO: 14831 - DNA, 684 bp, Panicum virgatum
  misc_feature: Ceres CLONE 1778944
  misc_feature: Encodes the peptide sequence at SEQ ID NO. 14832
acacttcagaagctcgccaacctcggatccgctagaagatgagcggctatccaccgccgccggggtcctggaccaccggcctctgtggctgctgcagcgactgcaagagctgctgcttggcgttcttctgcccgtgtgtcgcattcggccaggtggcagagaccttggacaagggatccacatcctgtggtatggctggtacgatctactgcgcgctgctgcacgcgggggtgtgcctgctccactgcctctactcctgctcctaccgccacaagctccgggcggcgtacggcctgccggcgaagccgtgcgccgacgactgcgtccactgcttctgcgagccatgtgcgctctcccagatgtaccaggagctcaagaaccggggcgccgacccggcagatggttatctactcaactacgcactggccctgtacttgggctatccttcagaagtttactttgcaggacaagctagcttgtagtagtttctcatttcttggcacaggtggccaatgtttttttttttttttttgcctgggcacatgggtggcggttcattagtgtggaaggatatatatcaaactttgtttaggctgtgtgtcgttccacagaggtcggaaaaatttcaagacgatgtatcactttgatatattgtgcttgaaatcaataaaatttcctttttcc

SEQ ID NO: 14832 - protein, 147 aa, Panicum virgatum
  misc_feature: Ceres CLONE 1778944
  misc_feature (11)..(112): Pfam Name: PLAC8 Pfam Description: PLAC8 family
MSGYPPPPGSWTTGLCGCCSDCKSCCLAFFCPCVAFGQVAETLDKGSTSCGMAGTIYCALLHAGVCLLHCLYSCSYRHKLRAAYGLPAKPCADDCVHCFCEPCALSQMYQELKNRGADPADGYLLNYALALYLGYPSEVYFAGQASL

SEQ ID NO: 14833 - DNA, 1225 bp, Panicum virgatum
  misc_feature: Ceres CLONE 1778953
  misc_feature: Encodes the peptide sequence at SEQ ID NO. 14834
agcgccatcttctcttatcctctctccgctcctctcgcgttcttggttacgcgaccgcatccaccgtaaggaaaggaagaacaagggcaggtgccgatggcaagcagtgtcagcagctccaagagcctggcgcagtggctgagggagaacgggttcgacgaggacaccgtcgcgcgcatgtcgaggaggtgcaagaacctgcacagcctcgacgccggcgaggcctcgggcgtctgggactacctcctcaccggcgtcaagatcgagcggcggaggctgcggcacgtggtggccaagtgccccaaggtgctcaccctgcccgtggacggcaagctcgtgcccacggtgcagtgcctcgccacgctgcaggccaagcccggggaggtggcgcaggccatcgccaagttcccgcagatactcttccacagcgtggaggagaagctctgcccgctcctcgccttcttccagacgcttggcgtctctgagaagcagctcgccaagctgctcatggtcaacccgcgcctcatcagctacagcatcgaggccaagttctcgcagacggtggacttccttgtcggcttaggcattgacaaggaaggcatgatcggaaagatcctgaccaaggagccttacatcatggggtatagtgtcgacaaacggctgcgtcccactgccgagttcctcaagtcggagatcgggttacaggggtcagatctcaaaagggtgatcatgagcttccctgatatattatcacgagatgtggataagattctgcggcccaatttagcgttcttgcagaactgcggtttcagcaagggtcaggttatggcattggtggctggataccctcctgttctcatcaagagcgtcaaacactgcttggagccaaggataaagttcctggttgaagaaatgggacgggacatgggtgaggtggtacattacccccagttctttcgccatgggctcaagaggagcctggagtaccgtcacaaggtgctcaagcagaataactcgagttgcagcctcagcgagatgctagactgtaatcagaagaagtttgccatgaaatttggtttggttgcagcagtttaggtactcatcttgtctctagttttaatgtagtatgttttatttttcaggtgatgttttggtttgtacctttgggttgtatggttcttgaacatctgggtattgagaatacaaatctctcattcaagtttcc

SEQ ID NO: 14834 - protein, 332 aa, Panicum virgatum
  misc_feature: Ceres CLONE 1778953
  misc_feature (12)..(324): Pfam Name: mTERF Pfam Description: mTERF
MASSVSSSKSLAQWLRENGFDEDTVARMSRRCKNLHSLDAGEASGVWDYLLTGVKIERRRLRHVVAKCPKVLTLPVDGKLVPTVQCLATLQAKPGEVAQAIAKFPQILFHSVEEKLCPLLAFFQTLGVSEKQLAKLLMVNPRLISYSIEAKFSQTVDFLVGLGIDKEGMIGKILTKEPYIMGYSVDKRLRPTAEFLKSEIGLQGSDLKRVIMSFPDILSRDVDKILRPNLAFLQNCGFSKGQVMALVAGYPPVLIKSVKHCLEPRIKFLVEEMGRDMGEVVHYPQFFRHGLKRSLEYRHKVLKQNNSSCSLSEMLDCNQKKFAMKFGLVAAV

SEQ ID NO: 14835 - DNA, 681 bp, Panicum virgatum
  misc_feature: Ceres CLONE 1778960
  misc_feature: Encodes the peptide sequence at SEQ ID NO. 14836
accccaccctcccactctccctcactctactctttccatccagcgcgagaggcaggtcggcagcagagcgagagcgcgtgccagcccatggcgagcaccaacatggcgtcggccacctcgcggttcatgctggccgcgggcgtgcccgcggcagggcaggaggctcgtggtgcgcgccgaggaggaggccgccgcggcggccgagccggcgccggaaggggagggcgccgtggccaccaagcctaaggccgagaagccgccgccgatcgggcccaagaggggcgccaaggtcaagatcctgaggagggagtcctactggtacaacgggattggcaacgtcgtcacagttgatcaggaccccaacacccgctacccggtggtggtgcggttcaacaaggtgaactacgccggcgtatccaccaacaactacgccttggacgagatccaggaggtgaaatgagcagcgaggctggctggctggctgtgaaatgagggtcacaacatctagtgtgtaatagcttaatctctgtaatcattatgtaattgcttgcttgcttcaccgtggacacaataatctcctgctcttaagttgttgtattcttttcttgtgattttgtacatgcacataaacctcttttcctgccaccgtttgtgcgcgatgctggaaacttgatcgatact

SEQ ID NO: 14836 - protein, 152 aa, Panicum virgatum
  misc_feature: Ceres CLONE 1778960
  misc_feature (91)..(152): Pfam Name: PSI_PsaE Pfam Description: Photosystem I reaction centre subunit IV / PsaE
PHPPTLPHSTLSIQRERQVGSRARARASPWRAPTWRRPPRGSCWPRACPRQGRRLVVRAEEEAAAAAEPAPEGEGAVATKPKAEKPPPIGPKRGAKVKILRRESYWYNGIGNVVTVDQDPNTRYPVVVRFNKVNYAGVSTNNYALDEIQEVK

SEQ ID NO: 14837 - DNA, 911 bp, Panicum virgatum
  misc_feature: Ceres CLONE 1779003
  misc_feature: Encodes the peptide sequence at SEQ ID NO. 14838
aaaaagccccggcgcctttccttctgctaatcccctccgccgggcctcctcgccgccgcccacgcacgcgcgcgccgcctcctctcgccgcccgcctaccccccaggggttccttctcgctctcctcggcggagacccgtccggccgtcgatcgatcccgagagaaaatgataaatctttttaagattaagggccagaagaaggatgatgcagcgaccgcaaatggaaaacctgctgccaggaagcaaagtccaggggagctgcgtctccataaagatattgctgaactcaaccttcccaagaccaccaagatctcttttccgaatggcaaggatgatctgatgaactttgaggccactattaagcccgatgaaggatactacgtggatggtaaatttctttttaccttccaagttcctccagcttaccctcatgaacctcccaaagtcaagtgcaagactaaggtttaccatcccaatattgacttggagggaaatgtctgcctgaacattctgcgtgaagattggaagcctgtcctgaacatcaacaccattgtgtatggtttgaatcttctattctcgcaacctaatgatgaggaccccctgaaccatgaagcagcagctgttcttcgtgatgacccgaagaagtttgagaaaaatgtccacagggcgatggctgggggttatattggtgaaacccacttccctaggtgtatgtaatccagaagatggtgaccggtacctgactatagcaactgtaattgatcctagcatgtgtgctatggtaaacatgtgatgctgaagaaaaatgctagatttaagtactgcggtcgtgtaatataagtgcatgtgacagttgctaaacagatgttcagaacctaatcaggagaacctgcaatgaactgtcgtgac

SEQ ID NO: 14838 - protein, 183 aa, Panicum virgatum
  misc_feature: Ceres CLONE 1779003
  misc_feature (33)..(169): Pfam Name: UQ_con Pfam Description: Ubiquitin-conjugating enzyme
  misc_feature: SWISSPROT Homolog: EC 6.3.2.19 Ubiquitin--protein ligase
MINLFKIKGQKKDDAATANGKPAARKQSPGELRLHKDIAELNLPKTTKISFPNGKDDLMNFEATIKPDEGYYVDGKFLFTFQVPPAYPHEPPKVKCKTKVYHPNIDLEGNVCLNILREDWKPVLNINTIVYGLNLLFSQPNDEDPLNHEAAAVLRDDPKKFEKNVHRAMAGGYIGETHFPRCM

SEQ ID NO: 14839 - DNA, 848 bp, Panicum virgatum
  misc_feature: Ceres CLONE 1779028
  misc_feature: Encodes the peptide sequence at SEQ ID NO. 14840
atgctctgctccgatcccccgcccgacagcccgccttcgcatccgccatcccccacctcgccctctccccactaaacccacgcccgccgccgccgcgaggggacgcccgacgccggcgcgatggccatgcgggtggtgcagaacctggacctggagcggtacgcggggcggtggtacgagatcgcgtgcttcccgtcggcgttccagcccaagacgggcaccaacacccgcgccacctacgcgctcaatccggacagcaccgtgcgggtgctcaacgagacgtggaccgacggccgccgcggccacatcgagggcacggcgtggcgcgccgacccggccggcgacgaggccaagctccgggtccgcttcttcgtgccgcccttcctccccgtcttccccgtcaccggcgactactggatgctccacgtcgacgaggactaccagcacgcgctcgtcggccagccctccaggaagtacctctggatcctgtgcaggcagccgcacatggacgaggccgtgtacgacgagctggtgaagcgggccgaggaggaggggtacgacgtgtcgaggctccgcgggacggcacacccggacccgccgccggagagcgaggcgagccccagggacggcgggacgtggtggctcaagtccctctttggcaagtagcgcggcgtggcggccccgcggctgcgccggtcgagcaggcggcgagatggccgcggcggcgcttggagagttggagtccggtgtttacagctagcggctagctactgccgtttaccgcgtgtaaatttgtgttttgtttggtcggtgtttacccgttttgaaatgaacttggacttggagtc

SEQ ID NO: 14840 - protein, 181 aa, Panicum virgatum
  misc_feature: Ceres CLONE 1779028
  misc_feature (9)..(156): Pfam Name: Lipocalin_2 Pfam Description: Lipocalin-like domain
MAMRVVQNLDLERYAGRWYEIACFPSAFQPKTGTNTRATYALNPDSTVRVLNETWTDGRRGHIEGTAWRADPAGDEAKLRVRFFVPPFLPVFPVTGDYWMLHVDEDYQHALVGQPSRKYLWILCRQPHMDEAVYDELVKRAEEEGYDVSRLRGTAHPDPPPESEASPRDGGTWWLKSLFGK

SEQ ID NO: 14841 - DNA, 786 bp, Panicum virgatum
  misc_feature: Ceres CLONE 1779037
  misc_feature: Encodes the peptide sequence at SEQ ID NO. 14842
atccagtactccagtatccacgaccacgcagcacctgcgactgcgagcacacagctgcttcggccccttctcagcgcgcgagcgttgcctgtgtgtgtgttgttcgtgagcaggcgcggcggcacggatggcgcagtccatgctcatgtcgacgagcgtcggcggcggccgcgcgctgccgtcactgcagaccggccggccggcgccgtacccgcggctcgcgctgccgtcagcatacaggcactccaggtccgtctccgtgaagaccctggccctcttcggcaagtccaaggccgcgccggcgaagaaggctcctgcgcccaaaccgaaggttgaggacgggatcttcggcacgtccggcgggatcggtttcaccaaggagaacgagctgttcgtcggccgtgttgccatgcttggttttgccgcatccctactcggagaggccatcaccgggaagggcatccttgcccagctgaacctggagacgggcatccccatctacgaggcggagcccctcctcctcttcttcatcctcttcttcttcatcgccgccatcaaccctggcaccggcaagttcatcatcggcgaggacgagaagtagagagagaccgagggaaatgatgcgcctggttgtttgtggttgattgatcagtgcgtctctgcgcgtgtgcgtgcaactcgctgtgtattgcacgtgaggctttggaggttagggtgttgcgttgggttgtcttgtaaaacaagagcttatctaatatccaatggctgccggtgttctcttagagt

SEQ ID NO: 14842 - protein, 157 aa, Panicum virgatum
  misc_feature: Ceres CLONE 1779037
  misc_feature (62)..(155): Pfam Name: Chloroa_b-bind Pfam Description: Chlorophyll A-B binding protein
  misc_feature: Useful for making plants with modulated light quality response
  misc_feature: Useful for making plants with modulated nitrogen use efficiency
MAQSMLMSTSVGGGRALPSLQTGRPAPYPRLALPSAYRHSRSVSVKTLALFGKSKAAPAKKAPAPKPKVEDGIFGTSGGIGFTKENELFVGRVAMLGFAASLLGEAITGKGILAQLNLETGIPIYEAEPLLLFFILFFFIAAINPGTGKFIIGEDEK

SEQ ID NO: 14843 - DNA, 630 bp, Panicum virgatum
  misc_feature: Ceres CLONE 1779055
  misc_feature: Encodes the peptide sequence at SEQ ID NO. 14844
gaagtaccacacgggacagaccagagcagcacagacgtcgccatggcctcccagctctccgccgccgtgccgcagttccacggcctgcgtggctacgcctcgccccggtccgtggcggcgctgccgccggtgagggccggcaggaagcgggcgcagggcatccggtgcgactacatcggctcggccaccaaccagatcatggtgctgtcgacgacgctgatgctggtcgcggggcggttcgggctggcgccgtcggcgaaccggaaggcgacggcggggctgaagctggagtcccgcgactccggcctgcagaccggcgaccccgccgggttcacgctcgccgacacgctggcctgcggcgccgtcggccacatcatcggcgtcggcatcgtgctcgggctcaagaacaccggcgcgctcgaccagatcatcggctaggtccattgtctgccttgtctctctcgccgccggccggtgcccatgtaaccatgcatctcgtttcgtttcaatggacatagcttgttgcttcttttgccccccagagttatcaggttcagtacgttctttacattctttcgatcggtgcgagtttacagatttttttttaacaaaacagttcgaagtttcttc

SEQ ID NO: 14844 - protein, 131 aa, Panicum virgatum
  misc_feature: Ceres CLONE 1779055
  misc_feature (46)..(126): Pfam Name: PSI_PSAK Pfam Description: Photosystem I psaG / psaK
MASQLSAAVPQFHGLRGYASPRSVAALPPVRAGRKRAQGIRCDYIGSATNQIMVLSTTLMLVAGRFGLAPSANRKATAGLKLESRDSGLQTGDPAGFTLADTLACGAVGHIIGVGIVLGLKNTGALDQIIG

SEQ ID NO: 14845 - DNA, 719 bp, Panicum virgatum
  misc_feature: Ceres CLONE 1779099
  misc_feature: Encodes the peptide sequence at SEQ ID NO. 14846
atgcaaagctaatgagacagctaccctgaacaccctcagtcagagacatacaagagaaagagagcttcagagatggcctccagctccaagcagcagctgcaggctcctgctctcctcttggtggcatcagctctgctcatcctcgtctgcgctacaagggtccaggcagcaaggccggtaccaggatccaaggaccacatgccacagttcgctgtctccgcgactgtggctggcgacgagaagagtggttcggtgcccgggatggaaatgcatcgagcagagcctgaggcgacggaggagtgcgagggcgaggaaggggaggagtgtctcatgaggaggacactggtcgctcacaccgactacatctacacccaggggaagcacaactagtcgctagtgtgcaggctcacgccgaacaatgaagttcagaagaaaagaatttcgcatggtccacgagctagcttatctgaagctctgcagttctgtcagctgtggatcatgtgttttcatatacgtgccctagacccctagtagcccgtgcgatttccatcagcttctcgagcacatgtacggcctggaattgtatccatcatcttggcttgagatgctaaatggaaatcctaggctattatactgtactcactgtaaatactgaatcaccaagtgtagtcctgtgcttcagttgcaagaaactctgcttgtttccattttcttttccc

SEQ ID NO: 14846 - protein, 105 aa, Panicum virgatum
  misc_feature: Ceres CLONE 1779099
  misc_feature (22)..(105): Pfam Name: PSK Pfam Description: Phytosulfokine precursor protein (PSK)
MASSSKQQLQAPALLLVASALLILVCATRVQAARPVPGSKDHMPQFAVSATVAGDEKSGSVPGMEMHRAEPEATEECEGEEGEECLMRRTLVAHTDYIYTQGKHN

SEQ ID NO: 14847 - DNA, 766 bp, Panicum virgatum
  misc_feature: Ceres CLONE 1779111
  misc_feature: Encodes the peptide sequence at SEQ ID NO. 14848
actcgactccctcccaactcccaaccaccttcccttccacaccgattcccctcgcctcctcccaacccgctcactcccgtccccatctgccgcgatggcctcaagcctcgccgtcgccgtctccgtctccgtcgccgcgcccgcctcgtcgccttccccggtcgccgccgccgccccgccccgcgtcgccctccgccgcggcctcccgccgatgtgccgcgcgttccgcgcccgcccgcgctcccgcggcccggccgtcgtgtgccaggcccagggcggccaggacaccgccatccaagttcctgatgtgagcaaatctacatggcaatcgcttgtggtggagagcgagctgccagtcctcgtagagttctgggcctcatggtgcggaccgtgcaaaatgatagaccccatcgtcggcaagctctcaaaggagtacgaagggaagctgaaatgctacaagctgaacaccgacgagaaccctgacatcgcgacccagtttggcatccggagcatccccacaatgatgatattcaagaacggcgagaagaaggatgctgtaattggggccgtgcccgagagcaccctgatcacgtgcatcgagaagtatgttgacgggaggtgaaatcgaactcaatctgagccgcttagccttggactacaatatgtagatggatgggtatgtatgggtataccgttgtcactgaactgctgctgaagtagctataagtagataataatgtgagataacatggaataaatgcgattc

SEQ ID NO: 14848 - protein, 175 aa, Panicum virgatum
  misc_feature: Ceres CLONE 1779111
  misc_feature (68)..(171): Pfam Name: Thioredoxin Pfam Description: Thioredoxin
  misc_feature: SWISSPROT Homolog: EC 1.8.1.8 Protein-disulfide reductase
  misc_feature: Useful for making plants with modulated heat sensitivity
MASSLAVAVSVSVAAPASSPSPVAAAAPPRVALRRGLPPMCRAFRARPRSRGPAVVCQAQGGQDTAIQVPDVSKSTWQSLVVESELPVLVEFWASWCGPCKMIDPIVGKLSKEYEGKLKCYKLNTDENPDIATQFGIRSIPTMMIFKNGEKKDAVIGAVPESTLITCIEKYVDGR

SEQ ID NO: 14849 - DNA, 583 bp, Panicum virgatum
  misc_feature: Ceres CLONE 1779113
  misc_feature: Encodes the peptide sequence at SEQ ID NO. 14850
actcctctctctcgtctctccgccgctgccttggcttatcatcactctctctttctccaacccaatcaggtcccggacctatttccgcgccgcgaaccgattcgcagtgcactcgtcccatacgacatccaacccgagtcccaggactgagcgtgatggtcataaccaactctttacacctccagcacccccttgataagagggaatctgaagatcaccggattcgacataaatgccctgacacaattccggtgattgttcataacggtgaaacaagtgacattcccgatatcgacaagaaaaaacaccacctccctgctcatctgacagttggacggtttgtctgcattgatgctaatataattctcctgatcgctgagaacgccctcttaatatttgtgaataacactcttccaccaactcctgctcatgatgtcttctatatttgatcagaacaaggacgacgactgcttcctctatatatacttaaagagactagaaaaccttcggactgctctagatggaggctctcctcatctctttgtggtcagcactgacggtcttccctacgaatgcctcctgt

SEQ ID NO: 14850 - protein, 97 aa, Panicum virgatum
  misc_feature: Ceres CLONE 1779113
  misc_feature (15)..(97): Pfam Name: MAP1_LC3 Pfam Description: Microtubule associated protein 1A/1B, light chain 3
  misc_feature: Useful for making plants with modulated nitrogen use efficiency
MVITNSLHLQHPLDKRESEDHRIRHKCPDTIPVIVHNGETSDIPDIDKKKHHLPAHLTVGRFVCIDANIILLIAENALLIFVNNTLPPTPAHDVFYI

SEQ ID NO: 14851 - DNA, 822 bp, Panicum virgatum
  misc_feature: Ceres CLONE 1779125
  misc_feature: Encodes the peptide sequence at SEQ ID NO. 14852
acatcccgctgtgctctctctctctctctctctctctctctctcgccgccgccgcaaccgccgtctcgcccgcgcccgctcccgctccggaaggaaagctcaggtgaagagctgggtagcaggaaatggcggcgtttctgaggtcaaagtgttcgtcagttggacgtactctgatgggaagccttggaaataatttgtatggagccaccagctcatctgttgaggcagtgacaagactttctcattgtgatgctatcagccagcaaatcagaacattcatccagatgagaaccaacctcaaggtcgtggacaactctggagcgaagcgggttatgtgcattcaggccaagaggggcaagtatggagcgaggcttggggacacaattgttggatctgtcaaggaagcacagcctcgtggcaaggtcaagaaaggagatgtcgtgtacggagtggtcgtccgtgctgccatgaagaaaggccgcagtaatggcagcgaggtccagttcgatgacaatgcgatagtccttgtaaacaacaagggcgagctgatcggcactcgcgtctttggtccggtgcctcatgagcttaggaagaagaagcacctcaagatcctggcgttggctgagcacattgtttgagatgtcgtccctcttaggtatctgcctgttagttattcagagtgaaatgaatgtggtgtttcccttaaagaatgtttctagggattttttttttcactgtggaatcgtgacattagtgtatttcactgttgggtttggccgttcgtattctcaataatgtaccatgaaaagagagtttgaaccg

SEQ ID NO: 14852 - protein, 170 aa, Panicum virgatum
  misc_feature: Ceres CLONE 1779125
  misc_feature (52)..(170): Pfam Name: Ribosomal_L14 Pfam Description: Ribosomal protein L14p/L23e
MAAFLRSKCSSVGRTLMGSLGNNLYGATSSSVEAVTRLSHCDAISQQIRTFIQMRTNLKVVDNSGAKRVMCIQAKRGKYGARLGDTIVGSVKEAQPRGKVKKGDVVYGVVVRAAMKKGRSNGSEVQFDDNAIVLVNNKGELIGTRVFGPVPHELRKKKHLKILALAEHIV

SEQ ID NO: 14853 - DNA, 597 bp, Panicum virgatum
  misc_feature: Ceres CLONE 1779168-R
  misc_feature: Encodes the peptide sequence at SEQ ID NO. 14854
aacacgcttctgctgaaccagagcacaaaacggcccccgcagctgagctcccccaggagcacggcgacactgccgggcttcagagcgaggcaagacgtccgcgtcgccgccgtctacaaggtgaagctcatcatgcccggggggaaggagaccgtgatcaatgtgccgaaaaacacctacatcctggacgcggccgaggaagccgggctcgacctgccctactcctgccgcgccggcgcctgctccgcgtgcgccggcaagatcctgaagggctccgtcgaccaaccggaccagtcgttcctcgacgacgaggagatcgacgccgggtacttgctcacctgcgtcgcgttcccgacctccgactgcgtcatcaagacgaaccaggagaaggacctgattgatcagtagcccggtgtggcggtgtcactcccacactatgaatcaccatacttccctatatgctgcattacccgtatccgatactctgatatatatccgatactgccgatacggaattatatatatatatatatatatatatatatataagatttgtgcaaacaagattcgtttattatatcgattgatttcttttcg

SEQ ID NO: 14854 - protein, 135 aa, Panicum virgatum
  misc_feature: Ceres CLONE 1779168-R
  misc_feature (44)..(120): Pfam Name: Fer2 Pfam Description: 2Fe-2S iron-sulfur cluster binding domain
  misc_feature: SWISSPROT Homolog: EC 1.14.13.7 Phenol 2-monooxygenase
NTLLLNQSTKRPPQLSSPRSTATLPGFRARQDVRVAAVYKVKLIMPGGKETVINVPKNTYILDAAEEAGLDLPYSCRAGACSACAGKILKGSVDQPDQSFLDDEEIDAGYLLTCVAFPTSDCVIKTNQEKDLIDQ

SEQ ID NO: 14855 - DNA, 488 bp, Panicum virgatum
  misc_feature: Ceres CLONE 1779168
gaagaggctggagagaagctatagccgatgagaaagggggagcggagagagaagggcggcggcggtgtgcgagggggccggcggaggaggagagagggatgggggaggtgacagaaagcgagagggagatgcacggtgcatgatgatggcgtggttgatcgatctgctctggtactactctcatgtgagtcaagaagccatcatcagatcggtgcagttctcctctccttcactcgtcttcttccagcagactagctcctcttcagctagcttcttttgtacactgctgcgccgtggctttggggaatcaagcgtcttggtccgaaataatccgttttctttccagctaggatctacgtacttgtgcaagagtatgtcatgctatgctctatatgttacttctacatgcaggttcccgttcggtcttttatatatatatatatatatatatatatatatatatatatatatatatatatatatatata

SEQ ID NO: 14856 - DNA, 823 bp, Panicum virgatum
  misc_feature: Ceres CLONE 1779189
  misc_feature: Encodes the peptide sequence at SEQ ID NO. 14857
atccatcgtcccgactactcctacctcctcacctcgcgatccagtcccccgccgccccgcctcgtctagaatccggcctccgccgcaccccggccctcgaccaccgctccgcatcgtcgggaggagtaatccacggtgatcaccgggccaagcaagatgtcggctgccaccgccccgagattgtccgtccccaaatgcggggcgagcctccggaccgccgctccggcggccagggcccctcactccgtcggcttcgcgaggcaggcggcccgcgcgcctgggccgcggctctccggcaggttcgtggcctccgcggcggccgtgcacaaggtgaagctggtcgggccggacggggtggagcacgagttcgaggcccccgaggacacctacatactcgaggcggccgagaacgccggcgtggagctgcccttctcctgccgcgccgggtcctgctccacctgcgcgggcaagatgtcggacggcgaggtcgaccagtcggaggactcgttcctcgacgagaaccagatggccgaggggtacctcctcacctgcatctcctaccccaaggcggactgcgtcatccacacccacaaggaggaggagctgtactagagtgctcgtgcgtcagtgagcttcaatggcggcgcagtggctgagaccatgggttgctatgccatggtagagacgattgttgtgggggaagggatagctcttgatgtctactgttgaacatctgtttcgttgagatcgtgccatatgagctgtgacaataattgttgtaacgtgattctgaaattcaaactgcaagtattttttgagcagc

SEQ ID NO: 14857 - protein, 151 aa, Panicum virgatum
  misc_feature: Ceres CLONE 1779189
  misc_feature (62)..(138): Pfam Name: Fer2 Pfam Description: 2Fe-2S iron-sulfur cluster binding domain
  misc_feature: SWISSPROT Homolog: EC 1.18.1.3 Ferredoxin--NAD(+) reductase
MSAATAPRLSVPKCGASLRTAAPAARAPHSVGFARQAARAPGPRLSGRFVASAAAVHKVKLVGPDGVEHEFEAPEDTYILEAAENAGVELPFSCRAGSCSTCAGKMSDGEVDQSEDSFLDENQMAEGYLLTCISYPKADCVIHTHKEEELY

SEQ ID NO: 14858 - DNA, 720 bp, Panicum virgatum
  misc_feature: Ceres CLONE 1779215
  misc_feature: Encodes the peptide sequence at SEQ ID NO. 14859
acaaatcccccgcaacctcccaacgcggcaacgcatcctctcattccaaaccctcgttcctccagcaccgagagaatcggagcggcctcgatggcgcccaaggcggagaagaagccggcggccaagaagcccgcagaggaggagcccgcggagaaggcggctccggcggagaaggcccccgctggcaagaagcccaaggcggagaagcggctcccggcgggcaagtctgccggcaaggagggcggcgacaagaaggggaagaagaaggccaagaagagcgtggagacgtacaagatctacatcttcaaggtcctcaagcaggtgcaccccgacatcggcatctcctccaaggccatgtccatcatgaactccttcatcaacgacatcttcgagaagctcgccgcggaggccgccaagctcgcccgctacaacaagaagcccaccatcacctcccgcgagatccagacctcggtgcgcctcgtcctccccggggagctcgccaagcacgccgtgtcagagggcaccaaggctgtcaccaagttcacctcgtcttaggctatgctgaaaggcttgtttgcgcctgcctgtgatgtgttgcttctgctgttagtagtggtagttcggagtattggctggtgtggtgtagtgagctgttccggtggcttttgtgacttatcgtggtgggtatggaaggctattgttatctgaaacttgatcagt

SEQ ID NO: 14859 - protein, 154 aa, Panicum virgatum
  misc_feature: Ceres CLONE 1779215
  misc_feature (61)..(131): Pfam Name: Histone Pfam Description: Core histone H2A/H2B/H3/H4
  misc_feature: Useful for biocontainment applications
  misc_feature: Useful for making plants with modulated flowering time
MAPKAEKKPAAKKPAEEEPAEKAAPAEKAPAGKKPKAEKRLPAGKSAGKEGGDKKGKKKAKKSVETYKIYIFKVLKQVHPDIGISSKAMSIMNSFINDIFEKLAAEAAKLARYNKKPTITSREIQTSVRLVLPGELAKHAVSEGTKAVTKFTSS

SEQ ID NO: 14860 - DNA, 858 bp, Panicum virgatum
  misc_feature: Ceres CLONE 1779222
  misc_feature: Encodes the peptide sequence at SEQ ID NO. 14861
acacagagcaccaccaccggagcacagagagagctcgggagagagcagagcgccacaggccgtccgatcctccgcgcgaagcagatcagatggctctcgctctctccggctcctccgcgctccgcgccgcgctggcctcgctggcccccgccaggggctacgcggcgtcggcggcgtccggggccatgcggcgcgcggcggccgcggcggaggccgccgccgcgggggaggccaaggaggccgggcgcggcgccgcctccgagatctcctgggtccccgaccccgtcacgggccactaccgccccgccaactgggccgccgccgccgaccccgccgacctccgcgccgcgcacctcgcccgggcgtgagccccgcgcccgcccgcccccacccgtctgacataacataccaacaaaggggaaggtggggtggaggttcgtctggcgtcgtcgtcggccgcgcgcgcgagcgctcgctccgtcacggcggcgggccggcatggccgggaagtcgtctcggttggtcgctgtgggacgctcgacgccgctgcatcatctcggcctcggccaatcgggagatacggtacagggaggagcggaggagcggccgctggtcgccgtggcgtgcgtgcgtgcgtggtgtgggctggacgccctgttctagcttctcgcttgtgctctcctaccagattcggatatatactactacgctgcggagagcgagcagggtttcgctgctgttctacgttttgttaggtgtttttggctccaggacttttttcaaaagtccctattacattaaaaagaatcttactattttataatattaaataaaatctgtttataaatgttttttgac

SEQ ID NO: 14861 - protein, 92 aa, Panicum virgatum
  misc_feature: Ceres CLONE 1779222
  misc_feature (1)..(90): Pfam Name: LEA_3 Pfam Description: Late embryogenesis abundant protein
MALALSGSSALRAALASLAPARGYAASAASGAMRRAAAAAEAAAAGEAKEAGRGAASEISWVPDPVTGHYRPANWAAAADPADLRAAHLARA

SEQ ID NO: 14862 - DNA, 728 bp, Panicum virgatum
  misc_feature: Ceres CLONE 1779231
  misc_feature: Encodes the peptide sequence at SEQ ID NO. 14863
gttcctccctaattcttcctccccttccttcgcggcttcgcttccgcttctcgcagcgaggcgaatcccaaatccgcgccgatccaacgcgaatcaaccgagaggcagggggacacgattcgaatcgagacgagcgccatgaacccgagaggctaccgtagcaacagaacttctctcttcgatggcattgaggaaggtggaatccgagcaacatcctattcttcccatgagatagatgaacatgaaaatgatcgagctattgatggactgcaggatcgtgtcagcattcttaagcggctgtcaggtgacatccatgaggaggtggagactcataacagaatgctagaccgcatggggaatgatatggatacatcaaggggttttctctctggaactgtggacaaattcaagatggtgtttgagaccaaatcaagtcggaggatgggaaccctggtggcatcattcgttgctctttttctgctggtttactacttgaccaggtagaagcatcccggaggaaacctatgttggctggtgtgttgcagaacatgctggaaattgatgtaccggtcgacttaccatgcagtatattatacccttgtgaactcactttcctgaatgcaaagtacgttgatcctggtgtcgtgaattctgactgtatgacgatcacagcatgttgggtggactctttgcacagctgctgtaactaaagaaactggattcacctt

SEQ ID NO: 14863 - protein, 121 aa, Panicum virgatum
  misc_feature: Ceres CLONE 1779231
  misc_feature (36)..(98): Pfam Name: SNARE Pfam Description: SNARE domain
MNPRGYRSNRTSLFDGIEEGGIRATSYSSHEIDEHENDRAIDGLQDRVSILKRLSGDIHEEVETHNRMLDRMGNDMDTSRGFLSGTVDKFKMVFETKSSRRMGTLVASFVALFLLVYYLTR

SEQ ID NO: 14864 - DNA, 551 bp, Panicum virgatum
  misc_feature: Ceres CLONE 1779233
  misc_feature: Encodes the peptide sequence at SEQ ID NO. 14865
aaaagaacccgcggcagggaagaggagaggagggggtcgtgaaaggaagaaaccaaacccagcccaagaacagaacaccaccgttccctcgccggggcgtccatccgcaacgatctgcagccatggcgatggcttacaagatggcgacggaggggatgaacgtgaaggaggagtgccagcgctggttcatggagatgaagtggaagaaggtgcaccgcttcgtggtgttcaagatcgacgagcggtcgcgcgccgtgctggtggacaaggtgggcggccccggcgaggggtacgaggagctcgtcgccgcgctgcccggcgacgactgccgctacgccgtcttcgacttcgacttcgtcaccgtcgacaactgccagaagagcaagatcttcttcatcgcctggtaaatctcactactgtctgtctcagttttttttttcgctccatccctcaaccaattctcatcacctcgcaaagctctcggttccttctctgacatggtccatggcgatcttgacagcagtaacttaaggacttttctttggaaaggc

SEQ ID NO: 14865 - protein, 94 aa, Panicum virgatum
  misc_feature: Ceres CLONE 1779233
  misc_feature (16)..(94): Pfam Name: Cofilin_ADF Pfam Description: Cofilin/tropomyosin-type actin-binding protein
  misc_feature: Useful for making plants with modulated time to senescence
MAMAYKMATEGMNVKEECQRWFMEMKWKKVHRFVVFKIDERSRAVLVDKVGGPGEGYEELVAALPGDDCRYAVFDFDFVTVDNCQKSKIFFIAW

SEQ ID NO: 14866 - DNA, 1012 bp, Panicum virgatum
  misc_feature: Ceres CLONE 1779247
  misc_feature: Encodes the peptide sequence at SEQ ID NO. 14867
agcaaaaaatcgaacgcccgagcccaaacccgaccccggcgaccggcgtgcgtgggccgtgggcggacggagcgagcgagcgagagagtcggcggcggtgaccggaggggcggcgagatggcgaaggggttcgcgtcgtacctggcgatgaagacgggcccggaggccggggacgcgtcggcggcggcgaaggcgctcatcgacgccgacctgcgggagatcggcgtcgccgcgcggaagctcgccaaccacgccttcgtcctcggcggcgggctcggcttcggcacctccttcctcaagtggctcgccttcctcgccgcagtgtacctcttgatattggaccgcacaaactggaagaccaacatgatgacggccctcttggttccctacgtgttcttcacactacctcatgttctgttttctctgataagaggagaggttggaaaatggattgcaattgttgcagttattctgcggctcttcttcccacgccacttcccagattggttagagctgcctggtgccatcatcctgctcacagttgtcgctcccagcctctttgcggacaccttcaggggtgacctggtcggcatcttcatatgcctcgcgatcggatgctacctgctttcagaacatatcaaggcatcgggtgggttcaggaacgccttcaggaagggcaatggcgtgtcgaacagcattggcatcctcctgctcttcatctacccagtttgggccctggtgctgaacttcctgtaggcactactgccttggttgcggtaccccctgtgccatgcaactccattcgttgcttgttcagtgtgcagatatttcctctatggtggtcttgtatcttctggaggggggatgcgttgtctatgtttgagttgcccagttggtggacagatttgttatcttgtttgttgtagtttgatgtcagcatttggttctttgtagtacataaacaccaataaaatcaaaagctgtggcttgatgtaaatcgagatgttggccc

SEQ ID NO: 14867 - protein, 212 aa, Panicum virgatum
  misc_feature: Ceres CLONE 1779247
  misc_feature (9)..(200): Pfam Name: WCOR413 Pfam Description: Cold acclimation protein WCOR413
MAKGFASYLAMKTGPEAGDASAAAKALIDADLREIGVAARKLANHAFVLGGGLGFGTSFLKWLAFLAAVYLLILDRTNWKTNMMTALLVPYVFFTLPHVLFSLIRGEVGKWIAIVAVILRLFFPRHFPDWLELPGAIILLTVVAPSLFADTFRGDLVGIFICLAIGCYLLSEHIKASGGFRNAFRKGNGVSNSIGILLLFIYPVWALVLNFL

SEQ ID NO: 14868 - DNA, 790 bp, Panicum virgatum
  misc_feature: Ceres CLONE 1779256
  misc_feature: Encodes the peptide sequence at SEQ ID NO. 14869
atacgtgcacaataaccgctccactttggtcgcattgcacgccacagcaacgagagaccgagcgacgaaaaaaaaaaaaaaaggagaggccgagaagccgcttcagctagccgtcgtagcgataagggtagctgccccgagctagctggtgctccggcatgatggcggccacggcgtactccgtggcgctcctcgacggcgcgcgcctccccgccgccccgcgctccgccgccctcctcccgcgccgcagcgcctgccagctccgcctccaagatgcaccgaggctctccctgctccgcgtgaaggccgcctccgaggacacctcggcctccgccgacgagctcatcgaggacctcaaagccaagtgggacgccgttgaggacaagcccaccgtgctcctgtacggcggcggcgccatcgtcgcgctctggctgacgtccgtggtcgtcggcgccatcaacgccgtgcctctgctacccaagatcatggagctcgttggcctcggctacaccggctggttcgtctaccgctacctcctcttcaaggaaagccggaaagagttggctagcgacattgagaccttgaagaaaaagatcaccggaacagaataaacgcacgctcttggagagttttgagtggttctttcatcttgggggagaaaatatgtaatgggagaaccgtctgcttgagtactactgccgatgtgtgctatatatctggatacaaaggaagctttgttatgttgtgcagtaacattgtagtttaaatatatcgctctaccagtttgttt

SEQ ID NO: 14869 - protein, 149 aa, Panicum virgatum
  misc_feature: Ceres CLONE 1779256
  misc_feature: SWISSPROT Homolog: EC 6.1.1.9 Valine--tRNA ligase
MAATAYSVALLDGARLPAAPRSAALLPRRSACQLRLQDAPRLSLLRVKAASEDTSASADELIEDLKAKWDAVEDKPTVLLYGGGAIVALWLTSVVVGAINAVPLLPKIMELVGLGYTGWFVYRYLLFKESRKELASDIETLKKKITGTE

SEQ ID NO: 14870 - DNA, 684 bp, Panicum virgatum
  misc_feature: Ceres CLONE 1779257
  misc_feature: Encodes the peptide sequence at SEQ ID NO. 14871
gtcgccgccatctgcggctccctccgcaaggcctctttcaaccgcggcctcctccgcgccggtacgcctcccttcgcttcgctcctcctcccaatcattcattcacccacatcttcggatcaacccggccggcagccgcggaggtgtgcgacgactccatcccggggctgcgcgtccaccacctcgacatctccgacctgcccatcatcaacaccgacctcgagaccgacggcgccttcccgcccgccgtcgaggccttccgcgccaaggtctcccaggccgactgcttcctcttcggcgcgcccgagtacaactactccatcgcaacccccctgaagaatgcacttgactgggcatctagaggaaagaactgttgggcagacaaacctgctgcgattgtcagtgcaggaggtggctttggaggagggagatcacagtaccatctgcgccaggttggggtattcttggatcttcatttcatcaacaagccagaattattcgtccaagcatttcagcagccaccgaagtttgacagtgatggaaatctgattgacgatcaaatcagagagaggctgaagcaagtgctcttatctcttcaggccttcacactaaggctccagaaggactgaatcaactgaggaccattgcagtccgtgcttgcctgaagaagtgtttataattcct

SEQ ID NO: 14871 - protein, 208 aa, Panicum virgatum
  misc_feature: Ceres CLONE 1779257
  misc_feature (35)..(189): Pfam Name: FMN_red Pfam Description: NADPH-dependent FMN reductase
  misc_feature: SWISSPROT Homolog: EC 1.6.5.2 NAD(P)H dehydrogenase (quinone)
RRHLRLPPQGLFQPRPPPRRYASLRFAPPPNHSFTHIFGSTRPAAAEVCDDSIPGLRVHHLDISDLPIINTDLETDGAFPPAVEAFRAKVSQADCFLFGAPEYNYSIATPLKNALDWASRGKNCWADKPAAIVSAGGGFGGGRSQYHLRQVGVFLDLHFINKPELFVQAFQQPPKFDSDGNLIDDQIRERLKQVLLSLQAFTLRLQKD

SEQ ID NO: 14872 - DNA, 911 bp, Panicum virgatum
  misc_feature: Ceres CLONE 1779292
  misc_feature: Encodes the peptide sequence at SEQ ID NO. 14873
accctcgccgcggccgttggcgcagccgccctcctcgccgcttccctccgccgccgcgcgccgccgtccggccttcctgcccagctcgtcccctcctcccacatggcgggaaggaaccggagcttcgtgctgtggctgcacggcctcggcgactccggcccggccaacgagcccatccgcaactttttctccgccccggagttccgccttaccaagtggtccttcccctccgccccccgctcccccgtttcctgcaacaatggttttgtgatgccgtcgtggttcgatatccacgagctacccatgagcgctggttctccgcaagatgagagtggggttctgaaggctgtggaaaatgtgcacgccatgatagataaagaagtagccaatggcatccaccctgacaacatctttgtttgtggttttagccaaggaggtgctctgacattagctagtgtgttgctttatccgaagaagctaggtggaggagcagtcttcagcgggtgggtgccttttggttcatcagtcaccgagaggatttcacctgaagcaagaaagaccccaattctttggtcgcatggaatggctgacagaacagtattgtttgaagctggtcaagctggtccatcgtttttgcaaagcatcggtgttacctgtgaattcaaggcatatccagatcttggccattcgctttccaaagaagagctacttcatcttgagtcgtggatcaagagtcgtctaaatgcctctccagaaaaggacagttaacatttttttcgttcaagacaccaccacttcccccatcatactgtgtggctgatgccgtcatgtttaagttggattcggtcttcctgacttcgcctcatgcaacttattatttgagacttctcatgtatatcattgtgtcaacc

SEQ ID NO: 14873 - protein, 221 aa, Panicum virgatum
  misc_feature: Ceres CLONE 1779292
  misc_feature (1)..(213): Pfam Name: Abhydrolase_2 Pfam Description: Phospholipase/Carboxylesterase
  misc_feature: SWISSPROT Homolog: EC 3.1.1.1 Carboxylesterase
MAGRNRSFVLWLHGLGDSGPANEPIRNFFSAPEFRLTKWSFPSAPRSPVSCNNGFVMPSWFDIHELPMSAGSPQDESGVLKAVENVHAMIDKEVANGIHPDNIFVCGFSQGGALTLASVLLYPKKLGGGAVFSGWVPFGSSVTERISPEARKTPILWSHGMADRTVLFEAGQAGPSFLQSIGVTCEFKAYPDLGHSLSKEELLHLESWIKSRLNASPEKDS

SEQ ID NO: 14874 - DNA, 870 bp, Panicum virgatum
  misc_feature: Ceres CLONE 1779308
  misc_feature: Encodes the peptide sequence at SEQ ID NO. 14875
aaccaaacacccaccagcgaggcagcgagcagccgtatctccggtccacaatctatcctatcgatcgtcatggcggtttccctcccctccgtcctcctcgccgccgcctccctcctcgccgccgccgtgtacatccgcagctccgacacggttggcaccaccaccaccacgcacctccacttcttcatgcacgacgactacaccggcccgcgccccaccgccacacgggtcgtgtccggccgctccctcctgccaacgtcgtccagcgacggcagtgacagcaacgacaacgccaccgccactgatcggagcgtgctgacgacgtcgccgcggcagttcggggacgtggtggtgctgaacaacgcgctgacggaggggccggacgggggcagcgcgcgcgtcggcaccgcgcaggggttcgccgtgtgcgtgtcggagggcggcatcgtgtcgcacctgaccctgcacatggtcctggacgccggcgagcaccggggcagctccgtcatggcgaacggccggatcgacatggacgccgaggtgcgggagtcggtggtcatcggcggcaccggcaagttccggttcgcgcgcgggtacatgctcaccaggaactacgactacgacctcgcccgcggcggcattgtcaagatcgatgtcttcgtgcagcactagtgtagcagttagcagtagcaccggggaagggggaacattctcttgcacatggatagctctggttgatgatatgtgtgtgttgcatgcatgttgaataagttggtatatgcatgggccgggtgccttttgtttttaatttgcttcttgcatttgtacgtgtaccgtatatatacgtacctacagcggttttgagatgtc

SEQ ID NO: 14875 - protein, 200 aa, Panicum virgatum
  misc_feature: Ceres CLONE 1779308
  misc_feature (12)..(200): Pfam Name: Dirigent Pfam Description: Dirigent-like protein
MAVSLPSVLLAAASLLAAAVYIRSSDTVGTTTTTHLHFFMHDDYTGPRPTATRVVSGRSLLPTSSSDGSDSNDNATATDRSVLTTSPRQFGDVVVLNNALTEGPDGGSARVGTAQGFAVCVSEGGIVSHLTLHMVLDAGEHRGSSVMANGRIDMDAEVRESVVIGGTGKFRFARGYMLTRNYDYDLARGGIVKIDVFVQH

SEQ ID NO: 14876 - DNA, 659 bp, Panicum virgatum
  misc_feature: Ceres CLONE 1779312
  misc_feature: Encodes the peptide sequence at SEQ ID NO. 14877
gcctcccctcttctcccggcggcgctctagggttctatctagctccttctatccggcggcgcgcgcgcatcgacggatcccaccttccagcccataaggcggcggcgagacccgaggtaagggcgcgatggtgtctggctccggcgtgtgcgccaagcgcatcgtggtggacgcgcgccaccacatgcacggccgcctcgcctcgattatcgccaaggagctgctcaacggccagaaggttgtggtggtccgctgtgacgagatctgcatgtctggtggcctcgtccgccagaagatgaagtacctccgcttcctccgcaagaggatgaacaccaagccgtcccacgggcccatccacttccgcgccccagccaagatcctgtggcgcaccatccgcggtatgattccgcacaagaccaagaggggagaggctgcgctcgcgaggctcaagacgtacgagggcgtcccgccgccgtacgacaggaccaagcgcatggtcatccctgacgcgctcaaggttctgaggctgcagcctgggcacaagtactgcctcctcggcgagctctccaaagaggtcggatggaactaccatgacaccatcagggagctcgaggagaagaggaaggagaaggccaaggttgcctatgagaggaggaagc

SEQ ID NO: 14877 - protein, 177 aa, Panicum virgatum
  misc_feature: Ceres CLONE 1779312
  misc_feature (11)..(127): Pfam Name: Ribosomal_L13 Pfam Description: Ribosomal protein L13
  misc_feature: Useful for making plants with modulated nitrogen use efficiency
MVSGSGVCAKRIVVDARHHMHGRLASIIAKELLNGQKVVVVRCDEICMSGGLVRQKMKYLRFLRKRMNTKPSHGPIHFRAPAKILWRTIRGMIPHKTKRGEAALARLKTYEGVPPPYDRTKRMVIPDALKVLRLQPGHKYCLLGELSKEVGWNYHDTIRELEEKRKEKAKVAYERRK

SEQ ID NO: 14878 - DNA, 670 bp, Panicum virgatum
  misc_feature: Ceres CLONE 1779318
  misc_feature: Encodes the peptide sequence at SEQ ID NO. 14879
tagctgcaggatcggaaaccaaaggccctcctccatccagatccagctgcatgctcaattgctcatccaatccagcacatcatcttgatccacggtagattggtagatggggtctctgagaggaggaggaggcggcggcggcggcggcggcggcggcggcatggacgatgaggaggcgaggaatccgcagctggtggatgcggacgaggcatgcgccctcctcagcatggccacgcaccagtatctcgatgtcaggatgtgggaggactttgacaagggccatgtcgccggtgctcggaatgttccctactacctctccgtcactccacatgggaaggagaagaatccccactttgtggagcaggtgtccgcgctctatcccaaggaccaacacctgattgtgggctgccgctccggcattcggtccaagctcgccgctgcagacctcctcagcgcgggcttcaagaatgtgaggaacctagaaggcgggtatctctccttggtccgaagcgccaaccagcagcaccaccaccagcaggctgctgcttaacccatccattaattatcctagtagtattatttaaccatccatggactacaaaatactactactctgtatgtataagacgatgggcatacatacatacaacagtatatattttcctcttgg

SEQ ID NO: 14879 - protein, 147 aa, Panicum virgatum
  misc_feature: Ceres CLONE 1779318
  misc_feature (31)..(135): Pfam Name: Rhodanese Pfam Description: Rhodanese-like domain
  misc_feature: SWISSPROT Homolog: EC 2.8.1.1 Thiosulfate sulfurtransferase
MGSLRGGGGGGGGGGGGGMDDEEARNPQLVDADEACALLSMATHQYLDVRMWEDFDKGHVAGARNVPYYLSVTPHGKEKNPHFVEQVSALYPKDQHLIVGCRSGIRSKLAAADLLSAGFKNVRNLEGGYLSLVRSANQQHHHQQAAA

SEQ ID NO: 14880 - DNA, 467 bp, Panicum virgatum
  misc_feature: Ceres CLONE 1779323
  misc_feature: Encodes the peptide sequence at SEQ ID NO. 14881
ggcactgtaaacagaatcaaggttaaagatatatccatccagtctcgttatgcgaggggagtaattctgatgaggctggagcatgctggaaagacacagtcagcttcactgatatctgcagcggcagcagaagtcgctgaagattaatcttgctcccaagaggcaagtagttagtctaaagttaaagccctgggtgtgcaccgcatggcaatacattgagcatgcatttgaggttaatcctgtcaccagtaggattcagtgattcagttagttcccacgccaaaggctggcgcagttagtagctgatgatttggtggatagatctcctgtggccattaacctgtcaagagatgtaggttttgccaacacagtattcatgcgatgtgtggtggatgtaaaatggcacgttggcttgcaaaattttacccctctacggtatttcctcttggattggccttggctccgat

SEQ ID NO: 14881 - protein, 48 aa, Panicum virgatum
  misc_feature: Ceres CLONE 1779323
  misc_feature: SWISSPROT Homolog: EC 5.99.1.3 DNA topoisomerase (ATP-hydrolyzing)
GTVNRIKVKDISIQSRYARGVILMRLEHAGKTQSASLISAAAAEVAED

SEQ ID NO: 14882 - DNA, 574 bp, Panicum virgatum
  misc_feature: Ceres CLONE 1779364
  misc_feature: Encodes the peptide sequence at SEQ ID NO. 14883
taaatatataactattgccaggcttgggccacgacaggctattgagctccaggcacatgctgttaagggagttgggaaagttcatgcccagtggtctccagttgctacggcctggcacagaatgctcccacaggttgtttttcctgaacaaattgaaggtgatgaggccgaggagctcgcgaagaattgcccacttaatgtttttgatattgaacacctacgcaaaggcggaaagagggcagttgtggcaaagccaagggcttgcacactctggagagaatgcgtcaggggaccatctgggggaaaaatccaactaaggcgtgttacacaccatttcatatataccatcaagtcgacggcagctctgcccccagacgtgctattcacataagccttgaacattttggaaaaaaaatgcgagaggtccatatctgagctatcctgagagtcaggcaggcacttgcgacaacggagcaaaatagccgactccgccatatgcgttattttgccggatactaatgcgcgatccaacatttttgtgatggttgtttggctcaagaaatgtgaactgaat

SEQ ID NO: 14883 - protein, 129 aa, Panicum virgatum
  misc_feature: Ceres CLONE 1779364
  misc_feature: SWISSPROT Homolog: EC 2.7.7.6 DNA-directed RNA polymerase
KYITIARLGPRQAIELQAHAVKGVGKVHAQWSPVATAWHRMLPQVVFPEQIEGDEAEELAKNCPLNVFDIEHLRKGGKRAVVAKPRACTLWRECVRGPSGGKIQLRRVTHHFIYTIKSTAALPPDVLFT

SEQ ID NO: 14884 - DNA, 668 bp, Panicum virgatum
  misc_feature: Ceres CLONE 1779372
  misc_feature: Encodes the peptide sequence at SEQ ID NO. 14885
agatccgtcgccgccctgcgcccgtctccgccgtccgccggccgcgccgcccgcctctccccgccccttgctcgctcccgcccgccgcccacgcgcctcctcgcgctcgtgctgggcacggcgccgcccgtctccccggcccgcgccgcccctccgcggcgtctgcgtgccacctcgcgctcgcgccgccgtccgtcccggaagagaaatggaactgggtgataaggcagttggttttctgctgacgctaacgagcttatccatcttcacctattatacattctgggtcattatcttgccgttcgttgacagcgaccactttgtgcacaagtacttcctgcctcaagagtatgcgattttgataccagtgattgccggcgtggttctcctttgtttcttgagcatctttgtgggtctcgtgatgcttaagtcaaagaaaaagaagaagaccacttgattgggtttgccatgtacattgtagtactcttcacttactatgatgattaaatccatgaattcagagcccatgtaattgctagaagctcggtaaacagttccatcatattgaaggcgctcactttgtaactcagatctctgttttcatttgtgattctcagatcaagttaatcgaaagatgaccactcaggttgtcggtttttctttattgt

SEQ ID NO: 14885 - protein, 82 aa, Panicum virgatum
  misc_feature: Ceres CLONE 1779372
  misc_feature (1)..(80): Pfam Name: DPM2 Pfam Description: Dolichol phosphate-mannose biosynthesis regulatory protein (DPM2)
MELGDKAVGFLLTLTSLSIFTYYTFWVIILPFVDSDHFVHKYFLPQEYAILIPVIAGVVLLCFLSIFVGLVMLKSKKKKKTT

SEQ ID NO: 14886 - DNA, 883 bp, Panicum virgatum
  misc_feature: Ceres CLONE 1779373
  misc_feature: Encodes the peptide sequence at SEQ ID NO. 14887
accccccagtcccaagaacactcgatcgagctgagcttggtcgccggcgtgcaagatccatggcgaggctcccgcgattgcccgccgcggcggcaatcgccgtggccgtcctggcggccgccgcgctgccggccgtgcgggccgcgtcgccggcggcggacgacgcgcccgagtaccggaaccacaccgtgggcggcgccgacggctggttcttcgatgccaaggccaacgccacctccgggaactactccggatgggccaacggcgagacattctacctcggcgacttcctcatattcaagacgaacgacaactcgtcggtggtgcacaccaccaacgccacaacctacgacctctgcgaccccgccgacgacctgtctccgactacctacatctacggcggcggcggcggcggcggtggcggcggcctcgagcagaacaacacgatcgcggtgcctctcgtccaggagggctccaactacttcttctccgacgccgacggcggcgcgcagtgccagaaggggatgcgcttcgagagcaaggtcgagcacggccagggcctgccgccgtcgctgaagaacccgcccccggcgcccaaggagcgcgtcctcgcgccgcccccggccgggacggccttctcgggcaccggcggggtcgagcctggggacggcgccggcgacaacggcggcgagggcaggagcggtgcatgcagagtggcggcggcgggtggccggttctttggggcggctgtcgctgtggcactggcggctctggttgctgcctgagtggacttggtggggtcgtgatgtcagagataggagttctgccattggttgtttggatttctgtatttaattttatttatatcaccttcttttggggc

SEQ ID NO: 14887 - protein, 241 aa, Panicum virgatum
  misc_feature: Ceres CLONE 1779373
  misc_feature (50)..(156): Pfam Name: Cu_bind_like Pfam Description: Plastocyanin-like domain
MARLPRLPAAAAIAVAVLAAAALPAVRAASPAADDAPEYRNHTVGGADGWFFDAKANATSGNYSGWANGETFYLGDFLIFKTNDNSSVVHTTNATTYDLCDPADDLSPTTYIYGGGGGGGGGGLEQNNTIAVPLVQEGSNYFFSDADGGAQCQKGMRFESKVEHGQGLPPSLKNPPPAPKERVLAPPPAGTAFSGTGGVEPGDGAGDNGGEGRSGACRVAAAGGRFFGAAVAVALAALVAA

SEQ ID NO: 14888 - DNA, 541 bp, Panicum virgatum
  misc_feature: Ceres CLONE 1779389
  misc_feature: Encodes the peptide sequence at SEQ ID NO. 14889
gtttcgcccgccgccgccgcttccgtcttcttccgccgccgccatgccgtcccacaagaccttccggatcaagaagaagctggccaagaagcagcgccagaaccgccccatcccctactggatccgcatgcgcactgacaacactatcaggtacaacgcgaagcgcaggcactggcgccgcaccaagctcggattctgagcgggggaagagatgccgggcaccgatgcttggggaaactggggcttacgagccagcctctggacgcttccatgtttccgcatgctatgaagctcttgtttagattttgcttgtgttaaatttatcttatccgttgttcctgtagcactgagaatgccatgttttgctgatggttgaagaacatcttttataattatgcagaagctatcttgatccgcagtgcggtaatcagttggtccagattgcttttttgcatttcagtatttcgatttacatgtcttgtgtagatgcttgttcatgttcattgatggcttaattgctatgattttagcagttgtttat

SEQ ID NO: 14889 - protein, 51 aa, Panicum virgatum; identical to SEQ ID NO: 9830
  misc_feature: Ceres CLONE 1779389
  misc_feature (9)..(51): Pfam Name: Ribosomal_L39 Pfam Description: Ribosomal L39 protein

SEQ ID NO: 14890 - DNA, 1034 bp, Panicum virgatum
  misc_feature: Ceres CLONE 1779404
  misc_feature: Encodes the peptide sequence at SEQ ID NO. 14891
gtcgccgacctacacccttctcggtcacggccggcgccgcaaagccgcagcctagtgccggggaggggagaaggggattaggaggaagcaatggggaagcgccggcgcgcagccgtgccggcggtggaggagctgatttccccggtgaacagcctggacgacggctgcctcgtgcacatcttcagcttcctcagcccgattccagataggtataacaccgccctcgtttgccacagatggcgcttccttgcatgccatcctcggctatggttgcgtgttgagaggccaatcagagatgtgatggagcctggagtttatccgaatcttgaggccgctgtttctgctgctaggcctggtgacaccattcttattgcggctggtggtactcatattgcatgtaacatccaaataaagaagcctatttgcatcattggcgggggtgaacttcccgatgacactgtattaacctgttcacgtggctccgacaatgcactggagttcctatcaacatgcaagattgcaaatttgactattagagcagagcttggatgctgcttgctgcatcgaagcggtaaattgactattcaggagtgtttgctgcagtgtgagcagaaccctttggactatctgtcctttccaataatcagcacagcaatagagtataattcattcccatccctcaaggagcaagggcatggtgtaaccgttgttcgcacccggattgaagggggtgcgaaggctgtcaggacgaacggaacgctcacactgcagcatgtgcgggccatatattcccggagttctgttttcttttggttcgaagtaggagaaaagtaaataatgctgtacactagcaataagctgttgaattcctgtatgtgtcatcctagtctggtaaactcacccttgtattcctctttgctgtaacttatggtaactgccttgatgttcgtttccacaagaaacttgttgctgtttggaagtttggtgtagtgtacaaattcacagttgtcattgattaaattttccttagtttc

SEQ ID NO: 14891 - protein, 247 aa, Panicum virgatum
  misc_feature: Ceres CLONE 1779404
  misc_feature (17)..(65): Pfam Name: F-box Pfam Description: F-box domain
MGKRRRAAVPAVEELISPVNSLDDGCLVHIFSFLSPIPDRYNTALVCHRWRFLACHPRLWLRVERPIRDVMEPGVYPNLEAAVSAARPGDTILIAAGGTHIACNIQIKKPICIIGGGELPDDTVLTCSRGSDNALEFLSTCKIANLTIRAELGCCLLHRSGKLTIQECLLQCEQNPLDYLSFPIISTAIEYNSFPSLKEQGHGVTVVRTRIEGGAKAVRTNGTLTLQHVRAIYSRSSVFFWFEVGEK

SEQ ID NO: 14892 - DNA, 585 bp, Panicum virgatum
  misc_feature: Ceres CLONE 1779406
  misc_feature: Encodes the peptide sequence at SEQ ID NO. 14893
accacgctccgttcgttgcctcgccgccgccgtctgctgctgcgtccccggtcctccggcagagcggctcttgctctcttcaccacaggtagcagggaaaccggtgaccatggtgatccctccaccagaaagggcagctagagtcacccgctttctgaagccctacctgttgaggatgcatttctcaaacaagtatgtatccgctcaggtcatccataccccaacatcgactgtcgcatgttcagcaagctcgcaggagaagctcctgagaccaaacatggaatcgacccgtgatgtttcagctgcggcgaagattggaaagttgcttggtgagcgccttctgctcaagggaatacctgcagtgtccatccatatgaagagagaacagaagtaccatgggaaagtcaaggctgtaatagattctgttagagaagctggagtcaaattgttgtgattgttatgttgaaattattgatctcatttagcatttgacgctcattgagctgtgtttctaaagtttgctattttgtaatatggtgctaagtgggacatttctaagtcaataaaaggacttttgtattgctg

SEQ ID NO: 14893 - protein, 114 aa, Panicum virgatum
  misc_feature: Ceres CLONE 1779406
  misc_feature (4)..(113): Pfam Name: Ribosomal_L18p Pfam Description: Ribosomal L18p/L5e family
MVIPPPERAARVTRFLKPYLLRMHFSNKYVSAQVIHTPTSTVACSASSQEKLLRPNMESTRDVSAAAKIGKLLGERLLLKGIPAVSIHMKREQKYHGKVKAVIDSVREAGVKLL

SEQ ID NO: 14894 - DNA, 640 bp, Panicum virgatum
  misc_feature: Ceres CLONE 1779460
  misc_feature: Encodes the peptide sequence at SEQ ID NO. 14895
ggattcccgagggagaccgccggcgccgccgacccacccgacccgacccctccctccctcgctgacctccgccgtcgccggaggcgaagcgaccgcaaaggaggctgcagaagaattaggtggtgaaatcactcagagaactgtgcaatagtttcaatggctgctaccaagcttcaggccttttggaaccatcccgctggccccaaaaccattcatttctgggcgccaacgttcaaatggggtatcagcattgccaacattgctgactttgctaagccacctgaaaagatatcttatcctcagcaaattgctgttacttgtactggactcatttggtcaaggtacagcttggttatcaaaccgaaaaactggaaccttttcagcgttaatgttgcaatggctggtacgggcctgtatcaactttcgcggaagataaggcaagattacttgtctggtgagaaggaagctgctccacaactggaagcataatgacaacaacagaccagaataccttgctatatgttccagtttcccgggaggctgggactgcaagggtctctttcaatccaggacatgaatcttttgctttatgttttctcgttctaaagtcatgagcagattaatgtgaaaattttctgcc

SEQ ID NO: 14895 - protein, 110 aa, Panicum virgatum
  misc_feature: Ceres CLONE 1779460
  misc_feature: Useful for making plants with modulated biomass
  misc_feature: Useful for making plants with modulated flowering time
MAATKLQAFWNHPAGPKTIHFWAPTFKWGISIANIADFAKPPEKISYPQQIAVTCTGLIWSRYSLVIKPKNWNLFSVNVAMAGTGLYQLSRKIRQDYLSGEKEAAPQLEA

SEQ ID NO: 14896 - DNA, 861 bp, Panicum virgatum
  misc_feature: Ceres CLONE 1779500
  misc_feature: Encodes the peptide sequence at SEQ ID NO. 14897
caacccatttcctctcccttcgctcccccagcggccgccgctcgccacgcggtcggcccgtgcgccgcgccgccgccctccacgctcccctgcccagctgcaggtcgagtccggctggtgcggcagcaccctcccttcccacgacttctctgttctttctctcggcctctgtcttccttcctagcggcgacgaccgggcgagttgcgctgcccgttgttcgtcaagggacgggcacttcgccggcgacgaatatcagacagggacagtagatcagaaataagatcaaggggtgacagggatattgacaatcaacaaatccttcaagcagaagagaaggaagtcgtgtcatctgttgccacagtgttatctgacctctgcggtcctggagaatggatgcccatggcaaaactccatacagagcttcttgaacagtttggcaacgtgtggcaccccagcagggtccgaaagtacctaacaacagatgactggtcaccaacggagacgaagggcaggccttggtttggccttctggccctgctcagaaagtacccagagcattttgtcatcaacacaagatcgaaaggcagagtgacttcggagtttgtttcgctggtctccttgctctcctagaggggaaacgaggggggctagctgtcctgccgaggaaataacaggcgtttcagtctgttcagaagggtaggaggtgtctctctcatttgcctcttctgttttgaaccctacgtatggtatcaactgtgtttgaacagccgtaatgactggatcattatcatctctgtactgttgacttgtatatgtactatggaagcatgagttttaaccaatgctagcaacttggcacc

SEQ ID NO: 14897 - protein, 78 aa, Panicum virgatum
  misc_feature: Ceres CLONE 1779500
  misc_feature: Useful for making plants with altered alkaloid content
  misc_feature: Useful for making plants with altered lignin content
MPMAKLHTELLEQFGNVWHPSRVRKYLTTDDWSPTETKGRPWFGLLALLRKYPEHFVINTRSKGRVTSEFVSLVSLLS

SEQ ID NO: 14898 - DNA, 590 bp, Panicum virgatum
  misc_feature: Ceres CLONE 1779505
  misc_feature: Encodes the peptide sequence at SEQ ID NO. 14899
acccacccaaggcacccacacacatctcggcggcgtgcgcgaggcgatcagattcagatcggagcaccccgtcccgacgaggtaggaggaaggccggccggcgacccgggggaaggaggatggggaagactccggtgaggatgaaggcggtggtgtacgcgctgtcgccgttccagcagaaggtgatgccggggctgtggaaggacatcaccaccaagatccaccacaaggtcaccgagaactggatctccgccacgctcctcctcggccccgtcgtcggcacctaccaatatgcgatgtggtacaaggagcaggagaagctatcccacagatactaaatgagaggtcgtccaagttgactgccacagcagctggatttttcgtgatggattatatagcctccaaggatgattataatttgttggatgaattttggttgtactccttttcaccttcccatgcatatacgacatccgcgccttgcaaacttgtttgaggcttgctacatttggtggcatcttctgtcactgatgatgtcgttgaataaatcaaattaactgtctgtttcatttgatttcccctttttggtg

SEQ ID NO: 14899 - protein, 72 aa, Panicum virgatum; identical to SEQ ID NO: 12324
  misc_feature: Ceres CLONE 1779505
  misc_feature: Useful for making plants with modulated nitrogen use efficiency

SEQ ID NO: 14900 - DNA, 767 bp, Panicum virgatum
  misc_feature: Ceres CLONE 1779573
  misc_feature: Encodes the peptide sequence at SEQ ID NO. 14901
aaaaaccttccgtgcttcactccatcgccatcgccatcgccagatcgccactcccaagtctccaagagctcccaatcgtcacgccatggccagcatggtcaccaccatggctgccatagcctctttcccggctccaagaagcctccagcaggccccggccccgctgcaactccgcccgaacgccgtgtcgttcgccgcacggccggttcgcgcgcgccgccggctggtggccgtggcggccagctcgccggccacgccgccggacctcgccaacaaggtgtccgagagcatcaagcaggcgcaggagacgtgcgcggacgacccggtgagcggcgagtgcgtggcggcgtgggacgaggtggaggagctcagcgcggccgccagccacgcgcgggaccggcagaagggcgccgacccgctcgaggagttctgcaaggacaaccccgagaccgacgagtgccgcatgtatgaggactgagccgcgcgaggctcgtcgtgccatccgccatcgctgtcagcctgttcacctgatctggctgagcttagctagagtggcatgatggcaacatgcgccaatgtatgatggacctactccttcgtttcatctggcttggtttgcaataaatcgaggtttgcttattggttttttatttacaagaaatatttaggagctcctactgtaatcccaaggtaaagatgtaatcattaggaatatgtttgctggtgtgcttctggaacatgattttactagaagtatatgtgatatt

SEQ ID NO: 14901 - protein, 130 aa, Panicum virgatum
  misc_feature: Ceres CLONE 1779573
  misc_feature (61)..(130): Pfam Name: CP12 Pfam Description: CP12 domain
  misc_feature: SWISSPROT Homolog: EC 1.2.1.13 Glyceraldehyde-3-phosphate dehydrogenase (NADP(+)) (phosphorylating)
MASMVTTMAAIASFPAPRSLQQAPAPLQLRPNAVSFAARPVRARRRLVAVAASSPATPPDLANKVSESIKQAQETCADDPVSGECVAAWDEVEELSAAASHARDRQKGADPLEEFCKDNPETDECRMYED

SEQ ID NO: 14902 - DNA, 601 bp, Panicum virgatum
  misc_feature: Ceres CLONE 1779590
  misc_feature: Encodes the peptide sequence at SEQ ID NO. 14903
acaagtcgttgcatttccctacaagctcacagcgcaaagccagctcgtgcaaacctacctctgttagcttcacaccttcacagcgtcatggcctccaagatcttgtacgtcgccgtcgtcgcggccgtcgccgtgtcctccttcgccggcgtcgccttcgcggccgacgccccggcgccgagccccacctccggcgcggcggccgtctcctcgtcgctcgtggccgccgtcctctgcccggccgtggcgctcctcctcggcaacctgcgccactgagccctcggcggatcgtcgtggacggaagctgctgccaatacatgcttgccatgcgtcgcatgatatcttttacctgcttgctttgtttcctgaccagtgtttcttactaccgatcgaaccgcatggaattttattcattcagagattcagaccatttctgtatcgaaccgcatggaattttatttcagagattcagaccatttctgtagcagcgttgattccgtgtgtcaattatcatgtgtgcccagattctgatgacatttttcgagcatttgagagactgaattgtcgtctgatgatgaggaaatgtgttggtttctttgtg

SEQ ID NO: 14903 - protein, 62 aa, Panicum virgatum
  misc_feature: Ceres CLONE 1779590
  misc_feature: Useful for making plants with altered carbohydrate content
MASKILYVAVVAAVAVSSFAGVAFAADAPAPSPTSGAAAVSSSLVAAVLCPAVALLLGNLRH

SEQ ID NO: 14904 - DNA, 866 bp, Panicum virgatum
  misc_feature: Ceres CLONE 1779660
  misc_feature: Encodes the peptide sequence at SEQ ID NO. 14905
accgtgacagatgctgctgcgctcacgtgccgtcggcctcctcccaccctgcctcgctccgcctcctcgcttcattcgccgcctgccgcacctgcgcgccgtctcctcctccccgtttcagccgccgcctcggatggaggccacctacaagttcgggccctacaagatcgacgccagggaggtcttccacgccacgcccctctcatacgccatggtcaacctccgccccctcctccctggtcatgttcttgtgtgccccaagtgtgaagtgaaaagatttgccgatctaagttctgatgagacaagtgacctatgagttactgcaaaggaagttggtgtacgtcttgagcagtatcataaagcatcttcacttacctttgctattcaggatggtcctcacgctggccaaacagttccacatgtccacattcatgtcatcccgaggaagaaaggggattttgataaaaatgatgaaatatatgatgcgattgatgtgaaagagaaagaattgaaggagaagcttgacctggacgttgagaggaaagatagaagcatggaagaaatggctcatgaggccaatgagtaccgtgctcttttctcctagaattaactcttagtatagtggttagtttctaagttgagctgactcttttctataaataactatgtttttaaagcggtaaggcgaggcgaggcgatccaccaccgccttatcgcctaggcgacgcctaggcgggctaaggcgagaccttaagcaaggcgagccgccactgccttgtcgcctaggcaatgccttgaaaacagagataaataagccttgctgcttcttgttctccattgttgcaatccagatatcatttaactgc

SEQ ID NO: 14905 - protein, 60 aa, Panicum virgatum
  misc_feature: Ceres CLONE 1779660
  misc_feature: SWISSPROT Homolog: EC 3.6.1.29 Bis(5'-adenosyl)-triphosphatase
MEATYKFGPYKIDAREVFHATPLSYAMVNLRPLLPGHVLVCPKCEVKRFADLSSDETSDL

SEQ ID NO: 14906 - DNA, 647 bp, Panicum virgatum
  misc_feature: Ceres CLONE 1779693
  misc_feature: Encodes the peptide sequence at SEQ ID NO. 14907
aacagctctagaagaaaaggccacggacctcagcagcctccgcgcgccggccagcagcttctccggcgtccgcgccgccgcggcacccgcggcgcccgccatcgtcgccatgcccgccgccaaggagtaggttgcccgcggcgccaggctgcccgccaagacgaccaacaacgagaagctcgtcacgaccgaaggcgaggtggagctgcaggtgcccgacgacgtgtacgtcctgaacgaggacgaggaggaggggatcgaccttccctactcctgccgcgccgggtcctgctcctcaagcgccagagaggacgactgcggctccgtcgacgaatccgaccagagcttaatcgacgaaaaccagatctccagcggctgggtgctcacctgccacgcctaccccacctccgacgtcaacatcaagacccacaaggaggaggagctcaccgattaatatacaattaatgaaactcgctccatcgtgcgtctatatatatcatcatcatctagtatatctgaatctgcctgccttgcaagagatgttgtaatcgatcgaatggacgaagccggccgccggagaaattacttcctaaatttaatttgtatcatccatcatgcatgtcggtcaaccaagctaaagatcgata

SEQ ID NO: 14907 - protein, 42 aa, Panicum virgatum
  misc_feature: Ceres CLONE 1779693
  misc_feature: The sequence is a functional homolog of SEQ ID NO 158 in the 10/714,887 US patent application
  misc_feature: The sequence is a functional homolog of SEQ ID NO 158 in the 11/435,388 US patent application
TALEEKATDLSSLRAPASSFSGVRAAAAPAAPAIVAMPAAKE

SEQ ID NO: 14908 - DNA, 879 bp, Panicum virgatum
  misc_feature: Ceres CLONE 1779701
  misc_feature: Encodes the peptide sequence at SEQ ID NO. 14909
gaccacaaatccgccggcgcatcgcaaccccacccccacaacccgctccggccgccaccgcccgatcgatcgcccggagatcgccggaccccgccgcgaatctaacccctgctgcgttcgtagccttcgacgacgatgtcgggagccggagaggaggacaagaagccggcggagggcggcgcccacatcaatctcaaggtcaagggacaggatggcaatgaggtgttcttccgtatcaagaggtccacccagctgaagaagctgatgaacgcctattgtgaccgccagtctgtggacatgaatgccattgcattcctttttgatggccgcaggcttcgcggtgagcagaccccagatgagctggagatggaggacggcgatgagattaacgccatgcttcaccagaccggaggctacatgcctagtgtttagaaagcccttgtcgcagccttgttttgctgcgctgtgcgctctgccttcagtagtaaactaaagaagtcatgaaggaacttgtgaggctctggccctctgtgtgccattgctgaaggacatcggtagtcttgtgtttagtaagatttggtactttggcgtgtcatgactcgtttatctatcccctaatatatcctcccctgtatgtactcccaatgatcgcccatggtttgtttatcctgcttgaagtgagcattgctttgctgacctggagctgggggtcatggttagttttgtgttgctgaggtgccggaaaacgtgcgctgcacgtgtcaccactatcatttcgatgtaataagcctgtgatagcctgtgatcaccatgagcaggccatggggatatcatggcttttatatctttatatatatattgtttgcatctctgccgccg

SEQ ID NO: 14909 - protein, 98 aa, Panicum virgatum
  misc_feature: Ceres CLONE 1779701
  misc_feature (21)..(91): Pfam Name: ubiquitin Pfam Description: Ubiquitin family
MSGAGEEDKKPAEGGAHINLKVKGQDGNEVFFRIKRSTQLKKLMNAYCDRQSVDMNAIAFLFDGRRLRGEQTPDELEMEDGDEINAMLHQTGGYMPSV

SEQ ID NO: 14910 - DNA, 909 bp, Panicum virgatum
  misc_feature: Ceres CLONE 1779709
  misc_feature: Encodes the peptide sequence at SEQ ID NO. 14911
agtagatttccaccgcctcccgtcgttcccgacttaccgccaccgccgctgctgcgccgcctctccaggtctcgctcgccgaccgactccctcacaaggactcttcagggaattctgctccgcccctgatccttggaggagaggagatgtcggactccgaggagcaccacttcgagtcgaaggccgacgccggcgcgtccaagacctacccacagcaggccggcaccgtccgcaagaacggctacctcgtcgtcaagaaccgcccctgcaaggttgtggaggtttcaacctctaaaactgggaagcatggtcatgccaagtgccactttgtcgctattgacatcttcaatggcaaaaagcttgaagatattgtcccctcttcgcacaactgtgatgttcctcatgtaaatcgcactgaataccagctcattgatatatctgaggatggatttgtgagtcttctgactgaaaatggtaacaccaaagatgacctgaggctcccaactgacgacaacctgcttagtcagatcaaggatggctttgctgaaggaaaggacctggtggtgacggtcatgtctgccatgggagaggagcaaatctgcgcgctaaaggacattggcccaaggaactaatctcgcgccatatataggtcacatgtctgctgggtttcggtcaaggattttttcttggggggccttttgtgtattaaggagcacggatcactgatgatacacatagttgcaaccaataggaggcaaatattttttgttcagtttttgctcttgccttgctctttcgttggtatgcagccgtgtctgccgctatcagactcagagtggtattcttgtacggcatctcatctggaccacgctgttaactatttatcctgattcctgaggtcgcttttgc

SEQ ID NO: 14911 - protein, 161 aa, Panicum virgatum
  misc_feature: Ceres CLONE 1779709
  misc_feature (86)..(155): Pfam Name: eIF-5a Pfam Description: Eukaryotic initiation factor 5A hypusine, DNA-binding OB fold
  misc_feature (30)..(64): Pfam Name: KOW Pfam Description: KOW motif
MSDSEEHHFESKADAGASKTYPQQAGTVRKNGYLVVKNRPCKVVEVSTSKTGKHGHAKCHFVAIDIFNGKKLEDIVPSSHNCDVPHVNRTEYQLIDISEDGFVSLLTENGNTKDDLRLPTDDNLLSQIKDGFAEGKDLVVTVMSAMGEEQICALKDIGPRN

SEQ ID NO: 14912 - DNA, 673 bp, Panicum virgatum
  misc_feature: Ceres CLONE 1779727
  misc_feature: Encodes the peptide sequence at SEQ ID NO. 14913
tggcgtgacgctcgatccacctgcagagaggcctcatctacaactaaattttgccactacagcgcactgcttgttcttccccatacgagcccacgccgtaaagcaaggcagcatgtccaagacaaccgatgtctttggggagccccagccagggtggtactggatttattacaacatgaacaatcctcgcgacttagaaaccgctctatcgaaagcctacccggtggtgctgatgttctgggcggtctggaacgagccgtgcaaggtcatgttgaaaccctacagggccatggccttggctaaaaaggaccgggccgtgttctgccggctagacgtcgacaagttcaaaggcgttgcggagaagtacagggtggaggccctgccgacgttcgtgctgatcaggaacggcgaggaggagagcagggtcgtcggccccaaggtggacgagctcaccacggccatccagaacagcatatgatctgatcagatatgatcttccatgcatcgaggacagggaacgatcggtccagaacagcatatgatctgatcagatatgatcctctcccgtcccatctgtttgttgtacacagacgacatagacatgcaaagaccgcacccatagttgtatgattatattttctgtaacaaataaactcttgtaggttactagatc

SEQ ID NO: 14913 - protein, 121 aa, Panicum virgatum
  misc_feature: Ceres CLONE 1779727
  misc_feature (23)..(119): Pfam Name: Thioredoxin Pfam Description: Thioredoxin
  misc_feature: SWISSPROT Homolog: EC 1.8.1.9 Thioredoxin-disulfide reductase
MSKTTDVFGEPQPGWYWIYYNMNNPRDLETALSKAYPVVLMFWAVWNEPCKVMLKPYRAMALAKKDRAVFCRLDVDKFKGVAEKYRVEALPTFVLIRNGEEESRVVGPKVDELTTAIQNSI

SEQ ID NO: 14914 - DNA, 933 bp, Panicum virgatum
  misc_feature: Ceres CLONE 1779731
  misc_feature: Encodes the peptide sequence at SEQ ID NO. 14915
cattcccatcccaccaccgcctccctcctctctcccattgcgttgcgcccggcccattccttcatccccaccggcaccggcagcgcaagaagaagaagatgaagctctccgtccagtccctggccaggaagctctccctcccgtccccgaagcggtcctggagtagcggcagcaagaaggacggcagcgggaagcgctccctgtcgcgcagcgaggcgccgtccttcgcgtcggcgtcctcctcctccgacgacgacacgctcgcgcgctcctccacgccgcggtccgtgctctcgctgtcccccgccgagatcccgcgccgggagctggaggccgtgctgcggcgcctcggccacggggagccctccgacgacgagctggacgccgtggccgccatggccgcgcagccgcccgcgcccggcggggaggacgacctcatggaggcgttccgggtcttcgacgccgacggcgacggccgcatcaccgccgaggagctccgcgccgtcatggaggccatcctcggcggcggcgccgagggctgcagcctcgacgactgccgccgcatgatcggcggcgtcgacgccgacggcgacggcttcgtcggcttccaggacttcgcgcgcatgatgatgaacgccaccaccgccccaacgacaaccttcttgttgtgaacttgtgaacctcacctgaccaaacaagattggccccagccctgatgcgcgctcagagtatcatcatcaatctgctccgcgagatcattttccttttgggcgcgcaggatgataggctgctctgctactactagtagtaggattaagagaaagcgcttgcttgctaatccatgcacgattagccgtgcatgcaagctcgttgtaaaattatttgtcgcgagagagtatgttataacggcaaggcgaatgcttggttctttcg

SEQ ID NO: 14915 - protein, 190 aa, Panicum virgatum
  misc_feature: Ceres CLONE 1779731
  misc_feature (112)..(140): Pfam Name: efhand Pfam Description: EF hand
  misc_feature (152)..(180): Pfam Name: efhand Pfam Description: EF hand
MKLSVQSLARKLSLPSPKRSWSSGSKKDGSGKRSLSRSEAPSFASASSSSDDDTLARSSTPRSVLSLSPAEIPRRELEAVLRRLGHGEPSDDELDAVAAMAAQPPAPGGEDDLMEAFRVFDADGDGRITAEELRAVMEAILGGGAEGCSLDDCRRMIGGVDADGDGFVGFQDFARMMMNATTAPTTTFLL

SEQ ID NO: 14916 - DNA, 774 bp, Panicum virgatum
  misc_feature: Ceres CLONE 1779735
  misc_feature: Encodes the peptide sequence at SEQ ID NO. 14917
aatggggccaaatggccatctataacccgcggcgcactgcgcttcatcgtcctctcctcccctcccccctgccgtgcaccctcgctttccacaacaccaatccgcgaagcgcgaaccctactccgcgccgccgccgccgccatgagccgccaacctgaggttttgtgggctcagcgctccgagaagatttacttgactatctcattgccagatgcaaaagatgttgagctaaagactgaacctaagggcctcgttactttctcagctgttgcccatggggaaccttttagcttcactttggagctctttgattccatactgccagagggaagtaaaacaaagacaaagatgggcttgcgaaacataatctgttcaatccagaaggaaaagaaaggttggtggaagcgcttgctgaagtcagaggaaaagcatccatacatcaaagttgactggaacaaatggtgtgatgaggatgaagagtctgaagcctcaggggattcggatgatgactttgatggggccaatgaagcagatgaaagtgatgaagatgacgggatgctttgtgagtgcccttctagtgctaaatttcctctctcgctctccctcacttcttgatagagtaccagagggttattaatgtgaagtctttccttaagggaacctacccactatgctctaggtgtaactgcacgtttcgctcatgacaaacataagctcacttgaattttgtttgggtacagacctttttcagagttaccagttttctttttattc

SEQ ID NO: 14917 - protein, 157 aa, Panicum virgatum
  misc_feature: Ceres CLONE 1779735
  misc_feature (5)..(81): Pfam Name: CS Pfam Description: CS domain
  misc_feature: SWISSPROT Homolog: EC 5.3.99.3 Prostaglandin-E synthase
MSRQPEVLWAQRSEKIYLTISLPDAKDVELKTEPKGLVTFSAVAHGEPFSFTLELFDSILPEGSKTKTKMGLRNIICSIQKEKKGWWKRLLKSEEKHPYIKVDWNKWCDEDEESEASGDSDDDFDGANEADESDEDDGMLCECPSSAKFPLSLSLTS

SEQ ID NO: 14918 - DNA, 998 bp, Panicum virgatum
  misc_feature: Ceres CLONE 1779742
  misc_feature: Encodes the peptide sequence at SEQ ID NO. 14919
attgaccggctcccgctcaggttcatctcctccctctgtttttctcaaagctgacaaaaaaaaactttcccttctctcggactccctcctccccggcggcgacgattgggcgagcggcggcgccatttgtcctgtcttcgcccagccctttgccggcgatgagcgcatcctccatacttgggattgatggattcagtgtagatgcttgtggctttgagcaatctaatttagggaaaaggcctagagatgaaccatcttcatctggtccgaaatccaaagcttgtcgtgaaaaaatgaggagggacaggctgaatgacagatttctggaattaagttcggttatgaatcctggtaagcaagctaagttggataaagcaaatatcttaagtgatgcaacccgtatgttggcacaacttagaggtgaggcagaaaagcttaaagaatcaaatgagaagctgcgagagaatatcaaggacctgaaggaggagaaaaatgagctccgagaagagaaagtgagactgaaggcagaaaaggagaggctggagcagcaagttaaagcaatgagtgcacctcctacaggatatgtttcccatgtccctcatccagctgcataccatcctgctgcttttgctccatttgtaccaccacagcaggctccaaccaataaaagcgctccaatccccgcagcgttccctgggatggcgatgtggcagtggctgcctccgactgtggtggacacaactcaagatccgaagctctggccaccaaatgcttagctgcatctagtgcataatgctgactcatggtgctgtctcatccattggcggcaaatcagagtgtctgtagatccctggagaggaaagaagtcttcaactccggtcatgattttgctgttactgttatttccagcagttataaacacttgttccattgaagggtgatgcctgtaattaatatggatcttaaccctcttagttgcaaatattccattgcgacct

SEQ ID NO: 14919 - protein, 205 aa, Panicum virgatum
  misc_feature: Ceres CLONE 1779742
  misc_feature (36)..(87): Pfam Name: HLH Pfam Description: Helix-loop-helix DNA-binding domain
  misc_feature: The sequence is a functional homolog of SEQ ID NO 1203 in the 11/479,226 US patent application
  misc_feature: The sequence is a functional homolog of SEQ ID NO 2422 in the 10/374,780 US patent application
  misc_feature: The sequence is a functional homolog of SEQ ID NO 542 in the 10/412,699 US patent application
  misc_feature: The sequence is a functional homolog of SEQ ID NO 814 in the 10/225,066 US patent application
  misc_feature: Useful for making plants with altered terpenoid content
  misc_feature: The sequence is a functional homolog of SEQ ID NO 917 in the 11/479,226 US patent application
MSASSILGIDGFSVDACGFEQSNLGKRPRDEPSSSGPKSKACREKMRRDRLNDRFLELSSVMNPGKQAKLDKANILSDATRMLAQLRGEAEKLKESNEKLRENIKDLKEEKNELREEKVRLKAEKERLEQQVKAMSAPPTGYVSHVPHPAAYHPAAFAPFVPPQQAPTNKSAPIPAAFPGMAMWQWLPPTVVDTTQDPKLWPPNA

SEQ ID NO: 14920 - DNA, 739 bp, Panicum virgatum
  misc_feature: Ceres CLONE 1779752
  misc_feature: Encodes the peptide sequence at SEQ ID NO. 14921
tgctctctcagaggtgggttggcttctcctccccctccggttcgcggttcggttcggtccgggttcgtgaggttcttgggggtgagaggaagagatggcggcgtcggatgttgagtaccgctgcttcgtcggcggccttgcctgggccaccgacgacaactcgctccacaacgccttcagccccttcggcgaggtcctcgagtccaagatcatcctcgatcgtgagacccagaggtcccgcggcttcggcttcgtcaccttctcgagcgagcaggcgatgcgcgatgccatcgaggggatgaacggcaaggagctggacggccgcagcatcaccgtcaacgaggcccagtcccgccgccgccgccgccgccgcgagaagaagagctcggcgactccccggtcgtacgagaagatgccgaagcagatccatgagatcaaggacttccttctcaccgcgaggaggaaggatgcccggtctgtgaagatcaagaggagcaaggatgttgtcaagttcaaggtgcgctgctccaagtacttgtacaccctctgcgtcttcgatgctgagaaggcaaacaagttgaagcaatcccttcccccaggtttgaccgtccaggaggtttgaagggacacaagacaacatcaagatgtgaactatcaaagcttccttatcatcagcagagcattctcttcgatgtaccttttggacctaagcttttagacctgtcagtcatggatttgt

SEQ ID NO: 14921 - protein, 175 aa, Panicum virgatum
  misc_feature: Ceres CLONE 1779752
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with altered lignin content
MAASDVEYRCFVGGLAWATDDNSLHNAFSPFGEVLESKIILDRETQRSRGFGFVTFSSEQAMRDAIEGMNGKELDGRSITVNEAQSRRRRRRREKKSSATPRSYEKMPKQIHEIKDFLLTARRKDARSVKIKRSKDVVKFKVRCSKYLYTLCVFDAEKANKLKQSLPPGLTVQEV

SEQ ID NO: 14922 - DNA, 952 bp, Panicum virgatum
  misc_feature: Ceres CLONE 1779829
  misc_feature: Encodes the peptide sequence at SEQ ID NO. 14923
ctcttcgacagccgcaacctctctctgtctcctccctctcgtatcggctatccccacacctcaccctctcccccaaaaaaccctcgaaaagcggcggcggcggcggcgcgacatggcggaggttgagaccgcgccggcggctgttgcggcgacgaccccggaggtcgcggctaccgagggcggcgccgcggcggaggccaaggggccgcacaagctgcaccggcagtggacgttctggtacgacatccagtcgaagcccaagcccggcgccgcgtggggcacctccctcaaaaaggcctacaccttcgacaccgtcgaggagttctggagcttgtacgaccagattttccgtccaagcaagttgattgggaatgctgattttcatctgttcaaggctggagtggagccaaaatgggaagacccagagtgtgcaaatggtggcaaatggactgtcccatgcaacagaaaggcaacctttgagaccatgtggcttgaaacgttgatggctcttattggagagcagtttgatgaaactgaggacatctgtggaattgtcgctagtgcccgtcagagaggagataaactcgcattatggactaagactgccagcaatgaagctgtccaggtaaacattggcaagaaatggaaggatgttatcgactacaatgacaagatcacctacactttccatgatgactccagaagagagaagccaagcagaggtggacggtacaccgtgtaaggtgcgcatcatgaaggccgtggcttggattggatagccttctcggtatctactttcattygacagcctcagctatgcccgaggcaattttcccatctgttatgatgttatgtgtctctcagatagctaatgtagtacaagaaagagatgctggaaagacattggcgactttgtatggcactaaatttcaatcttaatatgccctgattc

SEQ ID NO: 14923 - protein, 209 aa, Panicum virgatum
  misc_feature: Ceres CLONE 1779829
  misc_feature (5)..(209): Pfam Name: IF4E Pfam Description: Eukaryotic initiation factor 4E
MAEVETAPAAVAATTPEVAATEGGAAAEAKGPHKLHRQWTFWYDIQSKPKPGAAWGTSLKKAYTFDTVEEFWSLYDQIFRPSKLIGNADFHLFKAGVEPKWEDPECANGGKWTVPCNRKATFETMWLETLMALIGEQFDETEDICGIVASARQRGDKLALWTKTASNEAVQVNIGKKWKDVIDYNDKITYTFHDDSRREKPSRGGRYTV

SEQ ID NO: 14924 - DNA, 849 bp, Panicum virgatum
  misc_feature: Ceres CLONE 1779837
  misc_feature: Encodes the peptide sequence at SEQ ID NO. 14925
  misc_feature (769)..(769): n is a, c, t, g, unknown, or other
aacttgactgctcggtcaggctgcgcctacaaatccatcctcctcctcgccccagcagccaactacccccagtcaagcagccccgccccgcccgggaaccttccagaagcgcaagattccaaggccgtcgccttcccacccgttcctcgccgcgggggtcgcctgagatcacattaacaatggtgaaggctgttgctgtgcttggtaacagcgagggtgtcaagggcaccatctacttcacccaagagggagatggccccaccactgtcaccggaagtgtctctggcctcaagcctggcttccatgggttccatgtgcatgcacttggtgacacaacaaatggctgcatgtcaactggaccgcattacaaccctgcgggcaaggagcatggagcaccagaagatgagaaccggcatgctggtgatctcggaaatgtcaccgccggagatgatggtgttgctaacttcactgttaccgacagccagatcccactgactgggccaaactcaatcattggcagagctgttgttgttcatgctgatcctgatgatcttggaaagggtgggcacgagctgagcaagagcactggaaacgctggtggccgtgttgcctgcgggatcatcggactccagggctgagagtgatcaccgaactcaagtgccgaaagkgtcgtcgtccccgctgtcaccactcaccactrggaccagcctgagcatccwccggaaaagagaaaaaagagcgccagaacaacaaacggcgggggggggancccgccccggaagcacccaccgaagaacggaaacccggggggggggaacgcagagccaccgggaccggaggaccaaacaa

SEQ ID NO: 14925 - protein, 152 aa, Panicum virgatum; identical to SEQ ID NO: 9904
  misc_feature: Ceres CLONE 1779837
  misc_feature (1)..(152): Pfam Name: Sod_Cu Pfam Description: Copper/zinc superoxide dismutase (SODC)
  misc_feature: SWISSPROT Homolog: EC 1.15.1.1 Superoxide dismutase

SEQ ID NO: 14926 - DNA, 502 bp, Panicum virgatum
  misc_feature: Ceres CLONE 1779856
  misc_feature: Encodes the peptide sequence at SEQ ID NO. 14927
cacctcatcgatcgagccagccatccagccagtcgcctatcctcgcctgctgcgcgcgtctctctgctctcctagggagatctcgcgcagcgcggtaacccaccttcccacctcgtcgccgtcggagatggccggcctcaggatgaagctcgtcgccgccgccgccgtggccgccgcgctcgtggcgtccgccgccgccgccacagaggcccccgccccggcgcccgcctccgacgccgccgccttcggctacctcttctgctagatccgccgcccgttccccgtgggtcctgctgatatgatgattcgttctggcgtggcgtgagtcgagtccgtgtggggaggatgtcggtgggcgtgtgtatgtacgagttcggctgcggtgggggtggtgtgcgagcggtggttgcgtgcgtcgacgcgccgttctctatggcgccgatcatgtactcactccgtttctggttattgatgagatcatttatttgattctttccatctt

SEQ ID NO: 14927 - protein, 45 aa, Panicum virgatum
  misc_feature: Ceres CLONE 1779856
  misc_feature: Useful for making plants with altered carbohydrate content
  misc_feature: Useful for making plants with altered cell wall content and/or composition
  misc_feature: Useful for making plants with altered lignin content
MAGLRMKLVAAAAVAAALVASAAAATEAPAPAPASDAAAFGYLFC

SEQ ID NO: 14928 - DNA, 644 bp, Panicum virgatum
  misc_feature: Ceres CLONE 1779867
  misc_feature: Encodes the peptide sequence at SEQ ID NO. 14929
attccgctttgagcttgcttgcagctccagctcccctcgtctcttggtggctacgccatggccaccgtagtcctgatgagctgcagcctccgcgcgccggcctgcagcggcttatctggcgtccgcgccgccccggcaccggccatcgtcgccatgcccgccgccaagcagcaggttgttggccgcggcgccaggctgcgcgcgcaggccacctacaacgtgaagctcatcacgcccgacggcgaggtagagctgcaggtgcccgacgacgtgtacatcctggaccaggccgaggaggaagggatcgacctgccctactcgtgccgcgcggggtcctgctcctcctgcgccggcaaggtcgtctccggcagcgtcgaccagtccgaccagagcttcctcgaagacgaccaggtcgccggcggctgggtgctcacctgcgccgcctaccccacctccgacgtcgtcatcgagacgcacaaggaggaggagctcacctcctcttcgtaatccgatccagtatatgcggctttcattgcttattaattatctcagctcccttgattatatatatatatatatatatatatatatatatatatatacatctacgtgcgcgctatatctagagctatatatatattgtt

SEQ ID NO: 14929 - protein, 149 aa, Panicum virgatum; identical to SEQ ID NO: 10105
  misc_feature: Ceres CLONE 1779867
  misc_feature (58)..(133): Pfam Name: Fer2 Pfam Description: 2Fe-2S iron-sulfur cluster binding domain

SEQ ID NO: 14930 - DNA, 580 bp, Panicum virgatum
  misc_feature: Ceres CLONE 1779932
  misc_feature: Encodes the peptide sequence at SEQ ID NO. 14931
acttcaccaggtaaggaaaatggttgagactgatgggaacaacacagaccatgtccggcctcttcttgggcataaaaaagggacatgtcctcaccaagcgcgagctgccgccgcgcccgtcccaccgcaaggggaaagcaaacaagcgggtgaccatggtcaggggcctgatcagggaggttgctgggtttgctccttatgacaactcaatcattgaacttctgaaggttgggaaggacaaccgtgctctaaaggttgctaaaacaaagtctcctaactcacaagaaggaaaataataacaaagaggagatggtcaatgtcctaacgaaaatgatatctgctggtacccacacagataataataaatacagcatctcaagtacttaaacctgggggcaacattctcctgtgtaagttttccctacctgtaaaacctaatagacttgtcaaaatacctgacagcaaaatcatcgtgttgttagttatgtgataaacacctccatgattttttgatccaactttgaatgcatctatggtttgtctatccttagcagtggtttacaataccttatatcttgta

SEQ ID NO: 14931 - protein, 87 aa, Panicum virgatum
  misc_feature: Ceres CLONE 1779932
  misc_feature (5)..(83): Pfam Name: Ribosomal_L36e Pfam Description: Ribosomal protein L36e
MGTTQTMSGLFLGIKKGHVLTKRELPPRPSHRKGKANKRVTMVRGLIREVAGFAPYDNSIIELLKVGKDNRALKVAKTKSPNSQEGK

SEQ ID NO: 14932 - DNA, 546 bp, Panicum virgatum
  misc_feature: Ceres CLONE 1779935
  misc_feature: Encodes the peptide sequence at SEQ ID NO. 14933
aacgcctcgtaccgttcatccagtaaatccacatcacatcacaccccagctagctgcgaaaatggtgtccaccgtggccagcctctctaccccggcgaccgccttcgcggccgccgacgtggtcccgaggaggaaggccacccaaggccgcgtctggttccccgtggcccgcccctgccgcttcgcggtgaggtccagcgggccggggacgccggcggggatctccgacaaggtgtccgagagcatcatcaacgaggacgagacctgcgcggacgagaaggtctccggggagtgcgcggcggcctgggacgaggtggaggacctagccgccgcggcgagccacgcccgggacaagctcaaggacaggggccacccgctcgagaactactgcatggacaaccccgagatccacgactgcctcatctacgacgactagagcgagcctgctgtatatatcgatctgtgtatcaccaatcaaaagaagttagatttgttatagatatagataattaatgaaccaatacctgatatttgaccgccggtcag

SEQ ID NO: 14933 - protein, 124 aa, Panicum virgatum
  misc_feature: Ceres CLONE 1779935
  misc_feature (54)..(124): Pfam Name: CP12 Pfam Description: CP12 domain
MVSTVASLSTPATAFAAADVVPRRKATQGRVWFPVARPCRFAVRSSGPGTPAGISDKVSESIINEDETCADEKVSGECAAAWDEVEDLAAAASHARDKLKDRGHPLENYCMDNPEIHDCLIYDD

SEQ ID NO: 14934 - DNA, 992 bp, Panicum virgatum
  misc_feature: Ceres CLONE 1779983
  misc_feature: Encodes the peptide sequence at SEQ ID NO. 14935
gacttccaccgcaaatcgcacgcaaaaatcccactcgccgccgcgccctgccatggcgcccgcctcgcttccgctctcctttccgcgcgcggccggcgcgcctctcccgccgccagccagccacggcaccagcgtcgccgcgtgctcgcaccttgccgcgccgtcgcggggcaccgggcggaggagagggccgcgcgtcgcgctcgcagcggcaccggccgggcgccagggcggcaggtggagggcgggcgtgtcgtccttctccttcctcccgtcgttcttcacggggaataaaggggaaaaggacgccgagaaggcgatgaggctcaaggaggagctgctcgctgccatcgcgcctctcgaccgcggcgccgaggccacgcccgaggacaaggagcgcgtcgagcagattgttcagcagctggaggcggtgaaccaggtgaaggagccgctcaagtccgatctcatcaacggcaaatgggagcttctctacaccacctccacaaccatactgcaaccacagaggccaaagtatctgaggccatttgggaagatttatcaagcaatcaacgccgacactttgagagcccaaaacatggaaacctggccttactttaatcaggttactgccaacttggtgcctcttaatcctagaagagtggcagttcagtttgattacttcaagatatttagtttgatcccaatcaaatcacctggaagcggtaaaggtgaactagaaattacttatcttgatgaagagctcagggtttcaagaggagacaagggaaatttgtttgtattgaagatggttgacccaacatacagagttccattgtaacaatgtaaaacgataacaccttttgcaatgtagttcttaaaatatatgtcagtatagatttaagtgtcagctttatgtgtaacattacctggggtgacgtaatgcctgtaaatattaaagattctacttgatatgtgggaatcccattggaacc

SEQ ID NO: 14935 - protein, 261 aa, Panicum virgatum
  misc_feature: Ceres CLONE 1779983
  misc_feature (90)..(251): Pfam Name: PAP_fibrillin Pfam Description: PAP_fibrillin
MAPASLPLSFPRAAGAPLPPPASHGTSVAACSHLAAPSRGTGRRRGPRVALAAAPAGRQGGRWRAGVSSFSFLPSFFTGNKGEKDAEKAMRLKEELLAAIAPLDRGAEATPEDKERVEQIVQQLEAVNQVKEPLKSDLINGKWELLYTTSTTILQPQRPKYLRPFGKIYQAINADTLRAQNMETWPYFNQVTANLVPLNPRRVAVQFDYFKIFSLIPIKSPGSGKGELEITYLDEELRVSRGDKGNLFVLKMVDPTYRVPL

SEQ ID NO: 14936 - DNA, 704 bp, Panicum virgatum
  misc_feature: Ceres CLONE 1779988
  misc_feature: Encodes the peptide sequence at SEQ ID NO. 14937
attccacccgcggccgcaccaaacccccgtccctaatcatccccccaaccaaaccaaaaccaaaacccaaacaagtcttctcctccccgatccccgacgtcgccggaggcttcgcctaagcagcgtcaacgggcgcggtttttgaaagggtgcagtgtcgccaaggagacaaagggctcggtttgcaacctcttcactccaaattcaaataatgccaaagtaaaatcagtgggcttgagaatatcatcatccttgaaaagggatggtggctatccagctggtggtgcctctgggaacggcgacgtgctattgccaagaagtacttccgtacgtggccaggaccattcggttgctgaccctgtactcccgacagattccatggttgcgccagaaattctctctgctaatctggcacgtgttgcggacaagttcgcagatgaagacacagacactgaacttgatttggatagcccgacagagggctttgcatctattgcagatgccattgaggatatacgacaaagaaaacttgtgattgttgttgatgacgagtcaagggaaaatgaaggagaccttataatggctgcttccttggttacctcagaggctatggcttttatagtaaggcatgggactggaattgtgtgtgtcagcatgaaagaagaagatctggaaagactgaaccttccattgatggttactgg

SEQ ID NO: 14937 - protein, 108 aa, Panicum virgatum
  misc_feature: Ceres CLONE 1779988
  misc_feature (39)..(108): Pfam Name: DHBP_synthase Pfam Description: 3,4-dihydroxy-2-butanone 4-phosphate synthase
  misc_feature: SWISSPROT Homolog: EC 4.1.99.12
MVAPEILSANLARVADKFADEDTDTELDLDSPTEGFASIADAIEDIRQRKLVIVVDDESRENEGDLIMAASLVTSEAMAFIVRHGTGIVCVSMKEEDLERLNLPLMVT

SEQ ID NO: 14938 - DNA, 814 bp, Panicum virgatum
  misc_feature: Ceres CLONE 1779996
  misc_feature: Encodes the peptide sequence at SEQ ID NO. 14939
ttcccacctcgccccttgcaagttcatagcacacctcgcggcggcggcgcccgagaccggcggcgggcggcggaggcagcatcagccatggtgcatgtcagcttctaccgcaactatggtaaaactttcaagaagccaaggcgtccgtatgagaaggagcgccttgatgctgagctgaagctggtaggtgagtatggcctgaggtgcaagcgtgagctgtggcgtgtgcagtatgccctcagccgcatccggaatgctgcgagggagctcctcacccttgatgagaagaacccccgccgtatcttcgagggtgaagcactcctgcgccgcatgaaccgctatggcctcctcggtgagggccagaacaagcttgattacgttcttgcgctcactgttgagaacttccttcagcgtcgccttcagaccattgtcttcaagaatggcatggcaaagtccatccatcatgctcgtgtgctcatcaggcaacgccacattagagttgggaggcagcttgtcaacattccctcattcatggtcagagttgactctgagaagcacattgacttctcccttaccagcccgcttggtggtggtgagcctggaagagtcaagagaaagaaccagaagaaggcttctggtggaggcggtgatggtgatgaggatgaagagtgatcatgtgatgattgctcccggttttgttcttaggacctaatttttctggccctgttaggacctaaacttgttacatgaactgaagcaaagagttggccaccaccagctgtctaaaattgcaatttaattatcgaaaaccatc

SEQ ID NO: 14939 - protein, 194 aa, Panicum virgatum
  misc_feature: Ceres CLONE 1779996
  misc_feature (7)..(108): Pfam Name: Ribosomal_S4 Pfam Description: Ribosomal protein S4/S9 N-terminal domain
  misc_feature (109)..(156): Pfam Name: S4 Pfam Description: S4 domain
MVHVSFYRNYGKTFKKPRRPYEKERLDAELKLVGEYGLRCKRELWRVQYALSRIRNAARELLTLDEKNPRRIFEGEALLRRMNRYGLLGEGQNKLDYVLALTVENFLQRRLQTIVFKNGMAKSIHHARVLIRQRHIRVGRQLVNIPSFMVRVDSEKHIDFSLTSPLGGGEPGRVKRKNQKKASGGGGDGDEDEE

SEQ ID NO: 14940 - DNA, 723 bp, Panicum virgatum
  misc_feature: Ceres CLONE 1780011
  misc_feature: Encodes the peptide sequence at SEQ ID NO. 14941
agatcagaatcagaccaacacagccgcaggcagcagctacactacttgcttgctttgcttgtaactacccacagctattccacttgaattggccagcgttagagttatggccaacaacaagctccccgcccttcccctcgccgccgtcctcctggcgctcgctgcgccctcactcgccggcgaccccgacatgctccaggacatctgcgtcgccgactacaagtccctcaacggccctctgaggctgaacgggttcccgtgcaagaggctggagaacgtgacggccgacgacttcttctccggcctgctcgcgatccccggctacacgggcaacgcggcggggtcggcggtgacggtggcgaacgtggagaggctcccggggctcaacacccagggcgtgtccgtggcgcggatcgacttcgcgccgtggggcgtcaacccgccgcacacgcacccgcgcgccaccgaggtcatcttcgtgctccagggctccctcgacgtggggttcgtcaccaccgccaacaggctctacgcccgcaccgtctgcaggggcgaggtcttcgtcttcccgcgcggcctcgtccactaccagaggaacaacggcggcacccccgccgcggtcatgtcgacattcaacagccagctgccgggcacgcaggccgtcgtccagaccctcttcggcgcctcgcctgcagtgcccaccgacgtgctgggcagggcgtt

SEQ ID NO: 14941 - protein, 177 aa, Panicum virgatum
  misc_feature: Ceres CLONE 1780011
  misc_feature (36)..(170): Pfam Name: Cupin_1 Pfam Description: Cupin
  misc_feature: SWISSPROT Homolog: EC 1.15.1.1 Superoxide dismutase
  misc_feature: Useful for making plants with modulated nitrogen use efficiency
MLQDICVADYKSLNGPLRLNGFPCKRLENVTADDFFSGLLAIPGYTGNAAGSAVTVANVERLPGLNTQGVSVARIDFAPWGVNPPHTHPRATEVIFVLQGSLDVGFVTTANRLYARTVCRGEVFVFPRGLVHYQRNNGGTPAAVMSTFNSQLPGTQAVVQTLFGASPAVPTDVLGRA

SEQ ID NO: 14942 - DNA, 552 bp, Panicum virgatum
  misc_feature: Ceres CLONE 1780020
  misc_feature: Encodes the peptide sequence at SEQ ID NO. 14943
gtcccctaccggcctaccccctcttcgtcggcgctcccccttcgccggccggccggcggcgtcctcccagatcggcgccccagccgcagctttccgcgcgttccgctccctctcctgacccccacgaaacccccagtagcagccccgtcccactctccccctcccttgctcgcggccaggcatggagaacaacaagaagcgttggaaggcggcccaggaggggcagggcggcggcggcggcggcggcggcagcgggcaccgagtggatctggatgatgaggacgacctcgaggagttccggctgccgatgagccaccggccgaccgagaacctcgacacggaggggctcgagcaggcctccgtccacacgcagctcaccgcctccaacgtcggcttccggctgctccagaagatgggctggaagaccggcaaggggctcggcaagaacgagcaaggtatactagagccaataagagctgacatcagagatgcaaaattaggtgttgggaaacaagaggaagatgacttcttcacatctgaagagaatgtacg

SEQ ID NO: 14943 - protein, 123 aa, Panicum virgatum
  misc_feature: Ceres CLONE 1780020
  misc_feature (67)..(111): Pfam Name: G-patch Pfam Description: G-patch domain
  misc_feature: Useful for making plants with altered lignin content
  misc_feature: Useful for making plants with altered terpenoid content
MENNKKRWKAAQEGQGGGGGGGGSGHRVDLDDEDDLEEFRLPMSHRPTENLDTEGLEQASVHTQLTASNVGFRLLQKMGWKTGKGLGKNEQGILEPIRADIRDAKLGVGKQEEDDFFTSEENV

SEQ ID NO: 14944 - DNA, 578 bp, Panicum virgatum
  misc_feature: Ceres CLONE 1780039
  misc_feature: Encodes the peptide sequence at SEQ ID NO. 14945
tgctctctcataggtgggcttggcttctccccctcttaccccgtcctctggttctagggttttagttggaagggaagatgggggcgggcgatgtggactaccgctgcttcttcggctgcctctgctgggccacctacaacgactccctccagaaggccttcgcctcctaccgcgacatcctcgactccggggtcgtcaccgacagtaagaccgggaggtcccgcgggttcggcttcttcgcctactccgcccagcactgcatgctcgacaccatctaagccatgaacggcagggacctctactgtcgctgcatcaccgacaaccctgcccgatcgctcggtggtggcggctgtggttgtgggtaacgtggctgacgccaaggaaggtacagccgcagcggaggctaccgatgcggtcgccgggatgccggctcctgcggcatccgtgactacggtggccgtggctgatactgcctccgtcgtcactacggtgggtacggcggcggtggctactgcagccgcggcgactcctgtggatactggaggaactactgtggtggccctcccctgctctccgtc

SEQ ID NO: 14945 - protein, 66 aa, Panicum virgatum
  misc_feature: Ceres CLONE 1780039
  misc_feature: Useful for making plants with altered lignin content
  misc_feature: Useful for making plants with modulated nitrogen use efficiency
  misc_feature: Useful for making plants with modulated flowering time
  misc_feature: Useful for making plants with altered alkaloid content
MGAGDVDYRCFFGCLCWATYNDSLQKAFASYRDILDSGVVTDSKTGRSRGFGFFAYSAQHCMLDTI

SEQ ID NO: 14946 - DNA, 847 bp, Panicum virgatum
  misc_feature: Ceres CLONE 1780050
  misc_feature: Encodes the peptide sequence at SEQ ID NO. 14947
aaccaccggaagagccgagccgagccaagtctcctcgtctccctcctcccctcccctcccctcgcgtctgacccaagcttagggttccgccccacccggccccaccccacccgatccgatccgatggacgccggcgactcctccggcgccggcgccggcggcgccgctgccgcggcggccaagtggcggagcgacgcgtcgcgggcgttccagtactacctggaccgctccacgccgcacgccacggggcggtggctcgggacgctcgccgccgccgccatctacgcgctgcgggtctacatggtgcagggcttctacatcgtcacctacgggctcgggatctacctcctcaacctcctcatcggattcctctcccccatggtcgacccggagctggacccctccgccgccgccgagggccccgcactgcccacccggggctccgacgagttcaagcccttcatcaggcgcctccccgagttcaagttctggtatgcaatcacaaaagcttttgttatagcttttgtgatgactttcttctctgtgtttgatgttcctgtcttctggcccatactcctttgctactgggttgttctctttgtccttacgatgaagcgccagattgtgcatatggtcaagtacaaatatgtgcccttcagtattgggaagcagaaatatggtgggaagaagagcggctcaagcagtggttccccaaaagactgatcccagaccttcccagtaggaagcatggcaggggaacaagatacggtggatgatgatatttgatgtgctaaataccaagtgtaatacttcattcatatctaagaggtagacggatattcgctcc

SEQ ID NO: 14947 - protein, 199 aa, Panicum virgatum
  misc_feature: Ceres CLONE 1780050
  misc_feature (4)..(188): Pfam Name: Rer1 Pfam Description: Rer1 family
MDAGDSSGAGAGGAAAAAAKWRSDASRAFQYYLDRSTPHATGRWLGTLAAAAIYALRVYMVQGFYIVTYGLGIYLLNLLIGFLSPMVDPELDPSAAAEGPALPTRGSDEFKPFIRRLPEFKFWYAITKAFVIAFVMTFFSVFDVPVFWPILLCYWVVLFVLTMKRQIVHMVKYKYVPFSIGKQKYGGKKSGSSSGSPKD

SEQ ID NO: 14948 - DNA, 712 bp, Panicum virgatum
  misc_feature: Ceres CLONE 1780060
  misc_feature: Encodes the peptide sequence at SEQ ID NO. 14949
aaaacgccactcctccttctcttctccctctcctctcgtctcggcctcaggatcatcagcggcaatggcgatggcgtcgtcgagcgggctccggagctgcagcgccgtcggcgtgcccagcctgctggcgccgtcgtcgtcgcgcgccgggcggctgccgttctgtgccagcgccaccacctccggccgcgtcatcatgtccgccgagtggatgcccggccagccccgccccgcccacctcgacggctcctcccccggggacttcggcttcgacccgctcggcttctccaaggaccccgtcaagttcgaggagtacaagctcaaggagatcaagaacggccggctggcgatgctggcgttcgtggggttctgcgtgcagcagtcggcgtacccgggcacggggccgctggagaacctggccacccacctcgccgacccgtggcacaacaacatcggcgacatcatcatccccagaacgatctacccttgagctgatgagaccacggcggcggcgaagaacggagatgagacgagacgacgggcggacggaaagtgtgtactggatagatcaatggtgttttctgtgtgtggattactgctgggcactgcctgcgtgcgtgcagcaactgtacaacgaacgacggcggcggcgactttccggccgtcggccgggaacccattgtccttgtgtaatgtaaagcttacttgttat

SEQ ID NO: 14949 - protein, 141 aa, Panicum virgatum
  misc_feature: Ceres CLONE 1780060
  misc_feature (4)..(107): Pfam Name: Chloroa_b-bind Pfam Description: Chlorophyll A-B binding protein
  misc_feature: Useful for making plants with modulated nitrogen use efficiency
MAMASSSGLRSCSAVGVPSLLAPSSSRAGRLPFCASATTSGRVIMSAEWMPGQPRPAHLDGSSPGDFGFDPLGFSKDPVKFEEYKLKEIKNGRLAMLAFVGFCVQQSAYPGTGPLENLATHLADPWHNNIGDIIIPRTIYP

SEQ ID NO: 14950 - DNA, 585 bp, Panicum virgatum
  misc_feature: Ceres CLONE 1780092
  misc_feature: Encodes the peptide sequence at SEQ ID NO. 14951
gcgcctccccgtctctctcgtcctccctcgccgccgccgagaaggaaggaataggaggaggaaggagcaagcggagatgggccactccaacgtctggaactcgcaccccaagaactacgggcccggctcccgcgtctggtaaggaacctgcgccgccgcgctcgtccctgccgctaggcggccgggtctgtgctaacccccatggattgatcaggaagtatggactcatgtgctgcaggcagtgcttccgcagcaacgccaaggacattggcttcatcaagtaccgctaaagacattgccttgctggcgtcgagaacttcacatgggttgaaaagaaatggatccttcaatagaaggctcaacttatgtgcattagattttcgttcagacttgagactgctagtaaactacttgttaaagttttgatgggtactatatgcctgttaaactaattataattaagtgattggagtattttgtcatgtttgatatctggtgtactcaacctgcttgtattggtgccctccaaggctccctagttattgtactgccaattctattccttgcttcatgtatgaacttggg

SEQ ID NO: 14951 - protein, 95 aa, Panicum virgatum
  misc_feature: Ceres CLONE 1780092
  misc_feature (46)..(95): Pfam Name: Ribosomal_S14 Pfam Description: Ribosomal protein S14p/S29e
ASPSLSSSLAAAEKEGIGGGRSKRRWATPTSGTRTPRTTGPAPASGKEPAPPRSSLPLGGRVCANPHGLIRKYGLMCCRQCFRSNAKDIGFIKYR

SEQ ID NO: 14952 - DNA, 114 bp, Panicum virgatum
  misc_feature: Ceres CLONE 1780092-R
gcctgggattaaaggtgcccttcaggggtccttggttagtataagcctatttaaattcatggccttatgtagaaatgggacatttaaaattgaacccaacacattgttcaaatc

SEQ ID NO: 14953 - DNA, 870 bp, Panicum virgatum
  misc_feature: Ceres CLONE 1780103
  misc_feature: Encodes the peptide sequence at SEQ ID NO. 14954
ggatagaagcaggtctccattctctctcaataaaaaaaggaagcacaagaacaagaagcaggtcgccgttagagggcatttctgctcatctttggtggagaaagcagcaatgggaggcatgctcttaccgcatcatcaaatatctccaaaccctctgcggaagaccgcctttgcaacaccctttgcgcttcacaaagatgggttgctcttctctactgctccgcggcaaggttttgcgcgcccaccatgcgcgaccgtcagcgtcatcagatcagaggccaacggggctgcgttgccagacgcggtcagaaagcatagcaaggaggagctcattgctttcttcagagacattcagacctccattgccgagagctcgcctaaagctcccaggaggacgaggaagccgtcgcctgacccgttcgaagaggttgatcagaggaagcaatcatatggcatggatggagatggtggcgccgatgatttttcagaggaacaaggaagggggatgataaatctggaggacatgaaggtgtctgacctgagggaactggcgagggcgagaaggatgaggggttactccaagttaaagaagggtgagctgattgatcgtttgaaaggggttatcatgtaataagcttgtccatgatcaagagcaagcagatattagggacctactggaactgtgcgagactagttttatgttctcttcatcttcaattgaccctgacgagagtacacaagttcttgttgtcgattcaaatgtatgatgagattttggcagaaagaaatgtaggacatgatccgccgtctttgtttagaaagaagttgtattattgatcttgcaggctagtgttactacagggatcacac

SEQ ID NO: 14954 - protein, 173 aa, Panicum virgatum
  misc_feature: Ceres CLONE 1780103
  misc_feature (135)..(171): Pfam Name: Rho_N Pfam Description: Rho termination factor, N-terminal domain
MGGMLLPHHQISPNPLRKTAFATPFALHKDGLLFSTAPRQGFARPPCATVSVIRSEANGAALPDAVRKHSKEELIAFFRDIQTSIAESSPKAPRRTRKPSPDPFEEVDQRKQSYGMDGDGGADDFSEEQGRGMINLEDMKVSDLRELARARRMRGYSKLKKGELIDRLKGVIM

SEQ ID NO: 14955 - DNA, 723 bp, Panicum virgatum
  misc_feature: Ceres CLONE 1780114
  misc_feature: Encodes the peptide sequence at SEQ ID NO. 14956
atcccgccgccgcgcaggacgaaggagacctcccggtcgccgccgccatgtcgtcgatgatgtccgtgctgtcgaactggctggtgaacccgcgccgcaacccgctcgcccgcctccacatgcacgccgtctcctcgcgcctcaggaaatacgggctgaggtacgacgacctgtacgacccgtacttcgacctggacatcaaagaggcgctcgggaggctgcctaaagaggtggtcgacgcccgtgtccagcgcctcaagcgcgccatggacctctccatgaagcatcagtacctccccgaggacctccaggctgcgcaaactccattcagaggctatttgagtgacatgttggctctggtgaaaaaggagagtgctgagcgtgaagctctgggagcccttcccctgtatcagagaaccattccttaaaaaagtgctgcctagaagctctctcaatttttctctttacggcacaccgaaatgcatgaaataatatgcagtggatgaaactgtttttccttcctatcaagttccattttacttgttgatgcgcttgtagttctgcttccactctaattgatgggaaaaaattatgtgttcaacccttattaacttgttatggaagtcttcagcagctggttaaactgttatagcgttatgttatagcgttatgttatttgaacttgcctttttgtccatttttgcgtatttgtatcatacattt

SEQ ID NO: 14956 - protein, 126 aa, Panicum virgatum
  misc_feature: Ceres CLONE 1780114
  misc_feature (11)..(114): Pfam Name: UCR_14kD Pfam Description: Ubiquinol-cytochrome C reductase complex 14kD subunit
MSSMMSVLSNWLVNPRRNPLARLHMHAVSSRLRKYGLRYDDLYDPYFDLDIKEALGRLPKEVVDARVQRLKRAMDLSMKHQYLPEDLQAAQTPFRGYLSDMLALVKKESAEREALGALPLYQRTIP

SEQ ID NO: 14957 - DNA, 768 bp, Panicum virgatum
  misc_feature: Ceres CLONE 1780123
  misc_feature: Encodes the peptide sequence at SEQ ID NO. 14958
cacctcaccccacctcgccgctcgcgatggcggtcatgcgcgtcgcggtggccgccgcactccttgccgcgccgccctcctcccgccgccgccgggccgtgctcccctcctcctgccggcctctccccacctcccgcgtgtccaaggcgctgcacgccgccgcccccgccgcaggcgcgatcgacgaggagacccccgccgcgtcgccttcctcagattctagcaagggagtggagaacttggtgatcattggttccggcccggccgggtacactgctgcaatctacgctgccagggcaaacctgaagcccgtcgtgttcgaaggttaccaggcgggtggtgtccctggtgggcagctgatgaccacgaccgaggtggagaatttccctgcacaaggggaggggagggtgacgggagggtttcgtggaggtcgagctgccgcgccgccttcgtgtccgatggtttgcgcgggggacgccgcgccggaaggccgccggatccacctcgccgccgctcccgttcccttctgagcctcgagaatacagaaaggcataattgtttctgaaagaaagaaaagttctccgcagcaataaagaaagataaactcagatgagtttttccctgtgggaaaagacagcctataagtttaaggttatgaaaagcttccgatgttgtaagtcaaagaaaggttgttttggcactattttgccattgtaagtgtcaagttgagcattagtttattcttaaaaggaacggaatttaaagttc

SEQ ID NO: 14958 - protein, 167 aa, Panicum virgatum
  misc_feature: Ceres CLONE 1780123
  misc_feature: SWISSPROT Homolog: EC 1.8.1.9 Thioredoxin-disulfide reductase
MAVMRVAVAAALLAAPPSSRRRRAVLPSSCRPLPTSRVSKALHAAAPAAGAIDEETPAASPSSDSSKGVENLVIIGSGPAGYTAAIYAARANLKPVVFEGYQAGGVPGGQLMTTTEVENFPAQGEGRVTGGFRGGRAAAPPSCPMVCAGDAAPEGRRIHLAAAPVPF

SEQ ID NO: 14959 - DNA, 1002 bp, Panicum virgatum
  misc_feature: Ceres CLONE 1780135
  misc_feature: Encodes the peptide sequence at SEQ ID NO. 14960
aaatcaacaagaacacaagagctagctagctgctcaacgtgtagctcgatctacagccagcagtcactagcttgatcttatcgaccaaaacatctagtcgtcgttgcattatatcgatcgatctatcgatttaacaataataatgcagggcctcagcacgatgaagccatctaattccaagcagcagcagctcagcagcttgttggtcgtcgttgctgctgtgttgctgctagggctcgccggagtcgcgcacggcggcaggaggctcatcgtctcccgcagcgaggacgagccgtgcaagaagatgacgatgtactaccacgacatcatatacagcggcaacaacaccgccaacgcgacgtcggcggcggtgacgaagcccgaggcggcgctgagcttgtcgcactggaagaacggcaccttcttcggcctgctggtggtgttcgacgacctggtgacggaggagcaggcgctgacgtcggagccggtggcgcgcgcgcagggcttctacttctacgacaagaaggagcagtacaacgcgtggatggccttctcgctcgtcttcaactcgacggcgtacacgggcaccctcaacctcatgggcgccgacctcatgtacgagaagacgagggacatctccgtcgtcggcggcaccggggacttcttcatgtcgcgcggcgtcgccacgctaagcctcgtcgcctacgagggtaccgtctacttccgcctcaagatggacatcaagctctacgagtgctacgtcgctgcctgatcagaccatgcattatcatattttcttcgttttttttcaataaatgcatgtttaattttttttagggtctgcatgtttgcttatatataagcacgggctttttgttttatggattgtgtgtgccatatatattgttgcatgccgcgacacgacatatatatatgggtagtacttgtatcgactctatgcaatactcttatataagagttactaataaaactttctttatc

SEQ ID NO: 14960 - protein, 203 aa, Panicum virgatum
  misc_feature: Ceres CLONE 1780135
  misc_feature (21)..(196): Pfam Name: Dirigent Pfam Description: Dirigent-like protein
MKPSNSKQQQLSSLLVVVAAVLLLGLAGVAHGGRRLIVSRSEDEPCKKMTMYYHDIIYSGNNTANATSAAVTKPEAALSLSHWKNGTFFGLLVVFDDLVTEEQALTSEPVARAQGFYFYDKKEQYNAWMAFSLVFNSTAYTGTLNLMGADLMYEKTRDISVVGGTGDFFMSRGVATLSLVAYEGTVYFRLKMDIKLYECYVAA

SEQ ID NO: 14961 - DNA, 758 bp, Panicum virgatum
  misc_feature: Ceres CLONE 1780167
  misc_feature: Encodes the peptide sequence at SEQ ID NO. 14962
gctaaaccctaacgaagcgccgccgttctcgtctgcacctccaacccctcggcggacgccgactcgtcgatcccttccttctctcccaccgcgagatcggcctcgcgtcccttctcccttgttcaggttgatccctgggggcggcagcaggatggcgctgaggggggtatggcagctgcagaagcttgtggtgaactactgcgattggggagggagcagcagggggatcagagcattcatggaggcacatcttccagcctttaaggaaaagaacccacacttagaagtggtcactgagcttgtccgcggtcaacaccctaacttaaaaggaatttacaaaaaccataacgagcgagtggtctgtgtaagaaatttaccacctgaggaaatactgttgcaagccaccaggttaaggaattctctgggcaggaaagtggtgaagctgcgaacaagacacgtcacgaaacgccccagtgttcagggaacatggacgacagacctgaagatgtgagctgagctgtcagacaagctgtttcggcgttcctgatggtgtgattttttaaaaaaaatctcagttgtgtcaataactttgttgggctgccattcagcttgcctatttcaatagcttagacgtgtttgcgctctgtttgttcctagtacaatccggtaataacatgtacacttgggatttttttgctagtgccagcttatcactcgtcagatgtcagtctggtgatatctatctcctgtcttggact

SEQ ID NO: 14962 - protein, 119 aa, Panicum virgatum
  misc_feature: Ceres CLONE 1780167
  misc_feature (18)..(91): Pfam Name: L51_S25_CI-B8 Pfam Description: Mitochondrial ribosomal protein L51 / S25 / CI-B8 domain
MALRGVWQLQKLVVNYCDWGGSSRGIRAFMEAHLPAFKEKNPHLEVVTELVRGQHPNLKGIYKNHNERVVCVRNLPPEEILLQATRLRNSLGRKVVKLRTRHVTKRPSVQGTWTTDLKM

SEQ ID NO: 14963 - DNA, 564 bp, Panicum virgatum
  misc_feature: Ceres CLONE 1780203
  misc_feature: Encodes the peptide sequence at SEQ ID NO. 14964
aactacgaacgcataccaggccaccgcccgcagaggcctcggggcgccggccaccagcttctccggcgtccgcgctgccccggcacccgcggcgcccgccatcgtcgccatgcccgccgccaagcagcaggttgcccgcggcgccaggctgcgcgcccaggcgacctacaacgtgaagctcgtcacgcccgacggcgaggtggagctgcaggtgcccgacgacgtgtacatcctggaccaggccgaggaggaggggatcgaccttccctactcgtgccgagccgggtcctgctcctcctgcgccggcaaggtcgtctccggctccgtcgaccaatccgaccagagcttcctcgacgacgaccaggtcgccagcggctgggtgctcacctgccacgcctaccccacctccgacgtcgtcatcgagacccacaaggaggaggagctcaccgcttaatatacaattaattaagctcgctccatcatgcgtcgatatatatcatcatcatctagtatatctcaatctgcctgccttgcaagagatgttgaaatcgatcgagttgacga

SEQ ID NO: 14964 - protein, 150 aa, Panicum virgatum
  misc_feature: Ceres CLONE 1780203
  misc_feature (61)..(136): Pfam Name: Fer2 Pfam Description: 2Fe-2S iron-sulfur cluster binding domain
TTNAYQATARRGLGAPATSFSGVRAAPAPAAPAIVAMPAAKQQVARGARLRAQATYNVKLVTPDGEVELQVPDDVYILDQAEEEGIDLPYSCRAGSCSSCAGKVVSGSVDQSDQSFLDDDQVASGWVLTCHAYPTSDVVIETHKEEELTA

SEQ ID NO: 14965 - DNA, 351 bp, Panicum virgatum
  misc_feature: Ceres CLONE 1780261
  misc_feature: Encodes the peptide sequence at SEQ ID NO. 14966
ccagtagctgcggctgctcgaccaagcaataattaatcaccaatggccatcgcccgcagcggcctccgcgcgccggccatcagcttctcctccggcgtgcgcgccgccccggcgcccggcgtcgtctctgtgcccgccctcaagcaggttgttgcccgcggagccaggctgcccgcgcaggccaactactacgcgaagctgatcacgcccgacggcgacgtggagctgcaggggcccgacgacgtgtacttactggattcggccgaggaggaggggatcgacctgtccttctcctgccgagcggggtcctgctcgtcctgcgccggcaaggtcttctcctgctccgtcgac

SEQ ID NO: 14966 - protein, 102 aa, Panicum virgatum
  misc_feature: Ceres CLONE 1780261
  misc_feature (54)..(101): Pfam Name: Fer2 Pfam Description: 2Fe-2S iron-sulfur cluster binding domain
MAIARSGLRAPAISFSSGVRAAPAPGVVSVPALKQVVARGARLPAQANYYAKLITPDGDVELQGPDDVYLLDSAEEEGIDLSFSCRAGSCSSCAGKVFSCSV

SEQ ID NO: 14967 - DNA, 741 bp, Panicum virgatum
  misc_feature: Ceres CLONE 1780280
  misc_feature: Encodes the peptide sequence at SEQ ID NO. 14968
ttcgatgtgaagcctcccacgagcactctcgcactccacggacgcacgcaggcgccgcccgaccaggcgcccgctcgagcgccgccggtcgccgtcgccggcgacgagccgccgcccgccggctaggaggagcaccggatgcaatccccgacgagaagaaggctcaaggaagaggaagctgaaggtgagcgagtggggagggaagaagatgaaggtccgcgcgtcggtgaagcggttgtgcgggttctgcaaggtggtgaagcgccgaggcattgtcttcatccactgcaccgccaaccccaagcacaagcagcgccagggcttctccactctcgccgaagccgcctcatcatgcacccacctgccgccgcccccgccaccgactgccagcagcaccgcctctgccgcagcgtttgcagaagcttccaaggtggctaggcaagagatgtttacaaaatttaattggcctctgggtttagctgccctgctcaagaatggcgaaaaataatgcgtctgctctactatacgctgacaattcagaagcagatttgtcactttgatatcaagtgaaagtttgtagccaaaactagtcagttgagttggtcctgtggtggaataatatcagcacatattgttacgctcctcaatatgtttgcttgttcgaacaaaatctattacacatttgacgaaagctgacatacatgactgctatttatcttgctggatggttatgatggcacc

SEQ ID NO: 14968 - protein, 99 aa, Panicum virgatum
  misc_feature: Ceres CLONE 1780280
  misc_feature (1)..(38): Pfam Name: Ribosomal_L36 Pfam Description: Ribosomal protein L36
MKVRASVKRLCGFCKVVKRRGIVFIHCTANPKHKQRQGFSTLAEAASSCTHLPPPPPPTASSTASAAAFAEASKVARQEMFTKFNWPLGLAALLKNGEK

SEQ ID NO: 14969 - DNA, 806 bp, Panicum virgatum
  misc_feature: Ceres CLONE 1780298
  misc_feature: Encodes the peptide sequence at SEQ ID NO. 14970
atcgagcaccctccaatcttcaaggcgtcgcagcaggcaaggcatcgatcgatcaatcaccagcagcgcgtgccgcgtagagagatcgagagagagagagagagagagagagagagagagagagagagagagagagagagagagaggagtctcaccggagaagggaggaatcgtcatcgccaccgccaccgccatgggcaaggtccgctccttcttctcccgcagcggcaagcgcggcgccggcccgtcctcgccgtcctcctccgcggcgggcagcgcgccgtcgtcgccgtccccgacgccgtcgaggaggacctgcgccacgccttcatggtcttcgacgccgacggcaacggcctcatcacgcccgccgagctcgcgcgcgtcctgcgcggcctcggggaggccgccaccgtcgcccagtgccgccgcatgatccagggcgtcgaccgcaacggcgacggcctcgtctccttcgacgagttcaagctcatgatggccgccggcggaggcttcggcaggatggcctcctcctcttcttaggcactcatctgtttgggcaagatcactgctcggctctgctcccacaaattggattcgttcgttgaattgcactgtacatacgtaacagcgagatcgaagagatcatcgccaccaaaccaaagtaattactagtactaggcccatatcacacggacaaaaccacatcgaaaaatagcacgattggttttgtatatgtacatatatcgccaatgtgcatccgttgtacatgatggatgttgaatgatttgttctggtttcagttc

SEQ ID NO: 14970 - protein, 180 aa, Panicum virgatum
  misc_feature: Ceres CLONE 1780298
  misc_feature (141)..(169): Pfam Name: efhand Pfam Description: EF hand
  misc_feature (105)..(133): Pfam Name: efhand Pfam Description: EF hand
  misc_feature: SWISSPROT Homolog: EC 2.7.11.1 Non-specific serine/threonine protein kinase
IEHPPIFKASQQARHRSINHQQRVPRREIERERERERERERERERERERSLTGEGRNRHRHRHRHGQGPLLLLPQRQARRRPVLAVLLRGGQRAVVAVPDAVEEDLRHAFMVFDADGNGLITPAELARVLRGLGEAATVAQCRRMIQGVDRNGDGLVSFDEFKLMMAAGGGFGRMASSSS

SEQ ID NO: 14971 - DNA, 1031 bp, Panicum virgatum
  misc_feature: Ceres CLONE 1780306
  misc_feature: Encodes the peptide sequence at SEQ ID NO. 14972
attttcgatcgaaaagagcccaaaacgacccagaaaacccttttaattcctccccatatccactcgtcgcgcaaacgaagaagagagcgtctctcccactccggcacgacccgggcctggcgcgggagtggtcgccggaggagcaggccaccctcgacgagctgctcgccaagtatgcatctgatgcgcctgtcattcgttatgcaaagatagccatgaaattgccagagaaaacagttcgggatgtagccttgcgctgcagatggatgaataaaaaagagagtggcaaaagaaagaaagatgaccacaactcgtctaagaaaagcaaggacaaaaaggagaaggtttcagattcttcatccaaaccacctgtacacatggccggtaagcctaacgttgctccataccctctcccagttcttcccatggacgatgatgaaatctcagccaaagctattggaggcccaacaggagaaatccttgagactattgcgcatgttttgagtcaaatctcgacaaatcttaccaatatgcaggtatccttttctttcaagatacaagataacatctcactgttgtgccaaacgcgggataacatactcagggtcttgaaaaagataaatgatgctccagagatcatgaagcagatgccgccgctacccgtgaagataaacgaggacctcgtcaactcaatcctccccaggccgactgtacctatgcagtagcaatagcgaaacaaatgtttcctctgtagtcccaggagttgtttagatagcaatagctgaaataaaaatgccagccctggtgcttgttcgtcccctctgtagctccatcctctcacacctcccgcttccttctgcttgttcagtctggatgctgatctcccaaccgtcccgaagtcaggcggttggaacgtgtacctagttaccaagggctgcttctatacaacagtatcaggttccgactctggcatgttttgtaatctacagctgttctcgtaatgtcatggaaccggagtagcctttagcttg

SEQ ID NO: 14972 - protein, 240 aa, Panicum virgatum
  misc_feature: Ceres CLONE 1780306
  misc_feature: Useful for making plants with altered lignin content
FRSKRAQNDPENPFNSSPYPLVAQTKKRASLPLRHDPGLAREWSPEEQATLDELLAKYASDAPVIRYAKIAMKLPEKTVRDVALRCRWMNKKESGKRKKDDHNSSKKSKDKKEKVSDSSSKPPVHMAGKPNVAPYPLPVLPMDDDEISAKAIGGPTGEILETIAHVLSQISTNLTNMQVSFSFKIQDNISLLCQTRDNILRVLKKINDAPEIMKQMPPLPVKINEDLVNSILPRPTVPMQ

SEQ ID NO: 14973 - DNA, 396 bp, Panicum virgatum
  misc_feature: Ceres CLONE 1780356
  misc_feature: Encodes the peptide sequence at SEQ ID NO. 14974
aaccccaatccccttcccattccccccctctcctgagcggctgaacatcccagcctactctgcctgcaaaaccaagacaagtaccctccactgcgccgaccaccgacgcgtctcttcctccccttcccaggctctgcgagcgcggcagatctcgaatcccgtgtgtcaaaatggctaccgcgtgccggcctctctcgctgccatccacctccgccctccgccgtggcaggtcggcccgcgccggtcccaggcgcgggcatgtatcctccatccgctgcagcgccatcggaaaggcggaatcagatgacgcctcggacgggaccgcgaaggagccgctgctggccagcgctatcagggtgaagaaggtcaagaggccggccgtatggctcatgaggc

SEQ ID NO: 14974 - protein, 75 aa, Panicum virgatum
  misc_feature: Ceres CLONE 1780356
  misc_feature: SWISSPROT Homolog: EC 4.1.1.37 Uroporphyrinogen decarboxylase
MATACRPLSLPSTSALRRGRSARAGPRRGHVSSIRCSAIGKAESDDASDGTAKEPLLASAIRVKKVKRPAVWLMR

SEQ ID NO: 14975 - DNA, 748 bp, Panicum virgatum
  misc_feature: Ceres CLONE 1780361
  misc_feature: Encodes the peptide sequence at SEQ ID NO. 14976
tccttttcgcacccgccccctccccacccgcccacttgccttctcgctccgaagcggcgaagcttctcctctcgcgtctggcaccgggaggagacccggcgggcgctgcggtgccgggggcccggcgagggatcggggcctgaccgcctgagccaaaggtttgggaggcggagatgtcgacgccggcgaggaagcggctgatgcggaacttcaagcggctgcagcaggacccgcccgccggcatcagcggcgcgccgcacgacaacaacatcatgctctggaacgccgtcatattcgggccggatgacacgccgtgggatggaggaacgtttaagttgacactacaatttacagaagattaccccaacaagccaccaactgttcggtttgtttcgaggatgtttcacccaaacatctacgcagatggaagcatctgcttggacatcctacaaaaccagtggagccctatatatgatgttgcagcaatattgacctctattcagtccctgctgtgtgacccaaacccaaattcccctgcgaactctgaagcagccagaatgttcagtgagaacaagcgcgagtacaaccgcaaagttcgcgaggttgtggaacagagctggacagccgactaagtttctatccgcttcaccagatggtgcaataagcatctgcatttcatactccgccggtctgtattatccacttaaccgttaaaaatcctcggtggctgttgtgtccttgtggttcg

SEQ ID NO: 14976 - protein, 152 aa, Panicum virgatum
  misc_feature: Ceres CLONE 1780361
  misc_feature (8)..(145): Pfam Name: UQ_con Pfam Description: Ubiquitin-conjugating enzyme
  misc_feature: SWISSPROT Homolog: EC 6.3.2.19 Ubiquitin--protein ligase
MSTPARKRLMRNFKRLQQDPPAGISGAPHDNNIMLWNAVIFGPDDTPWDGGTFKLTLQFTEDYPNKPPTVRFVSRMFHPNIYADGSICLDILQNQWSPIYDVAAILTSIQSLLCDPNPNSPANSEAARMFSENKREYNRKVREVVEQSWTAD

SEQ ID NO: 14977 - DNA, 719 bp, Panicum virgatum
  misc_feature: Ceres CLONE 1780371
  misc_feature: Encodes the peptide sequence at SEQ ID NO. 14978
gttcctccctaattcttcctccccttccttcgcggcttcgcttccgtttctcgcagcgaggcgaatcccaaatccgcgccgatccaacgcgaatcaaccgagaggcagggggacacgattcgaatcgagacgagcgccatgaacccgagaggctaccgtagcaacagaacttctctctacgatggcattgaggaaggtggaatccgagcaacatcctattcttcccatgagatagatgaacatgaaaatgatcgagctattgatggactgcaggatcgtgtcagcattcttaagcggctgtcaggtgacatccatgaggaggtggagactcataacagaatgctagaccgcatggggaatgatatggatacatcaaggggttttctctcaggaactgtggacaaattcaagatggtgtttgagaccaaatcaagtcggaggatgggaaccctggtggcatcattcgttgctctttttctgctggtttactacttgaccaggtagaagcatccccgaggaaacctatgttggctggtgtgttgaagaacatgctggaaattgatatgtaccggtcgacttacgatgcagtatattatacccttgggaactcacttttttgaatgcaaagtacgttgatcctggtgttgcgaattgtataacgatcacagcgtgttggatggactctttgcactgctgctgtaactgaagaaactggattc

SEQ ID NO: 14978 - protein, 121 aa, Panicum virgatum
  misc_feature: Ceres CLONE 1780371
  misc_feature (36)..(98): Pfam Name: SNARE Pfam Description: SNARE domain
MNPRGYRSNRTSLYDGIEEGGIRATSYSSHEIDEHENDRAIDGLQDRVSILKRLSGDIHEEVETHNRMLDRMGNDMDTSRGFLSGTVDKFKMVFETKSSRRMGTLVASFVALFLLVYYLTR

SEQ ID NO: 14979 - DNA, 843 bp, Panicum virgatum
  misc_feature: Ceres CLONE 1780376
  misc_feature: Encodes the peptide sequence at SEQ ID NO. 14980
attccatcccatttccagctcctcgcgtgttccttccgcccgcctgcttcccctccgggcccggcagcggcgggaggagccgagccgaccgaggaggccgggcaggggaccggaggatcgccctacgtcgccgcccggcggatgtcggatcgggagctctgcccgctgcgctcgatcagaatcacaggggacggccgatgcctgttcaggtccgttgcttacggcgcatgcttgaggagaggaaagcagtcacccagcgacagcgcgcagaaggaactggctgacgagcttcgagcgaaagtggctgatgagtttgtcaagagaagaggagacactgaatggttcctcgaaggagatttcgagagctacgtgcgaaagatgagaaaaccgcatgcttggggaggagaacctgaactgctcatgtgctcccatgttctcaggatgcccatcacggtttacatgtatacaagtagctctgatagccccaggatcatagcggaatatggccaggaatatggcaaggacaatccagtccgtgttctctatgatggttatgggcactacaacgcacttcagccatcttttgtaagaacacaatcaagactgagaggtgtgtagataatcggaggttgcgttacctgagcttcttctataggacagctgcataagtggcagcagctcaagattcaccaacgtggttttgcccagcttgacaaacgtatgcagtagcacacatatgaaattcagcctcgattggttgctctggcctttccttttcttcaaggattgatgtataaataaacttcagacgcagtaagaaaattaatggaatggccttatacc

SEQ ID NO: 14980 - protein, 205 aa, Panicum virgatum
  misc_feature: Ceres CLONE 1780376
  misc_feature (62)..(188): Pfam Name: OTU Pfam Description: OTU-like cysteine protease
IPSHFQLLACSFRPPASPPGPAAAGGAEPTEEAGQGTGGSPYVAARRMSDRELCPLRSIRITGDGRCLFRSVAYGACLRRGKQSPSDSAQKELADELRAKVADEFVKRRGDTEWFLEGDFESYVRKMRKPHAWGGEPELLMCSHVLRMPITVYMYTSSSDSPRIIAEYGQEYGKDNPVRVLYDGYGHYNALQPSFVRTQSRLRGV

SEQ ID NO: 14981 - DNA, 1698 bp, Panicum virgatum
  misc_feature: Ceres CLONE 1780427
  misc_feature: Encodes the peptide sequence at SEQ ID NO. 14982
gcgccttacgatccattcgttccccgcttccgcccccgtccctcaccccgcacagccgccgcctccgcgtctctgccccctccgcctctctcgccccggcctcctcaaccctcgcgctccagatccagatcgcggctcatgggtctccaatctctctccgctcccggccgaccacccaacgacgccaccccgcgaacccggaaccgccgacgtccagtcgcacggatcggagtccgccgctcgccgcagatctctgcgcaatctccgcccatggccgtcactagacaagcgggtggcattgacggatccaggcacgtgctctcggggcggctctcctcggcatccggcggccggggcggcgctgaggcggcaacggaggccgggtgaagaggacgaggccaacatgggggaggagaggtggccggagcaggcgccgccgacctggagggagaccgcggcggtgacagcgaggatggcggggttcgcgtcaacggggagcagctcgtcgatggggaaccccagcgagagcgcgatgagcgcctccgtctccgtctcccgcggccactccttcgccggcgtcagggtcaagattggagtcccgtgtgatggcatccttgagctgacgctgtccaaccccgacgggatcgtgaccggcgtgcgctacaaatggtgtggatattaacatggaagacaatagagggtaggtaccaatttctgattactttattctttttcatctccgtattttattcttcaatttctgctaattggattttggcacaattaaaaatatattttattctttaattaattaagatttctattgtttataaatgcaaaattgatgctgtgagacagagctgacaaagtgtaactggcacctttgatgtgtaagagctctcttaattcacaattcagacttgactactgcatcactgtgaatgcattttgcttctgtactggaatattcttgtgcaggatcaaaggtacttagtttctcatcatatatcatgatgagaaccaggctgagatctccatcaacagaaattgggatccttctgtagaaggaaaagctgtccccttgaacattgataagaggtgagtcatgcacacaaaacataacaattcggcaattctcaccagctcaattcatcgggtgtaaacaaaagagaacatgttaaactgagcaaatgtttctgtacaagttcgttctcaattcatccattaactcaagtttcgaggggttccttctttactgaaggacatgcaactgtaaataggtataaatatgttaattagtttgtctgttaactcaagttttgaggggttctttctttactgaaggacatacaatcatactttatttgtttgaatacatcatcgtgttcctattagtagcattcacagcatgttgggacttgagaggcagccgttcatgtccggtgttgaccccgactgccacgagtcattgatggcggcgcaagctctgcctcttgcagtgttagatggagctcactgtaattccgaagatagcaactgaggctgtatttttagagcggctgagttggagacttatctcaattatactgagacgatagtagataggtagtttacttttattttctattttcaattcatttcaatgacaaggttataccagttctttttataagcaaaaggggtaatcgttcctgtttt

SEQ ID NO: 14982 - protein, 69 aa, Panicum virgatum
  misc_feature: Ceres CLONE 1780427
  misc_feature: Useful for making plants with altered carbohydrate content
MAGFASTGSSSSMGNPSESAMSASVSVSRGHSFAGVRVKIGVPCDGILELTLSNPDGIVTGVRYKWCGY

SEQ ID NO: 14983 - DNA, 1906 bp, Panicum virgatum
  misc_feature: Ceres CLONE 1780433
  misc_feature: Encodes the peptide sequence at SEQ ID NO. 14984
accaagaggcaagagcctatccgcaccttgcctctctccgtcttcctcgccctgatccggttcccccccaaatccttcgccctcgtcgtcgtcttctccgagccaaattgatcggagcgcagctgtgatcctgtccatgcgcggagcgtggtagcctcggaggatcctctcgccgccgtcttcccctttcgccaaccatttctggtcgccgggatcagccgagttggatctcgaggcataacagcgttgcgggcgtccggcgaggatacgatgcctgcggtgctcgccgcgttcgccagcctccgcgcggcagcagccatcgtctccgggaactcgtccttcccctgctcccaccgcctcaagcatcgttttagtagtaattttagtagtagtagtagtagtagtagtagtagtagtagtagtagtagtagtaattgtctttgaccatcgccttcccctcgtcgtcgatctggttgtgctcgatccgaggcttgttggactgtgcgggttccgtgctcgatctcgcgcgcttcccgggttgtcggagtttggtgtctgggttcgatctgcaggttcggaagggaagcagtttgggggtgttggtcgtggtgatctgcattcctagaaaagagaaacttctcttcgtaatttggaattaaacttgtggatgggcgaacccttggcagacttcactgctgaaggtattagcagcagctcatgtctctgccgcaacacctgtgaaaaaccaggttgggaacacagctatgcttgcttgaaagatgagcaagatgatttggtggttgaggaaattggaatggctcttactgaagtgatacatgcctatggtgatggtgacaatgatgaagggccagatttggatgaggattctagcgatgatgatgatgatgatgatgaccttattctttctatggaatctgattcaaccgatgatttattggatgttgactctgaattggtcatatcatctgcctctcctagtggtgatgcatcggaatcatcaattagcaaatcacttgatgagaagtcttcaattcttggcactccaaggctggtttctgcaatgaagggagcccgtgcaaagcagggaatcatgacaaagttaagcgtttcgtgggcccctgatgtatatgatcctcctgttacttctgactcgcatactgtgagagggcaccagaggagttcaaggaagggccactataaatacaaaccctccaagagcagcagcaccaacagccggagtaccagtggcagcaaaaaggacaagaagcattctcgccacagcagcagcagcagcaaaaaggacaggaagcattcttcccgcagtaccagtactagtggcagcaacagaactgatacgagtagttctcattatcgtaagccatacagtggtgtggagatcagtaacggcagaactgtgacgtgtgttccagaatctgctaaggtatcttcattggtgctagctgaaactgccgtgctgccggagatagtttccgtactcaagactacggagctgatcaaatgtgctaccagctgcggcaaggagaagccatttgcattgctgcctcgtcagttttccccgggaaggtacaaggggatgttctccttttggagccaaaaccaactggcttaatattcagtcactgctatgggctcacttgggagtcttcattgctagtcatgtggtaccagtgaggctcgtcgttttgcatcgttctcttcgttgcactgtttatttggtttgtttctgaaactccagagatcactttctcgaaaattgtcaggcaaagtacttgtatgtttcagattctttttttgaaacgaaccaggcagaaaagctgctgttattaaaaactcaagactgtatgtttgagcttctgttctattc

SEQ ID NO: 14984 - protein, 57 aa, Panicum virgatum
  misc_feature: Ceres CLONE 1780433
  misc_feature: Useful for making plants with modulated biomass
  misc_feature: Useful for making plants with modulated heat sensitivity
MPAVLAAFASLRAAAAIVSGNSSFPCSHRLKHRFSSNFSSSSSSSSSSSSSSSSNCL

SEQ ID NO: 14985 - DNA, 645 bp, Panicum virgatum
  misc_feature: Ceres CLONE 1780446
  misc_feature: Encodes the peptide sequence at SEQ ID NO. 14986
tggtttgtttgtagcaggactcaggagcaagagagccgagaggtgcttgctagctactacggtggcgcaacagcggcggcggcagcgcaccgcgcgcggaacgacgccgcagccggcggcgctgcgggctccgagggcgccgccgcagtggcggaggtggatgaggcgggcaccgaggtcgccgggggcgccgcaacctcctcgcggccgccctactcgctcatctccgcggagaatgtgcagaaggcgatgcgtggcctagctattacagatgctgatcactatgggaggcttggagtcacaagactagcttctactgatgacgtaaccactgcctatgagacaaagtgtgtacaactaaatagcaaaaaaatggaagaagaggagctcaacaaggaacttgacctcctaaaggaatcatttaccatactatcaactgaggaagagcgaagattatatgattggagcatgtccagaagtggacaacctgagcgatatgtctggccttttcaagtacgatccattggagccggcaccagatcctccccaggaacctgaagacgaggtcccgacaaagctcggtggctacttcttcctggggtgtttcatactctctgttgtgttctcggagaccctcgaagaatg

SEQ ID NO: 14986 - protein, 185 aa, Panicum virgatum
  misc_feature: Ceres CLONE 1780446
  misc_feature (93)..(154): Pfam Name: DnaJ Pfam Description: DnaJ domain
WFVCSRTQEQESREVLASYYGGATAAAAAHRARNDAAAGGAAGSEGAAAVAEVDEAGTEVAGGAATSSRPPYSLISAENVQKAMRGLAITDADHYGRLGVTRLASTDDVTTAYETKCVQLNSKKMEEEELNKELDLLKESFTILSTEEERRLYDWSMSRSGQPERYVWPFQVRSIGAGTRSSPGT

SEQ ID NO: 14987 - DNA, 1675 bp, Panicum virgatum
  misc_feature: Ceres CLONE 1780455
  misc_feature: Encodes the peptide sequence at SEQ ID NO. 14988
agggcattctcgagtctggacttgctcttcttcgagaagaacaccccagccgcctgtgccacgtctctttaccttgccacctcatctcactgaccccccaagtcccggagcccatccaatcccaactccatctctcttccccgcggcgcgagcaagggcgacgccggccgcgacggggctccgccacgacggcggcgtcggcgggaacccggcttccgctccatctcctcactccccccctctgatcacttctgactcgtgaaaatggtggatgaactgcgttctacgtctgtggtccagaaggtccatgggcagtccgtgttgttgagcagaatctcttcttgttctgccatgaataaccctgtattcaacaatgcgtattctgcctacaatgtgccccggaggtcataccacgggatgaatgcaactgttggactttcctctgtcatggcaccatctcctttctttgcttctgccccaaaagagaaaggtttttcaggatttatgattgactttctaatggggggagtttctgcttctgtttccaagacagctgctgctccaattgagcgtgtcaagcttttgattcagaaccaggatgaaatgctcaagagcggcaggctttctgaaccgtacaagggtattggggagtgctttacccggacaatcaaagatgagggttttgtctcactgtggaggggcaacacagctaatgtcatccgttacttccccacacaggcattgaactttgccttcaaggaccacttcaagcgtatgttcaactttaagaaggataaggatggatactggaagtggtttgctggcaacctggcttctggaggagctgctggtgcttgctctctcttctttgtttattctctggactacgctcgtacgcgtttggccaatgatgccaaagctgcaaagaagggtggtgagaggcaattcaatggactcgttgatgtttacaaaaagacccttgccagtgatggtatccgcggcctctaccgtggattcaatatctcttgtgtgggaatcattgtctaccgtggtctttactttggaatgtacgactccctcaagccagtgcttcttgttggttccctgcaggataacttcttggccagcttcttgctcggctggggcataaccattggtgctggtcttgcctcgtaccctattgatactgttcgccgccgcatgatgatgacatctggtgaggctgtcaagtacaacagttccttggatgccttcaagcaaattgtcgcaaaggagggtaccaagtccctcttcaagggcgctggcgcgaacatcctccgtgctgttgctggggctggtgtccttgctgggtacgacaagctccaggtgattgtcttcggcaagaagtacgggtctgggggcggctaagagtagatgatgatgatgatgaacaacaaataggatgttttaggtgcctttaaataacatacacatggacggcggacaccatttttaaattcagcacttggaagaggttgttgacttggtttgtaatgcggttgtcaccgcttctctttttgcgtgggagattgaaataagttaagttagaaattacagccctgcagaccttaaatcatggtagtcccgcagtggatcgatgtttgcttgtattggttacatttggttttgcgcgtgc

SEQ ID NO: 14988 - protein, 380 aa, Panicum virgatum
  misc_feature: Ceres CLONE 1780455
  misc_feature (79)..(176): Pfam Name: Mito_carr Pfam Description: Mitochondrial carrier protein
  misc_feature (184)..(280): Pfam Name: Mito_carr Pfam Description: Mitochondrial carrier protein
  misc_feature (284)..(374): Pfam Name: Mito_carr Pfam Description: Mitochondrial carrier protein
MVDELRSTSVVQKVHGQSVLLSRISSCSAMNNPVFNNAYSAYNVPRRSYHGMNATVGLSSVMAPSPFFASAPKEKGFSGFMIDFLMGGVSASVSKTAAAPIERVKLLIQNQDEMLKSGRLSEPYKGIGECFTRTIKDEGFVSLWRGNTANVIRYFPTQALNFAFKDHFKRMFNFKKDKDGYWKWFAGNLASGGAAGACSLFFVYSLDYARTRLANDAKAAKKGGERQFNGLVDVYKKTLASDGIRGLYRGFNISCVGIIVYRGLYFGMYDSLKPVLLVGSLQDNFLASFLLGWGITIGAGLASYPIDTVRRRMMMTSGEAVKYNSSLDAFKQIVAKEGTKSLFKGAGANILRAVAGAGVLAGYDKLQVIVFGKKYGSGGG

SEQ ID NO: 14989 - DNA, 711 bp, Panicum virgatum
  misc_feature: Ceres CLONE 1780461
  misc_feature: Encodes the peptide sequence at SEQ ID NO. 14990
gccggccaacgatgcctcctcctcggctccaacggcgcaggcaagacgacgatactgaagatactgggcgggaagcacatggtggatccgagcatggtgcgggtcctgggcaggtccgccttccacgacacggcgctcacctcctccggcgacctctgctacctcggcggcgagtggagacgcgacgtggcctttgccggctaccaggtgaatattcagatggatatatcggcagagaagatgatttttggtgttgctggtgttgatccaaagaggagagatgagcttatcaagatattagacattgaccttgcttggcgcatgcacaaggcatcagatggtcagaggagacgagtccagatttgcatgggacttcttaagccattcaaggttctcctccttgatgagatcacagttgacctggatgtgttggcaagatcaaatctgttgacatatcttaagcaggaatgtgatgaaagaggtgcaacaatcatctatgccacacatatttttgatggtcttgatgattggccaacacacgttgtttacattgctcatgggaagctgcaattagcactgcctttggaaaaagtgaaagaaatgagccagttgtctcttatgagaactgtggagagttggttgaggaaagaaagagacgaggacaggaggaggagaaaggagcgaaaggagaaaggcctcccggaattcgac

SEQ ID NO: 14990 - protein, 236 aa, Panicum virgatum
  misc_feature: Ceres CLONE 1780461
  misc_feature (2)..(187): Pfam Name: ABC_tran Pfam Description: ABC transporter
  misc_feature: SWISSPROT Homolog: EC 3.6.3.29 Molybdate-transporting ATPase
  misc_feature: Useful for biocontainment applications
AGQRCLLLGSNGAGKTTILKILGGKHMVDPSMVRVLGRSAFHDTALTSSGDLCYLGGEWRRDVAFAGYQVNIQMDISAEKMIFGVAGVDPKRRDELIKILDIDLAWRMHKASDGQRRRVQICMGLLKPFKVLLLDEITVDLDVLARSNLLTYLKQECDERGATIIYATHIFDGLDDWPTHVVYIAHGKLQLALPLEKVKEMSQLSLMRTVESWLRKERDEDRRRRKERKEKGLPEF

SEQ ID NO: 14991 - DNA, 695 bp, Panicum virgatum
  misc_feature: Ceres CLONE 1780472
  misc_feature: Encodes the peptide sequence at SEQ ID NO. 14992
acaccagagcacagcgcagcacggcacgccacggccgggctcttcttcttcttgctcttcttgttcttccccggcgccagcggacctgcggggcgatcctccactggcagggcagcagcgaggtgtaactgtaattgacggcggcagcagcggcggcaggaggaggaggaagctttccggcggcggaggaccggggaggaggaggaggaggacgaagatggtggttgagtccgcggggggaggcggaggggactgcctcatcaagctgttcgggaagaccatccccgtgccggaggccgccgccgacaaggagagcggcggcagcagcagcatcagctcctccactgaatccgacaccccggagaacgcctcggagccgtccccgcagccggaggtcgtggacgccgatgaccccaagagctcgccggagacgccgccgccgaccggcgccggcgacctggccgggcagagggagaagctcaagaagcccgacaaggtgctgccgtgcccgcgctgcaacagcatggacaccaagttctgctacttcaacaactacaacgtcaaccagccgcgccacttctgcaagaactgccagcgctactggaccgccggcggcgccatgcgcaacgtccccgtcggggccggccgccgcaagaaccagcacgccgccgccgccgccgccgcctcccacttcc

SEQ ID NO: 14992 - protein, 159 aa, Panicum virgatum
  misc_feature: Ceres CLONE 1780472
  misc_feature (90)..(152): Pfam Name: zf-Dof Pfam Description: Dof domain, zinc finger
  misc_feature: The sequence is a functional homolog of SEQ ID NO 1132 in the 10/374,780 US patent application
  misc_feature: The sequence is a functional homolog of SEQ ID NO 1331 in the 10/412,699 US patent application
  misc_feature: The sequence is a functional homolog of SEQ ID NO 1130 in the 10/374,780 US patent application
  misc_feature: The sequence is a functional homolog of SEQ ID NO 1329 in the 10/412,699 US patent application
  misc_feature: The sequence is a functional homolog of SEQ ID NO 1131 in the 10/374,780 US patent application
  misc_feature: The sequence is a functional homolog of SEQ ID NO 1330 in the 10/412,699 US patent application
  misc_feature: The sequence is a functional homolog of SEQ ID NO 112 in the 10/666,642 US patent application
  misc_feature: The sequence is a functional homolog of SEQ ID NO 2352 in the 10/374,780 US patent application
  misc_feature: The sequence is a functional homolog of SEQ ID NO 724 in the 10/225,066 US patent application
  misc_feature: The sequence is a functional homolog of SEQ ID NO 1008 in the 10/225,066 US patent application
  misc_feature: The sequence is a functional homolog of SEQ ID NO 1970 in the 11/479,226 US patent application
  misc_feature: The sequence is a functional homolog of SEQ ID NO 364 in the 10/374,780 US patent application
  misc_feature: Useful for making plants with modulated nitrogen use efficiency
MVVESAGGGGGDCLIKLFGKTIPVPEAAADKESGGSSSISSSTESDTPENASEPSPQPEVVDADDPKSSPETPPPTGAGDLAGQREKLKKPDKVLPCPRCNSMDTKFCYFNNYNVNQPRHFCKNCQRYWTAGGAMRNVPVGAGRRKNQHAAAAAAASHF

SEQ ID NO: 14993 - DNA, 2043 bp, Panicum virgatum
  misc_feature: Ceres CLONE 1780481
  misc_feature: Encodes the peptide sequence at SEQ ID NO. 14994
accaggccaccactcggttgctctgactgagttcttgctcttcacaaggctttgcgttcgccaccgggacgaggcgggcgtgcgtgcgtggggcttgcgcgcgcgtgcccctgcccccaggccacagctcgtctcgacctgctcgagcccccggccgctggttggtgctttgctcaggaacagggagctagttgggagaagatggcgggggccgcgggcggcagggacctgccgtcgacgccgacgtgggcggtggcgctggtgtgcaccgtcatcgtgctcatctccgtcgccatggagcacggcctccacaagctcggacactggttccacacccggcagaagaaggccatgcgggaggcgctcgagaagatcaaagcagagctgatgctgatgggcttcatctccctgctcctcgccgtggggcaatcgcccatcgccaagatatgcatccctgccaaggctggcagcgtcatgctgccgtgcaaacccaaggccaacggcaaaagcggcggcgggaatggccgccggaggctcctctggtaccctggagaagaagtcaaccatcgccggttcttggccggcgccggacctgcggacgacttttgcgtcaataaaggcaaggtgtccctgatctccgcaaacggcgtccaccagctgcatatattcatctttgtgctcgcagtgttccatgtcgtttacagtgtcgccacgatggctttagcacgtctgaaaatgaggagatggaagaaatgggaatcagagaccaactcgctggagtatcagttcgcaacagatccttcacgattccgattcacacaccaaacgtcgttcgtgaagcggcacctgggcctcccgagcacacctggagtcagatggattgtggcattcttcaggcagttctttgcttcggtgaccaaggtggattacctgaccatgcgccaaggcttcatcaacgctcatctgtcgcccaatgctaagttcgatttccaaaagtacatcaagcggtcgttggaggacgatttcaaagtcgttgttggcatcagcctcccgctgtggtttgttgccatcttcatactcttcatcgatatccgaggactcggcacgcttatttggatctctttcgtcccactcgttatcctcttgttagttggcaccaagctagagattgtcatcatggagatggccaaggagatacaggacaaggcgactgtgatcaagggggcacctatcgtggagccaagcgacaggttcttctggttcaaccggccggagtgggtcctgtttctcatacacctgacgctcttccagaatgcattccagatggcacatttcgtttggacactgctcaccccaggcttgaaagattgctacaacgaaaaattgggactgagcatcatgaaagttgtagtgggggtgactcttcaggtcctctgcagctacatcaccttcccattatatgcactcgtcacacagatgggctcgcacatgaagaaggccatcttcgaggagcagaccgccaaggcggtgatgaaatggcgcaaggcggccaaggacaaggtgaagcagcgggaggcaggcttcgacgggttggtgagcgtggacacgacgccgagccagagccgggcgacgtcgccgagccgcgccaactcgccggtgcagctgctgcacaagtacagggggaggtcggatgatccccacagcgcgccgacctcgccggggggagggcaggagctcggagacatgtacccggtggccgaccagtaccggctgcacaggctagaccctgagaggaggcggacggcctcgtcctccgccgtggacattgatatcgccgatgctgatttttccttcagcgttcagcggtgattgaacagatttgtgtagcatgttttaccttttcttttgtatagcaacaaagcataggagggagggaatactactgacacgttagccaagtttcgtttattcaaaaataatatgtaatagtgtgggtaactttgtgcaacagaaaaaaaaaacatggatgcaaagaagcatcac

SEQ ID NO: 14994 - protein, 555 aa, Panicum virgatum
  misc_feature: Ceres CLONE 1780481
  misc_feature (5)..(498): Pfam Name: Mlo Pfam Description: Mlo family
MAGAAGGRDLPSTPTWAVALVCTVIVLISVAMEHGLHKLGHWFHTRQKKAMREALEKIKAELMLMGFISLLLAVGQSPIAKICIPAKAGSVMLPCKPKANGKSGGGNGRRRLLWYPGEEVNHRRFLAGAGPADDFCVNKGKVSLISANGVHQLHIFIFVLAVFHVVYSVATMALARLKMRRWKKWESETNSLEYQFATDPSRFRFTHQTSFVKRHLGLPSTPGVRWIVAFFRQFFASVTKVDYLTMRQGFINAHLSPNAKFDFQKYIKRSLEDDFKVVVGISLPLWFVAIFILFIDIRGLGTLIWISFVPLVILLLVGTKLEIVIMEMAKEIQDKATVIKGAPIVEPSDRFFWFNRPEWVLFLIHLTLFQNAFQMAHFVWTLLTPGLKDCYNEKLGLSIMKVVVGVTLQVLCSYITFPLYALVTQMGSHMKKAIFEEQTAKAVMKWRKAAKDKVKQREAGFDGLVSVDTTPSQSRATSPSRANSPVQLLHKYRGRSDDPHSAPTSPGGGQELGDMYPVADQYRLHRLDPERRRTASSSAVDIDIADADFSFSVQR

SEQ ID NO: 14995 - DNA, 746 bp, Panicum virgatum
  misc_feature: Ceres CLONE 1780496
  misc_feature: Encodes the peptide sequence at SEQ ID NO. 14996
accactctgcttgctccgctgctctgctccgccccaatcagtgagagctgccatccactgacccgccgcgagcgccaatggcggcggccgcggccctggcagcggccgtgctggcgctgtcatgcttcggcgcgcccgcgacggccgcgacggcggaggcggaggcgaaccgcatcggcagcctgccggggcagccgccggtcaacttctccatgtactccgggtacgtcaccgtggacgcggccgcggggcgggcgctcttctactggctcatcgaggcggccggcgcgcccgcggagtccgcgccgctcgtgctctggctcaacggcgggcccgggtgctcctccgtcggctacggcgcgtccgaggagctcggcgccttccggatcaaccccgacggcaggtcgctctccttgaacgcttacccctggaacaaagtggcgaacatgctgttcctggactcgccggccggcgtcggctactcctactccaacaccaccgccgatctgtacaccgccggtgacaacaagacagctcatgattcgtacaatttcttggtgaattggttggagcggtttccgcagtacaagcatcgcgatttctacatcacgggagagagctacgcaggtcactacgtgcctcagctgtctcagctagtgtaccggaacaacaaaggaattagaaagccaatcctgaacttcaaaggcttcatggtcggaaacgcggtaattgacgactaccatgac

SEQ ID NO: 14996 - protein, 222 aa, Panicum virgatum
  misc_feature: Ceres CLONE 1780496
  misc_feature (37)..(222): Pfam Name: Peptidase_S10 Pfam Description: Serine carboxypeptidase
  misc_feature: SWISSPROT Homolog: EC 3.4.16.6 Carboxypeptidase D
MAAAAALAAAVLALSCFGAPATAATAEAEANRIGSLPGQPPVNFSMYSGYVTVDAAAGRALFYWLIEAAGAPAESAPLVLWLNGGPGCSSVGYGASEELGAFRINPDGRSLSLNAYPWNKVANMLFLDSPAGVGYSYSNTTADLYTAGDNKTAHDSYNFLVNWLERFPQYKHRDFYITGESYAGHYVPQLSQLVYRNNKGIRKPILNFKGFMVGNAVIDDYH

SEQ ID NO: 14997 - DNA, 2009 bp, Panicum virgatum
  misc_feature: Ceres CLONE 1780499
  misc_feature: Encodes the peptide sequence at SEQ ID NO. 14998
aagcccgcttacacgtgaacttaccctaacccccctttctctgctccggtctcaagcgcgtaccctccgccgccggcgaccattccgcgcgcagccacgcttgcttcccccggccgccacgatgtcgtcggagcctccgcccaccgccgccgccgcggatgagctcgcggctgacctctccgccgccaccctcagcaagaagcagcagaagaaggacgccaggaagtcggagaaggccgagaaagcggcgcagcgccagcagcagcagcagctgccggcggacgccgaggaccccttcgcggccaactacggcgatgtccccgtcgaggagatccagtccaaggccatctccggccgctcgtggaccaagatcggcgacctcgacgccgacgccgcgggccgctccgtgcttatccgcggggccacgcaggctatccgtccggtcagcaagaagatggccttcgtcgtcctgcgccagagcatgagcaccgtgcagtgcgtgctcgtcgccagcgccgacgccggcgtcagcacgcagatggtgcgcttcgccaccgccctcagcaagaagtccatcgtcgacgttgagggcgtcgtttccctccccaaggagcccctcaaggccacgacccagcaggtggagattcaagtaaggaagatatattgcatcaatagggctatcccaaccctcccaattaaccttgaagatgcggcccggagtgaggcggagtttaagaaggctgaacaggctggagaaaagcttgttcgtgttggtcaagatacccgcttgaactacagagctattgatctacgaacacctacgaaccaagcaatattccggatccagtgtcaagtcgaaaataaattcagagaatttttgttgtcgaaggacttcgttgggatccacaccccaaaactgatttctggatcaagtgagggaggtgcagctgtattcaagcttttgtacaatggtcagcctgcttgtttggcgcaatctcctcagttgtacaagcaaatggctatctgtgatgggtatgaacgtgtatttgaggttggtcctgtgtttagagcagaaaattcaaacacacacaggcatctctgtgagtttgttggtcttgatgctgaaatggagattaaggagcattactttgaggtttgcgatattatagatggcttgtttgtgtcaatatttaagcacttgactgaaaactgcaagaaggaacttgagacaataaataggcagtatccatttgaacctctgcagtatctagagaaaaccttgaagctcacttatgaggaaggaattcaaatgctgaaggaagctggaactgaaatcgagcctatgggggatctcaatactgaagctgagaaaaaacttggtcggcttgttaaggaaaagtatggcaccgactttttcattctgtatcgctatcctttggctgtgcgtccgttctacaccatgccttgttatgacaacccagcttacaccaattcctttgatgtgttcattcgaggtgaggaaataatttctggagcacaaagaatacacacccctgagctgttgtccaagcgcgcaacggagtgtggtatcgatgtgagcaccatctcggcatacattgaatcgttcagctacggtgcacctcctcatggtggcttcggggtgggcctggagagagtggtgatgctgttctgcgccctcaacaacatcaggaagacctcgatgttcccccgcgatccgcagaggctcgtcccgtaattttccatgtcccaagtgaacacaaggctttcgccctgctttgcgatgctgttgccatcctcaccagccactgatctcagctgccgagaccaagaaacgacgaccgatgtagctgtgacacaatggacctggcgttaatgtggtttagagccttttctgttaaattcacaaagatgtttgtatgtactagtgggttgctggaggctggagacccgacaatgatatgtgctttctatattggcatattgcactc

SEQ ID NO: 14998 - protein, 544 aa, Panicum virgatum
  misc_feature: Ceres CLONE 1780499
  misc_feature (218)..(540): Pfam Name: tRNA-synt_2 Pfam Description: tRNA synthetases class II (D, K and N)
  misc_feature (96)..(183): Pfam Name: tRNA_anti Pfam Description: OB-fold nucleic acid binding domain
  misc_feature: SWISSPROT Homolog: EC 6.1.1.12 Aspartate--tRNA ligase
MSSEPPPTAAAADELAADLSAATLSKKQQKKDARKSEKAEKAAQRQQQQQLPADAEDPFAANYGDVPVEEIQSKAISGRSWTKIGDLDADAAGRSVLIRGATQAIRPVSKKMAFVVLRQSMSTVQCVLVASADAGVSTQMVRFATALSKKSIVDVEGVVSLPKEPLKATTQQVEIQVRKIYCINRAIPTLPINLEDAARSEAEFKKAEQAGEKLVRVGQDTRLNYRAIDLRTPTNQAIFRIQCQVENKFREFLLSKDFVGIHTPKLISGSSEGGAAVFKLLYNGQPACLAQSPQLYKQMAICDGYERVFEVGPVFRAENSNTHRHLCEFVGLDAEMEIKEHYFEVCDIIDGLFVSIFKHLTENCKKELETINRQYPFEPLQYLEKTLKLTYEEGIQMLKEAGTEIEPMGDLNTEAEKKLGRLVKEKYGTDFFILYRYPLAVRPFYTMPCYDNPAYTNSFDVFIRGEEIISGAQRIHTPELLSKRATECGIDVSTISAYIESFSYGAPPHGGFGVGLERVVMLFCALNNIRKTSMFPRDPQRLVP

SEQ ID NO: 14999 - DNA, 445 bp, Panicum virgatum
  misc_feature: Ceres CLONE 1780505
  misc_feature: Encodes the peptide sequence at SEQ ID NO. 15000
actttggctcacgagagatgaccctggtcccctccgcagccgttcccgggctcttccgcctttccttcgcgccgcggtttggattctcacctcggtctgcctcgatctcccgcgcgcgctcgaggaaccatgggaaggataagaagcgggagaggaacgacgggatcgcctgcgccactgctactgcggatgggccgcggagagacctcactgcgatcggggtccgttgcatcgggtggatgagctcgtctcacgtgggggaccttcaccgaggggttcttcttcggctcttcttccgccgcctaccacaacaactcacccgcttacgcgcatggccgaccgccaactatctggtatggttgcgggtggagattcggcaacattttctatttttcctgtgccgatgctgccgtatatgcttcccggccttgtccggacgatgttc

SEQ ID NO: 15000 - protein, 37 aa, Panicum virgatum
  misc_feature: Ceres CLONE 1780505
  misc_feature: Useful for making plants with altered carbohydrate content
MGRIRSGRGTTGSPAPLLLRMGRGETSLRSGSVASGG

SEQ ID NO: 15001 - DNA, 1833 bp, Panicum virgatum
  misc_feature: Ceres CLONE 1780526
  misc_feature: Encodes the peptide sequence at SEQ ID NO. 15002
aaaaaaaccactcatcatccgctgcttggctgcttcccctccccaccccggcgccgcgccaccatggccaccgccacggtgaccccgccgcaatgctggcgagggctccccgcttccgcgcgcgcacgcccgcctctctcctcccccctccgcattcacccccttgccgctcccttccgtcccccgaggccccgcaccgccagcacggcagccagcggaagaggaaggcgacccgccctggcctgctccccgaggtgcacgctggggacggccggcctcgcggggttcgaccctctggggctctacaaggagggcccgtcggggtctgaagcctcttcgcggtcgcccctgtcgatcttcttcggtatcctggcgccggtgtttgggagctccagcgggggtggcgccaggagggagaaggcgtcctatggccgaggagcagcagctgcaatcgaggatagctccattgacatcggtgacttcttcaagggtcctctacctgggaagttcctgaagctccttggttttttggccttgtctcgacttggtgtgtatatacccttgggtggggtgaaccgagaagcttttgctgggaaccttgaccagaacagcctgctgagcactttagattctttctccggtggtggtattggtcgtcttggaatatgctctcttggcattgtaccattcattaatgcacagattgtgtttcaacttcttgcacaactgtacccaaaattgcaagaccttcagcggaaagaaggggaagcaggaagaaagaaggttcttcagtatacaagatatgcctctgttggttttgcagttgtccaggctattggacaagtcctttatctccgtccttatgtgaatgacttcagcacagaatgggttctaacctcggtgacattattgacacttggatcagtctttactactttcattggtgaaagaatatctgatctgaaacttggaaacggaacatctcttcttatatttacaagtattatatcatatttgcctgcatcatttgggaggacagttgcacaggcatttcaagatgggaactatgttggacttatcacaatcatattgtcgttctttttgttggtccttggaattgtctatgtccaagaagctgagcgcaaaatacccctgaactatgcttctagatacagcagtcgaactgggggacttcaacgatctgcatatctaccgtttaaggtcaacagttctggtgttatgcctatcatattttcaacatcttctctggctttgcctggtactttggcacggttcactggcttggagtttcttaagaaggctgccgtagcccttaatccaggaggatctctgtatcttccaaccaatgtattacttatagccttttttaattactattacacatttctccaattggatcctgatgatcttagtgagcaattgaagcggcaaggtgcttcaattcctcttgtgagaccagggaaaagcacagctgcttatattaaaacagttctcagtcgtatatctgtcctgggatctgcgtttcttgctgtgctagctgctggaccttctgtggttgaacaaataagtcacttgacggcattccggggatttgctggtacatcggtgcttatccttgttggatgtgcaactgacacagctcggaaagttcaagcagaaataatttcccagaaatataagaatatcgagttctatgatgttaaccgttttgaccaatagttgatctcactggtcgttcttttcaacctgtacttaaattttcaattatgtaattgagcatcggattcttagctaagcattttatcattgttc

SEQ ID NO: 15002 - protein, 558 aa, Panicum virgatum
  misc_feature: Ceres CLONE 1780526
  misc_feature (200)..(535): Pfam Name: SecY Pfam Description: eubacterial secY protein
MATATVTPPQCWRGLPASARARPPLSSPLRIHPLAAPFRPPRPRTASTAASGRGRRPALACSPRCTLGTAGLAGFDPLGLYKEGPSGSEASSRSPLSIFFGILAPVFGSSSGGGARREKASYGRGAAAAIEDSSIDIGDFFKGPLPGKFLKLLGFLALSRLGVYIPLGGVNREAFAGNLDQNSLLSTLDSFSGGGIGRLGICSLGIVPFINAQIVFQLLAQLYPKLQDLQRKEGEAGRKKVLQYTRYASVGFAVVQAIGQVLYLRPYVNDFSTEWVLTSVTLLTLGSVFTTFIGERISDLKLGNGTSLLIFTSIISYLPASFGRTVAQAFQDGNYVGLITIILSFFLLVLGIVYVQEAERKIPLNYASRYSSRTGGLQRSAYLPFKVNSSGVMPIIFSTSSLALPGTLARFTGLEFLKKAAVALNPGGSLYLPTNVLLIAFFNYYYTFLQLDPDDLSEQLKRQGASIPLVRPGKSTAAYIKTVLSRISVLGSAFLAVLAAGPSVVEQISHLTAFRGFAGTSVLILVGCATDTARKVQAEIISQKYKNIEFYDVNRFDQ

SEQ ID NO: 15003 - DNA, 2015 bp, Panicum virgatum
  misc_feature: Ceres CLONE 1780530
  misc_feature: Encodes the peptide sequence at SEQ ID NO. 15004
cgccccggttccccaccgcccgcctcctcctccccagcaggcacctcccgctcccacccccgcctctccccttcgcgccccctcgcgccctccgcctccctccgccgccgcttccccgaggcgcccgccgccgctgccgccgccttcccccgctgctccgcgccatggcctccgccgccgccgccgccgccgccgcggaggcgccgcccgccccctcgcggcggctcgcgctggaggagctcccctgggaccactccttcgtccgcgagctgcccggggacccccgatccgacaccatcccgcaggaggtcctgcactcctgctactccagggtgtccccctcggccaaggtggacggccccaagctcgtggcgtcgtccgacgccgtcgccgacctcctcgatctggaccacaaagagtttgaaagacctgactttcctcagtatttttccggagcaactccactggtgggaagtttgccctacgcccagtgctatggaggacatcagtttggtgtatgggctggtcagttgggggatggaagagcgataacacttggggaggttgtaaactctcgaggtgagaggtaggagttgcagctcaagggttgtggaaagactccatacagcagatttgcggatggtcttgctgtccttcgcagtagcatccgtgaattcttatgcggtgaagctatgcatggtctaggcattcctacgacacgtgctctctgtctagttgaaaccggcaaatcagttctccgagatatgttctatgatggcaatgcaaaggaagagccaggcgcaattgtttgtcgtgtagcaccatcctttttacgttttggttcataccaaatacatgcttcaagaagcaaagaggatctggaaattgttcgtcgtttggcagactatacaatacgtcatcactatccgcatcttgaaaatatgaagaagagtgaaggtttatcatttgacgcagctataggagattctccagcaattgatcttacatccaacaaatatgcagcctgggcagttgaggttgcagagaggactgcttacttgatagccaggtggcaaggtgttggctttacccatggtgtactcaacacagacaacatgagcgtgctgggcctgactattgattacggaccatttggctttctggatgcctttgatcctagctatactccaaataccactgaccttcctgggaagaggtattgttttgcaaatcagcctgatgttggtttgtggaatattgctcagtttactggaccactatcatctgctgaacttgttagcaaagacgaggcaaattatgtaatggagaggtatgggacaaagttcatggatgagtaccaatctatcatgaccagaaaactgggcctgaccaagtataataagcagctaataagtaagctgcttaacaacatggcagttgataaggttgactataccaactttttccgtcttctttcaaacgtcaaagcggatcctggcattccagagaatgagctgcttgtgccactgaaggctgctctcctggatattgggaaagaaaggaaggaagcatggattagttgggtgcagacttatattgaagagctggtggagagtggcattcctgatgaagaaaggaaagctgcaatgaactctgtcaatccaaagtatattctccgcaactatctctgccagtcggcgatcgacgcggccgagcaaggtgattacgaggaggttcgtcggttgctgaaagtaatgcaacatccgtatgataagcagccggggatggagaagtatgcacggttgccaccagcctgggcgtacagaccaggagtgggcatgctgtcctgctcctcttgaacccagcataagggccggtgtttatcaccttttcctgtataggggattcagctttgtgctatgatgtgtaaagcatcacatgctatttctacctgtgatgcaagagtgtaagaagcttagttgcaagttctgcactatttgccatattgtaagatt

SEQ ID NO: 15004 - protein, 388 aa, Panicum virgatum
  misc_feature: Ceres CLONE 1780530
  misc_feature: Useful for making plants with modulated flowering time
MHGLGIPTTRALCLVETGKSVLRDMFYDGNAKEEPGAIVCRVAPSFLRFGSYQIHASRSKEDLEIVRRLADYTIRHHYPHLENMKKSEGLSFDAAIGDSPAIDLTSNKYAAWAVEVAERTAYLIARWQGVGFTHGVLNTDNMSVLGLTIDYGPFGFLDAFDPSYTPNTTDLPGKRYCFANQPDVGLWNIAQFTGPLSSAELVSKDEANYVMERYGTKFMDEYQSIMTRKLGLTKYNKQLISKLLNNMAVDKVDYTNFFRLLSNVKADPGIPENELLVPLKAALLDIGKERKEAWISWVQTYIEELVESGIPDEERKAAMNSVNPKYILRNYLCQSAIDAAEQGDYEEVRRLLKVMQHPYDKQPGMEKYARLPPAWAYRPGVGMLSCSS

SEQ ID NO: 15005 - DNA, 1629 bp, Panicum virgatum
  misc_feature: Ceres CLONE 1780533
  misc_feature: Encodes the peptide sequence at SEQ ID NO. 15006
gggaagcgaaacggggcccgtctctccccgcggaccgcatctcgccctcctgctcagtcgcgcgatccagtgaggcggcgcctgccatcgcaattcgcaggtccagctaccaacgggatgggtgaggaggaggaccagcggaagcgcatggtgggttccgagcgagaccaggagctggagccgcggccaggagaggaggaggaggtgaaggaggagggggcgaagaaacccgcgcctggcgaggcggaggccggcgacggcgccgccgcggaggcggcgaactgcgactactgcggcgccgccacggcggcggtctactgccgcgccgacgccgccaggctctgcctgccgtgcgaccgccacgtgcacggcgccaacggggtctgcacccgccacgcccgcgccccgctctgcgccgactgccgcgccgccggggccgtcctccgccgcgcctcctccgcggccttcctctgctccaactgcgacttcgggaggcaccgggacggcaccgccggcggcgagccggcgctccacgaccgctgcgcggtgcagccttactccgggtgccccccggcgaccgagctcgccgcgctcctcggggtgcccctcttcgacaagccggccgccgaagacggtggttggtggaacatctgggaggagccgcaagtgctcagcttggaggatctgatcgtgcccaccactccctgccatggcttccagcctctcctcacgccatcatctcccaagaatcggagcatctcggcggacgaaaagatgaacgaggagatcctccggcagctgggtgagcttgcagagtcagatggaggggtgcaggcagcagcaggtcacgaggaggcagagcaagctggagatcagttcccttcgggggcaccgccaccgcagtataccactggacatggcaattttggagcagagaacagccatgaggtcgcgaccatgcctactcctggctatgagaatggcagttggaacaacaatgattatcatgtcctaaatgatgcctgcaaggtcgagctcacatatgatcaggctccggtcagctcatctgaagcatgcttgtcatcatttgttccgatgtcggaaatctgccccaacaggagcaattttagcagtatggaggagaaccaccagactaatcctggccttggcacacctacgcaagctttccccaaaagaaccggatttgatgttgtgccctgccctgatcggggctcggtcatcttgcgctataaggagaagaggaagacaagaagattcgacaggcaggttcggtatgaatcacgcaaagttcgtgctgatggcaggctcaggatcaaggggcgttttgcgaaggcaaaccagacataaaacttaaggagaaaactgattaggagtgaagataatacaaaacgtgccataattttgtttgccttcagttccatagctgatagctcatagcctcatatacagtttgaatgttgtatgtatattgccgtcatgtggatacacttatttgaaaaagagatccagtccctgtaaatagccctacacccacgaattctaagattttgtcatgctggagatatcatgcacacgaaagaatagcatacattgttattttgttttggc

SEQ ID NO: 15006 - protein, 416 aa, Panicum virgatum
  misc_feature: Ceres CLONE 1780533
  misc_feature (371)..(415): Pfam Name: CCT Pfam Description: CCT motif
  misc_feature (51)..(98): Pfam Name: zf-B_box Pfam Description: B-box zinc finger
MGEEEDQRKRMVGSERDQELEPRPGEEEEVKEEGAKKPAPGEAEAGDGAAAEAANCDYCGAATAAVYCRADAARLCLPCDRHVHGANGVCTRHARAPLCADCRAAGAVLRRASSAAFLCSNCDFGRHRDGTAGGEPALHDRCAVQPYSGCPPATELAALLGVPLFDKPAAEDGGWWNIWEEPQVLSLEDLIVPTTPCHGFQPLLTPSSPKNRSISADEKMNEEILRQLGELAESDGGVQAAAGHEEAEQAGDQFPSGAPPPQYTTGHGNFGAENSHEVATMPTPGYENGSWNNNDYHVLNDACKVELTYDQAPVSSSEACLSSFVPMSEICPNRSNFSSMEENHQTNPGLGTPTQAFPKRTGFDVVPCPDRGSVILRYKEKRKTRRFDRQVRYESRKVRADGRLRIKGRFAKANQT

SEQ ID NO: 15007 - DNA, 1776 bp, Panicum virgatum
  misc_feature: Ceres CLONE 1780554
  misc_feature: Encodes the peptide sequence at SEQ ID NO. 15008
gattgcgcgttgtcaatccggtctcgtcttcctgcgtcggccccccttcgcctcgtacctctcggcttgtcggcggcggcggcggcggcggcgttgccggagagcaggagggggatggcacaccggctgctgcgggacgcgcaggcggatgggtgggagcggtcggacttccccatcatctgcgagtcatgcctcggcgacaacccctacgtccggatgttaagagcagaatatgacaaagagtgcaaaatatgtgcacgtccttttactgtcttccgatggagacctggtcgggatgcaaggtacaagaaaacagagatctgccagacatgttgcaagctgaaaaatgtctgccaggtttgcctgctggatcttgaatatggtctaccagttcaggtccgggatacagcgctcgccatcaattcgaacgatgcaattccaaggagtgatgtcaatcgtgaatattttgcagaagagcatgatcgaagggccagagctggcatagactatgattcttcctatgggaaggcccgtccaaatgataccattctgaagcttcagaggacagcaccatattacaagaggaacagggctcacgtttgcagtttctatgtacgtggtgaatgtactagaggtgctgagtgcccatatcgacatgagatgcctgaaaccggggagctatctcaacagaacatcaaagatcgttactatggagttaatgatccagttgcaatgaaacttttgagtaaagcaggtgagatgccatccctgacaccaccagatgatgagactataaggacactatacattggtggactcgatagcagagtaactgaacaggatttgagggaccagttttatgcccatggtgagatcgagtccgtaaggatggtgcttcagcgtgcatgtgcatttgtgacatacactacaagagaaggcgctgagaaggctgcagaggagcttgctaacaaactagtcatcaagggtgtgcgactgaagctcatgtggggcaagcctcaggctccaaagcccgaagaggatgaatcgggaaggcaggggcaggtttcccacggaggacttctccctagggctgtcatatctcagcagcaaggcagtgaccagcctcagcctcctggtatggagggccagcatcaaccaccagcaccagcatcatactacttcaacattccagctccaccagcagcagagcggactctgtacccgtccatggatcctcagaggatgggtgctatagttaagtcacaggatggagaaggcaacccagggccgcagcaagctggacaagctcagccatcaagcagctcaggacagggcggccatcctgcgccaccaccatactaccatggtcagtatccaccatactatccacctccaccatatggtagctacatgcatccacctcgcatgccctacccaccccagtatccaccataccagccgatgctagcaccaccagcacaagctcacgcaagttcatctcagcaaccagtgcaagcaggacagcagccacctcaaggccctcccgctcagtcacagcagccggcgcccggcccttcagtgcagcagcagccatcccagaactgaggtacttgcaagatattggatattgctactgttgtaattcctctctgagggaggatgaaaccctcgttggtcgccaacttttgtaatttcttaatctgtgattaacagtaacacatcgtgttattgcttatcttactttgaaaacggagatatactggatctatccagcat

SEQ ID NO: 15008 - protein, 496 aa, Panicum virgatum
  misc_feature: Ceres CLONE 1780554
  misc_feature (230)..(296): Pfam Name: RRM_1 Pfam Description: RNA recognition motif. (a.k.a. RRM, RBD, or RNP domain)
MAHRLLRDAQADGWERSDFPIICESCLGDNPYVRMLRAEYDKECKICARPFTVFRWRPGRDARYKKTEICQTCCKLKNVCQVCLLDLEYGLPVQVRDTALAINSNDAIPRSDVNREYFAEEHDRRARAGIDYDSSYGKARPNDTILKLQRTAPYYKRNRAHVCSFYVRGECTRGAECPYRHEMPETGELSQQNIKDRYYGVNDPVAMKLLSKAGEMPSLTPPDDETIRTLYIGGLDSRVTEQDLRDQFYAHGEIESVRMVLQRACAFVTYTTREGAEKAAEELANKLVIKGVRLKLMWGKPQAPKPEEDESGRQGQVSHGGLLPRAVISQQQGSDQPQPPGMEGQHQPPAPASYYFNIPAPPAAERTLYPSMDPQRMGAIVKSQDGEGNPGPQQAGQAQPSSSSGQGGHPAPPPYYHGQYPPYYPPPPYGSYMHPPRMPYPPQYPPYQPMLAPPAQAHASSSQQPVQAGQQPPQGPPAQSQQPAPGPSVQQQPSQN

SEQ ID NO: 15009 - DNA, 1661 bp, Panicum virgatum
  misc_feature: Ceres CLONE 1780568
  misc_feature: Encodes the peptide sequence at SEQ ID NO. 15010
actcattcactcaccaagaagttgagcacctagagcttcagctcagctcattcgtttcttccggcttcccatccgggcttatcactagtgatcgctagctagcgaacaattctctgaagttgtcgagctgagcactagctagcggccatgatctccccggacaccatccgcacggccattggcgtcatcggtgagtcgccgccaccgccgcccgctggctacgccgtcgctacctctgcacgaacgcatgtacgcagaggagcagctgcaacatgcagcagaagtgctgtggagcctgcctgtgatagatggcactagctggtcatgtggggtgtggggctcttttcatgctacttccttgcttccttccgcacgcccccaccttcctcagctcgtttatttttcatccatcccttttctcttcgtttgtgttttagcaaagctttacacatgtccccgtcgcatcacaagcttttgatccctgccaattcaaggcttgttcccccgggtttatttcctggagagctatgaccattttgtttcttatgcttgttcataatttgctacgatccagttggtgatcttctgtatattgatctttggtttctctttcgttctgtctatctcgcaggcaatgggactgctctggtgctcttcctctccccagttccgacgttcatccgcatctggaagaaggggtcggtggagcagtactcgccggtgccgtacgtggcaacgctcctcaactgcatgatgtgggtgctgtacggcctaccgcttgtccacccccacagcatgctcgtcatcaccatcaacggcaccggcatggccatcgagctcacctacgtcacgctcttccttctctactccacgggacccgctcgccgcaaggtcgtcctcctcctcgccgccgaggtcgccttcgtctgcgccgtcgccgttctagtgctcagcctggcgcacacgcacgagcgcaggtccatgatcgtcggcatcctctgcgtcctcttcggcaccggcatgtacgcggccccgctctccgtcatgaaaatggtgatccagacgaagagcgtggagtacatgcccctattcctgtccctagcttctctggtgaacggcatctgctggactgcctacgccctcatcaaattcgacctctacatcacaatccccaacgggctgggcgttctgttcgcggtggcgcaggtggtcctctacgccatctactacaagtccacccaggagatcatcgaggcgcacaggcgcaaggcaaaccaggtcgccatgaccgaggtcgtcgtcgacgacggcaagaccaacaacagccacgccggcgccggcctctactgacgaagtcatcgatgatatataccaagattaaggaagcgctcggcacaatataatcaagtatcaagtcgccgctggatgcctgtattgtgtgattgtgttcttcccacaagagatggaggccacatcatgttgtttcctaactgcttgcgcagcgctggacggagtcaccgggcctcttattaggtgggagtgatgggacgactgaggtgggggattttagctaattccaccttgccgatagggtttagcttaatctcgatgtgtagcggcacttattaatggtctcttgtctcaaatttgtattgatcacg

SEQ ID NO: 15010 - protein, 199 aa, Panicum virgatum
  misc_feature: Ceres CLONE 1780568
  misc_feature (78)..(164): Pfam Name: MtN3_slv Pfam Description: MtN3/saliva family
MMWVLYGLPLVHPHSMLVITINGTGMAIELTYVTLFLLYSTGPARRKVVLLLAAEVAFVCAVAVLVLSLAHTHERRSMIVGILCVLFGTGMYAAPLSVMKMVIQTKSVEYMPLFLSLASLVNGICWTAYALIKFDLYITIPNGLGVLFAVAQVVLYAIYYKSTQEIIEAHRRKANQVAMTEVVVDDGKTNNSHAGAGLY

SEQ ID NO: 15011 - DNA, 1724 bp, Panicum virgatum
  misc_feature: Ceres CLONE 1780574
  misc_feature: Encodes the peptide sequence at SEQ ID NO. 15012
atccaaccggtcccacgcctgacagtctccggcggcggccggcggcagagggagcggcggagcgggcagcgcccgtcgaggtcgcgagctgccagtgaggggcgaccgggcgagctgcgcatgcggcttccaggagcgccggggcggcggccaggcgtctagggagcgaataacttctgtaacgtcaaatagccatccagcaaattttggccatcaggattcagacaaccagacccctgtcttccctgtcaaagcagtcaagagtctgcataggaactggagatggtgcaacctgagccaatggcgaagcgcagcatggcatgtagccagggtgtaggtggcgctgtggaccggcttagcgcgctgccgattgagctcatccacaccgtgttgtcattcctcccagccccggaagttgtgcggacatgtcttctgtcacagcagtggagaagtctttggcgctctgcgccctgcatcgacctcgatgatgaggactttgggatctccatgatgaccatccatgatggtaccttggaggagaagtgggccaagtttgaggatttcgccaccaacctgctgctgttccatgataatacctcgtccttgggagaattccggctttcatctagcatctataaccagcatcatattgaccgatggattcgccgtggcatcgagtactgcccttctgtgctcaaaattcagatacaggtatatcctcgcttcaagttgccaccaatagtgggctcaaatttttgtcatcttaagacactgtatcttcaaaatgtggatttgggtagccattttgcgggcctgttctgttcggcatgccctgtcatggaagatttggagcttgataactgcgagttttctggcaacccttctcaaggcgttacatcatcctcactgaaaaatttggtattagaattttgtgagtacaacacagattatccgttggtgatcacagttcctagcctcgcaaatctgcgtctcatgtttggatgctacgaatatggtatttctttatgcaagatggattcccttatcaaggcagagatttatgttgcagaatacgaaacaacgttgcctcagcattcccagcgtgagcttctttgtagcctctacaatgtgacatgcttaaaattggtgggttttgaagtggaggaaatactgaatgaggagtctgataaattcccaaaatttcataatatgcgaaccttgaaccttcatagctgttttcatgatgattatgaactgtacaaaaaattagaggttttggggagctttctttgtagtgcgccttgtttggagaaacttattttgaagtattgcatgttctctccgtcttctgattcagagtgggagataggaaagaaaaatatcactctgcgttgccaggatggaaagacattccagtgtccaaagctgaagttgattgaagtcatctacaatcacgacaataatcaccaactaattgaacttttgtggagcctcgggaggagcctaccagacgccaggattgaacttaagaaaatcgagttgtttcttggctagtacatttctttgtgcaatcttccgtgaggcatttgtctttgcacatttcttagcatattgagtggacgtgtatgtgcgctgtgtgggcatgagttgggcacatgtgttccattatgtattgaacttgcgtgatgtaggatatgtttattcagatatgagtgttttgattt

SEQ ID NO: 15012 - protein, 423 aa, Panicum virgatum
  misc_feature: Ceres CLONE 1780574
  misc_feature (23)..(70): Pfam Name: F-box Pfam Description: F-box domain
MVQPEPMAKRSMACSQGVGGAVDRLSALPIELIHTVLSFLPAPEVVRTCLLSQQWRSLWRSAPCIDLDDEDFGISMMTIHDGTLEEKWAKFEDFATNLLLFHDNTSSLGEFRLSSSIYNQHHIDRWIRRGIEYCPSVLKIQIQVYPRFKLPPIVGSNFCHLKTLYLQNVDLGSHFAGLFCSACPVMEDLELDNCEFSGNPSQGVTSSSLKNLVLEFCEYNTDYPLVITVPSLANLRLMFGCYEYGISLCKMDSLIKAEIYVAEYETTLPQHSQRELLCSLYNVTCLKLVGFEVEEILNEESDKFPKFHNMRTLNLHSCFHDDYELYKKLEVLGSFLCSAPCLEKLILKYCMFSPSSDSEWEIGKKNITLRCQDGKTFQCPKLKLIEVIYNHDNNHQLIELLWSLGRSLPDARIELKKIELFLG

SEQ ID NO: 15013 - DNA, 1612 bp, Panicum virgatum
  misc_feature: Ceres CLONE 1780584
  misc_feature: Encodes the peptide sequence at SEQ ID NO. 15014
aaaaaaaaattgtaatctaccgtacaaagatcaaagtgtacattcatacatgtgagtacttgcgcccatatcgagcgtacaggggacatcactgacgagcaagatcgctgcacgctgccgttgaggagagatgattgccacgggcagcttggcgaagaaggcggcggcggccggggcggtgggcggcaaggcggcgcgggcctgcgacggctgcctgcgccggcgggcgaggtggtactgcgcggcggacgacgcgttcctgtgcaaggggtgcgacacgtccgtgcactcggcgaacccgctcgcgcggcgccacgagcggctgcgcctgcgcccgacgtcgccgctgtgcgcgccgccggcgcccgcgggggaggaggcgcggcgcgagcctcgggacgaggtggtgcccgcgtggttcaagcgcaaggcgcgcacgccgcggggcgggcacgccaagagcctcgggcaggcgctgtcgcggcggctcgtcgtgccggaggcggcgagcggggcggactcgcccgaggggcggaacggggaagaagaaggggaggtggaggaggaggaggagcagctgctctaccgagtgcccgtcttctacccagmcctcgctgagttctgctcaccgccgcctcttgaggacgcggcggccgtcgcgtcgtcgtgcaacgaggacggcgccgtcgaggaccccgcgaagccggctccggctccgccgccggcgcagctcttccccgacggccatgccaacttcgagcccacctacgccgagctcagggagttcgccgctgacatggaagccctcctggggcgcggcctcgacgacgggaacgaggaggactcgtcgttctacatggagacgctggggctcctcgacccggtggacgccgacgccgcgcgagtcaaggtggagatcgacggcagcggggcctgcgaaattaccagcggcacgctggcggcgtgcggcctcgagctggaggcggaggcatccgacgacatgctggacatcgacttcgactacggctcgccggatcaggagacgccgccggacgagaaggccgggagcaacgacacgagcgccgacgcccagttcttgcagacgagcctctcgctcaccctcaactacgaggcgatcatccagagctggggtagttcgccgtggaccggcggcggcgagcagccgcacgtcaagctcgacggcagctggccccacgactacacgggcatgtggttggtgggaggactcgccggccacggcggcgaggagctctgcacgccgaggctgggggtgatggacggcggccgggaggcccgagtgtcccggtaccgagagaagcggcggacacggctcttctccaagaagatccggtacgaggtgcgcaagctcaacgccgagaagcggccgcggatgaaggggcgcttcgtcaagcgcgccaccgccgggggcagcgtcgccgccgtcgcgtaatgccccggccgcgtgccgggccggccggccggcggcacgcccctcgcccggtcgtcgtagatgatgacacgaacagaacaactcgtcgaagctgctttaaattagttcattcaacttgaatgcaaatttttttcacggatc

SEQ ID NO: 15014 - protein, 446 aa, Panicum virgatum
  misc_feature: Ceres CLONE 1780584
  misc_feature (393)..(437): Pfam Name: CCT Pfam Description: CCT motif
  misc_feature (20)..(67): Pfam Name: zf-B_box Pfam Description: B-box zinc finger
  misc_feature (160)..(160): Xaa is any aa, unknown, or other
MIATGSLAKKAAAAGAVGGKAARACDGCLRRRARWYCAADDAFLCKGCDTSVHSANPLARRHERLRLRPTSPLCAPPAPAGEEARREPRDEVVPAWFKRKARTPRGGHAKSLGQALSRRLVVPEAASGADSPEGRNGEEEGEVEEEEEQLLYRVPVFYPXLAEFCSPPPLEDAAAVASSCNEDGAVEDPAKPAPAPPPAQLFPDGHANFEPTYAELREFAADMEALLGRGLDDGNEEDSSFYMETLGLLDPVDADAARVKVEIDGSGACEITSGTLAACGLELEAEASDDMLDIDFDYGSPDQETPPDEKAGSNDTSADAQFLQTSLSLTLNYEAIIQSWGSSPWTGGGEQPHVKLDGSWPHDYTGMWLVGGLAGHGGEELCTPRLGVMDGGREARVSRYREKRRTRLFSKKIRYEVRKLNAEKRPRMKGRFVKRATAGGSVAAVA

SEQ ID NO: 15015 - DNA, 704 bp, Panicum virgatum
  misc_feature: Ceres CLONE 1780585
  misc_feature: Encodes the peptide sequence at SEQ ID NO. 15016
acgcctctacagtcttgacttcccctccctcccctctctctctctctccggcggccggaaatctcctcaaattccgctgattttatccctgctgaccagcaggcgagggggaaggacgactcttgagctcaatttcttggaggatcggctggcatttgtaagatagtgctcaggaacggggacatgagctgcttgccgtgctccggttcgtcggggaaggatgccaagagcttggaagcgctctcgccgtccccccggcctgcggcgaagtcggcaccagttcggtcaaattcacgtgcttcaggctccaggaaggaaaattctgtacctgttcgcagaggaggaaatacttcacatggcccagcacagattttcactttccgggagttggccattgctaccaagaatttcaggaaagattgcctgttgggagaaggtggctttggtcgtgtgtataaaggacgcatggaaaatggacaggtcattgctgtgaagcaacttgatagaaatggctttcaaggaaatcgtgaatttcttgtggaggttctcatgctaagtctcttacaccaccctaatctggtcagattaattggctattgcgcagatggtgatcagcgcctcctagtttacgaatatatggcgttgggatcactagaaaatcatctgtatgattgtccgccagacaaggaacctcttgactggaa

SEQ ID NO: 15016 - protein, 173 aa, Panicum virgatum
  misc_feature: Ceres CLONE 1780585
  misc_feature (76)..(173): Pfam Name: Pkinase_Tyr Pfam Description: Protein tyrosine kinase
  misc_feature: SWISSPROT Homolog: EC 2.7.11.1 Non-specific serine/threonine protein kinase
MSCLPCSGSSGKDAKSLEALSPSPRPAAKSAPVRSNSRASGSRKENSVPVRRGGNTSHGPAQIFTFRELAIATKNFRKDCLLGEGGFGRVYKGRMENGQVIAVKQLDRNGFQGNREFLVEVLMLSLLHHPNLVRLIGYCADGDQRLLVYEYMALGSLENHLYDCPPDKEPLDW

SEQ ID NO: 15017 - DNA, 632 bp, Panicum virgatum
  misc_feature: Ceres CLONE 1780585-R
ccgctgttaaggtcgacgcccgtgagaaatagaatgcagagccgggcaaattctgcaggcagctttgatagtacatgtgattgatggattataccattctttccttgctatcaattttgccaggaaccttcagtgcttggcacgagtcttttttgaccggacattattgagagttgaacactattactgccacatactccatgtttggtttttagttgctccatggaccacttctacagttcttccaggttttacctcaagactcagggtgatgacaagaagaaccattccgtcactgagatttatagacttcagagcacgcattctgatgagaatcggctacattccagactgtcagccaccccactgtgatggacgctgcagtatgcatcattgaaaagtaggggtgagttttcttgttttacttttgtagaaattacgcttcgtgtgacaatgtgctgcggtgcagcctggattgtgtgtctgtacatgtaaatgggttgtacttgtaagtagacctgtttatagaggatttttttttcttttgtcggtgatgatgtgatggagtgatttgcagacgacttgtcacacatagttctgtacagaaaaggatgtttgatttttggcttgct

SEQ ID NO: 15018 - DNA, 2218 bp, Panicum virgatum
  misc_feature: Ceres CLONE 1780590
  misc_feature: Encodes the peptide sequence at SEQ ID NO. 15019
actcccagatctcccctcctcccccgcgcctcctctctcgcgtcgccacgatggccgacgagaccctcgacccgccgccggacgcggccccgtcgacgacgccgccgcctcacgccgcccccaccgcgctgctccgcccgcggcgggaggcgttcgagcacggcctcctgcccatccccaagctcatcttcccggagggcacgctggcgcagaccctcgcgcagctcaaggagaagctcgcggccgcggcgggccccggcgggcgcgtgggcgccgcggcgctggcggaggcgctgcagatcccgcaggagcaggccgcgctcgcgctcggcacgcttgcggccgtgctcccggccgaggaccccgcgctcggggacggcaccggggacgccgcggccgaggacatccgcgacgtgctgctcttcctctacatccagtcctacaagcgcctcgtcccgcggagcgcgcacaaggactcgcccgccgtcgcggacgtctggccctccacctccgcgttcgatgggtacctctccgcgctctccccgatccagcttgttcgcagtaacagccgtcgttttatgccttctcaagctgatgaagaaattcatcagttatcctatctgcaaaagcatatggcaaatattcttactctcttggcagattctgttgagggtgagggtgacgattctctggtattgacaatggagagttttgagcaccttggatttctagttcaattctcagaaggaacttccttaagccaggctgctacattttttgcgaactcggatccagacatgcctgctgctcccgtcgctgctgctcaggttcttgattggatgtcacagaacatagcttcttcactggaatattctgctgagaggtctgcagcaaaggaaagcaaccagcaaactgtgtctgatcttgatgtaaccatggctgaggccaatacaagtcattcacggaacagcacaccaagttccaatcctgcatactacagaaatgtaacttttgtggagggcttttcaaaaacctctgttgtcaagcatgcatctgatgtcaaagggaattcaataaaggttctgaactgccatgattctgttatctacatattagcaccagtgaagtatgctactgtgtatggttgttctgatgctactgttgttcttggtgctgttggtaaggtagtaaaggtggagcattgtgaaagagtgcatatcattgcagctgcaaaacgaatttgtattgccaactgtcgtgagtgcatcttctacttgggagttaatcaccaacctcttgttttgggggacaaccataaattacaagttgccccattcaatacgtgctacccgcagctgcaggatcatttgatgcaagttggtgtcgatcccagtatcaacaaatgggaccaaccttttgtgttgggagttattgatccacacgattcattatcccatcctgctggggtttctgatgttaaggctgaatctgcttcatgtctggatcctgatctatttacaaactttttgattcctagttggtttggggatgaaaggcaagagcccacaagctgcaatcctttccctttgcctgaaatatatggggcattccaaagcaaaaagctttctactttggaagatattcagaagacgattcgggagctacagcttgatgagaatcggaaaagggaatttgcgactgcccttcatgcacagttcaaggattggttatatgcttcgggcaatatccgccagctctactgtctacaaggtgattaaccatgcaatgatttgcactcataaacggaattgcacacctgcaagactgtttatcctttgccgacaagaaaacattcgacgattgtcgaagctgaccttcccggagaagatttctgcctggtcacccacccagcatgtagtattcacacaaggatgtaaaaaaagtggagtgtactatttccttttctttttttacagattcatgatttcccaattttcccgaaatcttctcttggctgcgagttgggtatttaattaggatgtaatcttgttttcctggtgtttactcatttttggcccttcataacacccacgagtatgtaatagggatcaatggatcaacgctgttaaataaacctttcatttctctttcttaaataggttttgatttgtccatgtaaacctgtacggatcattgctatagagaagtgcatttgttc

SEQ ID NO: 15019 - protein, 575 aa, Panicum virgatum
  misc_feature: Ceres CLONE 1780590
  misc_feature (339)..(456): Pfam Name: TBCC Pfam Description: Tubulin binding cofactor C
MADETLDPPPDAAPSTTPPPHAAPTALLRPRREAFEHGLLPIPKLIFPEGTLAQTLAQLKEKLAAAAGPGGRVGAAALAEALQIPQEQAALALGTLAAVLPAEDPALGDGTGDAAAEDIRDVLLFLYIQSYKRLVPRSAHKDSPAVADVWPSTSAFDGYLSALSPIQLVRSNSRRFMPSQADEEIHQLSYLQKHMANILTLLADSVEGEGDDSLVLTMESFEHLGFLVQFSEGTSLSQAATFFANSDPDMPAAPVAAAQVLDWMSQNIASSLEYSAERSAAKESNQQTVSDLDVTMAEANTSHSRNSTPSSNPAYYRNVTFVEGFSKTSVVKHASDVKGNSIKVLNCHDSVIYILAPVKYATVYGCSDATVVLGAVGKVVKVEHCERVHIIAAAKRICIANCRECIFYLGVNHQPLVLGDNHKLQVAPFNTCYPQLQDHLMQVGVDPSINKWDQPFVLGVIDPHDSLSHPAGVSDVKAESASCLDPDLFTNFLIPSWFGDERQEPTSCNPFPLPEIYGAFQSKKLSTLEDIQKTIRELQLDENRKREFATALHAQFKDWLYASGNIRQLYCLQGD

SEQ ID NO: 15020 - DNA, 964 bp, Panicum virgatum
  misc_feature: Ceres CLONE 1780599
  misc_feature: Encodes the peptide sequence at SEQ ID NO. 15021
acttcctcccctcccctcccctcccaccccccggcggcggcctccctcctccctcccaggcgcacgcaggtcagcgagatgtcggcggcggaggcgaaggcggcgccggtgccggagtcggtgctgcggaagagcaagcgcgaggagcagtgggcggcggacaagaaggagaaggcgctcaccgacgggaagaaggcgctcgagagccgcaagatcatcttcgcccgcgccaagcagtacgcgcaggagtacgacgcccaggagaaggagcttgtgcagctcaagcgtgaggcccggttgaagggtgggttctatgtcagccctgaggccaagcttctgtttgttgtccgcatccgtggtatcaacgccatgcaccccaagacccgcaagatcttgcagcttctgcgtctaaggcagatcttcaatggtgtcttcctcaaggttaacaaggctaccattaacatgctgcgcagggtcgagccatatgttgcatatggatacccgaacctgaagagtgttagggaattgatctacaagagaggttatgggaagctgaacaagcataggattcctctgagcaacaacagtgtcattgaggagggccttgggaagcacaacatcatctgcattgaggatcttgtccatgagatcatgactgttggcccacacttcaaggaggccaacaacttcctctggccattcaagctgaaggcaccgcttggtggcctgaagaagaagaggaaccactacgttgagggtggtgatgctgggaaccgtgaaaactacatcaacgagctcatcaagaggatgaactaggttcttgtatcctgtgagaatgatttcaatgtctgagaagtactctagggagttgatgctggatcgcgatggatgtgcaattttggcattccaaacagaatgtagacttgttttttcagtgagacttccaataggattttgctgttcc

SEQ ID NO: 15021 - protein, 245 aa, Panicum virgatum
  misc_feature: Ceres CLONE 1780599
  misc_feature (14)..(84): Pfam Name: Ribosomal_L30_N Pfam Description: Ribosomal L30 N-terminal domain
  misc_feature (86)..(137): Pfam Name: Ribosomal_L30 Pfam Description: Ribosomal protein L30p/L7e
MSAAEAKAAPVPESVLRKSKREEQWAADKKEKALTDGKKALESRKIIFARAKQYAQEYDAQEKELVQLKREARLKGGFYVSPEAKLLFVVRIRGINAMHPKTRKILQLLRLRQIFNGVFLKVNKATINMLRRVEPYVAYGYPNLKSVRELIYKRGYGKLNKHRIPLSNNSVIEEGLGKHNIICIEDLVHEIMTVGPHFKEANNFLWPFKLKAPLGGLKKKRNHYVEGGDAGNRENYINELIKRMN

SEQ ID NO: 15022 - DNA, 1522 bp, Panicum virgatum
  misc_feature: Ceres CLONE 1780603
  misc_feature: Encodes the peptide sequence at SEQ ID NO. 15023
attcccgatccccactcggtggccacgcgcgccggcttctccctccgcctccgccttcgcgatgataacccaccatccctccctgctccgtccgcccatcctgacccgccgcgtcggggtactcggccggcgtccagcactccacgccttcctgtccgccgccgtcgcctcggctcgcccttgtacgccgcccctccgcctgcggcctgtgcgcgccgccacctcgcaggttggtggtgatggaggcaaaggcgcggtgccgcctcgagcgctgggggccgcgctgctcgacttcgcgagtagcaacttcctcccccttgctcttgttggtggggtcatattgggtctcctagatcctaatcttggatgccttgctcacaaatactccttgtcgaagtacagcacttttgggatatttgtgatctcaggactgaccctgcgaaccaaggagcttggtgcagcattagaagcttggcctgctggactatatggactagcctctattttgctgtttacaccctttcttgctcagtttattatgcgacttcagctctttcctcgtgaatttatcactgggttagcaatgttttgctgcatgccaacaacattatcaagtggagtcacactaacacagcttgttggcgctaactctgcacttgctcttacaataacagttgtatccaatttacttggcattatctttgtacctctttctctagcaatgtacattggcgctggagctggggtgtctctgcctactgagcaactattcagaagtctggtcacccgccttctaatccctctgattatagggaaggttgctcgagaagcctcaaaaggtattgctgattttgttgatggaaatcgacaaggtttttcagttgcaagtgctgttcttctcagcctagtcccatggattcaagttagtagatcaagatcactaatcttatctgttcaagtaaaagcttttgctgctgctattgctattggagtgcttctacatcttgctctgtttgctttcaatgccgtgatgttgcagatcttgtcacgtcttgaacagaaaggggattcagtctttgctaaaaaagagtacgcacgagctgtcattttggtggccagtcagaaaacattgcccgtgttggttgctgtggttgatcagcttggaggagcctttggggagtctggatttctggtcatccctggcgtcgctgcacacattaaccagatcattatcgattctatgatagtaaattggtggcgcaagagggatcaacaatttactactgcgaactaacatcaaaattgaattttggcatgtaaaacagtgttcaatgtttatcaagtttcaagtgacactcatacaaaatgaggttacatattcagtctgaatgaaagcagccatatcgagattattttacacagaaatgctttcttgcctgaaggaatgatactgtcttgcctccatgatcctcccactcaacgttttcggatagttgaataataaatcaaagcattgattgtc

SEQ ID NO: 15023 - protein, 410 aa, Panicum virgatum
  misc_feature: Ceres CLONE 1780603
  misc_feature (115)..(298): Pfam Name: SBF Pfam Description: Sodium Bile acid symporter family
MITHHPSLLRPPILTRRVGVLGRRPALHAFLSAAVASARPCTPPLRLRPVRAATSQVGGDGGKGAVPPRALGAALLDFASSNFLPLALVGGVILGLLDPNLGCLAHKYSLSKYSTFGIFVISGLTLRTKELGAALEAWPAGLYGLASILLFTPFLAQFIMRLQLFPREFITGLAMFCCMPTTLSSGVTLTQLVGANSALALTITVVSNLLGIIFVPLSLAMYIGAGAGVSLPTEQLFRSLVTRLLIPLIIGKVAREASKGIADFVDGNRQGFSVASAVLLSLVPWIQVSRSRSLILSVQVKAFAAAIAIGVLLHLALFAFNAVMLQILSRLEQKGDSVFAKKEYARAVILVASQKTLPVLVAVVDQLGGAFGESGFLVIPGVAAHINQIIIDSMIVNWWRKRDQQFTTAN

SEQ ID NO: 15024 - DNA, 1747 bp, Panicum virgatum
  misc_feature: Ceres CLONE 1780611
  misc_feature: Encodes the peptide sequence at SEQ ID NO. 15025
aagcaagtcccagctctccactcccatagtccaatggccaccgcatccaacaccacccactcgcctccttccatcatcccccaccaacaggacgaggacgacgacgacctcgatgacgaagccgacgacgagccctccgcgtccccgtccgaggaggcgcgccacgaggccgtgctccggcggctcaccgcggatgaggtccggatccgggtgtaccaggtcacgatccggggctgcgctcgcacgcgccgcgccgcggtcgaggccgcggtgggcccggacctcgcgcgcgccgccaccgtgcgagacctcgtgcgcgccgccgccgcggccggctaccgcctccggcgcctcggcgccttcgatactgtctccatcacgctcgacgcggctccgtcagggatccccggcagcgccgtcgtcgtacttgttgacgtcgcagaggcccgcggccgcgctgccgctggattcggcgtcttcgccaacacccagactcaatcgtgttcacttgaaggttcactgaagttgaagaacttatttggatactgtgagacctgggatgcagcaggtgctcttgaattagataagacaacagaactaagtgctggagtggaaatgcctagaatcggagcgataccaactccgctggtggctagaatatcatttctgtccgaggactggttgaagtcctcactcaaagaacacctgatgggcgtttctgttggcttgctctccaccatgaaccacaacctttcttacaatttggcatggcgaaaattaactgatccagcacgcatgtcatccaattctgtacaagaacagttaggacatagccttttgtcctctgttaagtatgcatacacggttgaccaaagggactcgagcataaggcctacacgtggatatgcttttctctcgtcttctcaagtaggaggtcttgcaccagggagcagatattcacggtttcttagacaggaatttgatcttcgagtggctttgcctctgggtgtgcttaatggtgctctcaatgccggagttgcagcaggagtcatccatccattggaaaagggttccacgggatctgtgtcaccactttcagaaatgttttacttgggaggtaacaggtcccttgtatgccgcttgggtggaccatcatcactcttaggcttcaaaacaagaggactaggagcaagggagttcagggtctgtaaccccaacaattctgaaaatggtagttccagttgtcctgagctaattggtcttggtggtgacatagcagtggcagcatttacggacctctcctttgatatacctctgaagccactcagggatctaggaattcatggccatgcatttgtctgtgctggaaatcttggtaaattaactgagtgtgatttacggaaatttccccttaccgacttcctacaaacgttcaggagttctgccggatttggtgtagtcctgccaaccagattgtttcgcatagaggtaaattactgccacatcctgaaacaatttgaccatgacaagggaaagacaggcatacagtttaactttgcttcaccctaatttcattggcaagaagttcacatcaagatgaatagttgtattttttccctcactactctgatttttatccttttgacagagcttaccttgcgcactctaagtgataaattgcttgttctgggctgtggatttgatgttgtgacttgtaagtgaaaggggctctagcctatttgttcag

SEQ ID NO: 15025 - protein, 511 aa, Panicum virgatum
  misc_feature: Ceres CLONE 1780611
  misc_feature (167)..(510): Pfam Name: Bac_surface_Ag Pfam Description: Surface antigen
MATASNTTHSPPSIIPHQQDEDDDDLDDEADDEPSASPSEEARHEAVLRRLTADEVRIRVYQVTIRGCARTRRAAVEAAVGPDLARAATVRDLVRAAAAAGYRLRRLGAFDTVSITLDAAPSGIPGSAVVVLVDVAEARGRAAAGFGVFANTQTQSCSLEGSLKLKNLFGYCETWDAAGALELDKTTELSAGVEMPRIGAIPTPLVARISFLSEDWLKSSLKEHLMGVSVGLLSTMNHNLSYNLAWRKLTDPARMSSNSVQEQLGHSLLSSVKYAYTVDQRDSSIRPTRGYAFLSSSQVGGLAPGSRYSRFLRQEFDLRVALPLGVLNGALNAGVAAGVIHPLEKGSTGSVSPLSEMFYLGGNRSLVCRLGGPSSLLGFKTRGLGAREFRVCNPNNSENGSSSCPELIGLGGDIAVAAFTDLSFDIPLKPLRDLGIHGHAFVCAGNLGKLTECDLRKFPLTDFLQTFRSSAGFGVVLPTRLFRIEVNYCHILKQFDHDKGKTGIQFNFASP

SEQ ID NO: 15026 - DNA, 1697 bp, Panicum virgatum
  misc_feature: Ceres CLONE 1780612
  misc_feature: Encodes the peptide sequence at SEQ ID NO. 15027
acgctttccgcccacgaaaacgtaaatttatttgtctaaaggagtgtggaaggcggctggctgcttgcggtctccttccgtctccgactccgagcgagcgatcagcccgtgggggagggggatccgccgaggcgcgcgagaatgcagggcggatccagcggcatcgtctacggcggcctcaagtaccaggcgcggtgcatcgcggacgtgcgcgcggacgccggctccaccaccttcctcgccgggaccctcagtctcaaggaggagaacgaggtgcacttgatccggctgtcgccgggggagagcgagctggtgtgcgacggcctcttctaccaccccaacgagatctgggacctcaaatcgtgccccttcgatcacagggtcttctccacagtctacacctccggtgagggttatggcgctgccgtctggaagatcccagagcagcatgggcagtcaaactcaccacagcttgagcagctcttcgagctcgctgggcatatgggcaagttaagatgtgtgctctggtggccacttggaaagcatgataagctaattagcattgatgacagaaatatttttctttggaacatagactcgtcaaataaatcagctaaggtgatatcacaggggtcggctgacatgcttccaaatttacgtggtggagcttgggatccacacaatcacaattcaattgctgcaatatccgattcatcacttcacttatgggatctccgctctatggacaaatcaactgcaattgaacatgcacatatacgggatgtggattataaccccaagaagcaaaacttaattgcaacagcagaagatgaatttggaattcgcttatgggatctcagaatgctgaaacatcctctgaaagatctccctggacactcacattggacatggactgttcggcacaatcctgagtatgatgagctgcttctgagtgctggaacagattcaaccgtaaatttatggttggctcaagttagcagcaatgattctggacctgacagccctagttcacccaagaggcaagaagaacaattactcaattcatatactgactatgaagatagcatatatggtattgcatggagctcccacgacccatcattattcacttctttgtcttacgatggaagggttgttttggaatcagtcaagccttacttgcagagaaaatgaagcttgccggtcatcttctgcattcaaacttgtttgttatttgtataattggtgctgcacggagctttgccttgccattctgcacgctgttaagaagcattgatgtgatgatccatttgtattgactgcaacaatgctggtacaattgacagccaagaatgttgcagaaatcatcttggctgatatctagtctctccctctcgggtaatgccagcagtggttgcaaaaatgtctgatgtagcttcagcaggaaagagtacagacagcatggtcgagattatcagcatttctttcctgtatcgtcaagttttgtcctgggatttccttttcagttgctagaaacttggctgtgaaggtctgatcagttatgttagtaatggttttctgtttgccagaatattgattctttggattttatattatatatttgaaaaaggccccattataggaatgctgctttatgcaatgaacagagtcagctattctattaactcttctatttc

SEQ ID NO: 15027 - protein, 350 aa, Panicum virgatum
  misc_feature: Ceres CLONE 1780612
  misc_feature (243)..(282): Pfam Name: WD40 Pfam Description: WD domain, G-beta repeat
  misc_feature: SWISSPROT Homolog: EC 2.3.1.48 Histone acetyltransferase
MQGGSSGIVYGGLKYQARCIADVRADAGSTTFLAGTLSLKEENEVHLIRLSPGESELVCDGLFYHPNEIWDLKSCPFDHRVFSTVYTSGEGYGAAVWKIPEQHGQSNSPQLEQLFELAGHMGKLRCVLWWPLGKHDKLISIDDRNIFLWNIDSSNKSAKVISQGSADMLPNLRGGAWDPHNHNSIAAISDSSLHLWDLRSMDKSTAIEHAHIRDVDYNPKKQNLIATAEDEFGIRLWDLRMLKHPLKDLPGHSHWTWTVRHNPEYDELLLSAGTDSTVNLWLAQVSSNDSGPDSPSSPKRQEEQLLNSYTDYEDSIYGIAWSSHDPSLFTSLSYDGRVVLESVKPYLQRK

SEQ ID NO: 15028 - DNA, 1540 bp, Panicum virgatum
  misc_feature: Ceres CLONE 1780619
  misc_feature: Encodes the peptide sequence at SEQ ID NO. 15029
agcgcggagcacaagcagcggcaacatatactccacatatccagctccccaattgtcccttcagcgctgccaccgccaccaacaacgacgaccactgcaagaacaagaagaaacaagaagaggagggagtacaagcttcgtctccaccgtctcccatccttgcggcggcagccggcaagctcgcgcgaggatgggggtgacacgggagtggcagcaggggccggtgattggccgtggctcgtcggccacagtgtccctcgccgctgaccggcgcacgggggacgtgttcgcggtgaagtccgtggagattgcgcgcgccggcgtgctccagcgggagcagagtgtactctctgctctgagctcgcggtacgtggtgtcgtgcctgggcgccgacgtgtcggcggcggcggacgggagtggacggatgtgctacgacctgttcttggagtacgcgccgggcgggtcgctggccgacgagatcaagcggtgcgacggtcggtgcgaggaggccgtgatacggtcgcgcgcggcggacgtcctccgcgggctggcctacgtgcacggcgccggcgtcgcgcactgcgacgtcaagggccggaacgtgctgctcggcgccgacgggcgcgccatgctcgccgacttcggctgcgcgcgctggatggcggacgaggacggcaatgccggcatcaggggcacgccaatgttcatgtcgccggaggccgcacggggcgagatgcaggggccggcggccgacatctgggcgctcgggtgcacggtgatcgagatggccaccggcggcgcgccgtggcagcagcggttcgccgaccccgtcgcggtgctccaccacgtcgcacactccggcgacgtccctcaggcccccgcctggctctccgacgaggccaatgacttcctgtcccggtgcttggtcagggacccggccaagcggtggactgcggagcagcttctcctgcacccgttcgccgcgtcctcctcggcgcccatggatcccgtcgccgccgccaaggcttcgccgatcgagctgcgggtgtcgcccaggagcgtcctcgatcaggcattctgggtggactccgactccgacaccgacacggcgggggcgctcacgcccgccgaccgcgtccgcgcgttggcgttcgacgccgcggccgactggacctggagcggtgagcactggatcaccgtctgcgcgcacaccggcgtcggcgacaactccaacgacacggcagcatcagcgggattcgaagcggacgccggaagcagcagcacgggagtgtccgaggaagaaattggcagtggcggcgagcacatgcgcgcgcacgctcccgacggccacgcctcgtcacatggccaccatgcctgcggctcagcggcccaaggcaacgccgacgcgagctctggcagtggtagtagctcgtgtggctgtaacggcgtgattagcggcaggaacaatgacaggtgttccagccatagcagtaatttcgcaagttctggcaataaaaaaagatgctgctgttcggtagtt

SEQ ID NO: 15029 - protein, 449 aa, Panicum virgatum
  misc_feature: Ceres CLONE 1780619
  misc_feature (7)..(264): Pfam Name: Pkinase Pfam Description: Protein kinase domain
  misc_feature: SWISSPROT Homolog: EC 2.7.11.25 Mitogen-activated protein kinase kinase kinase
MGVTREWQQGPVIGRGSSATVSLAADRRTGDVFAVKSVEIARAGVLQREQSVLSALSSRYVVSCLGADVSAAADGSGRMCYDLFLEYAPGGSLADEIKRCDGRCEEAVIRSRAADVLRGLAYVHGAGVAHCDVKGRNVLLGADGRAMLADFGCARWMADEDGNAGIRGTPMFMSPEAARGEMQGPAADIWALGCTVIEMATGGAPWQQRFADPVAVLHHVAHSGDVPQAPAWLSDEANDFLSRCLVRDPAKRWTAEQLLLHPFAASSSAPMDPVAAAKASPIELRVSPRSVLDQAFWVDSDSDTDTAGALTPADRVRALAFDAAADWTWSGEHWITVCAHTGVGDNSNDTAASAGFEADAGSSSTGVSEEEIGSGGEHMRAHAPDGHASSHGHHACGSAAQGNADASSGSGSSSCGCNGVISGRNNDRCSSHSSNFASSGNKKRCCCSV

SEQ ID NO: 15030 - DNA, 1669 bp, Panicum virgatum
  misc_feature: Ceres CLONE 1780624
  misc_feature: Encodes the peptide sequence at SEQ ID NO. 15031
ccccacactgccaagtgccaaaacacatcacctattcacctccctcccgttttcccaaactgagccaccgagctagaggccgggaatagtattcttctagcccgtctcgagagccttctcccaatggccaagcacgttgccgccctcctgctgctactgatggcggtcgccgtaaccacggccccgccgtcagcggcgttcctggtccagccccagccgaacctcctcacgtaccacaacggcgccgtactgagcggcgacatccctgtctccatcctatggtacggccgcttcacgccggcgcagaaggccgtcgtctccgacttactcctctccctctccgcgacgccgtcgtcgtcgtcccgcgccccgtccgtcgcgcagtggtggagcagcatcaaccggctctacctctccaaggcggcggccgtcggcaagaacggcgcccacggcgacgccgggagcgcgcaggtggtcttggccgggcaggtctccgacgaggcgtgctcgcttgggaaaagcctcaagatgtcccagctcccggcgctcgcggccgcggcgcgccccgccaaggctggcggcatcgcgctggtgctcacggcgcaggacgtggcggtggagggcttctgcgcgagccggtgcgggcaccacgggtcgtacggcggcggcggcggcggcgcccgcgcggcgtacgcgtgggtggggaacccgggcgcgcagtgccccgggcagtgcgcgtggccgttccaccagccggcgtacgggccccaggcgccgccgctggtgccgccgaacggggacgccggcatggacggcgcggtgatcagcgtggccgccatggtggccggcgcggtgaccaacccgttcggggacgggttctaccagggcgaccgcggcgcgccgctggaggccgccacggcgtgcgcgggcgtctacggcagcggcgcctaccccgggtacgccgggcggctgctggtggacgcggcgacgggcgccagctacaacgcgcgcggcgcgcgcggaaggaagtacctgctcccggcgctgttcgaccccgacacgtcggcgtgctccacgctggtgtagccgccgtacgtagacccgatcgtgccgaggtgacggaccctccaaattaaaaaaaaaatgtttctcaagtgttgctatctgtgtaaatactgtatagacctatagtacagtgagtatcatcgtacgtatacgtacgtagctgccggccgggcagtgctaaataaagggcctgtgaattgtacgtagtatcgtactatcgtgtaccgcagctggcatgtacggtggagctcaggaagcttatcggctaaggcctaggggatgaggcctgaggaagacgacgccacgccgagaagggagatccagtccgtgctgccttattgggagtttgggacaccaaaaggaatgcgcgcatcatggaatgacacgtaaggtacggtttgctggcgaccataccgcacgtgtggccccaggatggcgacagcatggacgtgcttttcttaaatgggacaggatacattttgtgacgggtcatggtaagtagcccgtaattactagaataaattccctgtatgccattggaaaatagatgtgatcccatatatgccattgaaaattacctcatccattctatgccatcatttat

SEQ ID NO: 15031 - protein, 320 aa, Panicum virgatum
  misc_feature: Ceres CLONE 1780624
  misc_feature (35)..(320): Pfam Name: Phi_1 Pfam Description: Phosphate-induced protein 1 conserved region
MAKHVAALLLLLMAVAVTTAPPSAAFLVQPQPNLLTYHNGAVLSGDIPVSILWYGRFTPAQKAVVSDLLLSLSATPSSSSRAPSVAQWWSSINRLYLSKAAAVGKNGAHGDAGSAQVVLAGQVSDEACSLGKSLKMSQLPALAAAARPAKAGGIALVLTAQDVAVEGFCASRCGHHGSYGGGGGGARAAYAWVGNPGAQCPGQCAWPFHQPAYGPQAPPLVPPNGDAGMDGAVISVAAMVAGAVTNPFGDGFYQGDRGAPLEAATACAGVYGSGAYPGYAGRLLVDAATGASYNARGARGRKYLLPALFDPDTSACSTLV

SEQ ID NO: 15032 - DNA, 2346 bp, Panicum virgatum
  misc_feature: Ceres CLONE 1780632
  misc_feature: Encodes the peptide sequence at SEQ ID NO. 15033
ctctctctcttcccccctacccgtcttgcccccacccaaaccctagcaagacctcccaacatggccgccgccgccaccgccgccgccgaccagcctacggatttgctgcagaaactggctctggacacgactggcgacgccggcgacgtcttggcgaccaaggagaaggttccggcaaagggcgcggtggcggccgtagggagcctgcagcagggggtggagactttacaggtgcaggactacaaggatgcgagcatgtactatagtgcttacccggcttacgcctatggagcctatggtggatggggggattactccacatacttgagccatgagggagcacagacaccaacttctggtgcctatgctgacatgtactatggctatgctccatatggtgttgcagcgttggggcatgatggtcagatttatgggtctcagaattaccagtacccatcgacatacaacaagcagcagaattccactgccaagctgtcatccaatgttaaaagtgaaaaggtcactccatcgccacaaggggatgtctcctctattggcatcgatggggtgaagagtctgaaaaattcaaactcgtccctgaagtcagaccggccagtttccaatggttcgtatggacgatctagtgggcgttctggtagctaccagaacctgactaactggtcagcctatccgtattacagtagcgagatgttctctgacaagcagcaaaaacttcccagcaattgcaattcaaccgcttttaatactaaaaccaagggtcagtctaggaatcaaaacacgagacagtatcctcatctcatgacaccaacttcaccaatgggatccccatcgatttactcagctaatggaatctatgggtatgactcatatggacctggcctttggtatggatcgcacatgtatagttctgggtatggtggatggaatgggctgtatgatagaaagtacaggcccagaggcagagataatgggtattatgcttatggcaatggaagcctagatggtttcaatgagctgaaaagaggaccaagaagtggtctgtacaaaagtcagcaagggcttggagctactactgaagtacctgcaaaagagcaggatctgtcagctactaatggctcacatgctgccgtgaagaatcagtataacctggctgactttgcggaaacatactcagaggccaaattctttattattaaatcatacagtgaggatgacgttcacaaaagcattaagtacaatgtgtgggctagcactcccaatggtaataagaagcttgatgccgcctatcaagaggctaaagaaaaatcaagtgaaactcctgtcttccttcttttctctgtgaatgccagtggtcagtttgttggcctcgctgagatggtgggtcgtgttgattttaacaagacagtggagcattggcaacaggacaagtggactggttgtttccctgtcaagtggcacattgtgaaggatgttccaaacagcttgctaaagcacatcattctcgagaacaatgagaacaagccggtgacaaacagcagagatacacatgaggtgaagcttgagcaaggccttcaagtgcttaagattttcaaggatcatgtctgcaagacatccatactggatgactttggcttttatgataaccgtgagaagatgatgcaagagaggaaagcaaagcagcagcagtcactgaagaaggtcatcgatgtgaagctgcctaattcggccgatgcagagaagaaaagtctcgaaggggagactgtatcaactgaactcactaaggttgaggttgaagttttgaacaaagagccttcacttgacaaaggagagaaaaatgatgcaaaaggaaatgatgttgccccagaagatctgaaatctccaactgagaagttggcaagtgcaaatggctgctaatattttagtcatcagctcagccactgctggtggtatggggcaaaacctatatatgttgtggggtttgagtttgaggcaattcgagatcgaattaagcttatttcttgttcctgtttcctacttccccatagcttgctagaggtttagttagttgcttgtgtttggtgatagttgtggtctgtgttctggcatatcagatatttaggagtagaaggatgattaactgggttttccaatgatggatcttgggtttgaggaagtattttcatttactttctgcctgtttctgaatttaattttctacctctctgaattctggacaagtttagctccttttatgttagctggtgtaagaacctgaaatgaacctgggaatttgatctagcaatttacatatcatttgttagtccg

SEQ ID NO: 15033 - protein, 624 aa, Panicum virgatum
  misc_feature: Ceres CLONE 1780632
  misc_feature (430)..(520): Pfam Name: YTH Pfam Description: YT521-B-like family
MAAAATAAADQPTDLLQKLALDTTGDAGDVLATKEKVPAKGAVAAVGSLQQGVETLQVQDYKDASMYYSAYPAYAYGAYGGWGDYSTYLSHEGAQTPTSGAYADMYYGYAPYGVAALGHDGQIYGSQNYQYPSTYNKQQNSTAKLSSNVKSEKVTPSPQGDVSSIGIDGVKSLKNSNSSLKSDRPVSNGSYGRSSGRSGSYQNLTNWSAYPYYSSEMFSDKQQKLPSNCNSTAFNTKTKGQSRNQNTRQYPHLMTPTSPMGSPSIYSANGIYGYDSYGPGLWYGSHMYSSGYGGWNGLYDRKYRPRGRDNGYYAYGNGSLDGFNELKRGPRSGLYKSQQGLGATTEVPAKEQDLSATNGSHAAVKNQYNLADFAETYSEAKFFIIKSYSEDDVHKSIKYNVWASTPNGNKKLDAAYQEAKEKSSETPVFLLFSVNASGQFVGLAEMVGRVDFNKTVEHWQQDKWTGCFPVKWHIVKDVPNSLLKHIILENNENKPVTNSRDTHEVKLEQGLQVLKIFKDHVCKTSILDDFGFYDNREKMMQERKAKQQQSLKKVIDVKLPNSADAEKKSLEGETVSTELTKVEVEVLNKEPSLDKGEKNDAKGNDVAPEDLKSPTEKLASANGC

SEQ ID NO: 15034 - DNA, 2380 bp, Panicum virgatum
  misc_feature: Ceres CLONE 1780636
  misc_feature: Encodes the peptide sequence at SEQ ID NO. 15035
tggtttaattggttgcctcaagtagcgtttggtttggcctgccgggttcacaaaggtcttctccagcatggctcctgagatgctaaagatcggcttatatacccttgttgtcgctgctcgtagtcgatcactcaccattctctgcatctgaccggatgtgttgaggaaccagtgtcagtaggcaagtgatttcaataagttgagatttctcgagaaatccgtccatgcgtgtaggcaagtgatcccccccccctttgttttccatcaatttccccatcacttaaccctagaacattgagaaaattatggaagccataatttctcatctcgactgtatagtccccaaactggatctggattgcttgaagataaaaataggattggagatctgcctcttcttcatctcttctcctggctccttactgctcctattgtgactctcacctcagaagctcgggcgcttcctcagcatcgtcaagctagtcgaattcaagtacccagccaagtgacagccactggcccacccacttggtcattgggttgtcagatccacatgtttctcgtcaaacacgcaagcaaccaatttctctcttctcgttgatttcactcgatttatcttagaagatttgaaaagttatggactcccttgcttctcatccgaaccgtgcagttcctactagatccgagttgcttggtcatgtttataagataaataaaagggattggagatctgccgctcctctgtctcctccctggcttcctgctgctcctatattgtgcctctactagattcaatttgctccgttgtttttgaagataaaaaaggattgcagctcccacttcaccaggcttcctgctacggaggcgcgccgctgcccaccaagcctcttcgacaagctcagctgtcgagcacctcgcgtgcaccgtgatgccgcccaccaaggcgcgccgccgccggcggaggcgcggacccaggcgcgcccctcggtccccagcgcagcttgtggaagacaccatcggcgagatcctccaccggctcccacccgacgaccccgcgagcctcgtccgcgcctccgccgtctgcaagacctggcgccgcgccctcgccgaccccaccttccctgcccgctaccgcgcgttccaccggacgcctcccgtgctcggcgccttctggggggacgcggccttcgtccccaccgcgtcgttccgcccgcccgccgccgaccacagcggctgcaacgtgctcgactgccgccacggccgcgtgctcctcgagaacctcggctccgggggcctctccgtctgggaccctatcaccggcgacctgcgccgcctcccggatgtgcccggcatcttctcgctcgtctgcaatggcgcggtgctctgcgccgcgggcgcgggctcccgctgcgaccacctcgcctgccacgggggtgccttcctcgtggccttagtgggcgccggcatccaagggaaagtgcacgcctgcctctactcgtcggagaccggtgcgtggagcgcactgacctccgccccgatcgattacatctacctcccgccggattacgcttactccaccacctcctgcatcaccgtcgacaatgtgcccgccgcgctgttggggaacgaactctacttcattggtgacttcggcaatgagatcctgcggtgcgacctggtcggggaaaacctcgccgtggtcgacccgccggacgtggagacttgctacgacggcgtcgtcgtcatgccggaggagaacggcaggctgggatttgccttcgtgaaggccaacagcctccatctgtggttgatggagacgggccctgaacctgatggatacggccgatgggaaaagcgcagggtcatcgatctggagacgctgttcccaattctcaacctctcaccgtatttgagtggctttgtggatgcaatcaactgtattgttgtgacaacaggtgatgctctttacaccattgagctcaagacattactgacaaggaaggtgtgcaagacggagaaaccctactcttattgctgtctctacactagtttctacattccagcatgtgctagtggaatacttgcagcacctgtggcgaatggagactgagtgaacttctgtgagccatttgaggacataaccaggcaaatggaatgcaaatccatcactgtgcagtgctgatgctgtccggtgttttatttcctactaagcatttgagcaaatctatcatctgcagagctgaggctcgtgagaaagtttcagagaagaatagtatcagcagttatcttggtcgactaacattcttcaaatcaaaatttctgtttgtatgaatcaaaaactatgtttcagtttattgcagtcgtgagtcttttaccggtc

SEQ ID NO: 15035 - protein, 393 aa, Panicum virgatum
  misc_feature: Ceres CLONE 1780636
  misc_feature (20)..(70): Pfam Name: F-box Pfam Description: F-box domain
MPPTKARRRRRRRGPRRAPRSPAQLVEDTIGEILHRLPPDDPASLVRASAVCKTWRRALADPTFPARYRAFHRTPPVLGAFWGDAAFVPTASFRPPAADHSGCNVLDCRHGRVLLENLGSGGLSVWDPITGDLRRLPDVPGIFSLVCNGAVLCAAGAGSRCDHLACHGGAFLVALVGAGIQGKVHACLYSSETGAWSALTSAPIDYIYLPPDYAYSTTSCITVDNVPAALLGNELYFIGDFGNEILRCDLVGENLAVVDPPDVETCYDGVVVMPEENGRLGFAFVKANSLHLWLMETGPEPDGYGRWEKRRVIDLETLFPILNLSPYLSGFVDAINCIVVTTGDALYTIELKTLLTRKVCKTEKPYSYCCLYTSFYIPACASGILAAPVANGD

SEQ ID NO: 15036 - DNA, 574 bp, Panicum virgatum
  misc_feature: Ceres CLONE 1780644-R
  misc_feature: Encodes the peptide sequence at SEQ ID NO. 15037
gctgcatgtacgagtacggcaagtactgcttctcctggggctgctgcccgctggagggcgccacctgctgcgacgatcactacagctgctgcccccatgactaccccatctgcaacgtcaaggagggaacctgcctcatggccaaggacagcccgctgtcagtgaaggctctgaagcgcaccctggccaagccgcactgggctttctctggcaacgcagctgatggcatgaagagcagcgcttgaacaatctccagtaagatatcaggccgccaacagccacggtgatcagagctcctgcaaacgatcacccggtgcttaatcgaccaagacattgcgtggtgcggcggccgctgttttaagtgtatctgtataataggtgctcctgtacataagcctgaaaaaatgggtttgtgttgttcacggaactgctgccaaatttgcttttacatactatatatgtaagattcagctagctctgcttagcgccttgccgcgcagttcggccgaactacgattgatgtttatggaaattgatattggaacaataatcaatgattatgctatattcattc

SEQ ID NO: 15037 - protein, 80 aa, Panicum virgatum
  misc_feature: Ceres CLONE 1780644-R
  misc_feature (11)..(46): Pfam Name: Granulin Pfam Description: Granulin
CMYEYGKYCFSWGCCPLEGATCCDDHYSCCPHDYPICNVKEGTCLMAKDSPLSVKALKRTLAKPHWAFSGNAADGMKSSA

SEQ ID NO: 15038 - DNA, 549 bp, Panicum virgatum
  misc_feature: Ceres CLONE 1780644
cttttctacctccgggaacgccagccctatccgaaacaggactgggcacccgcccccgccgcgccccacccctcacccctcagatcgtcgcccacgagctgagcggcgccgccccgggggtcatgcgcagcaagatggtgcgcggcggcggcggcggcctcgaggagctaatcggcgccatccgacaccaagttcttccggctgagggaggaggtggacagcgagctgggcgtgttcgtgggggacctcgccggcgcgctggagcggggcgaccagcccgacgaggagcgccgcctcgcgctggaggacctgctggtggccgcgcctcggtgcgcggagatgaccccccaggagctgtgggcgagctgccagggcatcatgcaaggcctcgacgaccaccgccaggaggtccgtgacggcttgcccaagcaggcgcacacatcatcatcttgatcctcaggcgctgcacgctcctgctccagttccgcaacgagctcccccccgatgaggccagtcaccacgtgctcggcctgcaccaccggagcgacc

SEQ ID NO: 15039 - DNA, 1511 bp, Panicum virgatum
  misc_feature: Ceres CLONE 1780659
  misc_feature: Encodes the peptide sequence at SEQ ID NO. 15040
aagagcccaaggcagctgagagcctcctcacatagcgagcgagctcctctgccctctgccagcttctcctcctcctcctctccagtgcagcagcgccgccgcttctccgctgactactcagtgcactagatctctgatctctcccaccgagcaggaggatcggagaagggtcatcgtatcttgtgaggagaagagaagacagagagatcgagatggctttcctcaacatggagcagcagacctgggccttcaccttcggtatcctaggtaacataatctcgctgatggtgtttctgtcaccgctgccgacgttctaccgcgtgtaccgcaagaaggcgacggagggcttccagtcgacgccgtacgtggtgaccctcttcagctgcatgctgtggatcttctacgcgctgctcaagtccgggtcggagctgctggtgaccatcaacggcgtcggctgcgtcatcgagacggtgtacatcgccatgttcctcgtgtacgcgcccaggcccgcccgggtgctcacggccaagatgctgctcggcctcaacgtcggcgtcttcggcctcgtcgcgctcgtcaccatgctgctctccaagcacggcagcctccgcgtgcacgtgctcgggtggatctgcgtcagcgtcgcgctcagcgtcttcgccgcgccgctcagcatcatgcggcaggtgatccggaccaagagcgtcgagttcatgcccttctcgctgtccttcttcctggtgctgagcgcggtgatctggttcgcgtacggcgcgctcaagaaggacgtgttcgtggcgttccccaacgtgctgggcttcgtcttcggcgtggcgcagatggcgctgtacatggcgtaccggaacaggaagcccgcggccgcggtggtgatggtggaggaggtgaagctgccggccgagcacgccaaggaggtggccgcggcggcggcgcccgagggcagggccatctgcggcgccgaggtgcaccccatcgacatcctgccggcggaggagccccccgtggaggccgtggcggtggcggcggcacgcgacggcccgcagcaggtcgcggtggccatcgacgtggtggagcccatcgtcacgtgcgcggcggcggcggcggccggcggcggcgacggccacgtggcggcggagctggcgatgatgaagcctgacacggccattgccgtggaggtgtagtaggttaagccgcggggcgcaaaggcaggacaaggaaatcgatctctagctagtaccagtcatcagtgatcagtagtaattctcatgtgaatcgaagaagaccgggcgggcgggcctgctgctagtgctaccctccggtggcagtccgcatgcatgcaggcccggtgaccggtggaggaggaggtggagatagccgggcccgtaggcgagtagcgccttggcaggcctgtgcgatgacccggcgagagacgtgtaatcgattcgatcggcctgctgccgcctttgtgtgtcccagtctgattgttttgtttc

SEQ ID NO: 15040 - protein, 328 aa, Panicum virgatum
  misc_feature: Ceres CLONE 1780659
  misc_feature (13)..(100): Pfam Name: MtN3_slv Pfam Description: MtN3/saliva family
  misc_feature (135)..(221): Pfam Name: MtN3_slv Pfam Description: MtN3/saliva family
MAFLNMEQQTWAFTFGILGNIISLMVFLSPLPTFYRVYRKKATEGFQSTPYVVTLFSCMLWIFYALLKSGSELLVTINGVGCVIETVYIAMFLVYAPRPARVLTAKMLLGLNVGVFGLVALVTMLLSKHGSLRVHVLGWICVSVALSVFAAPLSIMRQVIRTKSVEFMPFSLSFFLVLSAVIWFAYGALKKDVFVAFPNVLGFVFGVAQMALYMAYRNRKPAAAVVMVEEVKLPAEHAKEVAAAAAPEGRAICGAEVHPIDILPAEEPPVEAVAVAAARDGPQQVAVAIDVVEPIVTCAAAAAAGGGDGHVAAELAMMKPDTAIAVEV

SEQ ID NO: 15041 - DNA, 2045 bp, Panicum virgatum
  misc_feature: Ceres CLONE 1780663
  misc_feature: Encodes the peptide sequence at SEQ ID NO. 15042
atctcatttcgcaaagccgccgccgccgcccgtccaggcgcctgcggcctgccgttcctcggctccgagcgccaggccgccagagcttctccggccgttactcttggccgatcgacgaccgcgtaaaaaattgaagacccggcccccctcctccggcgacgatgcctgccggcacggacccgctgctcgcccgcgccgacgacggcacggcggacgcggccgtcgaccaccgcggtcgccccgccgagcgcggatccaccggcggctggaggtcggcgctcttcataataggcaagcacccaagtctctctctcccccagtccccaattccccaccgcagtagcgatccttggtcgaatgaaatcttgctggagctgtgcgcagcggtggagatcgcggagcggttcgcgttctacggcgtgtcgtcgaatctgatcagctacctgaccgggccgctcggggagggcaccgcggcggcggcggcggccatcaacgcgtggaacggggtggcgcagctgctgccgcttctgggcggggccctcgccgacaagtggctcggccgctaccgcaccatcgtcatggcctcgctcctctacgtcctcggtctcggcatgctggccttctcgacgttgctctcctccggcggccaccaccaatgcaccacaaccgccggcgggcagcaggcctgcgcgccgtccaccctccaggcggccttcttctacgcctccctctacatcgtggccgtggcgcagggcgggcacaagccgtgcgtgcaggcgttcggcgccgaccagttcgaccagagcgaccccaaggagtccgtctcccggagctccttcttcaactggtggtacttcggcatgtgcgccggcaccgccgtcacgctcgtgctcctcagctacgtccaggacaacatcggctgggggctcggcttcggcatcccctgcgccgtcatggccgccgcgctcgccgtcttcctgctcggcacgcggacgtaccgctactacgtcgccggcgccaagggggccctcttcgctcgcgccgccgaggccttcgccgagtggcggagcaggcggaaggcggggcctctggagcaggcttcgcaggggatcagtgctggtgtcgatgaggaggatcaggctgtggcgagcaacgcaggcttcgtgcaggaggccaaggccgtcctccgtctcttcccgatatgggcgacgtgcctgatctacgcggtggcgttcgcgcagtcgtcgacgttcttcacgaagcaggcggggaccctggaccggcgcatcggcgatcacttcaaggtgccgccggccgcgctgcagagcttcatcagcatcaccatcgtggtcttcatcccgatctacgaccgcgtcgtcgtgccggtgtcgcgccggtactccggcaagccttccgggatcaccatgctgcagcgcatcggcacggggatgctcctctccctcctgtccatggtgatcgcggcgctcgtcgagacgcgccggctgcgcgtcgcacgggacgccggcctcgtcgacaggcccagcgtcccgctgccgatgagcctgtggtggatggtgccgcagtacgtgctgttcggcgccgcggacgtgttcaccatggtcggcctgcaggagttcttctacgaccaggtgccggacaagctgcgcagcctcgggctcgcgctctacctcagcatcttcggcgtcgggagcttcatcagcagcgcgctcgtgtcggtcatcgacagggtgacgacggcgaggggccagagctggttctccaacaacctgaaccgcggccacgtcgactacttctactggctgctcgccgcgctcagcgccgtcgagctcctcgcctatgtcttcttcgcggtcatctacaagtacaagaacaaaggagccgtgcatgcggctgttgctggttagctacgtgcagctgtgcactagtggagatagtacagagactacatagtaggtgacatggtaccaagggtgtaaatggcattttccctccattatatgattcgtgatggaaacttatcttcg

SEQ ID NO: 15042 - protein, 587 aa, Panicum virgatum
  misc_feature: Ceres CLONE 1780663
  misc_feature (135)..(513): Pfam Name: PTR2 Pfam Description: POT family
MPAGTDPLLARADDGTADAAVDHRGRPAERGSTGGWRSALFIIGKHPSLSLPQSPIPHRSSDPWSNEILLELCAAVEIAERFAFYGVSSNLISYLTGPLGEGTAAAAAAINAWNGVAQLLPLLGGALADKWLGRYRTIVMASLLYVLGLGMLAFSTLLSSGGHHQCTTTAGGQQACAPSTLQAAFFYASLYIVAVAQGGHKPCVQAFGADQFDQSDPKESVSRSSFFNWWYFGMCAGTAVTLVLLSYVQDNIGWGLGFGIPCAVMAAALAVFLLGTRTYRYYVAGAKGALFARAAEAFAEWRSRRKAGPLEQASQGISAGVDEEDQAVASNAGFVQEAKAVLRLFPIWATCLIYAVAFAQSSTFFTKQAGTLDRRIGDHFKVPPAALQSFISITIVVFIPIYDRVVVPVSRRYSGKPSGITMLQRIGTGMLLSLLSMVIAALVETRRLRVARDAGLVDRPSVPLPMSLWWMVPQYVLFGAADVFTMVGLQEFFYDQVPDKLRSLGLALYLSIFGVGSFISSALVSVIDRVTTARGQSWFSNNLNRGHVDYFYWLLAALSAVELLAYVFFAVIYKYKNKGAVHAAVAG

SEQ ID NO: 15043 - DNA, 1739 bp, Panicum virgatum
  misc_feature: Ceres CLONE 1780681
  misc_feature: Encodes the peptide sequence at SEQ ID NO. 15044
aattcgtgtcctccacctcgcccattgccccttccccccgccggcgcagccgcctctctttgtcttctcccacaagcacggcaggggaaccttaactcgatccctcggccggcatcctgattcgagaggtagcagattctctagatctacagccctaacgataccagcctgggagattcgcagacacaaagacgaggcttttctgagatagatctgccttcgtccatgggagctggtgctcaacatcaagcggggcagccgctgctcatcgtgctggaggagacgccggtggtcggcgttccggccgcattagaagaggagagggcagtggcgccaacgatcactatggagattgaggaactggcggcagcagaacaggttgtgacaccgtgggaggtatcagctccggatggggtcgactacgacaagctggtcgaccggttcggctgccagcgcatcgacgcagcaatcgtcgaccgcatcgcgcacctcacgcgccgcccaccgcatcgtttcctcaggcgcgggatcttcttcgcccaccgggatttgaacatgatacttgacctctacgaggcaggggagaagttctacctgtacacagggaggggaccctcatcagagtccctgcaccttggccacctcattcccttcatgttcacaaagtatttgcaggatgccttcaaggtgcccctagtgatacagctaactgacgatgaaaagtttttgtggaagaacatgactatttctgaatgtaaaaggcttgcccgtgaaaatgccaaagacattatagcctgtggatttgatgttgaaagaactttcatttttacaaatctcagttatcttggagggccattttatgaaaatgtgcttcaagttgccaaacatgtgacatttaacggtcttagagggacatttggagttaatcaggaggatcacattggtaaggtcagctttcctcctgtgcaggctgctccatcgttctcttcttcgtttccccatctgtttcctggcgatgaccaactgcggtgccttatcccatgtgcaatagaccaggatccttattttaggatgactcgcgatgttgctcctaaaattcatcttctgaaaccttccctgattgaatcaagattttttcctgcacttcagggagagagcactaaaatgtcggccagtgacccaaagtccgcaatatacgtgacagatagttctaaacaaataaaggcaaaggtgaataaatatgctttctcgggtggccaggcctctgtggagcttcacaggaaacttggtgctaaccttgatgtggatgtcccaatcaaatacctatacttctttctagaagatgatgacgagcttgaccacataaagaaggaatataaggaaggaaggatgctaactggcgaagtaaagcagcgcctcattgtggttctatcggagctggttgctagacatcagagagctagagctcaagtgactgaggagatggttgatgcattcatggcggtaaggcctcttcctaacatgtttggctgaacaacaaaacagggttggacatatttatcgctgaacaaaacaggagcgcctgcgtgaggacacggcccaatagtactgcaaaatgaattagcaatgttgaaatcggagccgtcatttgtatttgcattcaggaatgtttggatttatgtattgcaaaatgaattagtattgcggaaaagtatcgcatatccgataggtttccgcct

SEQ ID NO: 15044 - protein, 435 aa, Panicum virgatum
  misc_feature: Ceres CLONE 1780681
  misc_feature (117)..(407): Pfam Name: tRNA-synt_1b Pfam Description: tRNA synthetases class I (W and Y)
  misc_feature: SWISSPROT Homolog: EC 6.1.1.2 Tryptophan--tRNA ligase
MGAGAQHQAGQPLLIVLEETPVVGVPAALEEERAVAPTITMEIEELAAAEQVVTPWEVSAPDGVDYDKLVDRFGCQRIDAAIVDRIAHLTRRPPHRFLRRGIFFAHRDLNMILDLYEAGEKFYLYTGRGPSSESLHLGHLIPFMFTKYLQDAFKVPLVIQLTDDEKFLWKNMTISECKRLARENAKDIIACGFDVERTFIFTNLSYLGGPFYENVLQVAKHVTFNGLRGTFGVNQEDHIGKVSFPPVQAAPSFSSSFPHLFPGDDQLRCLIPCAIDQDPYFRMTRDVAPKIHLLKPSLIESRFFPALQGESTKMSASDPKSAIYVTDSSKQIKAKVNKYAFSGGQASVELHRKLGANLDVDVPIKYLYFFLEDDDELDHIKKEYKEGRMLTGEVKQRLIVVLSELVARHQRARAQVTEEMVDAFMAVRPLPNMFG

SEQ ID NO: 15045 - DNA, 702 bp, Panicum virgatum
  misc_feature: Ceres CLONE 1780682
  misc_feature: Encodes the peptide sequence at SEQ ID NO. 15046
ggcgacgcgcaggcgcaggctcccccacagaccccaaccgccaccgccgtttttttttcctccccgctacacccgcggagatccccagatctcggccgcgggagctcgccatggcgtcgtcctccgacgagcagcagcccaagccgccggagccgcccgccgcgggcgccgtcgtggccaccgcggcggcgccgccgccgcagacgcacgccgagtgggccgcctcgctccaggcgtactacgccgccgcggggcacccctacgcctggcccgcgcagcacctcatggcagcggcggcggcgggggcgcccttcggcacgccggtgccgttccccgtctaccacccggcgtactacgcgcacgcctccatggccgcgggcgttccttacccgaccgccgaagctgccgctgcagcggccgcggcggcggccaccgcggcggaagggaaaggcaaggggaagggcggcggcgcgtcgcctgagaagggcagctccggggcgtcctccggcgaggacgcctccaggagcggcgacagcggcagcgaggagtcgtcggggacgagagacaatgacacggaccataaggattcatcggcgcccaagaagaggaaatctggcaacacgttggctgaaggcgagccgtcccagctgctgttgtgcgctatgctgccgttgagtcgccatatccagcagtgaaggggag

SEQ ID NO: 15046 - protein, 194 aa, Panicum virgatum
  misc_feature: Ceres CLONE 1780682
  misc_feature (1)..(156): Pfam Name: MFMR Pfam Description: G-box binding protein MFMR
MASSSDEQQPKPPEPPAAGAVVATAAAPPPQTHAEWAASLQAYYAAAGHPYAWPAQHLMAAAAAGAPFGTPVPFPVYHPAYYAHASMAAGVPYPTAEAAAAAAAAAATAAEGKGKGKGGGASPEKGSSGASSGEDASRSGDSGSEESSGTRDNDTDHKDSSAPKKRKSGNTLAEGEPSQLLLCAMLPLSRHIQQ

SEQ ID NO: 15047 - DNA, 2488 bp, Panicum virgatum
  misc_feature: Ceres CLONE 1780683
  misc_feature: Encodes the peptide sequence at SEQ ID NO. 15048
accagcaaccgcggggactcttctccccgtcctctccaaagaatctccccctacccaaccaaactcgacaagcaagggggtgagagagagggaggcggcggccggcgggcagctgcaggcctgcagcgcgcgcgcggaggcagctagctccatccgccggcgaccggcgcccctgatcgagccgtgggcgcggtaaaaggcgcgcctttttctgcctcgcgcggtcgcgcggagccgatggggttcgagggggcggccggcgcgatgggcggaggggtacgggcgctgatgcgccggaagcaggtcgattccgagcgggcgcgccccgccggcagcagcaacgagctccgcaaggagctctccgtcgcccagctcatcgccatcggtgttggttcaacgattggagctggggtgtatgttcttgttgggacggttgctcgggagcattctgggccagcattgactctttcatttctgatagctggaatagccgctgcactatcagcgttctgttatgcagagcttgcaagccgctgcccatctgcaggaagtgcctaccattattcatacatctgcgttggtgaaggagttgcatggttgattggttgggctctgatacttgaatatacaattggtgggtcagctgtcgcccgtggcatatctcccaatttagccctatttttcggaggagctgatagtctgccatggatcttagctcgacatgagatcccatggcttgatgttgttgttgatccttgtgctgctttccttgttttccttgtcactggtctgctatgtgtggggatcaaagagagttcatttgtgcaaggagttgtgacagtcctgaattgctttgtgatgctatttgttattattgctggtagttacatcggctttcaaacaggatgggttggctacaaggttgctggcggatttttcccttttggagcgaatggaatgcttgctggatcagcaactgtcttcttcgcctacataggcttcgattcagttgccagcactgctgaggaggtgaaaaatccgcaacgagatctgccattgggaatcgcaacggcattgtcgatatgctgttccttgtacatgttggtttcagttgttattgttggtcttgtaccatactttgctatggatccagatactcctatttcatctgcctttgcaaggcatggcgtacactgggcaatgtatctggtaactactggtgctgttcttgctctttgttcaaccttgatgggatctatattgccacagccaagaatattgatggccatggcacgagatggcctgttaccatcattcttctctgatgtccacaagacgacacaagttccagtcaaaagcacaatcgtcactggcatctgtgcagcttctctcgctttcttcatggatgtctctcaactggctggcatggtcagtgttggcacgctcctagcattcactatagttgctgtgtccatcttgattctcaggtatgttcctccagatgaggtacccctgccatcttccctgcaagcatcattccgtctgagccatgaaaacgatgaggaaaagctgagggatactcttggagatgaggatcatgaagaaggggcatctgagattagtgatattgtagtagaatcaattaaggacccccttattgagaagcagctatatgcaagcaagttggatgagacaaagcggcgcaagactgctgcttgcagcattgcatctgtctgcataggggttctggtcctcacaacttcagcctctgcgacattcttgcccttcctggtgcgatgctttgtttgcgcttttggtggcctgctcctcctaactggtctgggcgtactctgctggattgaccaagacgacgggaggcattcctttggccattctggaggattcatctgcccattcgttccattgctgccagtgatgtgtatcctgataaacacatacttattgataaatctgggtggtggcacatggatgcgagtgggggtgtggctggtgatgggggtgtttgtgtacattttctatgggcgcacccacagctcattgacggatgtcgtgtacgtccctgttgctgaggcgaatgagatatatggatcatcatctgcatcagggtttgtggcctaaggggagatggaaggagacattgttgaagcctatctttagctattacatgctccagggtactttcttccagaaccttgaagaatcagactggagcagatcccagcttgagcactatgcattgcaggcgggtttgaagaattcaatttgtatgtcaattctttaaatgtgcatgtataaattgtaattcacggctatgcttgtgtgcctctgttcgaggaatgtaaatattacatagatttataggtgggattgttatgaaggtttttgtaaaatgagggttcctctaggaatttgtacggttagtaaaattatgttctaaattcaaaggtggagttatgatctccaaccc

SEQ ID NO: 15048 - protein, 633 aa, Panicum virgatum
  misc_feature: Ceres CLONE 1780683
  misc_feature (45)..(496): Pfam Name: AA_permease Pfam Description: Amino acid permease
MGFEGAAGAMGGGVRALMRRKQVDSERARPAGSSNELRKELSVAQLIAIGVGSTIGAGVYVLVGTVAREHSGPALTLSFLIAGIAAALSAFCYAELASRCPSAGSAYHYSYICVGEGVAWLIGWALILEYTIGGSAVARGISPNLALFFGGADSLPWILARHEIPWLDVVVDPCAAFLVFLVTGLLCVGIKESSFVQGVVTVLNCFVMLFVIIAGSYIGFQTGWVGYKVAGGFFPFGANGMLAGSATVFFAYIGFDSVASTAEEVKNPQRDLPLGIATALSICCSLYMLVSVVIVGLVPYFAMDPDTPISSAFARHGVHWAMYLVTTGAVLALCSTLMGSILPQPRILMAMARDGLLPSFFSDVHKTTQVPVKSTIVTGICAASLAFFMDVSQLAGMVSVGTLLAFTIVAVSILILRYVPPDEVPLPSSLQASFRLSHENDEEKLRDTLGDEDHEEGASEISDIVVESIKDPLIEKQLYASKLDETKRRKTAACSIASVCIGVLVLTTSASATFLPFLVRCFVCAFGGLLLLTGLGVLCWIDQDDGRHSFGHSGGFICPFVPLLPVMCILINTYLLINLGGGTWMRVGVWLVMGVFVYIFYGRTHSSLTDVVYVPVAEANEIYGSSSASGFVA

SEQ ID NO: 15049 - DNA, 386 bp, Panicum virgatum
  misc_feature: Ceres CLONE 1780687
  misc_feature: Encodes the peptide sequence at SEQ ID NO. 15050
aattctcatcctactcctcacttactctgagatgactccctgcccgatgattaggctcgaggatgaattgcgtctagcaccccatgccgtcctcgctcccgcccccctgccctagggtcataatcgccggggccggcatgtcggggatctcggcagagaagaggctgtcggaggccgggatgacctgactgctgaggctggaagcgaccgggcccggcggctgaaggatgcgctctcctactttcgcctagctcagcctcgacgtcggagcccactgggtggaggtcgtcatcggtcgtgaaactaacgccgtctggcccgtcgtcaatgcaaccctcaagctcaggaactttcgctccgaatttgactacctcgcacggaactta

SEQ ID NO: 15050 - protein, 34 aa, Panicum virgatum
  misc_feature: Ceres CLONE 1780687
  misc_feature: SWISSPROT Homolog: EC 1.5.3.11 Polyamine oxidase
MPSSLPPPCPRVIIAGAGMSGISAEKRLSEAGMT

SEQ ID NO: 15051 - DNA, 1481 bp, Panicum virgatum
  misc_feature: Ceres CLONE 1780689
  misc_feature: Encodes the peptide sequence at SEQ ID NO. 15052
gccgctaaagcagagcagaagcgaacagagtgaacgtttgcactcggccccctgtaccctccctttattaacgcctccgcccctcccaaacccaaaagcacgaccgcgccgccatgggctaccaggacgcgccgggcggcggcggcgggaagctatcgctcgccagcgtgggcttcgccggccccggcgccggggcgggcgggggcgggtacaaggagctcctcgtcatgcctaaggacgacggcctcgacggcgccagggtcgcggaggtcatcgccgtcaggctgccggacgtcgcaggggccgtgaagactattttggggcgcagagaggtcagagaatttgccagtggggcattagctggtgctatgtcaaaagctattcttgctccccttgagactatcaggacaaggatggttgtaggagtaggatctaggcatatttttggtacttttgtggagatcattgaacaaaatgggtggcaagggctttgggcgggaaatacaatcaacatgctccgcattattccaacacaagcagtagagctcgcaacattcgagtgtgtcaaaaggagcatggcagaagcacaagagaaatggaaagatgatggatacccaaagatacagcttggcaacctgaaaatcgagctgccactccacttcttgtctccagttgctattggcggtgctgctgctggaatagctggcacattggcttgtcatcctcttgaagttgtcaaggatcgcttgactatcagtcgagaggtttatcctaccattaggcttgccttcagcaagatctaccagacggaaggtataggtggtctatattctggcctcggtccaacactaattggcatgattccttacagcacatgctacttctttatgtatgatacaatcaagacctcttactgccgcttacataagaaatcatctttgagtcgtcctgagctagtacttattggggctctttcaggcctcactgcaagtacaatcagcttcccgctggaagtagcaaggaagcggctcatggtcggtgccctgaaggggaagtgcccgcccaacatgattgctgccttatcggaggtgatcaaggaggagggcctcctgggactttaccgcggatggcgtgcaagctgcctgaaggtcatgccgaattctggcatcacttggatgttctacgaggcttggaaggacattcttctcgctgacaaggacaagcagcgtgcttagcgttagctgctgaacaatgaaggcattgcgccgttgtcgttcatgaagtttcctcctttggctgggattcctggtacctttccaagtttcagaatcccacccgtgccgaggaatgggtagataggatgcactgctctttttggctgatgagtggaagcatttgttgatcctcaccgattctgaacatctgatcgccatttttttgttaacaaacaaactggttttcatgagctcgtaaaatgtggt

SEQ ID NO: 15052 - protein, 373 aa, Panicum virgatum
  misc_feature: Ceres CLONE 1780689
  misc_feature (183)..(271): Pfam Name: Mito_carr Pfam Description: Mitochondrial carrier protein
  misc_feature (277)..(368): Pfam Name: Mito_carr Pfam Description: Mitochondrial carrier protein
  misc_feature (76)..(159): Pfam Name: Mito_carr Pfam Description: Mitochondrial carrier protein
MGYQDAPGGGGGKLSLASVGFAGPGAGAGGGGYKELLVMPKDDGLDGARVAEVIAVRLPDVAGAVKTILGRREVREFASGALAGAMSKAILAPLETIRTRMVVGVGSRHIFGTFVEIIEQNGWQGLWAGNTINMLRIIPTQAVELATFECVKRSMAEAQEKWKDDGYPKIQLGNLKIELPLHFLSPVAIGGAAAGIAGTLACHPLEVVKDRLTISREVYPTIRLAFSKIYQTEGIGGLYSGLGPTLIGMIPYSTCYFFMYDTIKTSYCRLHKKSSLSRPELVLIGALSGLTASTISFPLEVARKRLMVGALKGKCPPNMIAALSEVIKEEGLLGLYRGWRASCLKVMPNSGITWMFYEAWKDILLADKDKQRA

SEQ ID NO: 15053 - DNA, 1889 bp, Panicum virgatum
  misc_feature: Ceres CLONE 1780690
  misc_feature: Encodes the peptide sequence at SEQ ID NO. 15054
accattactggtagctgccatttggttggggtgcaaaacattccaggcggccccgtggcgcgcgacgcgacaataaattcgccgcccgcccctcccagcgatccaatcctcctcctcctcctcgccaccgcggtttcctcctcctacccacccaagggccgcgcgcggcggcctctccgccgaccggacgacgatggccggcggggacgaggcgcacggcgggtccgggggccggctggagagcatcctggcggacgcgtcggcgccggcggcgcggcgcgcgtgggcggcgggcgccatcgagctgcgcctgctgacgcgcctggcggcgccggcggtggtcatgtacatgatcaactacctcatgtccatgtccacgcagatcttcgccggccacctcggcaacctcgagctcgccgccgcctccctcggcaacaccggcatccagatcttcgcctacggcctcatgctgggcatgggcagtgcggtggaaacgctgtgcgggcaggcctacggcgcccagaagtacgagatgctcggcatctacctgcagcgctccgccgtgctcctgtgcgccaccggcgtcccgctggccgtcatctacgccttctccgagccgatcctgctgctcctgggccagtcgccggcgatcgcccgcgccgccgccgtcttcgtctacggcctcgtcccgcagatcttcgcctacgccatcaacttccccatccagaagttcatgcaggcgcagagcatcgtcctcccgggcgcctacatctccaccgccacgctcgcgctgcacgtgctcctcagctggctcgtcgtctacaaggccggcctcggcctgctgggcgcctccctggtgctcagcctcagctggtgggtcatcgtcgccgcgcagttcgcctacatcgtgacgagcccccagtgccggcacacgtggacgggcttcacctgccaggccttctccggcctgggggacttcctcaagctctccgcggcgtccgccgtgatgctctgcctcgagacctggtacttccaggtcctcgtgctcatcgccgggctgctccccaacccggagctcgccttggatgcgctctctgtgtgcatgactatttcagggtgggtgtttatgatttcggtaggattcaatgccgctgcaagcgtgagagtgagcaatgagcttggcgccggcaacccaaagtctgcacacttctctgtatgggtcgtgacggcgctctctgcactaatcagcatcatccttggcattgtcatcctctgcttgcgcaactacgtcagctacttgttcacggagggtgaggtggtctcaaacgcggtggcagatctctgcccgctgcttgccgtcacgctcattctcaatggcatccaacctgttctgtcaggcgtcgctgtcggatgtggatggcaacaattcgtggcctacgtgaacatcggctgttactacatagttggcgtgccccttggcgcccttctcgggttcgtcttcaagctcggcgtaaagggtatctggggtggtatgattggaggaacctgcatgcagacggccattttgctgtgggtcaccttgagaaccgattggaacaaagaggtagaagaagcacagaaaaggatgaacagatgggaggataagaagacggagccccttctcgcgggggtcagcaatggcagttaactgaaaccatgaggatcaaacagttatttccacatccatccatcaccctgcaagtgcaagcctttctccggagtgctcagattttcttttcatttttttacggtatcagtgataccaagccgctgtgaaattacatgcactgagaaatttattcgcacgtcgcaaatttttagtgaaactgaaaggaagattttagaaacag

SEQ ID NO: 15054 - protein, 497 aa, Panicum virgatum
  misc_feature: Ceres CLONE 1780690
  misc_feature (268)..(431): Pfam Name: MatE Pfam Description: MatE
  misc_feature (47)..(207): Pfam Name: MatE Pfam Description: MatE
MAGGDEAHGGSGGRLESILADASAPAARRAWAAGAIELRLLTRLAAPAVVMYMINYLMSMSTQIFAGHLGNLELAAASLGNTGIQIFAYGLMLGMGSAVETLCGQAYGAQKYEMLGIYLQRSAVLLCATGVPLAVIYAFSEPILLLLGQSPAIARAAAVFVYGLVPQIFAYAINFPIQKFMQAQSIVLPGAYISTATLALHVLLSWLVVYKAGLGLLGASLVLSLSWWVIVAAQFAYIVTSPQCRHTWTGFTCQAFSGLGDFLKLSAASAVMLCLETWYFQVLVLIAGLLPNPELALDALSVCMTISGWVFMISVGFNAAASVRVSNELGAGNPKSAHFSVWVVTALSALISIILGIVILCLRNYVSYLFTEGEVVSNAVADLCPLLAVTLILNGIQPVLSGVAVGCGWQQFVAYVNIGCYYIVGVPLGALLGFVFKLGVKGIWGGMIGGTCMQTAILLWVTLRTDWNKEVEEAQKRMNRWEDKKTEPLLAGVSNGS

SEQ ID NO: 15055 - DNA, 1838 bp, Panicum virgatum
  misc_feature: Ceres CLONE 1780691
  misc_feature: Encodes the peptide sequence at SEQ ID NO. 15056
aaagcactcgccactcgcgtcgcagcacttcctctgcatctctctctctctctagaaaaaattgaaaagagaagggaaaaatccccaactcctcgccccataaaccctaatctcgtcggattcgcaccacaagcctcccaaatcgaagccctccggtggtccagccgcctgcgggagctgagccgttctcggtttggtggaaaattccggggttttctgcgctcggtgccgccatttctccgggctgttcctccgagggcagcggctccccggctcgggttctccggtgctcgccggcgccggatccggacgtgtcccggcgagaggtcgggtttcgcgtggggtcggttcagcttcgagctcgatttgcccgcttgagttgggtcgcggctgccgtggcggtgattgaggtagtcgcgtcgattttgggggcgcgaaggtttcgttgcgaggcagcagcgtttcttggtaatccttgggtctttctgccgtgcgatgcaccccaaggctcgaatccacgcggacccggtgctggaggtcgaccagttcgactgcctgccggattcgctcgtcctgctcatcctgaacaaggtggaggacgtgcggtcgctgggccggtgctccgccgtctcgaagcggttctgcgggcttgtctccctcgtccacgacgtgtatgtcaagatcgaccgcgtcgtggcggtcgacggcgacgccgaggacacgctcaacctgtcctcgcccaagcctcggaacatcttctcgcacttcctgaagctgatgctcttcacaatcatcaagccgttccacagcatgcgcaacccgaatggcaatgggaggccactgttcgctcagctctcacagcactcgccagcccaggtgctccggaacttcacgcacatccggaatcttcgggttgagctcccctctggggatgtgggtaccgaggagggagtgctcctgaaatggcgggcagagtatgggagtacacttcagagctgtgtgattctgggcggtacccgggttgatcgcaggcctgttggtggagagcatgaaccatctttggaggataatggaagcatgccagagtctttctataccaatggtgggctgaaactccgtgtcgtctggacaatcagctctctgattgcggcatcaacgagacactatcttctccggtcaattatcaaggaccatcccacacttacaagcctggtactaaccgacgccgatggccaaggcacattatgcatgggggcggaacagctgaaggagttcagagagaaccagttatcagcctcagcatgctccaacaggactcaggtcccagcctgcaacatgaagctcaagtacgccccatatctcgagctgcctggtggtatagctttgcaaggtgctacgttggtggctatcaagccatcgaccgagggaagcaatggaggccataccagccgtaaggaaactgatgctttcatctctggagcatttgatgggccattcaaggtagctgtgaaggcactgacgaagagacgtacttaccttctggagatgaatggcttctaggtatccgcagttttcatatctagcttggtggtgctaggcatggcacctttagttgacctttccatctgtgtaatatccaagatggcgccatctctagatttctagatggtgcttatctgctgttttagctctttgtacagtagtgacatttggctctatgaaaatcacatgaagttagtgtatctcttttttgctcaccattctgcatcctgatgccatgtttgatactgtaatgtatacttctgtcgactctttccagtgaaacagccttgtgtttc

SEQ ID NO: 15056 - protein, 354 aa, Panicum virgatum
  misc_feature: Ceres CLONE 1780691
  misc_feature: Useful for making plants with modulated low light sensitivity
  misc_feature: Useful for making plants with modulated nitrogen use efficiency
MHPKARIHADPVLEVDQFDCLPDSLVLLILNKVEDVRSLGRCSAVSKRFCGLVSLVHDVYVKIDRVVAVDGDAEDTLNLSSPKPRNIFSHFLKLMLFTIIKPFHSMRNPNGNGRPLFAQLSQHSPAQVLRNFTHIRNLRVELPSGDVGTEEGVLLKWRAEYGSTLQSCVILGGTRVDRRPVGGEHEPSLEDNGSMPESFYTNGGLKLRVVWTISSLIAASTRHYLLRSIIKDHPTLTSLVLTDADGQGTLCMGAEQLKEFRENQLSASACSNRTQVPACNMKLKYAPYLELPGGIALQGATLVAIKPSTEGSNGGHTSRKETDAFISGAFDGPFKVAVKALTKRRTYLLEMNGF

SEQ ID NO: 15057 - DNA, 685 bp, Panicum virgatum
  misc_feature: Ceres CLONE 1780693
  misc_feature: Encodes the peptide sequence at SEQ ID NO. 15058
tttcttcacagcagtcgcaacggcgcgcatggcggcggcggcggcggggctccgctgctgcttccccggctcctccgtgattggtagtggcttcgcgaagccctcctcctcggggtggggctggtgcgcgggggccgtagcggcgccgtcgagggaggcggagccggtcgcttcgcttgggcaacgcacccgcgtcgacttccccatccttcaccaggaatttgatggtgccaaattagtttacttcgacaatggtgcaacatcacagaaaccttctagtgtaatgaaaacattagatgactactaccgatcatacaattctaatgttcatcgtggtattcatgcgctcagcgcaaaggctactgatgcatatgagagcgcaagaagaaaagttgcaaattttgtcaatgcacctaatagcagagagatcattttcactcgtaatgctactgaagctatcaatttggtagcttattcatggggcctgtctaacttaaaacaaggagatgagattgttcttacagttgcggagcatcatagtgctattgttccatggcaatttgtttcccagaagactggtgccaccttgaagtatgttgggttgactaaagaggaggtcccagatattgagcaattaaaaaggcttctgtcaaacaagacaaagatagttgttgtccatcatgtc

SEQ ID NO: 15058 - protein, 218 aa, Panicum virgatum
  misc_feature: Ceres CLONE 1780693
  misc_feature (71)..(218): Pfam Name: Aminotran_5 Pfam Description: Aminotransferase class-V
  misc_feature: SWISSPROT Homolog: EC 2.8.1.7 Cysteine desulfurase
MAAAAAGLRCCFPGSSVIGSGFAKPSSSGWGWCAGAVAAPSREAEPVASLGQRTRVDFPILHQEFDGAKLVYFDNGATSQKPSSVMKTLDDYYRSYNSNVHRGIHALSAKATDAYESARRKVANFVNAPNSREIIFTRNATEAINLVAYSWGLSNLKQGDEIVLTVAEHHSAIVPWQFVSQKTGATLKYVGLTKEEVPDIEQLKRLLSNKTKIVVVHH

SEQ ID NO: 15059 - DNA, 662 bp, Panicum virgatum
  misc_feature: Ceres CLONE 1780693-R
atatctctatgaaagccttatttccgttccaaatgtccggatatatggtcaagcaccttcccaaactgatcaccgtgctcctttatgttccttcaatgttgagaatattcatcccacagatattgcacaaattcttgatctccagcatggtgtagcaattcggtcagggcatcattgtgctcagattttgcataggacccttggtatcaatgcaagtgcccgtgcaagtcttcacttctacaatacaaaagaggaggtggatgtcttcgttgatgctcttaaagctactattgatgtccttacgtcccaacactagtgcagtgcaatttattcatacagtctgcagaagcatacgaaagagatttgagaaaccaaggtagcatggcagagttgtgtatacaatatctggtgaatgtccatgtttggcaaggcagggggcgactcgtcacaagaaggttctcattgaagactgaactgctaaatttgagtgaataaaaagttacatttttttctccaggatctctacgatgcaacaaggactcccctcggatgtccaaaattgtagctttaacaattttctgcctgcctctcatgaatacgcctcaatgtaagcaaaataccgagtatcttctttcaaatttcaaactagactatagaaagat

SEQ ID NO: 15060 - DNA, 573 bp, Panicum virgatum
  misc_feature: Ceres CLONE 1780697
  misc_feature: Encodes the peptide sequence at SEQ ID NO. 15061
attcccctccccttctagatggagagatagagaagaaaagataagctcagctcagctcgcaagcaagaggtggagatgcggagcccacgaggaggagggcgcgcccatgagcacgtcgacctgatcccgggcatcccccacgacgtcggcgtcgactgcctggcgcgcgtgccccacgcgtcccaccgcgcgctgcgccgtgtctgccgcggctggcggagcgccgccgccgcgccggccttcgccgcggcgcgcgccgccgcgggtgccaacgaggacctcgtctacttgctgctcttcgggaacccctccgccgccgccgacgccgacgacagcggggccaaggacggcggcgccgcccagcgcgcccgcctacggcgtcgctgtctactacgtgaccacgggagagtggctccgggagcgcggcgcgccccccgtgctggccgtgttcgcgcagtgcgccgcgggtggctcccgcgtcgcgatgctcgggggctgggacccacgcaccttcacagcccgtagccgacgtgcacatcctctacaccacgaacggcgcgtggcgacgcgccg

SEQ ID NO: 15061 - protein, 149 aa, Panicum virgatum
  misc_feature: Ceres CLONE 1780697
  misc_feature (15)..(62): Pfam Name: F-box Pfam Description: F-box domain
MRSPRGGGRAHEHVDLIPGIPHDVGVDCLARVPHASHRALRRVCRGWRSAAAAPAFAAARAAAGANEDLVYLLLFGNPSAAADADDSGAKDGGAAQRARLRRRCLLRDHGRVAPGARRAPRAGRVRAVRRGWLPRRDARGLGPTHLHSP

SEQ ID NO: 15062 - DNA, 1712 bp, Panicum virgatum
  misc_feature: Ceres CLONE 1780699
  misc_feature: Encodes the peptide sequence at SEQ ID NO. 15063
ccccttggaagctggtctagtcccgtgtccctccttccgacgcggcgatcgaatcgagcgcccgccacggcgatggcgactcgagtcctgccgccgacgctgcttcctttcctcctcctcctcctgctgctcccgctctcagcccgcgccaccgccgccgcgggcgaggagttcccgcgcgatgggcgggtgatcgacctggacgagagcaacttcgaggcagcccttggcgccatcgacttcctcttcgtcgacttctacgccccgtggtgcggccactgcaagcgcctcgcgcccgagttagatgaagctgcgccagtgttggcagggttgagtgagcccatcgtagttgccaaagtaaacgctgacaaatacaggaaacttggatcaaaatatggagtagatgggttccctaccctgatgctttttatccacggtgtcccaattgaacacactggttcaaggaaagctgaccagcttgtccgcaatctgaagaagtttgttgcgccagatgtttctatccttgagtcagacactgcgataaagaactttgttgagaatgctggtacaagctttcctatgttccttggttttggggtgaatgagtcgctgattgctgagtatggaaggaaatacaagaaaagagcttggtttgctgttgcaaaagatttctccgaggacatcatggtggcctatgattttgataaggttccagcactagttgcaatacatccgaagtatagggaacaaagtttattctacggcccatttgaaggaaatttcttggaagattttgtacgacaatccctgctccctttggttgtcccaatcaatacagagacactaaaaatgctgaatgatgatgagaggaaagttgttcttataattttagaggatgattcagatgaaaattctacacaactggtacaagtcttgaaatctgctgctaatgcgaaccgtgatttggtgtttggatatgttggaatcaagcaatgggatgagtttgtggagacttttgacgtttccaagagctcacagctgccaaagttgctggtgtgggatagaaacgaggagtatgagctagtggatggttcagagagattagaagaaggtgaccatgcatcccaaataagccaattcctggagggatacagagcaggaagaaccacaaagaagaaagtcagtggtccttctttcatgggtttcctgaattctctggtcagcatgaattcgctgtacatccttatatttgtcattgcccttctggttgtcatggtgtactttgctgggcaagatgatactcctcagccaagacgagttcatgaagagtaatggaagcttggggagcttgttgcatctaaagatggcagatctaccaggagatgtagctaagaggttaaatctcaaactttcaactgacgcgattcctgaagaagtgtggttttagaaattgatcctgacattcttcaatttctattgacaatcaacttctacattttgcctgtttgcagttctactttttgtccttcgatttgtttgttgtttagaacttagaaactagcctctgcttgtgtattagaaactgccatttcagagttcatcctgtgcattaaatatttactgtgaaaatatatttgtcgtcatactcggctactaaacttttgtacaattaatacagaatatataaaagtgtgtgctattatgctatggtc

SEQ ID NO: 15063 - protein, 419 aa, Panicum virgatum
  misc_feature: Ceres CLONE 1780699
  misc_feature (39)..(143): Pfam Name: Thioredoxin Pfam Description: Thioredoxin
  misc_feature: SWISSPROT Homolog: EC 5.3.4.1 Protein disulfide-isomerase
MATRVLPPTLLPFLLLLLLLPLSARATAAAGEEFPRDGRVIDLDESNFEAALGAIDFLFVDFYAPWCGHCKRLAPELDEAAPVLAGLSEPIVVAKVNADKYRKLGSKYGVDGFPTLMLFIHGVPIEHTGSRKADQLVRNLKKFVAPDVSILESDTAIKNFVENAGTSFPMFLGFGVNESLIAEYGRKYKKRAWFAVAKDFSEDIMVAYDFDKVPALVAIHPKYREQSLFYGPFEGNFLEDFVRQSLLPLVVPINTETLKMLNDDERKVVLIILEDDSDENSTQLVQVLKSAANANRDLVFGYVGIKQWDEFVETFDVSKSSQLPKLLVWDRNEEYELVDGSERLEEGDHASQISQFLEGYRAGRTTKKKVSGPSFMGFLNSLVSMNSLYILIFVIALLVVMVYFAGQDDTPQPRRVHEE

SEQ ID NO: 15064 - DNA, 683 bp, Panicum virgatum
  misc_feature: Ceres CLONE 1780700
  misc_feature: Encodes the peptide sequence at SEQ ID NO. 15065
gtctagatctacataccgcagagcttggctcggagctggtggccacctcgacgtccgccgctcaccgggctgctgcgctatgggcacggcgagcgaccagcagcacgcgccgctcctgtcgcccgacggtggcggcggatcagagactattgccgccgcggctccgccatgcgatggcggcggcggcgggcacggggtgagcgcggagctggaacgcatcctggcggacgagtcggcgcccccggcgcggcggctgtggcgcgcggcgcgggcggagctccggctcctcgtggcgctggccgcgccggcctgcgccgtgtacatgatcaactacctcatgtccatgtccacgcgcatcttctgcggccacctcggcacgctcgagctcgccgccgcctcgctcggcaacgtcggcatccaggtcttcgcgtacggcctcatgctgggcatgggcagcgcggtggagacgctgtgcgggcaggcgtacggcgcgcaccggtacgagatgctgggcgtctacatgcagcgctccttcgtcctgctcgccgccgccggcgtcccgctcgccgccatctacttcttctcggaccgaatcctcgtcctcctcggcgagcccgcgcggatcgccggcgccgcccgggtctacgtcctcggcctcatcccgcagatcttcgcgtacgccg

SEQ ID NO: 15065 - protein, 201 aa, Panicum virgatum
  misc_feature: Ceres CLONE 1780700
  misc_feature (76)..(201): Pfam Name: MatE Pfam Description: MatE
MGTASDQQHAPLLSPDGGGGSETIAAAAPPCDGGGGGHGVSAELERILADESAPPARRLWRAARAELRLLVALAAPACAVYMINYLMSMSTRIFCGHLGTLELAAASLGNVGIQVFAYGLMLGMGSAVETLCGQAYGAHRYEMLGVYMQRSFVLLAAAGVPLAAIYFFSDRILVLLGEPARIAGAARVYVLGLIPQIFAYA

SEQ ID NO: 15066 - DNA, 1590 bp, Panicum virgatum
  misc_feature: Ceres CLONE 1780707
  misc_feature: Encodes the peptide sequence at SEQ ID NO. 15067
accaaccaaacaaacacggtctctcctcccctgctcctcaagttccaaactccatttccgctccggcgtttcttggtccggaagcacgctcctctctccaatctctacacacatgctattgctacgacatgccttgcgagctgctaatgtgatgcccactcctgctcggtttcgccttgtcctcccttcacttcttggccaaagccccgcttataggtggcgcgtcgcgtcaccctacttggcccccaagagaccgtctccttctttaccattgaatcgatcatcgcaagcctgcactgcgtactgcacctccgtgccatcccgtcctctctcgtccctgtgctcctgtccatccaacgtcctccattcctcctgtgtgatcggcggcggcggcgcaccgccggcggtttctcgatcggttcagccattcttgcagttccagggcatgtgctttttctggtaaagcgtgctgccccgtgcgtgccttgggccggagcaaggaatatttccgagttcttcagcacgggaaggtatcttcgaactagatgcatcacaaagttcctgcgtgaggatctttgcgcggcaaaccgcgagatttcttgggcggagatggaaaagggagggttcaagatgttcaacttagtctcatcctggaacaagaggaggagaagcagatcacttgatcagctgaatccatgggtgtacaagtcggccgagctgtggcaggccaaggagcagagcccgccgccgaagaagcgcagctgcacgatggtgttcacgctcaaggagatggaggaggccaccaacatgttcagcgaccggaacctcatcggcaagggcggcttcggccgggtttacagaggcgtgctcaaggatggccagatcgtcgccatcaagaagatggacctgcccacctccaagcacgccgacggcgagcgcgagttccgggtggagatcgacatcctgagcaggctagagcaccccaacctggtgacgctgatcggctactgcgccgacgggaagcaccgcttcgtagtctacgagttcatgcccaaaggcaacctccaggacatcctcaatggcatcggggaggtgaagatggactggccggtgcgcctgcggatcgcgctgggcgcggcgagggcgctggcgtacctgcactcgagcacggccgtcggcgtccccgtcgtccaccgggacttcaagtccagcaacattctcatcaccgaacacttcgaggccaagatctccgacttcgggctcgccaagctgatgcagcaggaccaggacctgcacaccaccacccgagtgctgggcaccttcggctacttcgaccctgagtacgcactgacggggaagctgacgctgcagagcgacgtgtacgcgttcggcgtggtgctgctggagctgctgacggggcggcgcgccatcgacctgagccaggggccgcaggagcagaacctcatcgtggggatccaccaggcggtgggcgactggcggaagctgcgcagggtggtggaccgggacatggccagggggtcctgcacggtggagtcggtgtccatgttcgccgggctcgccgcgcgctgc

SEQ ID NO: 15067 - protein, 326 aa, Panicum virgatum
  misc_feature: Ceres CLONE 1780707
  misc_feature (68)..(319): Pfam Name: Pkinase Pfam Description: Protein kinase domain
  misc_feature: SWISSPROT Homolog: EC 2.7.11.1 Non-specific serine/threonine protein kinase
MEKGGFKMFNLVSSWNKRRRSRSLDQLNPWVYKSAELWQAKEQSPPPKKRSCTMVFTLKEMEEATNMFSDRNLIGKGGFGRVYRGVLKDGQIVAIKKMDLPTSKHADGEREFRVEIDILSRLEHPNLVTLIGYCADGKHRFVVYEFMPKGNLQDILNGIGEVKMDWPVRLRIALGAARALAYLHSSTAVGVPVVHRDFKSSNILITEHFEAKISDFGLAKLMQQDQDLHTTTRVLGTFGYFDPEYALTGKLTLQSDVYAFGVVLLELLTGRRAIDLSQGPQEQNLIVGIHQAVGDWRKLRRVVDRDMARGSCTVESVSMFAGLAAR

SEQ ID NO: 15068 - DNA, 651 bp, Panicum virgatum
  misc_feature: Ceres CLONE 1780707-R
ccacgaaaagcaccaccaccagctctagcctctcgcctaacctggctccaatccgccattgaagcgcttcttcccctcccgaccttcttgctcgagagccgcggagattctttccaagaagaagggaggagaagacagaagagacaggaggggtcgagagagatttggaggagatgggcaagtacgtggagctgctggacatgggggtgcgcatcgcggcgcggttccactcccactgcccgcagaccgcgcgcctctactaccacccgcccgccggcgcgcccgccgccggcgccggagacggcggccgcaagggcgaggccgcggcggcggcggctgcgaggatgcagcaggggctcgagcccgcggagatcatcctctacaccgtcgtctaggccaagatttgtccccggcccggacaagatgtcgtgtggtgtggttgcttcaggagagggagagtcggagagatgtgatgctatcctcttttctttttctttcttcccctttccgtttgtgttggatcgatgagctgaacaaacttgcaaagctgcaagccgacagctgattgattgattcaccatgagttctattggttcatttcggagtgtcctaattggctaatggagtaattgcttgtgtgacacattcgtc

SEQ ID NO: 15069 - DNA, 553 bp, Panicum virgatum
  misc_feature: Ceres CLONE 1780711
  misc_feature: Encodes the peptide sequence at SEQ ID NO. 15070
aagctaatgagagcacgccacaagcaccactccaccttcttcagcagcgctgcctgcttccttcctcgctcgtgatcaccgagaggatatgtcttgctgcggcgccaactgccggtgcggctccggctgcgagtgcggcaacggatgccgccgctgcaagatgtcccctgacgtggaggcctcctccaccaccaccatcaccatggccatcgccgccggcaccaacaaggcgagctccggcgggtacgaggccgccaccgagggcggcggctgcgactgcaacacgtgcccgcgtggtaccagctgcggctgctcctgctgcagctgcggatgacgcggacatgctccgccgccatggaccgcgaggaggaaggagaagccccccgcgtaggatatagtagcagctcgtctaaataagaacttgcccaccgcgccatccatcatctatcgtgtcatgtcgtgacattcatggccgcctgccgtgtcgcagctggggtagtcgatctgaacgtctctgctgatcgacgacgcatgccggtcgtcaatctgagct

SEQ ID NO: 15070 - protein, 81 aa, Panicum virgatum
  misc_feature: Ceres CLONE 1780711
  misc_feature (1)..(80): Pfam Name: Metallothio_2 Pfam Description: Metallothionein
MSCCGANCRCGSGCECGNGCRRCKMSPDVEASSTTTITMAIAAGTNKASSGGYEAATEGGGCDCNTCPRGTSCGCSCCSCG

SEQ ID NO: 15071 - DNA, 666 bp, Panicum virgatum
  misc_feature: Ceres CLONE 1780718-R
  misc_feature: Encodes the peptide sequence at SEQ ID NO. 15072
ggcccacttactcgctgcactcgcggaaccgcgtgacgcaggaggagctcatcaacgaggtcaccgacgacgacgccatcggggtcgacgccggcaagcacaacacgctgctccgcctggccatcgacgacctcctggactcgctgaagcccaaggagagcctggtgatccggcagcggttcgggctcgacggccgggggaagcgcacgctcagcgagatcgccggcaacctcaacatctctcgggagatggtccgcaagtacgagctcaaggccctgatgaagctcaagcaccccacgcgggtggactacctgcgcaggtacatgtgagctcagcattcggaccgtgccaccaccatagcatcaggtgtagagcatgttctacaagaaaaatcagagtggttactctgctgtatataatttctacccctccgctactctgcactgcactgtgcacgctataggctacagaatccatccatcactacactgaagggaaatctgtccgtgttgtaatagaagaagacatgtacatatacacttacacaggaacggtgtgtgggggagtcctgatgagaagtgagttcattcgagtgaggttgtattgcagacctcgcatgtaatcttatattgtactctatggatatggtacatgacgcaagaaact

SEQ ID NO: 15072 - protein, 108 aa, Panicum virgatum
  misc_feature: Ceres CLONE 1780718-R
  misc_feature (44)..(97): Pfam Name: Sigma70_r4 Pfam Description: Sigma-70, region 4
PTYSLHSRNRVTQEELINEVTDDDAIGVDAGKHNTLLRLAIDDLLDSLKPKESLVIRQRFGLDGRGKRTLSEIAGNLNISREMVRKYELKALMKLKHPTRVDYLRRYM

SEQ ID NO: 15073 - DNA, 342 bp, Panicum virgatum
  misc_feature: Ceres CLONE 1780718
gcgactggcctgcccacctgagcctcctctgactttgcagttttgctaccgtcctctaccgcggttccacctgaccgctcttctttataagcaccaaccgcgtggcctagccgccccgattcgccacgaaaccgcacgggtcctgttggtccggatgacactcgatacactcccaatgccgccagggcccccagcgtcttcgtgcagaacatcaaccccaaggtcttaaaatgtgaatatgcagaacgtggggacattgacattcatgctcagcgcttgcagcaacagatactaactcaaccagggtcgcttccatttgatcatatcctctacagcaaaatt

SEQ ID NO: 15074 - DNA, 2007 bp, Panicum virgatum
  misc_feature: Ceres CLONE 1780725
  misc_feature: Encodes the peptide sequence at SEQ ID NO. 15075
gttccgttccgttccgttccgcccgcggcttgcttgtctgttgcgacggtgcgcgcggactgtgctgggcacggcagcatcggcggcgagcgagcgtatacgtacacgcagggcaccagtacagcgcccaaccacctcccctctccccaccttccctctcccgctctccctcatcatcactcaccacccggctgccgcgccatggtgtcgctcgccggctcccagatcccctcgcccttgccggggcagagcccctgcgcggccgctgggccgctgcgccgcccggggcgctccatgcgcaccatccgctccgcgctgctgcagccggactccgccccgggctccccggcggccccgcgcgatggcgccggcgacgcgggcgactccgacattgagaacctcaccgactccgtcatcgacttccacctcagcgagctcgccgccaccgcggggcccgcgcacccggcggccgtcgccaagtcgtcctccgccatcaacgcggccgccacggagctactcgagctgtcacgggacttctccgactactccagcttcaactccgacatctccggggagctcgagcgcctcgcgatggccgcggcgggggcgggggcggcgcccagatccgacgcgccggacccggcgcgcgccgccgtggatctgaacgaccttgagtccatggatctgtcgccggacgccgcgccgctggagcgcgtggagcccttcgtgctagcgtgcgttcaggcgctgggccccgacgcagcgcccgacgcgcgccgcgcggccgccgtcaggatacggctgctggccaagcaccggtccgacatccgggagctgatcggggtgtcgggcgccatcccggcgctcgtgccgctgctgcgcagcaccgacccggtcgcgcaggagaacgcggtcaccgcgctgctcaacctctcgctggaggagcggaaccgctcggccatcacgtcggcgggcgccatcaagcccctcgtctacgcgctccgcaccggaacggccgcggccaagcagaacgccgcctgcgcgctgctcagtctgtccggcatcgaggagaaccgcgcgaccatcggagcctgcggcgccatcccgccgctcgtagcgctgctttccgcgggctccacgcgcggtaagaaggacgcgctcaccacgctctaccgcctctgctcggcgcgcaggaacaagaagcgcgcggtcagcgccggcgccatcgttccgctcgtgcacctcatcggcgaacgcggcagcgggacgtgcgagaagacgatggtggttctggggagcctcgcgggcatcgccgagggccgtgaagctgtggtggaggctggcgggatccccgcgttggttgaggcgatcgaagacggccctgctaaggagaaggagttcgccgtggtggcgctgctgcagctgtgctccgattgcccgcataaccgtgcgcttcttgtacgcgagggcgccatcccgccgcttgtcgcgctatcacagtctggttctgcccgtgccaagcacaaggccgagactttgcttggctacctgcgggagcagcgacaaggagttggatgcagagctggatctgtggcagctacaagcttggctaggtaaatcaggaattatatggtcaaagtctgctccattctctgttggagtcttgagagcggagcagctgcccgaggggtgtgatgtgatgatcatctgtaaataacagctggtttgggtcggtttggttatgtcttatgtgaatacacatgtggtttggagtgagagatgctttggttggtcactaacatcagtgaagagaggtttcagggtttcaggggatgtcagccgaggatttgggtgctgaggttaatgatattggattgtagctgtgtacaggatgctagggtatgtttgcttggccttgtcaggttataggtgaatgttgggatcctcaaccatgtgttttttactttttttgcttgaggtttggagtcaacattcgcctattcgttt

SEQ ID NO: 15075 - protein, 471 aa, Panicum virgatum
  misc_feature: Ceres CLONE 1780725
  misc_feature (206)..(246): Pfam Name: Arm Pfam Description: Armadillo/beta-catenin-like repeat
  misc_feature (288)..(328): Pfam Name: Arm Pfam Description: Armadillo/beta-catenin-like repeat
  misc_feature (412)..(452): Pfam Name: Arm Pfam Description: Armadillo/beta-catenin-like repeat
MVSLAGSQIPSPLPGQSPCAAAGPLRRPGRSMRTIRSALLQPDSAPGSPAAPRDGAGDAGDSDIENLTDSVIDFHLSELAATAGPAHPAAVAKSSSAINAAATELLELSRDFSDYSSFNSDISGELERLAMAAAGAGAAPRSDAPDPARAAVDLNDLESMDLSPDAAPLERVEPFVLACVQALGPDAAPDARRAAAVRIRLLAKHRSDIRELIGVSGAIPALVPLLRSTDPVAQENAVTALLNLSLEERNRSAITSAGAIKPLVYALRTGTAAAKQNAACALLSLSGIEENRATIGACGAIPPLVALLSAGSTRGKKDALTTLYRLCSARRNKKRAVSAGAIVPLVHLIGERGSGTCEKTMVVLGSLAGIAEGREAVVEAGGIPALVEAIEDGPAKEKEFAVVALLQLCSDCPHNRALLVREGAIPPLVALSQSGSARAKHKAETLLGYLREQRQGVGCRAGSVAATSLAR

SEQ ID NO: 15076 - DNA, 1821 bp, Panicum virgatum
  misc_feature: Ceres CLONE 1780729
  misc_feature: Encodes the peptide sequence at SEQ ID NO. 15077
gtgcactaacacacgagagaggagcgagcgaggtttatttgtgagaaataaaaatgcctttcccactgtcggcgttgccaaggtgcgtcgccctccgctcaaagcatgacaagagttacctgcgcaccgtgcacgacgagagccacggcggcaacttggtcgagctcgtcggtggcggcggcgccgacggtggcgtgatgaacccgcgctccaggttctacctggagccttccaaggagcacgaggggtttatgcacgtcagatgctgctacaacaacaagtactgggtgccccagcagggcgtgcttgacggcggcagcgctcgctgggtcattggcaccgccgatgagccggaggaagacctgtccaagccgtcgtgcaccctgctcaagctcacccccatcgccggcgagcaagcggaaggcggctccacctgcaggttcctccattcccagctaggaaaatatgcttgtgtgtcatcgactccgtccataagctcctacttgcatatagcatcacatgaagaagctgatcgtcaagacggcggtctcattgatgccttcactctcattgatgtgtcggagcagaagcagttgccttcacatcttgctttcaaaggcgacaacgggtatttccttggggcgaaaatcgtagagggctacaattatcttgaattttcagcagaagatattggagatccaagagtgttgcatactatttacaccaatgacgatggagtcgtccgtataaaatccaactattttgacttgttttggaggcgcagcccaaactggatctgggctgattcatatgaccttacccacaacaactcggacacattatttagggtgaccactggggatgacttcattgctctccgaaacttgggcaacaacaatttctgtaagaggttaaccacagaagggaagacaagttgcctcaatgctgctgttgagtccataacaactgaagcaagattgcagtgctatgaaccagttgttacccgagacatctacgatgtcgattttcgcctgagtgaagctaggatgtataccaaagatgttgatggcctttatagccaaactgttaaaaaccagaccagtacaacaaacaaaaccacgataaccttcacgtactcaagtacagtggcgactacctggagttctactgtttcaatgaagatgggcatcaaaaccaatcttatgtccggggtcccatttgtttttgaagggaaaattgaggttagcgctgaattcagtggatcatatacctggggaaaaactgaaactgaacaaaagcaaattagcaaacaagttactgttgatgttcctccaatgaagaaagtgacaataaaagcgatcggatcaaatggtgtctgtgatattcccttctcatacaagcagaccgatgttttgatgaatgggcagaaggttaccaaagagttcaccgatggcatgtattttggtgttaaaacctctaatatcacgttcgaaaccatagaagaggacctgcagtgaggactgaaaagagacatgcatggatcgtgagggttggaaattaaactacatcatatatgtactaaataaattaagatgtagttagcatgcatctgtgcatgggtcatggtttatttctggtgttcacagtcgagctagtttgtgtttcccttttcttgtatgttcagaataagaggctatgcctgcgtccatcaatctagtgtggtgtgtggatgccttttatataacataacctgaattcagggtgtgttgggttcgatgaaataacccatactactgtaatgaattcagttatgtggtttgc

SEQ ID NO: 15077 - protein, 487 aa, Panicum virgatum
  misc_feature: Ceres CLONE 1780729
  misc_feature (179)..(313): Pfam Name: Agglutinin Pfam Description: Agglutinin
MPFPLSALPRCVALRSKHDKSYLRTVHDESHGGNLVELVGGGGADGGVMNPRSRFYLEPSKEHEGFMHVRCCYNNKYWVPQQGVLDGGSARWVIGTADEPEEDLSKPSCTLLKLTPIAGEQAEGGSTCRFLHSQLGKYACVSSTPSISSYLHIASHEEADRQDGGLIDAFTLIDVSEQKQLPSHLAFKGDNGYFLGAKIVEGYNYLEFSAEDIGDPRVLHTIYTNDDGVVRIKSNYFDLFWRRSPNWIWADSYDLTHNNSDTLFRVTTGDDFIALRNLGNNNFCKRLTTEGKTSCLNAAVESITTEARLQCYEPVVTRDIYDVDFRLSEARMYTKDVDGLYSQTVKNQTSTTNKTTITFTYSSTVATTWSSTVSMKMGIKTNLMSGVPFVFEGKIEVSAEFSGSYTWGKTETEQKQISKQVTVDVPPMKKVTIKAIGSNGVCDIPFSYKQTDVLMNGQKVTKEFTDGMYFGVKTSNITFETIEEDLQ

SEQ ID NO: 15078 - DNA, 1873 bp, Panicum virgatum
  misc_feature: Ceres CLONE 1780754
  misc_feature: Encodes the peptide sequence at SEQ ID NO. 15079
aaccccagcgtacgcaccaccgccgcgcaacccccaacgcccccgccaccgccgccgctctctttgccggagaagagagacaggaggaggggagcagcagcctcctccaggagcctagcctccgcgacccgatccccgacgagctccccccccccccccctccgggcgtggccaagttgtaggcatcacggctagcgttgtagccccccggcgcggccccgcagctgcgcaggtggagcccacgggcaccatcgcctccgccgtcgccaccagccccgccccgcacggcggccgcggggcgctgccctcggccggagggagcccgtccgacctcctcttcctcgccggcggcggttgcctctgagccgctcccccacccttctctctctctccgaccccttctcctcctaacaaccgtcgtctgctgaccccccgaccccgacaaacacgcacccgagagatttgagcgagccaccggccggccgccatggagatgaagctcaccatcaggagggtgcccaccgtcgtctccaactaccaggaggacgccgacaagccccgcgccggatgcgggaggaactgcctcggccactgctgcctgcctgtttccaagcttcccctctatgctttcaaggcaaatccggcaaaacctgcacaggaggatgctgcttcaactaagtcccttgtcaatatcctccttgctgagtgggaggacaggatggcccggggcttattccgctatgatgtcactgcctgtgagaccaaggtcatccctggcaaccttgggtttgttgcacaactgaatgaagggcgccaccttaagaagcgccctactgagttccgtgtcgaccgtgtgcttcagccatttgaccctgccaagttcaactttactaaagttggccaggaagaggtgctcttccaatttgagaatggtgctggcgatgacagctacttcctgaataatgctccaatcactgctgctgatcgtgcaccgaatgttgttgctatcaatgtgagcccaatcgaatatggacacgtgcttcttattccctgtgttctggaccgcctgcctcagaggattgatccagagagcttcttgcttgcgctgcagatggcagcagaggcagccagtccatacttcaggcttggttacaatagtctaggtgcctttgctaccatcaatcacctccactttcaggcatactacttgtcagtgcctttccctgtcgagaaggcagctacccacaagatccctctttctgaagacacaatgaagagtggggtgactgtgtccaagctgataaattatcctgtgagaggcctggtatttgagggagggagcacactgaacgacctggcaaatgtggtttccagtgcttgcatttggctgcaggacaacaatgtcccttacaacgtgcttatttcggactgtggcaagaggatctttctcttcccccagtgctacgcagagaagcaggctctgggtgaagtgagccaagagctgctggacacccaggtgaatccagctgtgtgggagatcagtggccacattgtgctgaagcggaggaatgactatgaggaggcatctgaaacctctgcgtggaagctccttgccgaggtctccctgtctgaagaacgcttcgaggaagtgaaagcttacatcttcactgctgctggcctggttcaggcggacgaggaggaagtctgcgagggtgaggaagcaacctacgcgcctgtccctgtcgcccctctgcctgtggcagaaggctgcctcgtcctccagtgagatggtacagctggctgttgcgctattaagcgttgtcattgttgtctatggcgcctatagctctgccataataaggtccttgtgacg

SEQ ID NO: 15079 - protein, 432 aa, Panicum virgatum
  misc_feature: Ceres CLONE 1780754
  misc_feature: Useful for making plants with modulated nitrogen use efficiency
MEMKLTIRRVPTVVSNYQEDADKPRAGCGRNCLGHCCLPVSKLPLYAFKANPAKPAQEDAASTKSLVNILLAEWEDRMARGLFRYDVTACETKVIPGNLGFVAQLNEGRHLKKRPTEFRVDRVLQPFDPAKFNFTKVGQEEVLFQFENGAGDDSYFLNNAPITAADRAPNVVAINVSPIEYGHVLLIPCVLDRLPQRIDPESFLLALQMAAEAASPYFRLGYNSLGAFATINHLHFQAYYLSVPFPVEKAATHKIPLSEDTMKSGVTVSKLINYPVRGLVFEGGSTLNDLANVVSSACIWLQDNNVPYNVLISDCGKRIFLFPQCYAEKQALGEVSQELLDTQVNPAVWEISGHIVLKRRNDYEEASETSAWKLLAEVSLSEERFEEVKAYIFTAAGLVQADEEEVCEGEEATYAPVPVAPLPVAEGCLVLQ

SEQ ID NO: 15080 - DNA, 2093 bp, Panicum virgatum
  misc_feature: Ceres CLONE 1780755
  misc_feature: Encodes the peptide sequence at SEQ ID NO. 15081
atcgaggctcggctctcctttctcgctagcttcttcccggagacggcgcctggctcctttcttctgctcccctcccctatcgttggcagctacgaccagagaagcgccacgtctcgcgcgcttgtccgctccccggcgatgagctgccgcgcgtcaccgtggatccgcccgtcgctccccgccgggccgcgcttcccgacctcggggcggccgcgctccccactcggaaatatgaatctgtagaagaatccaattttgaagaattcatggacattaggtgttggtgttccaaatatttttgcactgccatcaaggatgttcaggtgcatggctttaagtggctctggggataatagtggttttgctcggcctacatcaactgacgaagcagtagcaccgttgccattatactcatggccagataagcagcgaccacgggtgtgcattttaggtggtggatttggtggcctgtacactgctctaagactagagtctcttgtgtggccgagtgataagaagcctcaggttgtgctggttgatcaatctgatagatttgtatttaagcccatgttgtatgagctcctatcaggagaagtggatgtctgggagatagctccatcttttacagaattgttgaaaaacactagtgttcaatttgtgagggacagtgtaaagcttctgcgaccttctgatcactttagaagagaacctggagaatcatgcactggtggggttgttcatctggaaagtggaactgtcattgaatatgattggctcgttctagctttaggggctgaagctaagatcgatgttgttccgggatcagctgaatatgcacttcctttcacaacgttagtggatgctttgagagttgaaagcaagttgaaaatgctagagaggagaaggtttggtaagagctcccctactattgaggtggcaatagtggggttgggctattccggtgttgaattagctgcgactatatctgagagattaaagaacactgggactgtaaaggcaataaatgttcaaacaaccatatgtcccactgctccacaaggaaatcgtgatgctgctgtgaaggttctcgagtctcggaatattcagcttttgttgggatattttgtgagctgcatcaaagaggcttcttcagctgatgattcaagtggcacagttacagattctgaagttgatggtgatcataagaaactaattttggaccttcaacctgctgaaagaggcctcaaaggccagactctggaggctgatttggtgctgtggacagtgggttcagcatctcagattccccggttacaacctcctgatactccctatgtgattcctctcaatggtcgggggcaggtggagacagaggaaacccttctagtgaaaggccatccccggacatttgctattggtgattcggcagctctaagggatgcatcaggcaaacttctcccagccactgcacaggttgcttttcaacaagcagattttgctggatggaatctctgggcagcaatcaatgatcggcctctcctgccattcaggttccaaaaccttggtgagatgatgacgcttggtaaaaatgacgctgcaataactgcaagtttcatcgagggactgaccttggaaggacctctaggacatgctgctcggaagcttgtctactgcctcagaatgcccacagatgaacatcgggtgaaggttggagtcagctggttaacaaagactgcgatcgactcacttgcctccgtgcaaaacgcagtaagtgacatgctcacaagcccaccatgaccgtatggctgtcagatgcattgtgaccagccaattcctgaaccggatgtactggagagcaagttgagagcgataatatgtacgtaattgagggtcttgttaaatagttgcatacttttgaattaagatgactatggtcctgtagtaaccatttgtacaagtgaacagctatggtatttgcagaagtgatctacctcatctgctgcatcagagcggggatgttttatagaaaaacaagtccctgccacggtaatccttgtagaattttccaaaaaaaaataaatgataaaatttcc

SEQ ID NO: 15081 - protein, 493 aa, Panicum virgatum
  misc_feature: Ceres CLONE 1780755
  misc_feature (41)..(375): Pfam Name: Pyr_redox_2 Pfam Description: Pyridine nucleotide-disulphide oxidoreductase
  misc_feature: SWISSPROT Homolog: EC 1.6.99.3 NADH dehydrogenase
MFRCMALSGSGDNSGFARPTSTDEAVAPLPLYSWPDKQRPRVCILGGGFGGLYTALRLESLVWPSDKKPQVVLVDQSDRFVFKPMLYELLSGEVDVWEIAPSFTELLKNTSVQFVRDSVKLLRPSDHFRREPGESCTGGVVHLESGTVIEYDWLVLALGAEAKIDVVPGSAEYALPFTTLVDALRVESKLKMLERRRFGKSSPTIEVAIVGLGYSGVELAATISERLKNTGTVKAINVQTTICPTAPQGNRDAAVKVLESRNIQLLLGYFVSCIKEASSADDSSGTVTDSEVDGDHKKLILDLQPAERGLKGQTLEADLVLWTVGSASQIPRLQPPDTPYVIPLNGRGQVETEETLLVKGHPRTFAIGDSAALRDASGKLLPATAQVAFQQADFAGWNLWAAINDRPLLPFRFQNLGEMMTLGKNDAAITASFIEGLTLEGPLGHAARKLVYCLRMPTDEHRVKVGVSWLTKTAIDSLASVQNAVSDMLTSPP

SEQ ID NO: 15082 - DNA, 1592 bp, Panicum virgatum
  misc_feature: Ceres CLONE 1780759
  misc_feature: Encodes the peptide sequence at SEQ ID NO. 15083
attaaaatatccctccattagtctcaccatctcacgtgtctcagccggtcacccctcaaactcctctccctcctcttcttcatttccatcagcttttgtctcaccgtcacagaaattccgattgcggcgcagtcccggattgttcactccagcccgcaaatgatcatcaccgtcagcagcagcttctcgaagaattcatgatccttttgcgatgggtccgatctccaatgatgcgtcgcataagaggttcttcagcatcgctccaccggcggcactgatatttttcttcgtactaatattcgtcgctggtgcaattgtcacgcttgatcacaaggagaacttgtcgatactgcagctgcatccaagagaagcgtttgcaaccgaggagatcaggcctccagcgacgagcgcgttgcgcgctgagccaacagaggaacccaacctctgtgagaaccaatgcagaccttcaggcagcgaggccttgccgaggggcatcgtgcaggataagtccaacttccagatggagtccctgggcggcaatccagggcggaagaaggctgttaggccgtcgaaaagcctcctagcgatccccgtcggcatcaagcagaaggcggtcgtcgacaagcttgtcgccaagttcccggcttccaacttcgtcgtgatgctgttccactacgacggcgtggttgacgggtggcgagacctcaagtggtcggaccgcgccatccacgtcgccgtgcgcgaccagaccaagtggtggttcgccaagcggttcctgcacccggacgtggtggcggagtacgagtacatcttcctctgggacgaggacatcgaggtggatagcttcgacccgctcgagtacctgcggatcgtgtggagggaagggctcgagatctcgcagccggcgctggaccgccggtcgcagatccaccaccgtctcacggcccgcgcgcgcaacgtcgacgtccaccggcggttctacaagacgagcggccatggccggtgcaacggcaacagcacggggccgccgtgcacggggtgggtggagatgatggtgccggtgttctcgcgcgcggcgtggcggtgcgcgtggcacatgatccagaacgacctcatctacgcctgggggatggacttcaagctcggctactgcgcgcagggcgaccggcggcgcaacgtcggcgtcgtcgacagccagtacgtgctccaccggggcatccccacgctcggcgacggcggcaagccgcaggtgtcggcgtcggcggcggaccggctggcggtgaggcagcggtcgtacaccgagctgaagctgttcaacaggaggtggaaggaggccgtggcggaggacgggtgctggaccgacccttaccccgatccggcgaccaccggctgaccgtccgacggcaggagatggtgccgggacgggaggtacactacagtagtcagtagctgttacattgaccttgcctagatgacagattatacaccatatttacagcttcagagagctcagagcaatctcatgtatgatgtacagattgtaattttttttctttctctgatctcaaggaaaaaaaaagcaggcgcgaatg

SEQ ID NO: 15083 - protein, 393 aa, Panicum virgatum
  misc_feature: Ceres CLONE 1780759
  misc_feature: Useful for biocontainment applications
MGPISNDASHKRFFSIAPPAALIFFFVLIFVAGAIVTLDHKENLSILQLHPREAFATEEIRPPATSALRAEPTEEPNLCENQCRPSGSEALPRGIVQDKSNFQMESLGGNPGRKKAVRPSKSLLAIPVGIKQKAVVDKLVAKFPASNFVVMLFHYDGVVDGWRDLKWSDRAIHVAVRDQTKWWFAKRFLHPDVVAEYEYIFLWDEDIEVDSFDPLEYLRIVWREGLEISQPALDRRSQIHHRLTARARNVDVHRRFYKTSGHGRCNGNSTGPPCTGWVEMMVPVFSRAAWRCAWHMIQNDLIYAWGMDFKLGYCAQGDRRRNVGVVDSQYVLHRGIPTLGDGGKPQVSASAADRLAVRQRSYTELKLFNRRWKEAVAEDGCWTDPYPDPATTG

SEQ ID NO: 15084 - DNA, 621 bp, Panicum virgatum
  misc_feature: Ceres CLONE 1780761-R
  misc_feature: Encodes the peptide sequence at SEQ ID NO. 15085
gaggacaataaacaagtcgttgaaggatcagatgctacagatgacatggctgaagctgaacccgaggaagaaaatgagaccagcttaaatatcaagttggattatcctcctctccctgaagaacctaccggaagcagggaccttctctgcagggttgcgattcggctaccgaacaatcggaggatacaaagaaattttcttcacacagatcctattaagctcctatggtcattctgtgctactcaggatgaggatggggagaagcgggctttccactttgtgcagcccattcctggagcatcaaagaacctggagtttgcaagtgatctcactttcaaagaagctggattggccaactcaatgatcaacctcacgtgggactgagcctgcttccatcttgtgctttgaagccgcggcgtatttcagcctgggcttgaagatggttttagttgttttctttccttgaggcttaactctttatcttgcactctgctggagcttggagtcagggacaaatctgtggcctgggctgtgtgtggaaatgctcgttttgccgttggttcttgtgtctataaacacccatggtgggacttagctctatttaatgcacatatttgtcat

SEQ ID NO: 15085 - protein, 127 aa, Panicum virgatum
  misc_feature: Ceres CLONE 1780761-R
  misc_feature (45)..(126): Pfam Name: UBX Pfam Description: UBX domain
EDNKQVVEGSDATDDMAEAEPEEENETSLNIKLDYPPLPEEPTGSRDLLCRVAIRLPNNRRIQRNFLHTDPIKLLWSFCATQDEDGEKRAFHFVQPIPGASKNLEFASDLTFKEAGLANSMINLTWD

SEQ ID NO: 15086 - DNA, 116 bp, Panicum virgatum
  misc_feature: Ceres CLONE 1780761
gaggctctttctgacctttaccgtggcattcagggcccatcttcttctgctgatgcgctgagaacgaaagaagtggcaagtacgattcttacgaacaacatcactaaagagaaccc

SEQ ID NO: 15087 - DNA, 551 bp, Panicum virgatum
  misc_feature: Ceres CLONE 1780774
  misc_feature: Encodes the peptide sequence at SEQ ID NO. 15088
actgttctcctcctcctcctctctcggcgaattggatcccgcgtctcgtgttcatttcagctttgaagccctccatgaattaagcggtgctttctgaatatctaatcgcaacagagctgggttttaatggccatcattatgaagcaatccggattcttgatatacatgtttccttgttcacaaaatgaaaagtgctcagggtattcaggtgtggatgaactggctccacacctgcagcgacaagaaaacgctgaagaaatgatttttcatcgacaatagaattggctgagtacagaaaagaaagaaacaacgctcgacacactctttttccttgattcatccccaatggatatgagcaccatctcacctgtcatcaccgatccggtatccatgagccccccactgaataggaagcttgacctccaacctgatgccattttcagtcatgtccggaggctgctccggtcccggcatgaacgtgagcacctgcaagcataagatcaaatatgtccttgtcagtagccagttggatgcaatgaaatcctcatcgc

SEQ ID NO: 15088 - protein, 40 aa, Panicum virgatum
  misc_feature: Ceres CLONE 1780774
  misc_feature: The sequence is a functional homolog of SEQ ID NO 16 in US patent 7214858
MPFSVMSGGCSGPGMNVSTCKHKIKYVLVSSQLDAMKSSS

SEQ ID NO: 15089 - DNA, 1761 bp, Panicum virgatum
  misc_feature: Ceres CLONE 1780775
  misc_feature: Encodes the peptide sequence at SEQ ID NO. 15090
attctttttcttctttcttcgttttatgctgacaacaaaggttgatcttcaggatggcctgttcttggttcgattccttggagtgatatatagttataggggtacgtgttggtgtctttttgtttatcagttgtcttcctttgataaataggcaaaccatcaccccccaccagctccttgcttgccctctcttgcctccttttctgctcttggtgttcttagtgagacagagggagaggcagagtttgttcagtaggagttgtgcactatgggtaattgctggtttaaggggaattcatactttaacagggtttcctccaatgcaaccaaatcagaatccccaaaaattcagagcccatcggaaagaattgaaaaggaagatagccagctgccatccaacccgaaagaggtggaggcgctgagaaaggatacagctcgcaaccctttgatagcattcacatttgaggagctcaagggaatcaccaaaaatttcagacaagattcattactagggggtggtggatttggcagagtctacaaagggttcatcaccaaggatctacgcgacggtttagaaatagaagagcccctgagagttgcggttaaggtccatgacggtgacaatagcttacagggccatagggagtggctggctgaggttatatttcttgagcagctctcccacccaaatttagtgaagttgatcggttattgttgtgaagacgaccacagggttcttgtttacgagttcatgcccctgggaagtgtggagtctcatctgttttcaagggtgatgatgccacttccatggtcgaccagaatgaaaattgcgcttgacgctgcaaagggacttgcttttctgcatgaagcagagaagcctgtcatctatcgggactttaagacatcgaacatattgctagatgaggaatataatgcgaaactatccgattttgggcttgcaaaagatggaccagtcggcgacaagtcccatgtttcaactcgtattatgggtacttacggttatgcagcgccagagtacatcatgacagggcatctcacggcgatgagcgatgtctacagctacggtgttgtcctcctggagctcctcacgggccggaagtcgctggacaagtcccggccggtcagggagcagacgctgaccgactgggcattcccgatgctgacgcagaagaagaaggtgcttggcatagtagacccgaggctcgccgaggactacccggtgaaggctgtgcagaagacggcgatgctggcataccattgccttaaccgcaacccaaaggctaggccactgatgcgcgacatcgtggccaccttggagcctctgcagcagctggaggagaaccccagtgacagtctggccagtgccacttgaagtgctcacttgacttcaacacagctcagacgaacagaagtgccatgtactacttgtaacatacgagtgttgatagtggtaagctagcgttcttgatatgcagattatttcttgattgtttaatccagcaagacacgagttttgctgagcaggaagtcagtaccatagtatctgtttccctctctgtagatgtggatgtgtacccattcctggcacggcgagtttcgacgattcagatgtgggcatgtttgtgtgtaatcttcagtgtttgatgcccaccacggcagcttgcctgccacagtgtttgtaatctactccccccgtcccaaaaaaaaataagtcatcctgggattcaaattttgtcccac

SEQ ID NO: 15090 - protein, 374 aa, Panicum virgatum
  misc_feature: Ceres CLONE 1780775
  misc_feature (75)..(356): Pfam Name: Pkinase Pfam Description: Protein kinase domain
  misc_feature: SWISSPROT Homolog: EC 2.7.11.1 Non-specific serine/threonine protein kinase
  misc_feature: Useful for making plants with modulated drought sensitivity
  misc_feature: Useful for making plants with modulated heat sensitivity
MGNCWFKGNSYFNRVSSNATKSESPKIQSPSERIEKEDSQLPSNPKEVEALRKDTARNPLIAFTFEELKGITKNFRQDSLLGGGGFGRVYKGFITKDLRDGLEIEEPLRVAVKVHDGDNSLQGHREWLAEVIFLEQLSHPNLVKLIGYCCEDDHRVLVYEFMPLGSVESHLFSRVMMPLPWSTRMKIALDAAKGLAFLHEAEKPVIYRDFKTSNILLDEEYNAKLSDFGLAKDGPVGDKSHVSTRIMGTYGYAAPEYIMTGHLTAMSDVYSYGVVLLELLTGRKSLDKSRPVREQTLTDWAFPMLTQKKKVLGIVDPRLAEDYPVKAVQKTAMLAYHCLNRNPKARPLMRDIVATLEPLQQLEENPSDSLASAT

SEQ ID NO: 15091 - DNA, 566 bp, Panicum virgatum
  misc_feature: Ceres CLONE 1780776
  misc_feature: Encodes the peptide sequence at SEQ ID NO. 15092
attccatcccggccttctacttcatctatctatcctcttcctctccatcaccgcgccgcgctagttcaaacagcacacatccctctgcggactcgggcactgcggggggcggcgccctggcggctgagaatgggagcggaggcaaggggttcgaggtgcccaaggtggaggtcaggttcaccaagctcttcatcaacgaccagttagcctactccctctccgggaagacatgcaagacccgggacccccccaccggagatgtcatccccaacatgggcgagggcgacaaggcctacttcgacctccccatcgaggccgcccgggaggccttccacaatggatcctggaacaggatgtagggctatgagcggtgccggatactgttccatttcccggacctgatcgaacatctcgtcgaggagctggcgaagctggacacggaggaccccgattatctctacctcgtcggtaatgtctgggacatcccgggcaccgctcacctgctgcactactacgtaggtgcctccgacaagatccacggcgataatctcatgatggcgcagctg

SEQ ID NO: 15092 - protein, 118 aa, Panicum virgatum
  misc_feature: Ceres CLONE 1780776
  misc_feature: SWISSPROT Homolog: EC 1.2.1.3 Aldehyde dehydrogenase (NAD(+))
  misc_feature: Useful for making plants with altered carbohydrate content
SIPAFYFIYLSSSSPSPRRASSNSTHPSADSGTAGGGALAAENGSGGKGFEVPKVEVRFTKLFINDQLAYSLSGKTCKTRDPPTGDVIPNMGEGDKAYFDLPIEAAREAFHNGSWNRM

SEQ ID NO: 15093 - DNA, 2143 bp, Panicum virgatum
  misc_feature: Ceres CLONE 1780785
  misc_feature: Encodes the peptide sequence at SEQ ID NO. 15094
aacctgccccagccctgtcctgactcctgagcgtgggcgaggcttcaacgcaatacgagaggcgaggaggcacagaaaagcaaccaactcctctttcgcggtttcgcctcaccggccgcgccgcccaccgtcgcctcgattcgttcgggtggagtcctccctcctctccgacgaatccctaaccaaggctttttagctgaagaaacaatcctgcaacagaatggagagctcctcagctaggaacaatggttctgtggagaataacttgggttatacaagaagtgcatccatggattcagcgggtcctcctttagctgctaggtccggctcaatgttaagtaggagaagtagcagacaggcctcaaggggatccatcagcctctcccgggagatgggggactccatattgaactcaatgaggcattctcttcagtcagcagatcaattgcttggggatgtcgatagctctattctggctcagctcatcgaaagtggcagagtttcagcacctgaaggtgatgtttatgaggatacagctaatacctcggagcatcataaggttggacctcttccagatgatgtggaggtgcaaaacaatggcaaaagtgtggcagcacctatatctttagtagaaacaaaagttgctacttctaacattccggcagattcatgtaccaaggttgaaccgtataagctttctctgaggctcgactatgctgcttacatgatccatttagctgtctttggatttttgggggtattcacaaggtatggactccaaaagctgtttggcccagactgcttggcactcacctcagaccaaagcccgctatatcctgatcttccatctaatatgcttggatctttcctgatgggctggtttgggatcatcttcaaggctgatataaggaatatatctgatcatcttatcattggaatcactactggctacatgggaagccttaccactttcagtgggtggaaccaaaaaatggttggcttgtcttccaaaggccactgggtatatgctatagcaggcatagtactaggtatctcatcatcttttttatgataaagtgcaaaatgtcataaactagatgttatctaacaaaaaaccagaagaaacatcatccttctgatggttaacaatactgattcaggaatgttcattgtcaatgagtccatcacggttggtgtggagacgggcgagcgcctacgaagtttgatcctgaaatacatcaaggggaggtgttcaataagtcacaaatatgactgggagcactggagggtagataccaggactaagcagtctgtgcttctgtcagtgatgatgattgtgatgtccttcttatgggttttgagcattgtattggctgtagtaaagctgcgtagtcttgctgatggtgctgtactctggatgggctgctcggtagcgcctccaggtgtttggctacgctggtacctggcaaggctgaatggtcagggaattggcaagcaccaatccttcaaatggctgcccattgggacccttgcagccaatgttcttgctgcaggcatcatggcagcgcttgctgtaacatccaaagcggtacatacaaatcgatcgacaactattcttagtggcatacagcttggcttccttggttgcttgagcacagtgtctacttttgctgctgaagtttacaccatgagaagaagtgggcagattacaagggcctttgtttatgctgcatccaccttcctgctctcttttgtgctgggaactctgatatactctgtgccagtttgggaaaagcattacggatgactttggcaacttcaggatccaacatattagcagctggctcaaatacgtaatgaaacttttcagaacatataagtttgtgtgtcaatgtacttagaaagaatctcaaaacctaaacggaagtacaaggcacggagccaagagctcgaaggctcatggctacgggagagaaactggatcaaatatgcaattttgctgcacaaatgtgtgcacaatagactcaaaacgacaatacatacctggctaggaaaaagactccagctttacctgtagaactcatgtagagtggcctggtacaatttttgacttcgtgaatgtgaatcgagcatatgcatgttc

SEQ ID NO: 15094 - protein, 283 aa, Panicum virgatum
  misc_feature: Ceres CLONE 1780785
  misc_feature (169)..(277): Pfam Name: CRCB Pfam Description: CrcB-like protein
MESSSARNNGSVENNLGYTRSASMDSAGPPLAARSGSMLSRRSSRQASRGSISLSREMGDSILNSMRHSLQSADQLLGDVDSSILAQLIESGRVSAPEGDVYEDTANTSEHHKVGPLPDDVEVQNNGKSVAAPISLVETKVATSNIPADSCTKVEPYKLSLRLDYAAYMIHLAVFGFLGVFTRYGLQKLFGPDCLALTSDQSPLYPDLPSNMLGSFLMGWFGIIFKADIRNISDHLIIGITTGYMGSLTTFSGWNQKMVGLSSKGHWVYAIAGIVLGISSSFL

SEQ ID NO: 15095 - DNA, 1755 bp, Panicum virgatum
  misc_feature: Ceres CLONE 1780788
  misc_feature: Encodes the peptide sequence at SEQ ID NO. 15096
attgcagtacagctcctgacacaccacacaaggccacaggctctctccctctctgagcaagcttggattcctgacagtgcaagcaaagcaagcaccagaagctagtagctagtagtatttctcttgctgcctcccttctctcatttcaccttgttattacacaccactactactacatcagagaaaacaagccttcctcccattggccatccctagctcacagcctgctatctcttaccattgacattttcctgtgttttccttaccactttgccgtagtagttcgtggtgggcagtaaggttggtttcttgtagcaatggaggccaaggcttgagaaggcatgagcttgctccctctttgccctcctgattagccccttggcagccactgcgagatttgcagcggagcaggagctgcggcagaggaagggagcaaaggatggatctttccggggcgcagggcgagctgccggtgccgatggcaatgcacggcggcggcgggggctcgccgtacctgggcctgcaccacgggcaccagcacgagcacccgcagcagcatggccatggcccgaacgggcggcacatgtcgccgccggaggaggcgaagaaccggcagttggcggtggtgcccgtgggcgcggtaggcggaggcgtggcaggtggggtgaggtaccgcgagtgcctgaagaaccacgcggcggccatcggcgggagcgcgacggacgggtgcggctagttcatgccggcgggggaggaggggtcgctggatgcgctccggtgctcggcgtgcgggtgccaccgcaacttccaccgcaaggagccgccgggcgggcagctgctcggggggcaccaccacccgctgagcccgctggcggcggcgcaccaccaccaccaccaccaccaccggggcctgctggtggcggcgcttcccccggcgccgacgcgcatggtgatgccgctgagcgccatgcaggtgcagcagcaggcgcatcacagcgcggcgtcggcggagtccgacgacgcgcgggcgcagcagccgccggcgcggaagcggttccgcaccaagttcacggcggagcagaaggcccgcatgctggggttcgcggaggaggccgggtggcggctgcagaagctggacgacgcggcggtgcagcgcttctgccaggaggtgggcgtcaagcggcgcgtcctcaaggtgtggatgcacaacaacaagcacaccctggcgcggcgcggccaggagcaggaggggggccgggtccacctcgtcggcgacccggagcatctcgggcagctcggcggcggcatgccgctcccggagcccggcgggcccgggcggagcccaggccccagccggagcccgccgccgcagcagctccggctggattaacgaaccaacaaacccaacattgatcaagacggcgatcgcctcactctagctccggttaatctagcttagctagctgcattggcttcttttctttccactgttccatccatccgtccgtcaatcgaactgatgctcaacttccacggatttgttttcttttctccatgcttgatttctgtagctcctctttctttctttctttctttctttctttctttctttcttattgatgtccctagctaacttgctgcctaccattgcttgctcaggcgactgatgtgggagggtgagactgaacatcacttgttaactctgatgaagctcttgtgttgtgttgtgttgtgttgtgatgcgccttccattcc

SEQ ID NO: 15096 - protein, 216 aa, Panicum virgatum
  misc_feature: Ceres CLONE 1780788
  misc_feature (1)..(32): Pfam Name: ZF-HD_dimer Pfam Description: ZF-HD protein dimerisation region
  misc_feature: The sequence is a functional homolog of SEQ ID NO 116 in the 10/714,887 US patent application
  misc_feature: The sequence is a functional homolog of SEQ ID NO 116 in the 11/435,388 US patent application
MPAGEEGSLDALRCSACGCHRNFHRKEPPGGQLLGGHHHPLSPLAAAHHHHHHHHRGLLVAALPPAPTRMVMPLSAMQVQQQAHHSAASAESDDARAQQPPARKRFRTKFTAEQKARMLGFAEEAGWRLQKLDDAAVQRFCQEVGVKRRVLKVWMHNNKHTLARRGQEQEGGRVHLVGDPEHLGQLGGGMPLPEPGGPGRSPGPSRSPPPQQLRLD

SEQ ID NO: 15097 - DNA, 473 bp, Panicum virgatum
  misc_feature: Ceres CLONE 1780794
  misc_feature: Encodes the peptide sequence at SEQ ID NO. 15098
atctatccacagaattgcaccacagctaggccatgaagaagaccgtgattctgtaccccggggtcaccgtcagccacttcctccccatgctgcagctagccgacgccctcctgaacgaaggctacgccgtcaaggaggcccacctcgaccccgccctgaaaggggacctcgccgtggccgccgtcatcagacgcgccgacacctccaggccgtccgtcaccttctacgagctcccacggatccaggaccctcccaccgtcctccacgacgcccagttcctcgccacgtactccgacctcctaggacgccacaacgagcgcttccacgacttcctgctctcgctgcctctcggtaacgacgacgcgctggtcctggacgtcctggccgcctaggcggtgggcgacgccaatgagctggcgatcccggcctactccttcatcgacaccaactcctccaccttcgccattttctcc

SEQ ID NO: 15098 - protein, 119 aa, Panicum virgatum
  misc_feature: Ceres CLONE 1780794
  misc_feature: Useful for making plants with altered carbohydrate content
MKKTVILYPGVTVSHFLPMLQLADALLNEGYAVKEAHLDPALKGDLAVAAVIRRADTSRPSVTFYELPRIQDPPTVLHDAQFLATYSDLLGRHNERFHDFLLSLPLGNDDALVLDVLAA

SEQ ID NO: 15099 - DNA, 2172 bp, Panicum virgatum
  misc_feature: Ceres CLONE 1780807
  misc_feature: Encodes the peptide sequence at SEQ ID NO. 15100
cttcattgcttgcccatccacttctgccggagctggaccgactcgccagcttcgagcgcagagcgtcctagcaagtcaactcctgcctgggcaggagagtgtgtgtgagagagggggagacatcatatcagccgccatggatgtggagagctccccggcggccggggcctccgtggactggcgcggccgcccgtgccgcccgcgccggcacggcggcatgcgcgccgccgtcttcgtcctagtgttccagtcggcgcagacgatggcgctggcggcggtggggagcaacctgatcacctacgtcttcggtgagctccacttcccgctgtcgcaggcggccaacgtggtgaccaacttcgtcggcaccgtcttcatcctctcgccgctcggcggcttcctctccgactcctacgccggatgcttctggacgctcctcgccttcggcgccgtcgagctcgcgggcttgatactactgtcggtacaagcacatctgccgcagctcaagtcggcgccgtgcaacatgctcaccatggtcggcagctgcgagcgggccagcggcttcaaggccaccatcttcttcgtggcgctctacctggtggcgctcggctgcggctgcgtcatgcccaacatgacggcgtacggcggcgaccagttcgctggcgcggcggagaaggacgccaagatgctgccgacctacttcaacctgtcctacttcggctactgcgccggcgagctcgtcgcgctgacggctattgtctgggcgcagacgcgctacgggatggacgtcgggttcggcctggccgccgccgccctgggggccgggctcatcagcctggtctccggcgtggtgttctaccggatcaagccgccacggggcagcatcgtcactccgattgcaagggtttttgttgctgcgttcacaaagaggaagcaaatttgcccttccggctcttccaatcctgccaacggcggagccggtgatccggcggcgaccgtcgacgacaacttccctcacgccaataaattcaggttcttggacaaggcgtgcatcagggtcgcgccggagccggacacggagccggagagtccatggaggctctgcacggcggcggaggtgcggcaggtcaagacgctcctcgctgtgatgcccatcgtggcgtgcaccatcgtcttcaacaccgtgctcgcgcagctgcagaccttctcggtgcagcagggcagcgccatggacaccaggctggcgccgggctcctcctccttcgccatcccgccggcgtcgctgcaggccatcccctacaccatgctcctcgcgctcgtcccggcctacgagctcctcctcgtcccgctgctgcggcgggtcatgggcacccggtccgggatcaccccgctccagcgcatcggcgtgggcctctgcgtggtcgcgctgtccatggccgccgccgcgctcgtcgagcgccggcgccgggacgcctccgtgtccggcggcgggcggctgtccgtcttctggctcgtgccgcagttcctcatcttcggcgtgtcggagctgttcaccaacgtggggctcatggagttcttctacaagcaggcggccgccggcacgatgcaggccttcttcatggcgctcttctactgctccttctccttcggcttcttcctcagctccgtgctggtctcgctggtgaaccgggccacggcgaggggcggccgccgcggctggctcggcgacaacaacctcgacagggacaggctcgacctcttctactgggtgctcgccgcgctcagcgtgctcaacttcttctgctacctgctgtgcgcgaggtggtacaactccggcggtgcgggcggctccgatgaggccgcctccggcgaggccgcatccgaggacgaagacgacggcaaggggctcatctgaagaaatcaagaacgagcatgatactgaaactgatcgatgtatatgagcatggtcctctttttattaggaagtatacaggtctcctacatatagaagaagaatggtagatattagcatgcatacaaagtgtgagtgtgacgccaaagatttctaccggaattggccagagataccacccattgtgccgcccattcatgttaacgagaatttattatgtttgtatacctgtcaattaattgaaagtgtgaatgttcctgctc

SEQ ID NO: 15100 - protein, 591 aa, Panicum virgatum
  misc_feature: Ceres CLONE 1780807
  misc_feature (96)..(500): Pfam Name: PTR2 Pfam Description: POT family
MDVESSPAAGASVDWRGRPCRPRRHGGMRAAVFVLVFQSAQTMALAAVGSNLITYVFGELHFPLSQAANVVTNFVGTVFILSPLGGFLSDSYAGCFWTLLAFGAVELAGLILLSVQAHLPQLKSAPCNMLTMVGSCERASGFKATIFFVALYLVALGCGCVMPNMTAYGGDQFAGAAEKDAKMLPTYFNLSYFGYCAGELVALTAIVWAQTRYGMDVGFGLAAAALGAGLISLVSGVVFYRIKPPRGSIVTPIARVFVAAFTKRKQICPSGSSNPANGGAGDPAATVDDNFPHANKFRFLDKACIRVAPEPDTEPESPWRLCTAAEVRQVKTLLAVMPIVACTIVFNTVLAQLQTFSVQQGSAMDTRLAPGSSSFAIPPASLQAIPYTMLLALVPAYELLLVPLLRRVMGTRSGITPLQRIGVGLCVVALSMAAAALVERRRRDASVSGGGRLSVFWLVPQFLIFGVSELFTNVGLMEFFYKQAAAGTMQAFFMALFYCSFSFGFFLSSVLVSLVNRATARGGRRGWLGDNNLDRDRLDLFYWVLAALSVLNFFCYLLCARWYNSGGAGGSDEAASGEAASEDEDDGKGLI

SEQ ID NO: 15101 - DNA, 1799 bp, Panicum virgatum
  misc_feature: Ceres CLONE 1780826
  misc_feature: Encodes the peptide sequence at SEQ ID NO. 15102
acggcgacacagaggcagcttcctcgcgaaacaagcaaagaaaaatcaatggcgcgtcagagagcagctgctagcctctcctacaaatagaggccatttctcttcgttgtgatcgtgcaatcaacaaaagcctgtttccaatgacagcgacgatggcgatcggtgctgctttgctggagtcgctctacgttctcggaggcctgtctctcctgtggtttacctggcgggcgctggagtgggcatggctcagcccccggaggctgggccgggcgctgcgggcgcagggcctccgcggcacctcctaccgcttcccctccggcgacctggcggaggaggagcgtctccacgcggcggaacgaaccaagccgatgcctctgctgtcgcacgccatcagcggccgtgtggagccactgttcgacagcaccgtcaaggaacacggtaaaatttcgatgatatgggccggtccgacaccgatggtgatcctcggtgaccccaagctggtcagggaggtgctgtccaacaagtttgggcacttcaggaaacccaagctgcccgccaatctaataaagatgatcgccgacgggctgtcgaaccacgatggggagaaatgggccgtccatcggaagatcatcaaccatggcttccatctcgagaagttgaagagaatgttgccggcgtttactacctgcacgagtgagctgatcaagcgatgggaggactcgatggggtccggcaaggcgcaggagatagatgtctggccggagttgcaggacctcaccggcgacgccatctcgcgcgcggcgttcggcagcagcttaactgaagggagaaggatcttccggatacaatcagagcaagttcaactcctaaatagcatgacgaacctctacattccgggttacacctacctaccaaccaagctcaacagaaggattaaagcaaatgcacgagaggtcgaagggctcctgaaaggcatcatcacaaaaaaggagagggccatgaagaacggccatgccgatgacggcgatatgctagtccttctactgcagtccaacattaatgagagcaaagatagcggaagctccaaaccaatgatgaccatggacgacatcatcggcgagctgaagctgttctacttcgctgggatggaaacaacttcggtgctgctcacatggacattaatcgttctcagcaaacattctgagtggcaagaccgcgcgagggaggaggtcctgcgtgtcttcgggaagaaacaaccggatcttgacggcacacaccaactgaaagttgtgaccatggtactctatgaggttcttaggctgtatccaccgatcacattgttagaacggggaacgtacaaggagatggagctgggagggatcaagtacccacctggagtgagacttttgttaccagtcgtgaccattcatcacgacccagatatatggggagaagatgtcgaggagttcaagccggagaggtttgcggaggggatctccaaggcctccaaggaagcacctgctttcttccccttcggatgggggccacggatctgcattggccagaattttgcactgcttgaggccaagatagcactgagcatgatcctgcaacacttctcgtttgggctttcgccgtcctacatccatgcaccattccgcgtctctactctgcagccggatcatggggcccatataatgctcgagaggatttaatattttatttgacagatatcaaactattattattggacaaataaagcaaagacaccatattatatgggtcaagcaaattatatc

SEQ ID NO: 15102 - protein, 520 aa, Panicum virgatum
  misc_feature: Ceres CLONE 1780826
  misc_feature (71)..(516): Pfam Name: p450 Pfam Description: Cytochrome P450
  misc_feature: SWISSPROT Homolog: EC 1.3.3.9 Secologanin synthase
MAIGAALLESLYVLGGLSLLWFTWRALEWAWLSPRRLGRALRAQGLRGTSYRFPSGDLAEEERLHAAERTKPMPLLSHAISGRVEPLFDSTVKEHGKISMIWAGPTPMVILGDPKLVREVLSNKFGHFRKPKLPANLIKMIADGLSNHDGEKWAVHRKIINHGFHLEKLKRMLPAFTTCTSELIKRWEDSMGSGKAQEIDVWPELQDLTGDAISRAAFGSSLTEGRRIFRIQSEQVQLLNSMTNLYIPGYTYLPTKLNRRIKANAREVEGLLKGIITKKERAMKNGHADDGDMLVLLLQSNINESKDSGSSKPMMTMDDIIGELKLFYFAGMETTSVLLTWTLIVLSKHSEWQDRAREEVLRVFGKKQPDLDGTHQLKVVTMVLYEVLRLYPPITLLERGTYKEMELGGIKYPPGVRLLLPVVTIHHDPDIWGEDVEEFKPERFAEGISKASKEAPAFFPFGWGPRICIGQNFALLEAKIALSMILQHFSFGLSPSYIHAPFRVSTLQPDHGAHIMLERI

SEQ ID NO: 15103 - DNA, 736 bp, Panicum virgatum
  misc_feature: Ceres CLONE 1780839
  misc_feature: Encodes the peptide sequence at SEQ ID NO. 15104
tgcagtagctacctctcccagccatcgccttgcctccgatccacagctagccctcgcagctccggcgagccgcctgcctgcctgcctctggtacgacgctagcagagccaccgggtcggagcgagcgagatggccggcgcgacggtgacggtggaggaggtgaggaaggcgcagcgcgcgtcggggccggccaccgtgctggccatcgggacggcgacgccggccaactgcgtgtaccaggccgactacccggactactacttccgggtcaccaagagcgaccacctcaccgacctcaaggagaagttcaaaaggatgtgcgacaagtcgatgatccggaagcgctacatgcacctgacggaggagttcctgagcgagaaccccaacatgtgcgcctacatggcgccgtcgctggacgcgcggcaggacatcgtggtggtggaggtgcccaagctcggcaaggcggcggcgcagaaggcgatcaaggagtggggccagccgcggtcccggatcacgcacctcgtcttctgcaccacctccggcgtcgacatgcccggcgccgactaccagctcaccaagctcctgggcctgcgcccctccgtgaaccgcctcatgatgtaccagcagggctgcttcgccggcggcaccgtgctgcgcgtcgccaaggacctcgccgagaacaaccgcggcgcgcgcgtgctggtggtctgctccgagatcaccgccgtcacgttcc

SEQ ID NO: 15104 - protein, 202 aa, Panicum virgatum
  misc_feature: Ceres CLONE 1780839
  misc_feature (6)..(202): Pfam Name: Chal_sti_synt_N Pfam Description: Chalcone and stilbene synthases, N-terminal domain
  misc_feature: SWISSPROT Homolog: EC 2.3.1.74 Naringenin-chalcone synthase
  misc_feature: The sequence is a functional homolog of SEQ ID NO 2 in US patent 7202397
MAGATVTVEEVRKAQRASGPATVLAIGTATPANCVYQADYPDYYFRVTKSDHLTDLKEKFKRMCDKSMIRKRYMHLTEEFLSENPNMCAYMAPSLDARQDIVVVEVPKLGKAAAQKAIKEWGQPRSRITHLVFCTTSGVDMPGADYQLTKLLGLRPSVNRLMMYQQGCFAGGTVLRVAKDLAENNRGARVLVVCSEITAVTF

SEQ ID NO: 15105 - DNA, 651 bp, Panicum virgatum
  misc_feature: Ceres CLONE 1780839-R
  misc_feature: Encodes the peptide sequence at SEQ ID NO. 15106
accaggtggaggccaaggtgggcctggacaaggcccggatgcgcgccacccggcacgtcctctccgagtacggcaacatgtccagcgcctgcgtgctcttcatcctcgacgagatgcgcaagcgctccgccgaggacggccacgccaccaccggcgagggcttcgactggggcgtcctcttcggcttcggccccggcctcaccgtcgagaccgtcgtcctccacagcgtccccatcaccgccgcgcatgagtgatcgccgccgatcatcaccggccggtccaccgacgacatccaacagctggccatcattatttgccgcctccgacgacccgtcacgtgatgaataacgtacccgccctactttctgcatcattatatttgtaatctagacgctacctattactttattttgcatttactgtacaagtaagccctggtatacatgatgaattttaagagcgagctagatcaagggtaaaactgtaagagtgccatttattagcatattaattatggatggtgaggtattgtatacctgtgtaagataagcttggctggattctattttatttggtgaagaagattataataatgtggaggtgagcaatggctggcattattgaattcgattaataatatgagttaggggc

SEQ ID NO: 15106 - protein, 83 aa, Panicum virgatum
  misc_feature: Ceres CLONE 1780839-R
  misc_feature (1)..(77): Pfam Name: Chal_sti_synt_C Pfam Description: Chalcone and stilbene synthases, C-terminal domain
  misc_feature: SWISSPROT Homolog: EC 2.3.1.74 Naringenin-chalcone synthase
  misc_feature: The sequence is a functional homolog of SEQ ID NO 2 in US patent 7202397
QVEAKVGLDKARMRATRHVLSEYGNMSSACVLFILDEMRKRSAEDGHATTGEGFDWGVLFGFGPGLTVETVVLHSVPITAAHE

SEQ ID NO: 15107 - DNA, 648 bp, Panicum virgatum
  misc_feature: Ceres CLONE 1780865-R
  misc_feature: Encodes the peptide sequence at SEQ ID NO. 15108
gtcgaggtgacccccaacggcggcccgcgggtgcaggaggcggccatgaggctctaccacagccggaggcgcggcgagggcgaggaggccggcaaggtggagctgctccaggccttccagtccgtggaggcggccgtgaggaggttcttcttcgcgtaccggcagctggtggcggcggtgatgggcacggcggaggcgtcgggcaaccggatgctgttcgtgccggcggaggggatggacccgctcgcgcagatgttcctcgagccgccctactaccccagcctggacgccgccaagacgttcttggcggactactgggttcagaagatggcgggggcctctgctccgtcccggcagagctgaaaccacgagatggcgctgcggctggatagcgaccggatcgaagttttgcccgacctgctctcatgcatgcttgatgcatcctaattccggtggtgattgtgtggtccattcctatagagattgtgtacttacttgtagcaccagattctctttttttttttgtgtgcactgcttctgcattgtgttgtgttctactcctacccagagagtttgattcagttagatgccatttgtaactctagggaaagcatttcaatttgaaattatgtacatatcacattttgt

SEQ ID NO: 15108 - protein, 120 aa, Panicum virgatum
  misc_feature: Ceres CLONE 1780865-R
  misc_feature (1)..(109): Pfam Name: Hs1pro-1_C Pfam Description: Hs1pro-1 protein C-terminus
VEVTPNGGPRVQEAAMRLYHSRRRGEGEEAGKVELLQAFQSVEAAVRRFFFAYRQLVAAVMGTAEASGNRMLFVPAEGMDPLAQMFLEPPYYPSLDAAKTFLADYWVQKMAGASAPSRQS

SEQ ID NO: 15109 - DNA, 348 bp, Panicum virgatum
  misc_feature: Ceres CLONE 1780865
aaataaaaaccccaccgcctcgttctccattcctccgacgcgtcctcgacgtctcctccggctcactgtctgctgcctccccagccagcatcatgaaaaagaccggggcattgtcacagctagcttcccttccctcaaatgcccgagacaccacaaagacaacgaggccctgcatgctctgatggttgaccgggacctcgtcctcgccaccccacaggggcaccgccacgccggaaagggagcggacggctcctccgctgactcgcgccggggtcacggaccgcgtgacgatcagtgacttgatgcccctcgttggtgctctgcgggtgagaagatcgaggcggagaa

SEQ ID NO: 15110 - DNA, 2423 bp, Panicum virgatum
  misc_feature: Ceres CLONE 1780889
  misc_feature: Encodes the peptide sequence at SEQ ID NO. 15111
aacgccagccagtgaggggcaaaagctccatcacttccagctcccagctccagcctcaagcatctcctctcctcctcccccccaatgccgccccgcccgtagccgcgccccgagcccccgcgcccgtcgcaatgcccggcccccgcgcgcccctggcggcgctggcggccctgctcgcggtcgcctccctcgccccccgcgccgccgcggagccgccgcccagcgagcggtccgcgctgctggcgttcctcaccgcgaccccgcacgagcgccgcctcggctggaacacctccaccccgacgtgcagctgggtcggggtcacctgcgacggctccggctccaccgtcgtcgaggtgcgcctcccgggcgtcggcatcgtcggcgccatcccgccgggcacgctcggtcggctcaccaacctccgcgtgctctcgctccgctccaaccgcgtcctgggctccatccccgacgacgtgctgcagctgcccaacctccaggcgctcttcctgcagcagaaccggctgtccggcgccatcccgccggggatcgccaggctcggcgggctcgagcgcctcgtgctctcgcacaacaacctctcgggccccatccccttcgtgctcaacaacctcaccgcgctgcggatgctgaagctcgacagcaacaacctctccgggagcattcccagcatcagcatcccggcgctcgccgtcctcaacgtctccgacaacagcctcaacggctccatcccgaaatcgctctcgcggttcccgcgcgaatcgttcgccggcaacctccagctctgcggcgacccgctcccgccatgcggcagctcgttcttccccccggcgccggcgcccgggatgagcccgggcggtggcggccccatgccgggctcctccaagaagcggaagctctccggcgcggcaatcgcgggcatcgtcgtgggcgccgtggtggcggggctcctgctgctcatcgccatcgtgctctgcgcggtgtcccgccggcggaggggcggcgcccgcgaggggcccaaggccgcggcgacgtctgcggcggcggcggcggcgccggggagggggcagcccccgccggcgtccggcgagggcggcggcatgacctcctcgtccaaggaggacctcggcggcggcgcgtccggatcggccgcggccgtggccgcctcggcggcgggcggcgtcgcgggggagcagagccggctggtgttcgtgggcaagggcgccgggtacagcttcgacctggaggacctgctgcgcgcgtcggcggaggtgctgggcaagggcagcgtggggacgtcgtacaaggcggtgctggaggaaggcacgacggtggtggtgaagcggctcaaggacgtggtggtggcgcggcgcgagttcgacgcgcacatggaggcactcggccgggtggagcaccgcaacgtgctccccgtgcgcgcctactacttctccaaggacgagaagctcctcgtctacgactacctccccaacggcagcctctccgccatgctccacgggagccggggctcgggccggacgccgctggactgggaggcgcgcatgcgctccgcgctgtccgccgctcgcgggctggcgcacctgcacaccgcgcacagcctcgtgcacggcaacgtcaaggcctccaacgtgctactccggccggacccggacgcagcggcgctctccgacttcagcctccaccagctgttcgcgccgtcgtcggcgcgcgccggcgggtaccgcgcgccggaggtggtggactcgcggcggctgacgttcaagtccgacgtctactccctcggcgtcctgctcctggagctcctgacgggcaagtcccccgcgcacgcgtccctggagggcgacggcacgctggacctgccgcggtgggtgcagtccgtggtgcgggaggagtggaccgccgaggtgttcgacgtggagctcgtgcggctgggcgccagcgccgaggaggagatggtggcgctgctgcaggtggccatggcgtgcgtggccacggtgccggacgcgcggcccgacgcccccgacgtggtccggatgatcgaggagatcggcgccggccacggcggccggacgacgacggaggagagcgagggcgtgcggggcacgtcggaggaggagcggtcgcggtcggggggcacgccgccggccgcgccgacgccgtgagcgccgctagaggagcgagggtaaagtactcaagtggttcagattaaattgcataggttctttggtgctgtatgtcagtggacagtggttgttctgttctttctcccttcccccctttttccagggcattgttttgttggatcaaattgtattttttttcctactcccctccatctctctctccctcaggcctcattcatgcaagtaaaagaaaatgtaattttcttc

SEQ ID NO: 15111 - protein, 687 aa, Panicum virgatum
  misc_feature: Ceres CLONE 1780889
  misc_feature (380)..(647): Pfam Name: Pkinase_Tyr Pfam Description: Protein tyrosine kinase
  misc_feature (29)..(66): Pfam Name: LRRNT_2 Pfam Description: Leucine rich repeat N-terminal domain
  misc_feature (386)..(650): SWISSPROT Homolog: EC 2.7.11.1 Non-specific serine/threonine protein kinase
  misc_feature (110)..(202): SWISSPROT Homolog: EC 4.6.1.1 Adenylate cyclase
MPGPRAPLAALAALLAVASLAPRAAAEPPPSERSALLAFLTATPHERRLGWNTSTPTCSWVGVTCDGSGSTVVEVRLPGVGIVGAIPPGTLGRLTNLRVLSLRSNRVLGSIPDDVLQLPNLQALFLQQNRLSGAIPPGIARLGGLERLVLSHNNLSGPIPFVLNNLTALRMLKLDSNNLSGSIPSISIPALAVLNVSDNSLNGSIPKSLSRFPRESFAGNLQLCGDPLPPCGSSFFPPAPAPGMSPGGGGPMPGSSKKRKLSGAAIAGIVVGAVVAGLLLLIAIVLCAVSRRRRGGAREGPKAAATSAAAAAAPGRGQPPPASGEGGGMTSSSKEDLGGGASGSAAAVAASAAGGVAGEQSRLVFVGKGAGYSFDLEDLLRASAEVLGKGSVGTSYKAVLEEGTTVVVKRLKDVVVARREFDAHMEALGRVEHRNVLPVRAYYFSKDEKLLVYDYLPNGSLSAMLHGSRGSGRTPLDWEARMRSALSAARGLAHLHTAHSLVHGNVKASNVLLRPDPDAAALSDFSLHQLFAPSSARAGGYRAPEVVDSRRLTFKSDVYSLGVLLLELLTGKSPAHASLEGDGTLDLPRWVQSVVREEWTAEVFDVELVRLGASAEEEMVALLQVAMACVATVPDARPDAPDVVRMIEEIGAGHGGRTTTEESEGVRGTSEEERSRSGGTPPAAPTP

SEQ ID NO: 15112 - DNA, 629 bp, Panicum virgatum
  misc_feature: Ceres CLONE 1780895-R
  misc_feature: Encodes the peptide sequence at SEQ ID NO. 15113
aggaggtaaaaatgcgtgaagaaggatatattccaagaacggtcaatgagcatctacaggtttcactaaggactggtgcatgtcacctgttggcgtgcgcttcctttgttggaatggacgacatagcaacgaaggactcttttgattgggtttctaccatgcctaaaattgtaaaggatctttgcataatattgagactattggatgatctccagtcatatgagcgagagcaactgacgcctcatgttgcttcaaccatcaaaagctacatgaaagagcacaatgtctcaattcagattgcacgcaagaagatagaggaacttaaagaggatacatggaaagattttaaccatgagtggttgaaccctgataatggagtgcccaggcagctactggagagcatattcaacatgactaggacgatggaattcatgtacaaccaggatgataatttcactaactgtcagaacctcaaggataccatccatttgttgtttgtggagccctttgctatctccttctagtacagacaattccaacaaataaagtgtgttgtctaatgccgaggaaaggaagcccatatcaaccggcacaatataaatatgggcactttgcacagtacattgatt

SEQ ID NO: 15113 - protein, 173 aa, Panicum virgatum
  misc_feature: Ceres CLONE 1780895-R
  misc_feature: SWISSPROT Homolog: EC 4.2.3.24 Amorpha-4,11-diene synthase
EVKMREEGYIPRTVNEHLQVSLRTGACHLLACASFVGMDDIATKDSFDWVSTMPKIVKDLCIILRLLDDLQSYEREQLTPHVASTIKSYMKEHNVSIQIARKKIEELKEDTWKDFNHEWLNPDNGVPRQLLESIFNMTRTMEFMYNQDDNFTNCQNLKDTIHLLFVEPFAISF

SEQ ID NO: 15114 - DNA, 252 bp, Panicum virgatum
  misc_feature: Ceres CLONE 1780895
gtctacctcacatgcatcttctacaacagacgtaggatgagcttcggccgcaaccattcggttctcggttagcctccattgacattgctctctgctccatctctagcatactcagatccattggcaagcatggaatatctgaagtactacctgctggcgctcctacaccctcccctgcttcgcaagctcatcgctaggcgcgacgagcatggtatgaggctgcggccgggcccgggtgatctgccggtcatc

SEQ ID NO: 15115 - DNA, 637 bp, Panicum virgatum
  misc_feature: Ceres CLONE 1780927-R
  misc_feature: Encodes the peptide sequence at SEQ ID NO. 15116
cgacctcctcgaggaggaggggctcgacaacgtcatcaacaggcacacccgcctcggcaccgccacccggctggccgtggaggcgtgggggctcaagaactgcacccagaaggaggagtggttcagcaacacggtcaccgccgtcgtcgtgccctcctacatcgacagcggcgagatcgtcaagcacgcctggaagcggtacaacctcagcctcggcctcggcctcaacaaggtcgccgggaaggtcttcaggattggccacctcggcaacctcaacgagctgcaactgctggggtgcctgagcggggtggagatggtgctcaaggacgtgggctacccggtgaagctcggcagcggagtggcggccgcggcggcgtacctgtcgaattcgacgcctctgatcccctccaggatctgagctccgcgcgcgacggccacagaaggccggcaacgacggcgacggccggaaagaacaaacggaaacctgggcagaccggccgcacgcagtagtagctctttggctatacactctctgcatgtaaagtttaattttcacacacagctgtgctaaggagtataattttgtgaactgcagctttgtctcaaggtcagtcgattgagatttttacgatctgtc

SEQ ID NO: 15116 - protein, 138 aa, Panicum virgatum
  misc_feature: Ceres CLONE 1780927-R
  misc_feature: SWISSPROT Homolog: EC 2.6.1.45 Serine--glyoxylate transaminase
  misc_feature: Useful for making plants with modulated nitrogen use efficiency
DLLEEEGLDNVINRHTRLGTATRLAVEAWGLKNCTQKEEWFSNTVTAVVVPSYIDSGEIVKHAWKRYNLSLGLGLNKVAGKVFRIGHLGNLNELQLLGCLSGVEMVLKDVGYPVKLGSGVAAAAAYLSNSTPLIPSRI

SEQ ID NO: 15117 - DNA, 119 bp, Panicum virgatum
  misc_feature: Ceres CLONE 1780927
cggaaagggcgggagcgagggcgccaagacgcgggagcaggcccggaagacgaaccagaacacccgcgaagcagcggaccggaccggccgcgggacgcagacgacgaacaccgcggggc

SEQ ID NO: 15118 - DNA, 706 bp, Panicum virgatum
  misc_feature: Ceres CLONE 1780942
  misc_feature: Encodes the peptide sequence at SEQ ID NO. 15119
caaaggaatgtcgtagccccttcgagtactgtgatgttgttacgtcaactacccataagaaccttaggggtcctagaggtggtataatattcttcaggaaagggaaaaaattaaggaaacgaggtggatctttttctcaaggggatgagggtgaatacgacttcgaggataagataaattttggtgttttcccttcaatgcaaggagggccccataataatcatattgctgccctggcaataaccctgaagcaggtagcaactcctgagtataaagcatacattcaacaagtcaagaaaaatgcccaggctttggcatcagccttgctcagaagaaaatgtagattggttactgggggcacagataatcacttagtgctatgggatcccagaactcttggcttgaccggcaagatctttgaaaaggtctgtgaggcatgccacatatctattaacaagacaccaatttacggggataatggctcgatatcaccaggaggtgttcgaattggaactcctgcaatgactactagaggttgcttagaggatgatttcgagttgattgctgagttcctcatcagggcgactcagattgctagcaatgttctaaaagaacatgggaaactacaaaaggagtttctacgaggactacagaacaataaggatgttgtagaactccgtaatcaggtcgaggcatttgcatcacg

SEQ ID NO: 15119 - protein, 234 aa, Panicum virgatum
  misc_feature: Ceres CLONE 1780942
  misc_feature (2)..(191): Pfam Name: SHMT Pfam Description: Serine hydroxymethyltransferase
  misc_feature: SWISSPROT Homolog: EC 2.1.2.1 Glycine hydroxymethyltransferase
  misc_feature: Useful for making plants with modulated nitrogen use efficiency
KECRSPFEYCDVVTSTTHKNLRGPRGGIIFFRKGKKLRKRGGSFSQGDEGEYDFEDKINFGVFPSMQGGPHNNHIAALAITLKQVATPEYKAYIQQVKKNAQALASALLRRKCRLVTGGTDNHLVLWDPRTLGLTGKIFEKVCEACHISINKTPIYGDNGSISPGGVRIGTPAMTTRGCLEDDFELIAEFLIRATQIASNVLKEHGKLQKEFLRGLQNNKDVVELRNQVEAFAS

SEQ ID NO: 15120 - DNA, 471 bp, Panicum virgatum
  misc_feature: Ceres CLONE 1780949
  misc_feature: Encodes the peptide sequence at SEQ ID NO. 15121
atatacagggacccccgcggaatcgagtccctggtggcccgtccccttcctcctccccccgcacgccgtcgctggcaagactgcggcgaatggcgtcccgcgccgcctccggccccctccgcccccccgccggggcgacactacgcctcttaaggagtcatagacatgtcagaagctacggcagccaactttcggctttgattccagctacgtcccagtgctcgtagctgacaggaagaggttattagatgccgactgcctctccgtaccatgtatggagtcggccagttgcgtcccaccacggagacaaggttgacgctgttgtgcccttcatgggtgaatctgtcactgatggagcccttgctaagtttttgaagaaccccggtgagagagtcgaagccgatgaggtcataggccagatcgatactgataaggtgaccatggatgttgccagcccggaagctggtgtta

SEQ ID NO: 15121 - protein, 74 aa, Panicum virgatum
  misc_feature: Ceres CLONE 1780949
  misc_feature: SWISSPROT Homolog: EC 2.3.1.61 Dihydrolipoyllysine-residue succinyltransferase
MPTASPYHVWSRPVASHHGDKVDAVVPFMGESVTDGALAKFLKNPGERVEADEVIGQIDTDKVTMDVASPEAGV

SEQ ID NO: 15122 - DNA, 1232 bp, Panicum virgatum
  misc_feature: Ceres CLONE 1780952
  misc_feature: Encodes the peptide sequence at SEQ ID NO. 15123
ggcgagagaacgaggaaatactacacgctgcgcactttacgagagagagagggagagggagggagagaagtgcaaaggttcgcttcttgtagcctagtttgccttggctgccatggccgatccggctgtggagaccgtcgccgccccgccgccgactccggcggcccctgccaagagcgcctcagacccgccgttgcagtcgcctgcggatgctgcctcgccggagaaggtgtctcccccagccccggcgtcggcgccggagacaaggtcccgggggtttaggcttcttggagaggacacctccgtgcacaaggctcttgggggcggtaaaactgctgatgtactgttatggaaagataagaagacctctgctgtagtgataggtggcgcaactgtcatctggattctgttcgaagtgcttgattaccatcttctgactctgatatcccatgtgctgattggtgttttggccatcctgttcctgtggtccaaagccaccaccttcatcaagaagagcccaccagatattcccctggtgcagatacctgaagatctcgttgtgaatgtttctcgagcgctacgcaacgacatcaacagagcgcttcacttgttccgggagattgcaatggggcatgatctaaagaagtttctgggagcgattgtggggctttggattctctcaggagttggaagctgctgtgacttcctcaccttgatatacatcgctatcttgatgctccacatggtgccgatcctgtacgacaagtaccaggacaaggtggaccacttagccgggagggcgcacacggaggcccgcaagcagtacgaggtgctggatgccaaggtcctgagcaagatccccaggggcccggcaaaacccaagaagcagaactaggcgaaaccgaaaccgcctcttgtgattagaggcggttcgggatgttagcatcgttggctcctggtttcacgaatgtatgtatgatcttttgtcctatggctgcagctcacgcgccacagggtgttgttgctgcttagctgtgctgattcggggtggatgctgctgtctctttgtgatccagttgatgttagtcagtatgtgtgtgtcttgtccctctgaacttaaccgaatgatgttgggatcctaagtttctgctgctgctgctgctgctccttgtaaataactgcggtggtaaataagccgatatgttggtcgcctgccttgtgtcttcaggagt

SEQ ID NO: 15123 - protein, 260 aa, Panicum virgatum
  misc_feature: Ceres CLONE 1780952
  misc_feature (74)..(257): Pfam Name: Reticulon Pfam Description: Reticulon
MADPAVETVAAPPPTPAAPAKSASDPPLQSPADAASPEKVSPPAPASAPETRSRGFRLLGEDTSVHKALGGGKTADVLLWKDKKTSAVVIGGATVIWILFEVLDYHLLTLISHVLIGVLAILFLWSKATTFIKKSPPDIPLVQIPEDLVVNVSRALRNDINRALHLFREIAMGHDLKKFLGAIVGLWILSGVGSCCDFLTLIYIAILMLHMVPILYDKYQDKVDHLAGRAHTEARKQYEVLDAKVLSKIPRGPAKPKKQN

SEQ ID NO: 15124 - DNA, 664 bp, Panicum virgatum
  misc_feature: Ceres CLONE 1780953-R
  misc_feature: Encodes the peptide sequence at SEQ ID NO. 15125
gatggacctgtggaactgaaggccatggctgatagaataattagcatgaggcaacagctatttgatgcgctaaaatccagagggactcctggagattggagccacatcattaagcaaattgggatgtttactttcactgggctcaatagcgagcaagtggccttcatgaggcaagaataccacatttacatgacatcggacgggaggatcagtatggctggtttgaacatgaagaatttgccccatcttgcagatgccatacacgctgcagttactaaactgaagtgaatgacagcatctcgcggtcttcctccatggataaaatccaaatcacctacagcagtgtcctgaggactcagctagtggtatttactggcagaactcctgtaatttgcctttttaaagacatgtttgactctgttatcggagaagttttctactgacggattcaaacacaccaaatataaaagacacacatgcatatgttttttgcaccttcagtgcgaagtatttatcctacagcatcagcagcctgtaacagttttgtgaagctgctatttgcctgttgtaagcttcctctgctgcatatgttgtaacatgtattgctgcttgctcgagtagtcgagtgataactaaggggggaaaatgatgctagaatttactc

SEQ ID NO: 15125 - protein, 95 aa, Panicum virgatum
  misc_feature: Ceres CLONE 1780953-R
  misc_feature: SWISSPROT Homolog: EC 2.6.1.1 Aspartate transaminase
  misc_feature: Useful for making plants with modulated nitrogen use efficiency
DGPVELKAMADRIISMRQQLFDALKSRGTPGDWSHIIKQIGMFTFTGLNSEQVAFMRQEYHIYMTSDGRISMAGLNMKNLPHLADAIHAAVTKLK

SEQ ID NO: 15126 - DNA, 104 bp, Panicum virgatum
  misc_feature: Ceres CLONE 1780953
ggattatgttcttgctcgggctactgagtctctcgcctgttgtcgcgtgctggatctggcgctgccggacgcgtccctccttcttgatgctgactgtccggctg

SEQ ID NO: 15127 - DNA, 1206 bp, Panicum virgatum
  misc_feature: Ceres CLONE 1780961
  misc_feature: Encodes the peptide sequence at SEQ ID NO. 15128
gctgtgatgccgtgaccgtcccgtccacctttttccctcctcctcccctactccgccgccgtcacgccacctcgccgccggcgcgaacccccgtccgcggagatggggaacatcttcgtgaagaagcccaagatcacggacgtcgacagggccatcctcaccctcaagacgcagcgccgcaagctcgcccagttccagcagcagcttgagaaggtaatcgaagcagaaaaggaagctgcacggcagttggttcaacagaagaagagggacagagctttgattgctctgaagaagaagaaagctcaggaagagctgttgaaacaagttgacacatggcaaatgaatgttgaacaacagctgacagacattgaactagcaagtaaacaaaaggctgtatttgaaagcctgaaggctggaaatgctgcccttaagtctatacagaatgagataaacattgatgatgtccaaaagctgatggatgatacagccgaggctaaggcttatcaagatgaaataaatgctgttctaggcgagcagctatcggctgaggatgaagaagctgttatggctgagtttgagaatttggaagctcagcttgccgtcgagtctttgccagacgctcctgttactgaagtacggcctgaagagaaaatgaaagcaccagctgacacagaagctgcatctgaggacattgatgaggttattgagcttcctgatgtgcctacgaaagtgccagagagaccagaagctcctgaaaaaacgaaagttttggaagagccgctacctgcatagtggatggagctgagatgaatagggcactctcggtttgcagttgtaacatacccatcatttcattgtactaccccattttcagccatctcagaattttattctgtacagcatgaaaaaaaaagttgttgctctcgactattgattattgccaggttggatttcgcagtctccatttatagtacataatgttttgggtgcatttctgtttctgctgaagttctgaagcacgtgccttttgttccgtaagacactgaatatatatgattgtgttcaaagctgtaaaagatgtgacctttcccaagggagtcacttgttgcctgatcttaattgatgcagcgtgtaagatacccatttcattcgtgccgtgcgtgcgtcccggcacttgatcagagctcgtccatatcgattacatcg

SEQ ID NO: 15128 - protein, 229 aa, Panicum virgatum; identical to SEQ ID NO: 14808
  misc_feature: Ceres CLONE 1780961
  misc_feature (16)..(178): Pfam Name: Snf7 Pfam Description: Snf7

SEQ ID NO: 15129 - DNA, 733 bp, Panicum virgatum
  misc_feature: Ceres CLONE 1780962
  misc_feature: Encodes the peptide sequence at SEQ ID NO. 15130
cctccccacgaagagcagcggcagcagcagacacctccgccaccctcgaatcgtccccaaccatggcgtcgcaggtcgcctccatcttcgctggcatcgcgcaggccccggaggaccccatcctgggggtgacggttgcgttcaacaaggatcccagccccctgaaggtcaacctcggcgtcggcgcctaccggaccgaggaagggaagcccctcgtgctgaatgtggtccggcgcgccgagcagatgctgatcaatgacccgtctcgatttaaggagtacctaccaatcactggtttggctgaatacaataagttgagcgctaagcttatctttggtgctgacagccctgctattcaggagaatagggttgttacagtgcagtgcctatcaggaactggttctttaagagtgggaggtgaatttcttgcaaggcactaccatgagcgcactatctacattccagtaccaacctggggaaaccacccaaaagtcttcaccctagctggattgactgccatgagctaccgctactatgatcctgcaacccgtggtcttgatttcaacggactcatggaagacctcagttctgctcctttaggatcaattgtactgctgcatgcttgtgcccataaccctactggggtagatcctaccattgatcagtgggaacagattaggcagctgatgagatcaaaatcattgctttccattctttgacagtgcgtatcaag

SEQ ID NO: 15130 - protein, 218 aa, Panicum virgatum
  misc_feature: Ceres CLONE 1780962
  misc_feature (33)..(218): Pfam Name: Aminotran_1_2 Pfam Description: Aminotransferase class I and II
  misc_feature: SWISSPROT Homolog: EC 2.6.1.1 Aspartate transaminase
  misc_feature: Useful for making plants with modulated nitrogen use efficiency
MASQVASIFAGIAQAPEDPILGVTVAFNKDPSPLKVNLGVGAYRTEEGKPLVLNVVRRAEQMLINDPSRFKEYLPITGLAEYNKLSAKLIFGADSPAIQENRVVTVQCLSGTGSLRVGGEFLARHYHERTIYIPVPTWGNHPKVFTLAGLTAMSYRYYDPATRGLDFNGLMEDLSSAPLGSIVLLHACAHNPTGVDPTIDQWEQIRQLMRSKSLLSIL

SEQ ID NO: 15131 - DNA, 655 bp, Panicum virgatum
  misc_feature: Ceres CLONE 1780962-R
  misc_feature: Encodes the peptide sequence at SEQ ID NO. 15132
gagcattgtatgtggaagtgctgatgtagctgttagggttgaaagtcaactcaagcttgtgattaggcctatgtattcaagccctcctcttcatggttcctctgtcgtggcaaccatactcagggacagtgagatgttcaatgaatggactgtggaactgaaggccatggctgataggataattagcatgagggaacagctatttgatgcgctaaaatccagaggaactcctggagattggagccacatcattaagcaaattgggatgtttactttcactgggctcaatagcgagcaagtggccttcatgaggcaagaataccacatttacatgacatcagacgggaggatcagtatggctggtttgaacacgaagaatctgccccatcttgcagatgccatacacgctgcagttactaaactgaagtgaatgacagcatctcgccgtcttcctccatggataaaatccaaatcaccaacagcagtgtcctgaggactcagctagtggtatttactggcagaactcctgtaatttgccttttaatagacatgtttgactctgttatcggagcagttttccactgacggattcaaacatcatggtgctttcagacaccaaatataaaagacgcatatgcatatgtttttttgcacc

SEQ ID NO: 15132 - protein, 142 aa, Panicum virgatum
  misc_feature: Ceres CLONE 1780962-R
  misc_feature: SWISSPROT Homolog: EC 2.6.1.1 Aspartate transaminase
  misc_feature: Useful for making plants with modulated nitrogen use efficiency
SIVCGSADVAVRVESQLKLVIRPMYSSPPLHGSSVVATILRDSEMFNEWTVELKAMADRIISMREQLFDALKSRGTPGDWSHIIKQIGMFTFTGLNSEQVAFMRQEYHIYMTSDGRISMAGLNTKNLPHLADAIHAAVTKLK

SEQ ID NO: 15133 - DNA, 1933 bp, Panicum virgatum
  misc_feature: Ceres CLONE 1780963
  misc_feature: Encodes the peptide sequence at SEQ ID NO. 15134
acgtgccggtgccgcgccataagagcaaacacccagttcaattctcctccgcaacctcccacctcccctccgcctccctccccttcgcttcgataaccccaacgcgcgcgcgcgcgggcggcaccgagccagccagccatggagaaggcgatcgaccggcagcgggtcctcctcgcccacctcctcccctcctcgccgtcctcgcagccgcagctggaggcgtcggcgtgcgcggccggggatagcgccgcgtaccagaggacctcctccttcggagacgatgtcgtcgtcgtcgctgcataccgcacgccgatatgcaaggccaagcgaggaggtttcaaggacacgtacccagaggacctccttactgttgttctcaaggctgttctggacaacactaaaatcaatccaagtgacattggtgacattgtggttgggacggtgctaggtccaggttcgcagcgtgcaaatgagtgcagaatggctgctttctatgctggattccctggtaaatccctatgtttgcaaccatggcaccctcgtactcgtatgaagaagaggattctaccttctgggcaaaatttcactatcccattttgttggtgtagaactgttcctgtgagaactgtcaaccgacaatgctcatctgggttacaggcagtagctgatgttgccgccgctataaaggctggtttctatgacatagggattggtgctggtttggaatccatgtcgataaattccattgcttgggaaggacaagtaaacccaaaaataagtgcattccagaaagcacaggattgtcttctgcccatgggagttacttctgaaaatgttgctcatcgatatggtgtcaccaggcaagagcaagatcaggctgctgccgagtctcatagaagagctgctgcagccacagcttctggaaaattcaaggatgagattgtccctgtcccaacaaagatcgttgatcctaaaactggagaggagaagaaagttgtgatatctgttgatgatggaattaggcctggcaccacagcatctggattagcaaagcttaaaccagttttcaaaaaggatgggactactactgcaggcaattctagtcaagtaagtgatggtgctggagctgttctcctcatgaagagatctgtagctctgaagaaaggacttcctattcttggtgttttcaggagctttgctgctgttggagtggacccagctgttatgggtgttggtcctgctgtagccattcctgctgcagtgaagtctgctggccttcagatagaagacattgatctctttgaactgaatgaggcatttgcctctcaatttgtctattgctgcaacaagctgggactagaccgatccaaagtaaatgtgaatggaggcgcgattgcccttggacaccctgttggtgcaacaggtgcgcggtgtgtggctactcttctgaacgaaatgaagcgccgaggaagagactgcagatttggtgttataaccatgtgcatcggatctgggatgggtgcagcagctgtgtttgagcggggagacacggtggatgcactctccaacgtgcgggatgcccagtcacacaattttctatctagggatgcaaagtagaattgcagaaacattcttatctatctcaaggcatcgatcacagtaccatcctaaagcataatacggaaacccatatgtttattttcacagaaactatgtatacaaggaataaagggcatcatatggtatcttgttgtagccacccttatagatgaaaaagagaaagaaaagggtgttgtaaccaaacagctcaatgttctgagcttattctcttgctggtttgtttccggatcggaagagaaatgaattccaccatattgcctatgaccttatgtacttggaccaaaaggataaatagagcacctttgttcaccgg

SEQ ID NO: 15134 - protein, 492 aa, Panicum virgatum
  misc_feature: Ceres CLONE 1780963
  misc_feature (46)..(337): Pfam Name: Thiolase_N Pfam Description: Thiolase, N-terminal domain
  misc_feature (344)..(468): Pfam Name: Thiolase_C Pfam Description: Thiolase, C-terminal domain
  misc_feature: SWISSPROT Homolog: EC 2.3.1.16 Acetyl-CoA C-acyltransferase
MEKAIDRQRVLLAHLLPSSPSSQPQLEASACAAGDSAAYQRTSSFGDDVVVVAAYRTPICKAKRGGFKDTYPEDLLTVVLKAVLDNTKINPSDIGDIVVGTVLGPGSQRANECRMAAFYAGFPGKSLCLQPWHPRTRMKKRILPSGQNFTIPFCWCRTVPVRTVNRQCSSGLQAVADVAAAIKAGFYDIGIGAGLESMSINSIAWEGQVNPKISAFQKAQDCLLPMGVTSENVAHRYGVTRQEQDQAAAESHRRAAAATASGKFKDEIVPVPTKIVDPKTGEEKKVVISVDDGIRPGTTASGLAKLKPVFKKDGTTTAGNSSQVSDGAGAVLLMKRSVALKKGLPILGVFRSFAAVGVDPAVMGVGPAVAIPAAVKSAGLQIEDIDLFELNEAFASQFVYCCNKLGLDRSKVNVNGGAIALGHPVGATGARCVATLLNEMKRRGRDCRFGVITMCIGSGMGAAAVFERGDTVDALSNVRDAQSHNFLSRDAK

SEQ ID NO: 15135 - DNA, 1910 bp, Panicum virgatum
  misc_feature: Ceres CLONE 1780983
  misc_feature: Encodes the peptide sequence at SEQ ID NO. 15136
aagattccgatccgtccacgccattgcatcgctcgcgcggccggcacggtccagctagcaacgacgacccgagctgagcgcctgtgcgccacaagaagcttctctactctacatcgaggcagcagctaggccggcgcgcaccatgacgtccaccgtgaccacgcccagccggccgctcgccgccgggtgccggcgcgcggccgggccgcggcggtccggccccgccgtgctctcgctcaagggcccgcggcggcgggcgccgtccacgagctgctcggcggtcgcgtcgcccgagaagcggcgcgcggcggccaagctccccccgccgcagcggccgtcgagggccgcggcggcggcggagaaggaggaaggggagaggacggactacaacgaagtggcggccgcgctggagagcatctacaagctcagccccgccgtggtcgaggagaagcacggcgacgacgagggcaagaggaagaacaggaagaagaggaagggcgaactgggcaggagcacggtgatcgtgaggagccggcggaggaggcgcgggaggaggatggacctggggaagagggtggagatgaagagcagggagggcgacgccggcggcggccggcaggacgaggagcgggagttcgaggagatgctgctccgggagcactcggtgtccacggacatgggcagcctcgactggaagcgcatgaagatcccgccggtgctcagctccgcgcagagcgcgcgcctctttaagaccacgcagcccatgaaggcgatcttcgaagtgcaagagagcttgcgggaggacttgcagaaggacccgaccgacgccgagctcgcggaggccaccggcatgaccgtccagcagctgcgccgccgcctcgacgtcggccgggccgccaggaacaagctcatcaagcacaacctccggctggtgctgtacgccatcaacaagtactacccggacatggccagcgacgagaggttcgacgacctttgccaggccggcgccaacggcctcatcaccgccatcgaccgcttcgagcccaagcgcggcttccgcatctcgacctacgcgctcttctggatccgccactccatcgtccgcgccatgacgctttccaacttcacgcgcttcccgttcgccatggagtcggagaggcaggagatcaacaaggctcgggaggagctggcgttcgagctcgggagggcgcccacggacgaggaggtgatcgggagggtggggatctcccaggagaggtaccgcgacgtgctgaggatgacgcgacccacctactcgctgcactcgcggaaccgcgtgacgcaggaggagctcatcaacgaggtcaccgacgacgacgccatcggggtcgacgccggcaagcataacacgctgctccgcctggccatcgacgacctcctggactcgctgaagcccaaggagagcctggtgatccggcagcggttcgggctcgacggccgggggaagcgcacgctcagcgagatcgccggcaacctcaacatctctcgggagatggtccgcaagtacgagctcaaggccctgatgaagctcaagcaccccacgcgggtggactacctgcgcaggtacatgtgagctcagcattcggaccgtgccaccaccatagcatcaggtgtagagcatgttctacaagaaaaatcagagtggttactctgctgtatataatttctacccctccgctactctgcactgcactgtgcacgctataggctacagaatccatccatcactacactgaagtgaaatctgtctgtcttgtaatagaagacgacatgtacatatacacttatacaggaacggtgtgtgggggagtcctgactcctgatgagaagtgagttcattcgagtgaggttgtattgcagacctcgcatgc

SEQ ID NO: 15136 - protein, 489 aa, Panicum virgatum
  misc_feature: Ceres CLONE 1780983
  misc_feature (425)..(478): Pfam Name: Sigma70_r4 Pfam Description: Sigma-70, region 4
  misc_feature (332)..(413): Pfam Name: Sigma70_r3 Pfam Description: Sigma-70 region 3
  misc_feature (256)..(329): Pfam Name: Sigma70_r2 Pfam Description: Sigma-70 region 2
MTSTVTTPSRPLAAGCRRAAGPRRSGPAVLSLKGPRRRAPSTSCSAVASPEKRRAAAKLPPPQRPSRAAAAAEKEEGERTDYNEVAAALESIYKLSPAVVEEKHGDDEGKRKNRKKRKGELGRSTVIVRSRRRRRGRRMDLGKRVEMKSREGDAGGGRQDEEREFEEMLLREHSVSTDMGSLDWKRMKIPPVLSSAQSARLFKTTQPMKAIFEVQESLREDLQKDPTDAELAEATGMTVQQLRRRLDVGRAARNKLIKHNLRLVLYAINKYYPDMASDERFDDLCQAGANGLITAIDRFEPKRGFRISTYALFWIRHSIVRAMTLSNFTRFPFAMESERQEINKAREELAFELGRAPTDEEVIGRVGISQERYRDVLRMTRPTYSLHSRNRVTQEELINEVTDDDAIGVDAGKHNTLLRLAIDDLLDSLKPKESLVIRQRFGLDGRGKRTLSEIAGNLNISREMVRKYELKALMKLKHPTRVDYLRRYM

SEQ ID NO: 15137 - DNA, 679 bp, Panicum virgatum
  misc_feature: Ceres CLONE 1780985
  misc_feature: Encodes the peptide sequence at SEQ ID NO. 15138
ctttcggccgccgcccccgcctcttctgccgccgctatggccgcggcacccgctatcaccgcgtcctcctcctttgtctcgtcgtcgccgtgctctctcaggatgtcgaggagaagcccccggcggcccacgggaagagtgtcccacaaaatcagctgcgtcagtagcccaccggccgccgaaacatcttacaagactagtgtcccgcgcaatgctaacatggccaagctccaagcaggatatttatttcctgagattgccaggagaagagcagctcatttgctcaagtaccctgatgctaagattataagccttgggatcggtgacactacggagcccattccagatgtcataacaaccgccatggcagagagagcaaatgccttatcaacaattgatggctacagtggttatggagctgagcaaggtgaaaagaaactaaggtcagcaattgctgcaacctactatgcggaccttggtattgaagattcagacatatttgtctctgatggtgccaaatgtgacatttcccgcctgcaggtcctttttggatctaatgtgacgattgcggtccaagacccatcataccctgcatatgttgattcaagtgttatcatgggccaaactggcttatatcagcaagatgttcagaagtacgggaacatcgagtacatgagat

SEQ ID NO: 15138 - protein, 214 aa, Panicum virgatum
  misc_feature: Ceres CLONE 1780985
  misc_feature: SWISSPROT Homolog: EC 2.6.1.83 LL-diaminopimelate aminotransferase
  misc_feature: Useful for making plants with modulated nitrogen use efficiency
MAAAPAITASSSFVSSSPCSLRMSRRSPRRPTGRVSHKISCVSSPPAAETSYKTSVPRNANMAKLQAGYLFPEIARRRAAHLLKYPDAKIISLGIGDTTEPIPDVITTAMAERANALSTIDGYSGYGAEQGEKKLRSAIAATYYADLGIEDSDIFVSDGAKCDISRLQVLFGSNVTIAVQDPSYPAYVDSSVIMGQTGLYQQDVQKYGNIEYMR

SEQ ID NO: 15139 - DNA, 2381 bp, Panicum virgatum
  misc_feature: Ceres CLONE 1781017
  misc_feature: Encodes the peptide sequence at SEQ ID NO. 15140
gtgccatccagcgccttctcgatcgagaggaattagggagattggttagtaaatccggccgcagagctagctacgtacctcttgctacgcaattctagctaggttggtagcaagcggccagcggcctgctgcggaggctagccggcgccggcgacgatgaagaagggggaggacctcgagtcgccgctgctgcccgacgacggcgagccggcgccggcgggcgacaagggcagcgcgtacgcgctcgtctgcgccctcctcgcctccctcacctccgtcatctacggctacaaccgcggcgtgatgagcggggcgcagaagttcgtgcaggcggacctgggcgtcacggacgggcagctagaggtgctcatcggcgccaccagcgtctactcgctcgtcggctcgctggcggcggggtggacgtgcgaccgcgctggccggcgccgcgccgtcgcgctcgccgcggccatgttcctggcgggctccgccgccaccgccgccgccaacgggtacgccgcgctcatggcggggcagctcgtcgccggcgtcgcctgcgggttcggcctcgtcgtcgcgcccgtctacatcgccgagatcgcgccggcgggttcgcgcgggttcctctcctccattcccgagatcgccggcaactcgggcatcctgctcagctacgtcgccgacatggcgctcgcgggcctccccgcgacgctcagctggcgcctcatgatcggcatcggcgccgtcccgccgttgttcctcgccgccgccgcggcgctggccatgccggagacgccgcgctggctggtcctccacggccgccccgacgaggcccggcgcgtgctggcgcgcacctcgggggacgccgcagaacgccgcctccaggagatcgcggccaccgtccgggaggcgtcgtccaagggcgcgggcggcgagccggcggcggcggcgggcgtgtggcgcgagctcctgctccggcccacgccggccgtgcggcgcgtgatggtcgccatcctcggcctgcaggtgttccagcaggcaagcggcgtggcggcgatggtcctgtacgcgccgcgggtgttcggccacgtcggcatcacctccgaccgcgcggtgctcggcgccacggtcctcctcggcgccgccaagacggcggccatcgtggccccactctttctcgccgaccgcctcggccgccggccgatgctgctcgccagcgcggggggcatggccgcgtcgctcctggtgctcggcctctcggtgcgcgcgccgccgccggcggccgcggccgcggtcacgtggtgggcggcggcgacgtgcgtggcggcggcggcggcgttcatggcgacgttctcgctggggttcgggccggtgatctcgatgtacgggtcggagatcctgcctctgcggctgcgcgcgcagggcaccggcatcgggacggcggtgaaccgggtgatgagcgcggtggtggggatgaccttcatctcgctgtacgaggccgtcggcatggccgggaccttctacatctttgcggcggccgcggcggccgcatgggtgttcgtctacgcgtgcctgccggagaccaaggggaggagcctcgaggagatggaggcgctcttcgacgatgccggtgccaagcagccctcgccacggccgacgctcacgtgatcgatccggacagaggcagcgagtacgcatcgtacgtgtcgctagcgcggcatcagaagctgtgacgtggaattcagagtgaccattttaagtgacgtggcacttacattgaagaagggtactgactcataggctcagcaatgtcagtggccatcaagaccttcaaacccgaagtctgtcacattctcttggatagaaaaaagcagaacgggaactgaacaccaagttcattatactcttgacctcaagggtaatgcatcctgtaggtggcagtacaaatgaattagactccaatgacagcttttggcatcatggagactcatgcctcgttcctcatcagctgctcggactcccatcaggcatgcctgcacttctgaataagacccatcaagcagaaaggagcatcctccagcacctgcttttaccaactaactgtcataatctcttctcttattaagaactaggttggccacccgcgcatttgcgcggctagatattatatacgggtacatcttttattttgtattataagtttgtgatttttaagctttgagtacaaactataatttttacctgtaatatttatattttaattctttttgacattatttagataaaagttttacacaaagttgtttactggattatagatgttaataaaatagggtggacagttcacatgagatatatagtattaattatcttattagccttat

SEQ ID NO: 15140 - protein, 502 aa, Panicum virgatum
  misc_feature: Ceres CLONE 1781017
  misc_feature (32)..(487): Pfam Name: Sugar_tr Pfam Description: Sugar (and other) transporter
MKKGEDLESPLLPDDGEPAPAGDKGSAYALVCALLASLTSVIYGYNRGVMSGAQKFVQADLGVTDGQLEVLIGATSVYSLVGSLAAGWTCDRAGRRRAVALAAAMFLAGSAATAAANGYAALMAGQLVAGVACGFGLVVAPVYIAEIAPAGSRGFLSSIPEIAGNSGILLSYVADMALAGLPATLSWRLMIGIGAVPPLFLAAAAALAMPETPRWLVLHGRPDEARRVLARTSGDAAERRLQEIAATVREASSKGAGGEPAAAAGVWRELLLRPTPAVRRVMVAILGLQVFQQASGVAAMVLYAPRVFGHVGITSDRAVLGATVLLGAAKTAAIVAPLFLADRLGRRPMLLASAGGMAASLLVLGLSVRAPPPAAAAAVTWWAAATCVAAAAAFMATFSLGFGPVISMYGSEILPLRLRAQGTGIGTAVNRVMSAVVGMTFISLYEAVGMAGTFYIFAAAAAAAWVFVYACLPETKGRSLEEMEALFDDAGAKQPSPRPTLT

SEQ ID NO: 15141 - DNA, 1812 bp, Panicum virgatum
  misc_feature: Ceres CLONE 1781019
  misc_feature: Encodes the peptide sequence at SEQ ID NO. 15142
gaccgcaactgcaaggcaccgcacaagaactcgccaggaagcgacgacgcggaaagccaagagaagccacccgccgctgttggattgttccgttcttcgattcccccgcggaggtacgctccgcaccccacccaacccctgctcctaatccgcctctcctgctcccccggaaattccgcgtccagtgctcggatcttctcccgccgcttcccccgattttcctcacagcccgtttcgtctcctctcccgtccgccgccgccgccgcgctccaggaccggagtcttctctcctcggggatcgtcggcgccctcttatccgcgccctctactggtgctggactgccgtggggtggagatcggcttgaatcaactcttcttgtagtctgttggtgctgcgaaaatgagtgacaacttgatggacaaggttagcgcctttggcgagcgcctcaagatcactgggacggaggtcagcaagaagatgacggccggcatgagctccatgagcttcaagatgaaggaattgttccaggggcagactccggccgacaagatcgttgaggatgccacttcggagaacctggatgggcctgactggaacttgaacttggagatttgcgacctgatcaacactgagaaggttaacagtgtggagctcatccgtggcatcaagaagcagatcatgctgaaggatgcgaggatccagtacctctccttaatcctgctcgagactattgtgaagaactgcgagaaggccttctcggaggttgcggctgagcgggttcttgacgagatggttaggctgattgatgaccctcagacagttgtcaataacaggaacaaggcccttatgctgattgaagcatggggggagtctggtgatgagctacgctacctgccagtctatgaggaaacctacaagagcttgaaatcaagaggagtgcggtttcctggacgtgacaatgagagcttggctcccatatttactcccccacgatcagttgctgaagctgacattgatgcaaacttgccccagcaggcttttgaaaacgtgcatgttcatacatatactgccgaagaaacaaaagaagcattcgatgttgctcgtaacagcatagaacttctttcgactgttctttcctcttcccctgagcaggatgctttgcaggatgacttaacagccactcttgtgcaacaatgctaccaatctcagcacactatccagagaattattgagacggttggtgacaacgaagctgtgctctttgaggccttgagtgtgaatgatgagatccagaaagtgctatccaaatatgaagagatgaagcaacccagggcctcggagcaagcagaacagcgtccagtggtcataccgattgccacagaacacgaagattccactgccgttggcactgaagatgccctggtcagaaaaccagttgctgctagggcaaggtcaggtggagatgacgatatccttgatgatctcgacgagatgatatttggcaagaagggaggtagcagttcgcaggaagcacccaaaaagccagatccgaagaaagatgaccttatcagcttttaagcaccttcgcaccccgtacttgctattttatggtgctgtactcagtcggtagaagattgcagattctgtaggatttgaatcgcttgtttattctcatacgatcatacctgccccttttctcagtttgtccagttgttaagttgctgcactctctcaatcatctggcttcatggaggagtcccatgaatgtatttgatggtgaattctgccttgatgggaaaaatattttaact

SEQ ID NO: 15142 - protein, 392 aa, Panicum virgatum
  misc_feature: Ceres CLONE 1781019
  misc_feature (42)..(179): Pfam Name: VHS Pfam Description: VHS domain
  misc_feature (222)..(317): Pfam Name: GAT Pfam Description: GAT domain
MSDNLMDKVSAFGERLKITGTEVSKKMTAGMSSMSFKMKELFQGQTPADKIVEDATSENLDGPDWNLNLEICDLINTEKVNSVELIRGIKKQIMLKDARIQYLSLILLETIVKNCEKAFSEVAAERVLDEMVRLIDDPQTVVNNRNKALMLIEAWGESGDELRYLPVYEETYKSLKSRGVRFPGRDNESLAPIFTPPRSVAEADIDANLPQQAFENVHVHTYTAEETKEAFDVARNSIELLSTVLSSSPEQDALQDDLTATLVQQCYQSQHTIQRIIETVGDNEAVLFEALSVNDEIQKVLSKYEEMKQPRASEQAEQRPVVIPIATEHEDSTAVGTEDALVRKPVAARARSGGDDDILDDLDEMIFGKKGGSSSQEAPKKPDPKKDDLISF

SEQ ID NO: 15143 - DNA, 654 bp, Panicum virgatum
  misc_feature: Ceres CLONE 1781031-R
  misc_feature: Encodes the peptide sequence at SEQ ID NO. 15144
tacactgggactggcaaccaccatcatttccgtggtgtactctgctgtccgtgctggctcctctgcgactgtgctctcaccacccgactcgccacgtggtaccgacaagccattgcttcccttcagcaaggcagatgaacaagaagataagaaggatgtgcccaggccagtgacatactcctactctttcttccacctcatattctccctggccagcatgtactcagcaatgctcttgactggctggtcaacctccattggtgagagcggaaagcttgttgatgtcgggtggccatctgtctgggtcaggattgcaacccagtgggcgactgcaggtctgttcatatggtcccttgttgctccgatcctcttccccgacagggaattctaggtcaaccacgacaacctatgaatgcatgcatccctttggagcatcaaccatcaatcatttctactatggtagctaatatgtcctataaaaatatttgatctgtaatacatgccgtgagcgaatcgagcatgaagtcagtgtctgtccgtggctatcaagtctgtcaacttaataatatttggcatcaggtattgtgccagtatgtgaacagtgaaattgtgctgcttgtgttgtatatactggaatttgtgtttgtgtaggtc

SEQ ID NO: 15144 - protein, 129 aa, Panicum virgatum
  misc_feature: Ceres CLONE 1781031-R
  misc_feature (1)..(129): Pfam Name: Serinc Pfam Description: Serine incorporator (Serinc)
TLGLATTIISVVYSAVRAGSSATVLSPPDSPRGTDKPLLPFSKADEQEDKKDVPRPVTYSYSFFHLIFSLASMYSAMLLTGWSTSIGESGKLVDVGWPSVWVRIATQWATAGLFIWSLVAPILFPDREF

SEQ ID NO: 15145 - DNA, 192 bp, Panicum virgatum
  misc_feature: Ceres CLONE 1781031
aatgagatgcccgtttcagacgtgatggtggctactgcgcccgccggcgggcgctgcggtgacctgagacaacatgacgacggcccccccggccccgacagcatcaagtgggccgtccttcgctggacatcctactcgaagttgcacatggtgactacgctcgaccgcctcatcctccagctcctgcagggg

SEQ ID NO: 15146 - DNA, 1139 bp, Panicum virgatum
  misc_feature: Ceres CLONE 1781033
  misc_feature: Encodes the peptide sequence at SEQ ID NO. 15147
gccaccacgcagtctctagaacaaacagcgtcaatgtgctaatccctctcgtatccatctcccccaattctcctgacccgatcaaacaaagtcgaagccacctcccaatttccccacgcccagccacgcggatcgcagtccccgtcaagttcgcccctggcgtccgctcgatccgacgccgccgagtcgctcctgttggatcgtgtcgccggagggattcggccgcgggtggaggaaggagatcgaggcgagccgcgagcagcagccatgagcgaggtattcgagggctacgagaggcagtactgcgaggcctcggcctccctctcccgcaagtgcaccgccgcctccgccctcgatggagagaagaagaagcagaagctgtccgagatccagtccggcatggaggaagctgaatcgctgattcggaagatggacctggaggcgaggagcctgcagccgagtgtgaaggctggtttgcttgcgaagttgagggagtataaatctgacctcaacaatgtcaagagtgagctcaagaggatatcagcgcccaacgccaggcaggctacccgggaggagctccttgaggctggcatggctgacactcttgcggtttctactgatcagaggggaagattgatgatgacaactgaaagactgaatcagtccactgacagaatcaaagagagccgaagaactatgttggagacagaagaacttggtgtgtcaattcttcaggaccttcaccaacaacgacagtcactactacacgctcataccactttgcatggtgttgatgataacattggcaagagcaagaagatcctggcagcaatgtcgaagaggatggacaggaacaagtggatcattgggggaatcatcacggctctggttctggccatcctcatcatactctacttcaagcttgctcattaagcctgcttccaggtaggttggcccacatctctctgtccagtaattgtgtgttacgagttgtctgaatgcgtattaagtaacacgctttctcgccaagcatcatttgtttacccccaaacctctaaaaactcaagtggctcatattatgtacagtgtcagacactccaattatgtaaactgcccaaagggtgaaaagattacttctg

SEQ ID NO: 15147 - protein, 221 aa, Panicum virgatum
  misc_feature: Ceres CLONE 1781033
  misc_feature (41)..(196): Pfam Name: V-SNARE Pfam Description: Vesicle transport v-SNARE protein
MSEVFEGYERQYCEASASLSRKCTAASALDGEKKKQKLSEIQSGMEEAESLIRKMDLEARSLQPSVKAGLLAKLREYKSDLNNVKSELKRISAPNARQATREELLEAGMADTLAVSTDQRGRLMMTTERLNQSTDRIKESRRTMLETEELGVSILQDLHQQRQSLLHAHTTLHGVDDNIGKSKKILAAMSKRMDRNKWIIGGIITALVLAILIILYFKLAH

SEQ ID NO: 15148 - DNA, 1100 bp, Panicum virgatum
  misc_feature: Ceres CLONE 1781040
  misc_feature: Encodes the peptide sequence at SEQ ID NO. 15149
atcatcaagcctcgaccatccgccgtccatcctcgccccgcccggatcgaccacccaatccccccggcgcacacacggcggcgccatggacgccacgctgctgctctccgcctctgaagctaccctcgccgcccggcgccacccttctccgcccgcgcgccgcccggggcgggttgcgccaggccgacggccggcgtcctgcaggtccgtgcgcgcccgcgccgccgcagcggccgcgccagccgccggaggcgtcaccgggcaaagcaatggagtctacacagttggtgacttcatgacgaggaaggaaaatctacatgttgtcaagcctacaacatcagttgatgaagccctcgagctgttggtgcagcacaggatttctggctttcctgtggttgacgacaactggaagctggttggactcgtctcagattatgatctgttagcactggactcaatgtcaggaaatggactggctgatacgaataaaaacatgttccctgatgtggatagtacatggaagacattccgtgagatacaaaggctgctaagcaaaactaatggcaaagtcattggtgatgttatgacttcttcacctattgcggtgcgtgaaaatactaatcttgatgctgccacaaggttgctacttgaaaccaagtaccggagattacctgtagttgatagcacaggaaaactagttgggatgataacaaggggaaatgtcgtcaaagctgctctcaaaataaagaagaaatctgaagaaggtgcttgaatcgcatagtgccttaggggttcaattcattgagagattgattgatgaagttcattactgttgtatatgcagtagtgcagctccaagttctacctagacaccaatagatggatatggtgttgtatacggattgatataaattgcgaagggctttgatatagattcatataggaactgcttaattcatttgaggtaatcatacttggttccctctcaatataaggtagtgctagtgtagcggtgtataggttgatgtttcactatttatttgaaccttgtattcctggatatttcttattgatttatatagtgaggtctagatcttgtg

SEQ ID NO: 15149 - protein, 228 aa, Panicum virgatum
  misc_feature: Ceres CLONE 1781040
  misc_feature (71)..(218): Pfam Name: CBS Pfam Description: CBS domain pair
  misc_feature: SWISSPROT Homolog: EC 1.1.1.205 IMP dehydrogenase
MDATLLLSASEATLAARRHPSPPARRPGRVAPGRRPASCRSVRARAAAAAAPAAGGVTGQSNGVYTVGDFMTRKENLHVVKPTTSVDEALELLVQHRISGFPVVDDNWKLVGLVSDYDLLALDSMSGNGLADTNKNMFPDVDSTWKTFREIQRLLSKTNGKVIGDVMTSSPIAVRENTNLDAATRLLLETKYRRLPVVDSTGKLVGMITRGNVVKAALKIKKKSEEGA

SEQ ID NO: 15150 - DNA, 1746 bp, Panicum virgatum
  misc_feature: Ceres CLONE 1781049
  misc_feature: Encodes the peptide sequence at SEQ ID NO. 15151
tagataagcagcgcaaacccctaccctccctcggctctccctatccgctccgcccccaaataatccccacctcccgctgctcccctctcccgcctccgccgcccgccatggcctccctcgcctcggcctccacctccctcctcttcccgcaggcctcctcctcctcctcctccaggagccgcgccgggctctccacctccctgggcttccccgcgcagccggcggcgcggctccggagccgggcggcggcgggcgggcagaggcgcgggcgcctgctggtggtgcgcgcggcgaggggcaagttcgagcgcaccaagccgcacgtcaacatcggcaccatcggccacgtcgaccacggcaagaccaccctcaccgccgcgctcaccatggtgctcgcctccgtcggcggcagcgcgcccaagaagtacgacgagatcgacgccgcccccgaggagcgcgcccgcgggatcaccatcaacaccgccaccgtcgagtacgagaccgagacccgccactacgcgcacgtcgactgccccggccacgccgactacgtcaagaacatgatcaccggcgccgcccagatggacggcgccatcctcgtcgtctccggcgccgacgggcccatgccccagaccaaggagcacatcctcctcgccaagcaggtcggcgtccccaagattgtggtcttcctcaacaagaaggacatggtcgacgacgaggagctgctcgagctcgtcgagctcgaggtccgtgagctgctcagcaactacgagtacgacggcgacgaagtgccaatcgtctccggctctgccctcaaggcgctcgaggccctcatgggcaacccggccgtcaagcgcggcgacgacccgtgggtggacggtatcttctccttggttgattccgtggattcctacattccagtcccccagaggcagaccgacctccccttcttgctcgctgttgaggatgtcttctccatcactggccgtggtacagtcgccactggccgtatcgagcgtggcaccgtcaagattggtgacacagttgatattgtcggaatccgggagacccgcaactgcacggtgactggtgtcgagatgttccagaagactatggatgatgccatggctggggacaatgttgggcttctgctccgtggtatgcagaaggacgacattgagagaggaatggtgttggctaagcctggttctatcacaccgcacaccaagtttgaggctgttgtgtatgtgcttaagaaggaggagggtggccggcactcacctttcttccctggttaccgcccgcagttctacatgcggacaactgacgtgacagggaatgtgacaacaattatgaatgacaaggatgaggaggccaagatgtgcatgcctggtgaccgtatcaagatgattgtgcagctcatccagcccgttgcttgtgagcagggaatgaggtttgctatccgtgagggtggtaagactgtcggcgccggtgtcatcaacaaaatcattgagtaaaccggatatgccatatccaccatgaaattttccctgtttactctcagcgaaatgctatgtagttgttattatgtgttgagctttaggggttgctcatgtgaagttgtagtatggcactttttttgtccagtgaatttgcatactttgtgacattcacgacaatgatacatcggtcttttgcaattgatttggctaagaggtgccacctattgttacatgttcaattttt

SEQ ID NO: 15151 - protein, 469 aa, Panicum virgatum
  misc_feature: Ceres CLONE 1781049
  misc_feature (70)..(272): Pfam Name: GTP_EFTU Pfam Description: Elongation factor Tu GTP binding domain
  misc_feature (369)..(468): Pfam Name: GTP_EFTU_D3 Pfam Description: Elongation factor Tu C-terminal domain
  misc_feature (295)..(364): Pfam Name: GTP_EFTU_D2 Pfam Description: Elongation factor Tu domain 2
  misc_feature: SWISSPROT Homolog: EC 2.7.7.4 Sulfate adenylyltransferase
  misc_feature: Useful for making plants with modulated oxidative stress sensitivity
MASLASASTSLLFPQASSSSSSRSRAGLSTSLGFPAQPAARLRSRAAAGGQRRGRLLVVRAARGKFERTKPHVNIGTIGHVDHGKTTLTAALTMVLASVGGSAPKKYDEIDAAPEERARGITINTATVEYETETRHYAHVDCPGHADYVKNMITGAAQMDGAILVVSGADGPMPQTKEHILLAKQVGVPKIVVFLNKKDMVDDEELLELVELEVRELLSNYEYDGDEVPIVSGSALKALEALMGNPAVKRGDDPWVDGIFSLVDSVDSYIPVPQRQTDLPFLLAVEDVFSITGRGTVATGRIERGTVKIGDTVDIVGIRETRNCTVTGVEMFQKTMDDAMAGDNVGLLLRGMQKDDIERGMVLAKPGSITPHTKFEAVVYVLKKEEGGRHSPFFPGYRPQFYMRTTDVTGNVTTIMNDKDEEAKMCMPGDRIKMIVQLIQPVACEQGMRFAIREGGKTVGAGVINKIIE

SEQ ID NO: 15152 - DNA, 2641 bp, Panicum virgatum
  misc_feature: Ceres CLONE 1781058
  misc_feature: Encodes the peptide sequence at SEQ ID NO. 15153
ccgcgcgccgccgaacccgccgcctcctccagcctccgtccgcaccggagctcgccagtcagccacaccggcacggcggatcccgcgggaacctctccttcgtggtcttcgccgccgtgcgcccccctccccggtcccttctggtggtagattgagggcggggcggagatccgtccgggcttgggttgatctctcgttggctcttcctcgtacgcacgatcgatcccagtcgacgccatagaaattctgaaggtgcgggtgcaacttcttcttgcagaagcctaacccccatgcccctcgctacgcccacccgtgtgataccgccgtgacgcgtcatccatagtagaaggccatgttgtcaaggtttgctcacatagggaagagcagaaaacttgctcaaaccttattggttgcctcaaaacccaatactggtagtgggcaaagcattggttcaagctttgcatttggtttgggttattccggcagggcttttttgcaagggagggttcataatggtccaagcacttcgtacattcttggaagggcaaatgggagctcacactggagcactggtgtgagaaagttctcagttctttcgtcttgtagccagaatgcatatcagagccaacttgcttggaagcgactcgtggaaatgggttctcgtgcaccaaaagcatctccatttctgagtagggtcgcttgtgccattagcttggctgtgagtagatctaatttagctccttatctcttcgctttcatagcgggagaggtaatgctagctcagaagacatcagcagatggtgagtactacccaatacgtgagcgagctcaggatggccgtatttacgtcacctctttaatatattcggcagtagagatggttattataatcttcagatcaatatatttggcattgctgttcactccgagcatactgatggcaccatttgcagagactcttggcagcaagtatagaaaaacatggcttcgacttgtccatcgtactttggagttggcaggtcctgcatttatcaaatggggccaatgggctgcaacacgccctgatctatttgcaagtgacctatgcactgagttgtcaaaacttcacacaaaagcaccagctcacagctttaagtataccaagaaaactgttgagaaagcttttggtcggaagctatctgacatttttgagaattttgaagagaaccctgttgcatctggaagtgttgctcaagtgcatagagctgttttacgattatcgtatcccaagcagtcaaagcgtgtaacagttgcagtaaaagtaaggcatcctggtgtaggagactcgatacggagggatttcagtatcatcaatgcagtagcgaaaatttctagatatatccctacattaaattggttgcgtctggatgagagtgtgcaacagtttgctgtcttcatgatgtctcaggttgaccttgcaagggaagctgctcatttgagccggtttatctacaacttcagaaggtggaaggatgtatctttcccaagacctctttatccacttgttcatcctgctgttttggttgagacctacgagcatggggagagtgtttcacattatgtcgatgaccttgagggacatgatcgaattaaaagtgctctggcccatattggcactcacgcgctcttgaaaatgctactggttgataatttcgtccatgcagacatgcatcctggaaatattttggtccgtgttgtacaaccaaaaaactcaaataacacccttataaagtcaaggccacatgtagtcttccttgatgtgggaatgacagctgaactttcaagtaatgaccgtgtgaatttacttgagtttttcaaggctgttgctcgccgagatggtcgtacagctgcagaaagtactttaaagttgtcaaaacagcagaattgcccaaatccaaaagcttttattgaggaagttgagcgatcattctctttttggggcactgctgagggtgatgctgtccacccagcagagtgtatgcaccagcttcttgagcaagttcgacgtcacaaagtgaacatcgatggcaatgtttgcactgtcatggtgactacattagtacttgagggctggcaacgcaagttggacccagattacaatgtaatgaagacactacagactctactttttaaagaagactgggcaaagtctcttcaatacacgatccaagggctcatggcaccttaggagatctacactgccatcctctcgaaagttttgatctggtttgtgttgggctggaggatgctctgctctcaccattacattttgtttcttttccatttcatctactcttagatcatacagttctgtacccgtcctggcctgtgctgctaaagcagccttgataagtaataattgcagcattgttttgaagataccagagtactatgctgtagattgcattgccctggattgggtcctttttttgctcctcctaagtcccaacacttatgttaatagctcttagatgatgtagcaaaaggtgttttattcaggcgatctttttgtaactggggagactacgagggaatgatagatttcttatgtacacacagtcacacagagatactgttaattgtttgaagaatcctacgtctc

SEQ ID NO: 15153 - protein, 624 aa, Panicum virgatum
  misc_feature: Ceres CLONE 1781058
  misc_feature (269)..(394): Pfam Name: ABC1 Pfam Description: ABC1 family
MLSRFAHIGKSRKLAQTLLVASKPNTGSGQSIGSSFAFGLGYSGRAFLQGRVHNGPSTSYILGRANGSSHWSTGVRKFSVLSSCSQNAYQSQLAWKRLVEMGSRAPKASPFLSRVACAISLAVSRSNLAPYLFAFIAGEVMLAQKTSADGEYYPIRERAQDGRIYVTSLIYSAVEMVIIIFRSIYLALLFTPSILMAPFAETLGSKYRKTWLRLVHRTLELAGPAFIKWGQWAATRPDLFASDLCTELSKLHTKAPAHSFKYTKKTVEKAFGRKLSDIFENFEENPVASGSVAQVHRAVLRLSYPKQSKRVTVAVKVRHPGVGDSIRRDFSIINAVAKISRYIPTLNWLRLDESVQQFAVFMMSQVDLAREAAHLSRFIYNFRRWKDVSFPRPLYPLVHPAVLVETYEHGESVSHYVDDLEGHDRIKSALAHIGTHALLKMLLVDNFVHADMHPGNILVRVVQPKNSNNTLIKSRPHVVFLDVGMTAELSSNDRVNLLEFFKAVARRDGRTAAESTLKLSKQQNCPNPKAFIEEVERSFSFWGTAEGDAVHPAECMHQLLEQVRRHKVNIDGNVCTVMVTTLVLEGWQRKLDPDYNVMKTLQTLLFKEDWAKSLQYTIQGLMAP

SEQ ID NO: 15154 - DNA, 440 bp, Panicum virgatum
  misc_feature: Ceres CLONE 1781067
  misc_feature: Encodes the peptide sequence at SEQ ID NO. 15155
acacgagctacgagtccgggtcttccccgttcgcccgcgtccggaggctaggagagacgcgcggtcgctcgccgccatagcagagcgctcgggctctccgcccaccccggtatggaagggtccgaccgcggcggcgggggatggctcggaacaagatcggggagtacgactgaaagcgcgtcgtgcgggagcgcctcacgagcatcgccggcgtctacctccagatcctctcgggggaggtcacacgatcaacggatttcgccgagcttgccaacagggagccatggctttcatcgatgaagttggttgcgaaacctaacatgctgatttgtatacgtgggaagagtggagttgaggccctcaacctagaccttgcccaacttctccaatttgttaaggagcggttgggagttgaggttgagatgggtggctgcagagct

SEQ ID NO: 15155 - protein, 47 aa, Panicum virgatum
  misc_feature: Ceres CLONE 1781067
  misc_feature: Useful for making plants with modulated root development
MKLVAKPNMLICIRGKSGVEALNLDLAQLLQFVKERLGVEVEMGGCR

SEQ ID NO: 15156 - DNA, 384 bp, Panicum virgatum
  misc_feature: Ceres CLONE 1781082
  misc_feature: Encodes the peptide sequence at SEQ ID NO. 15157
agtaacctttcctttctctcggactgtctcctcccttctctttcttccctcgcggcggctacgactgggcgagcggcggccccctttgtcacgtcttcttccagaccctttgcccgcgaccagcctcctccatgcggccgccatggcccccttcgacctctgccggaggtgcgccctcggcctgtgcctcaccgagaggctcgacgggatggtctcctgcggcaccctctccccggagctcgccatccaggtcctcgtcccgtttgacaagtctacgaccgctgctctggagaaccagctggagagcacggttaccatcgcgggccctatgcgcacctagccgttctgccccaatgtgtggaccttcatcgtgacggatgcacc

SEQ ID NO: 15157 - protein, 65 aa, Panicum virgatum
  misc_feature: Ceres CLONE 1781082
  misc_feature (2)..(50): Pfam Name: TFIIA_gamma_N Pfam Description: Transcription initiation factor IIA, gamma subunit, helical domain
  misc_feature: Useful for making plants with altered lignin content
  misc_feature: Useful for making plants with altered terpenoid content
MAPFDLCRRCALGLCLTERLDGMVSCGTLSPELAIQVLVPFDKSTTAALENQLESTVTIAGPMRT

SEQ ID NO: 15158 - DNA, 714 bp, Panicum virgatum
  misc_feature: Ceres CLONE 1781097
  misc_feature: Encodes the peptide sequence at SEQ ID NO. 15159
accgagctgctcggctcatcccgcccgacgcgcttcgtcgggaaccctagggccggatccccgcggctactgcggcggccgcggaaatggcgaaccccctagcggggctgcaggaccacctcaagctcgcgcgcgactacgcgctcgagggcctctacgacacttccatcatcttcttcgacggcgccatcgcccagatcaacaagcatctaactactctggatgatgctctggttcgtatgaaatggatgaactgcaagaaagcaatctctgaagaagtggaaattgtaaaacagttagatgcccaattaaagtcccttaaagaagctcctggggtgaggcggtcctcatcacctcctattcgctccaacaaatcatttcatttccaaccgttggatgaatatccaacttcgtcaccagcaccctttgataatcctgatgtgtgggctcctccaagagatataccaaaccgaaggtcaacaagaggtcaatctagtgcaagaaaatcctcccaagatggagcctggtcacgtggtgcatcaaggactggaacacctagccgtagcgcaaagcctaatgggagtaaaggaagctctgcggtaagatcatcaactgcgtctagcgctggtgggagaaaaggaaaaccaagttcaagcaaggctgattcagtgagtagtgatgctgaagaaagtaagtccaagaagggtcagtacg

SEQ ID NO: 15159 - protein, 209 aa, Panicum virgatum
  misc_feature: Ceres CLONE 1781097
  misc_feature: SWISSPROT Homolog: EC 3.6.4.3 Microtubule-severing ATPase
MANPLAGLQDHLKLARDYALEGLYDTSIIFFDGAIAQINKHLTTLDDALVRMKWMNCKKAISEEVEIVKQLDAQLKSLKEAPGVRRSSSPPIRSNKSFHFQPLDEYPTSSPAPFDNPDVWAPPRDIPNRRSTRGQSSARKSSQDGAWSRGASRTGTPSRSAKPNGSKGSSAVRSSTASSAGGRKGKPSSSKADSVSSDAEESKSKKGQY

SEQ ID NO: 15160 - DNA, 3047 bp, Panicum virgatum
  misc_feature: Ceres CLONE 1781100
  misc_feature: Encodes the peptide sequence at SEQ ID NO. 15161
aaaaacagattctgcacatatttcttttagtgttcttgattaagaaggcagaaagattaacagctggagaaaaagttcctctgcttccgatcatttggtcaacatttctgcgcttgctgtcctccatcaagctgccgttcatcgattgcacagtagcaagttagcaatcattgacgaatcttcagaaggctgaaggaatttccagcaattttcaagaaagaggaggaagaagtctttgaggcaagctagcgaggtccaagaatggctagaagaagttgcaggcattctctgctcatcttactgccactgctgcttgcaatggtacctgagtccacgcagctgcagtcgtcgcagacatggtcgctgctcaagatccagcagctgctcaactacccgccggtgctgagcacctgggccaaccacaccgacttctgctacggtggcgactacaagacagcctccgccttcgtcgagtgctacggcgacagcgtcacgcagctccacatcatcggccccggcggcgccggcgcgcctccgctgcccaagaccttcagcatcgacgccttcttcacgacgctgtccaggctgcccgacctccgggtgctcacgctcaccggcctcggcctctggggcccgctgccggggaaggtgtcgcggctggcgtcgctggagatcgtcaacatcagcggcaattacctctacgggcagctcccggagggcctgtcccggctcggcagcctccagactttcatcgccgacgacaacatgctctccggcgagctccccggctggctcggcaagctgccgtcgctggccgtgctcagcctccgcaacaactcgctgcaggggccgctgccggagtccgtcagggacatggggtcgctgcggtcgctgacgctcgcctccaacaacctctccggcgcggtgccggacctgagcgcgctcaagaacctgcaggtggtcgacctcgccaacaattcgctcgggccggcgttcccgcggctggggaggaaggtggccagcgtcgtgctcagcggcaaccggttcagcgacgggctccccggtgagctcagctccttctacctcctcgagcacctcgacgtgtcgaggaaccggttcgtcggcccgttcccgacgacgctgctcgcgctgccgtccatcgagtacctcagcatcgccgggaaccacttcaccgggcttctcgccgccaacatgtcctgcggcgagaacctccggttcgtcgacgtgtcgtccaatctcctcaccggcagcctcccgtcctgcctgaccaggcccccctcgagcaagcccgacgagtccaaggtgacgctcgtcgcggcgtccaactgcctgtccgccaccggcggcggcgacgtcggctggcagcacccgttcctgttctgccagaaccaggcgctggccgtgggcatcgtgcccgaccaggcccacagcaggaagagcggcgccaaggcggggctcgtggccggcatcgtcgcgggcgccctcgccggcgtggtgctcgtcggcgtggccgtcttcctcgccgtgaggaaggtgaccatgaggcgcgccaaggccaggccgccccgacggctggtggagcacgcctccagcgcttacccttcgcagttcttcgccgacgctcgttacatatcgcagacggtgaagctgggagctctgggcattccggcgtacagaaccttctccctggtggagctcgaggcggcgacaaacaacttcgaggtctcctgccttctcggacaggatgctcacggccagatgtaccgggggacgctgggcaacgggacggcggtgacgatccggtcgctgcgggtgaagcggagccagacgtcgcagagcttcaaccggcacatcgagatgatctccaagctgcggcaccggcacctggtcagcgcgctgggccactgcttcgagtacaacctcgacgactccaccgtcacgcagctctacctcgtcttcgagtacgtgcagaacggcaacctcaggagcaggatctcgcagggaacggaggggaggaggctcccctgggtgcagaggatctcgaccgccatcggcgtggccaagggcatccagttcctgcacggagggatcatgccggggctgttcgccaacaacctcaagatcaccaacatcctcgtggaccagaacctcgtcgccaagatcggcagctacaacatccccatcctagccgaaactgcaaaatcagagggaggaggaggaagcaagtatccatctgacagggtggccaacggcgacaagatggacatctacgacttcggcgtgatcctgctggaggtggtgacggggcgggccatcacgtcgatccacgaggtggagatcatgcgggagcagctgcagtcggcgctgacgtcggagagcccggcgcggcggcggctgctggtggacccgtcggtgggccgcgcgtgctccgacgagtcggcgcggacggtgatggagatctgcctgcggtgcctggccaaagaggcggcgcagcggccgtcggtggaggacgtgctctggaacctccagttcgccgcgcaggtgcaggacgactggcgcgccggcgactcccgctcccagagcagcgaggagtcgccactgtcgccgtcgcagatccccagggcgtcggcgccggcggatgctgctgcctatgcctagctaggtcggacggtgaagaacgaggagcattggcgcgatcaggcgaagcagcatggagcaacaattttcgtttgatgatgttagggtcggtctgatcaacacggctgcatggtagagaactgaacagagtggtgtcaggctaagtgtatagcagggttgcagctgaagctggaaactcatactacgtattagttattgctactacccccaaggatcaaggatgtgtacagagctttcttggcctttttttttcgcttactgttttttcccatttctgtttctgttttcccttcatgaatccgttgactttgtaataaccactgtggcactggcactatgtttggtttgaccctcggtggggtcttcag

SEQ ID NO: 15161 - protein, 805 aa, Panicum virgatum
  misc_feature: Ceres CLONE 1781100
  misc_feature (493)..(762): Pfam Name: Pkinase_Tyr Pfam Description: Protein tyrosine kinase
  misc_feature (435)..(759): SWISSPROT Homolog: EC 2.7.11.1 Non-specific serine/threonine protein kinase
  misc_feature (133)..(344): SWISSPROT Homolog: EC 4.6.1.1 Adenylate cyclase
MARRSCRHSLLILLPLLLAMVPESTQLQSSQTWSLLKIQQLLNYPPVLSTWANHTDFCYGGDYKTASAFVECYGDSVTQLHIIGPGGAGAPPLPKTFSIDAFFTTLSRLPDLRVLTLTGLGLWGPLPGKVSRLASLEIVNISGNYLYGQLPEGLSRLGSLQTFIADDNMLSGELPGWLGKLPSLAVLSLRNNSLQGPLPESVRDMGSLRSLTLASNNLSGAVPDLSALKNLQVVDLANNSLGPAFPRLGRKVASVVLSGNRFSDGLPGELSSFYLLEHLDVSRNRFVGPFPTTLLALPSIEYLSIAGNHFTGLLAANMSCGENLRFVDVSSNLLTGSLPSCLTRPPSSKPDESKVTLVAASNCLSATGGGDVGWQHPFLFCQNQALAVGIVPDQAHSRKSGAKAGLVAGIVAGALAGVVLVGVAVFLAVRKVTMRRAKARPPRRLVEHASSAYPSQFFADARYISQTVKLGALGIPAYRTFSLVELEAATNNFEVSCLLGQDAHGQMYRGTLGNGTAVTIRSLRVKRSQTSQSFNRHIEMISKLRHRHLVSALGHCFEYNLDDSTVTQLYLVFEYVQNGNLRSRISQGTEGRRLPWVQRISTAIGVAKGIQFLHGGIMPGLFANNLKITNILVDQNLVAKIGSYNIPILAETAKSEGGGGSKYPSDRVANGDKMDIYDFGVILLEVVTGRAITSIHEVEIMREQLQSALTSESPARRRLLVDPSVGRACSDESARTVMEICLRCLAKEAAQRPSVEDVLWNLQFAAQVQDDWRAGDSRSQSSEESPLSPSQIPRASAPADAAAYA

SEQ ID NO: 15162 - DNA, 2258 bp, Panicum virgatum
  misc_feature: Ceres CLONE 1781107
  misc_feature: Encodes the peptide sequence at SEQ ID NO. 15163
gacccacccttgctgctcgatcttatccccgcagccgcgacttatcgatgatgacgccgccggctgctcgatcttatccccgcagccgcgacttatcgatgatgacgccgccggcggcggcagggccgcggcagcgccgcctccggccagccggacccggcgaccgcctctgctcccgttgcgccctcgtcgtcttcctgctcgccgcctgcgcctcctccggctccgggcgggtggtgaccagcctcccgggcttcgacgggcccctccccttccacctcgaaacagggtacgtggaggtggacgcgcagaacggcgccgagctcttctactacttcgtccagtccgagtccggcgcctccgcgcctttcctcctctggctcacgggcggcgaccgctgctccgtcttcagcggcctcgccttcgagatcggtcccgtcaggttcgtcgtagagccctacgacggcacgttgccgcgcctgcagtacaatcaaaactcgtgggccaaggtgtcacatatcctatttgtcgattcgccggttggggctgggttttccttttctagagaacctaaaggctatgatgttggagacatctcatccacactacaactatatgacttcctcatcaagtggtttaatgaccaccctcagttcctcacgaatcctttctatattggtggagactcctacgccggaaaaattgtgccatttcttgcgcaaattatttcagaaggtattgaagcaggaaggacccttccaaatctgaagggctatctagcgggcaacccgggcacaggagaaattgttgattttagctctagagtaccttatgctcacggatttggtattatttcagatcaactctacgagacaatagtgacgcattgccaaggacaggactacattgaccctggaaatgcgctctgtgctcaggctatgaatactttcaatgatctcatcaacgaagttgagaaggcccaggttctgctggacaagtgcgtctacgcatcggctgtaccaaatgttgacagcaagacagacgcctcagatggtagaaggatccttggggaggaggtgggaacagggaagctgaatcacccaccagctcgacccccatttggctgcattacttacggctattatctgtcgtatttttgggcgaatgataaacgcacccaagaagctctcgggatcaagaagggaactgtggaagagtgggtgagatgccacgacaaagatctgccctacacgaacgacctcggcagtgccatcaagtaccaccggaacctgacgtccagaggctaccgcgcgctggtctacagcggcgaccatgacctggtggtgccgcacctgggcacccaggcctgggtcaggtcgctcaacttctccatcgttgacgactggagggcgtggcatctcggcggccaatccgccggattcacgataagctattcaaacaacatgacattcgcgacgatcaagggtgctgggcacacggcgccagagtacgagccggagaggtgttttgccatgttcagacgctggatactcaaccgcccactttaaggacccactcactcgtactatatatcttggtggacggcactagctcatgcagggctttactggaatgtcgagtccaatccaattcataggtggggaggaataatggatgattgttatgaatcgatggatgattcattcatgtgtgaatctctttggtgatcgatgactgaaatgcttctctccggtatacttcattaacattggtagcaatagatacaagtcataaggggtgaagctctgctctacaataggaataatatatatatatatatatatatatatatatatatatatatatatataggtatgtattttggtgctgtgtatatatctctatttatatttatttatgtatagatatatgaaaaaaaaaaaaggggggagggggggagagacacagagacacacatacacaaacacacaaaaaaaagcatgatctatctctctctatatctctttctatatatatatatatgattgagatatatatgtgtgtgtgtgtgtgtgcgtgagagagagagagagagagagagagagagagagagagagagagagagtgtgtggtggtggggaggggagtgagagtgtgtgtgtgtgtctgtgtgtctctctctctctctctctctctgtgtgtgtctctgtctgtctgtgtgtgtgtgtgtgtgtgtgtgagagagtgtgagtgactga

SEQ ID NO: 15163 - protein, 489 aa, Panicum virgatum
  misc_feature: Ceres CLONE 1781107
  misc_feature (51)..(486): Pfam Name: Peptidase_S10 Pfam Description: Serine carboxypeptidase
  misc_feature: SWISSPROT Homolog: EC 2.3.1.91 Sinapoylglucose--choline O-sinapoyltransferase
MMTPPAAAGPRQRRLRPAGPGDRLCSRCALVVFLLAACASSGSGRVVTSLPGFDGPLPFHLETGYVEVDAQNGAELFYYFVQSESGASAPFLLWLTGGDRCSVFSGLAFEIGPVRFVVEPYDGTLPRLQYNQNSWAKVSHILFVDSPVGAGFSFSREPKGYDVGDISSTLQLYDFLIKWFNDHPQFLTNPFYIGGDSYAGKIVPFLAQIISEGIEAGRTLPNLKGYLAGNPGTGEIVDFSSRVPYAHGFGIISDQLYETIVTHCQGQDYIDPGNALCAQAMNTFNDLINEVEKAQVLLDKCVYASAVPNVDSKTDASDGRRILGEEVGTGKLNHPPARPPFGCITYGYYLSYFWANDKRTQEALGIKKGTVEEWVRCHDKDLPYTNDLGSAIKYHRNLTSRGYRALVYSGDHDLVVPHLGTQAWVRSLNFSIVDDWRAWHLGGQSAGFTISYSNNMTFATIKGAGHTAPEYEPERCFAMFRRWILNRPL

SEQ ID NO: 15164 - DNA, 438 bp, Panicum virgatum
  misc_feature: Ceres CLONE 1781107-R
gagggagagagagagagagagagagagagggatagctctattttttcggaagttatatacacacacccccccgcacactcgctctcactctctctctctctctctctctctcgcgcgcgctcgctcgcgcacgcagtctttttttgtttttatttttatttatatatagagagggagagatatatatagttatagatatatctatctttcttttttttatgtgtttgttttttttttatatatatatatatatatatatatatatatatatatatatatatatatatatatatatatatatatatatatatatatatatatatatatatatatatatatatatatatatatatatatatatgatgcgtccgtacatcgtacgcgaatggtatacatgtgtgattctcaagcaataacatttgcgtcagtttcaaactc

SEQ ID NO: 15165 - DNA, 2137 bp, Panicum virgatum
  misc_feature: Ceres CLONE 1781108
  misc_feature: Encodes the peptide sequence at SEQ ID NO. 15166
agcaataaactatccccgccgccaccggctctcggcatcgccactacgctagcttcgtcaacaccgcgaccgccccacctccgagcgccaattctaccgccgttcccggccaaatcggaggagcttccagtccacgaatccacggctccttcccggaggcaatcttgcgccgattggctgtcccgccgagtcctgcgttcttgcgggttggggggtcagatcaatctggcctcttctcgatcggattccagtggtcggcgcccccagctcgcgatctttcctgccggtttcgtcagccgctagtcaacttggccggtcggttttggtctccgactccgagggctgttcggcttcgtgctgccaccgtcgctttagttcgtcagtctccgccaagatttcggcgatcttccaatcaaggcccgcccaagatttgattgaagctttaccagttcttggattcgtttcttgggggcaagaagccggttcttgtgtcgtctctggtgctgcaagtatgttctgtggcacaccgggtctctagtaaagagttcgtctgttgttagtttagggacttccagcctcgttcctggaaagttgctctcggcccctgcggcgatggcttctagcaccagcgagatgcccgaggcaaaggcgaagctgaagaggtccgggagtatgggaagcaatgatacatatgtgcgagctgacaagattgatcttacgagccttgacatccagcttgagaagcaactcaccaagacctggggtaaggccagcctcaagtcccaggggcccaaggaggagtgggagattgatcttgcaaagctggagatccgctatgtcatcgcgcaggggacttatggcaccgtgtatcgtggcacctatgacggtcaggatgttgcagtgaagcttttggattggggagaggatggttttgctacagaagctgaaactgccactttgcgaacatcatttaagcaggaggttgctgtttggcataagctcagccatcctaatgtgacaaagtttgttggtgcatctatggggaccacagatcttaagattcctgccaacaattccaacggtgatgcacgcactaacttgccagcgagagcatgttgcgttgtggtagaatatctcgctggaggaactttgaagcaatatttgataaagaacagccgacggaagcttgcttacaaagttgtggttcagcttgctttggatttagccagaggattgagctatctacactcaagaaagattgtacacagggatgtgaaaagtgaaaacatgcttctcactccacagcgaaaccttaagattgctgatttcggtgttgctcgtgtcgaggctcagaatccaaaagacatgactggtgcgacaggcacacttggttatatggccccagaggtacttgatggtaaaccatacaacaggaagtgtgatgtttacagttttggcatttgcctgtgggaaatctattgctgtgacatgccgtatccagaccttagttttgccgatgtctcatccgctgttgtccatcagaatttgcgcccagacattcctcgctgctgtccaagcgcatttgctaatgttatgcggaaatgctgggatgcaaaccctgataaacgccctgatatggatgaggtggtacagcttttagaggctcttgacacgagcaagggtggtggcatgataccagatggtcaatcatctggatgcttatgcttcaccaaggctcgtggtccatagttcttttcatgataccttcttccctcagctacattttgcccatgtaaatgaatggggcatgacatgcttcctgttgccacctgcttagtcggtgctgtcagacgttcatggtagtggtgccacctttatgcgtcgactacaggcctaaagctctctcgtatgacctttggggtcaaatgctttttttctatacaagcggtatgatgtaattgtgattctaaagagatttcagggtatacggagttacactcttgaaaatgctaccttcccgtgtccatttcggatccattgctgaatatacatctttactttttttccttttaccatttacgaatcatgcaaagaattgaggaaaagaatgggcagaaataaaattggtgtttagctt

SEQ ID NO: 15166 - protein, 378 aa, Panicum virgatum
  misc_feature: Ceres CLONE 1781108
  misc_feature (71)..(349): Pfam Name: Pkinase_Tyr Pfam Description: Protein tyrosine kinase
  misc_feature: SWISSPROT Homolog: EC 2.7.11.1 Non-specific serine/threonine protein kinase
MASSTSEMPEAKAKLKRSGSMGSNDTYVRADKIDLTSLDIQLEKQLTKTWGKASLKSQGPKEEWEIDLAKLEIRYVIAQGTYGTVYRGTYDGQDVAVKLLDWGEDGFATEAETATLRTSFKQEVAVWHKLSHPNVTKFVGASMGTTDLKIPANNSNGDARTNLPARACCVVVEYLAGGTLKQYLIKNSRRKLAYKVVVQLALDLARGLSYLHSRKIVHRDVKSENMLLTPQRNLKIADFGVARVEAQNPKDMTGATGTLGYMAPEVLDGKPYNRKCDVYSFGICLWEIYCCDMPYPDLSFADVSSAVVHQNLRPDIPRCCPSAFANVMRKCWDANPDKRPDMDEVVQLLEALDTSKGGGMIPDGQSSGCLCFTKARGP

SEQ ID NO: 15167 - DNA, 1932 bp, Panicum virgatum
  misc_feature: Ceres CLONE 1781112
  misc_feature: Encodes the peptide sequence at SEQ ID NO. 15168
ctagacagctcgatctttagctcattagctataagacactgcacctcgctcgattacggtggccagaggcatgcaaatggaagagcagcagggcagcagcatggtcgccgatccggtgaccgcagtcctagtggcgctgatcgcggccttcaccaccgccgtggccttgcaccacctcatcatctcccggtggagcctgcagcaggccctccggctgccaccgggcccgacgagcctcccggtgatcgggcacctccacctgctccggccgccggtccaccgcaccttccaggagctggcgtcccgcgcgggccccctgatgcacatccgcctgggctccacgcactgcgtggtggcgagcaccgccgacgtcgccggcgagctgatccgcggccacgagggcagcatctccgagcggccgctcacggcggtggcgcggcagttcgcctacggctcggcgggcttcgccttcgccccctacaacgcacactggcgcttcatgaagcgcctctgcatgtcggagctgctgggcccgcgcaccgtcgagcagctgcgccccatccgccgcgccggcgccgtgtcgctgctgcgcgccgcgcgggcggcggcagcgcgcggcgaggcggtggacctcacccgcgagctcatccgcctcgccaacacctccgtcatccggatggtggccagcaccgtgcccgggagcgtcaccgacgaggcgcaggagctggtcaaggccgtggccgaactcgtcggcgccttcaacgtcgacgactacatcgccctctgccgcggctgggacctccagggcctccgcaggcgagccgccgccgtccaccgccgcttcgacgcgctgctggaggagatcctcaggcacaaggaggaggccagggaggcgcggaggctcctcgacggtgacggcgacgaccacatgaaggcgaaggccacgacgcacaaggaggacctgctggacatcctcatggacaaagccgaggacaagacggcggaggtgaagctcacgcgggacaacatcaaggccttcatcatcgacgtggtgacagctgggtcggacacgtcggcggccatggtggagtggatgctggcggagctgatgaaccacccggaggcgctgcgcaaggtggtggcagagatcgacgccgtggtcggtggaagccggatcgccggcgaggcggacctgccgcagcttccgtacctgatggcggcgtacaaggagacgctgcggctgcacccggcggcgcccatcgcgcaccggcagtcgtcggaggcgatggtggtgcgcggcttcaccgtgccgccgcagaccgccgtgttcatcaacatctgggccatcgggcgcgacccggcctcctgggaggagcccctggcgttccggccggagcggttcatgcccggcggcgccgccgaggggctggagccccgcgggcagcagttccagttcatgccgtttggcagcggccgccggggatgccccggcatgggcctggcactgcagtccgtgccggccgtgctggcggcgctcgtgcagtgcttcgactggaccgccggtggcgacggccaccagttgattgacatggatgagtccgacggcctggtgtgcgctcgcaagcaaccgctcctgctccgccccacacctcgcctcaacccattcccggccgtcgtctgatcgatctaacttgactttactccgtcggcatgcatgccgactgcgacgatgtcgtcctctatagtcgtctatacatacacatcactacctaccgccatgcacggcgtgacagtcatttgtcctttgtcgtcgtccttggtcatcccgttggttgatgagcatatgcacgcgtcatcaatcaagttggaagcacactgcgtgtttcttgatgttatgttataactgcaccatcaataaattgtttgaattgg

SEQ ID NO: 15168 - protein, 536 aa, Panicum virgatum
  misc_feature: Ceres CLONE 1781112
  misc_feature (50)..(524): Pfam Name: p450 Pfam Description: Cytochrome P450
  misc_feature: SWISSPROT Homolog: EC 1.14.13.87 Licodione synthase
MQMEEQQGSSMVADPVTAVLVALIAAFTTAVALHHLIISRWSLQQALRLPPGPTSLPVIGHLHLLRPPVHRTFQELASRAGPLMHIRLGSTHCVVASTADVAGELIRGHEGSISERPLTAVARQFAYGSAGFAFAPYNAHWRFMKRLCMSELLGPRTVEQLRPIRRAGAVSLLRAARAAAARGEAVDLTRELIRLANTSVIRMVASTVPGSVTDEAQELVKAVAELVGAFNVDDYIALCRGWDLQGLRRRAAAVHRRFDALLEEILRHKEEAREARRLLDGDGDDHMKAKATTHKEDLLDILMDKAEDKTAEVKLTRDNIKAFIIDVVTAGSDTSAAMVEWMLAELMNHPEALRKVVAEIDAVVGGSRIAGEADLPQLPYLMAAYKETLRLHPAAPIAHRQSSEAMVVRGFTVPPQTAVFINIWAIGRDPASWEEPLAFRPERFMPGGAAEGLEPRGQQFQFMPFGSGRRGCPGMGLALQSVPAVLAALVQCFDWTAGGDGHQLIDMDESDGLVCARKQPLLLRPTPRLNPFPAVV

SEQ ID NO: 15169 - DNA, 1486 bp, Panicum virgatum
  misc_feature: Ceres CLONE 1781115
  misc_feature: Encodes the peptide sequence at SEQ ID NO. 15170
ttacttggttacgactaggcccagaagtacgcatcgacctcgccatacttccattccaatgagggcggacagatgaccgaacgaaaaccgcacaaatgctgtggagagctgctggcgtgccaaatatccatcaaaacggaagggtcacggagatggagagcgctatccccaatccccccaacgcaaggtacgtgccatacctccacgctgcgttcttaatcgcgtggcggttttatttccttttaaactaatttaatctgggatttgaaaataacctaccacagatttttttttagtgattcatggccgctaactaacacggatagcatactgctcgagcgggtttgaaccttgacaggatcgcggtggtcaccggcgggaacaaagggatcgggctggaggtgtgccggcagctcgccggcgccggcgtcaccgtcgtcttgacggtcagggacgagacgaggggcgcagccgccgtggagaagctcagagaagcagggctctccgatgtcattttccatcagctggagatcaccgatgccccgagcatcgctaggttggctgatttcttgaaggcccgttttgggaagctagatatcctgataaataatgctgcaatcggtagggttgagtacctcctagatccttttgatcgttcactgaccagcgaggaaaagttcagtggcatggataagggtcagaggcttgagtggctgaccagtggcgtccgggggacctacgacgctgccagagagggcctgcagacaaactactacggcaccaagcatgtcatcgaagccttactgccgctgctgcaagcttcttccgatgggagaatcgttaatgtctcatccgaatgggggctgctaaggctaatcaccaacgaggagctgaagcaggagctgaacgacgtcgagaagctcaccgaggcgaggctggacgaggtgctcgacgcgttcctgaacgacttcaaggctggggagctgggggcgcgcgggtggccggagcatttctcggcgtacaaggtgtccaaggtgaccatgaacgcctactcgaggatcctggcgaggcggcaccccgagctgcgcgtcaactgcgcgcatcccggctacgtgaacaccgacatgaccatccactccgggcccctgacgcccgaggagggcgcggccaacgtggtgaaggtggcgctgctgccggagggcggggtcaccggcgccttctttgcagacggcgaggaggcgccgttcgtgtgacactcacactacacacgcggcctacacgggcacggccgatcggcagttcggcactggccctgtcgttcgccgttctactccaactgccttgtatcaacgtgcagtgaagattattagctgctggatctttagttcctctgtccatggtgtcgaagtccaaaattgttggcacacgctggtattttaatttgtccacggaagtgtacttgttactttgaattactcattcacgg

SEQ ID NO: 15170 - protein, 188 aa, Panicum virgatum
  misc_feature: Ceres CLONE 1781115
  misc_feature: SWISSPROT Homolog: EC 1.1.1.184 Carbonyl reductase (NADPH)
MDKGQRLEWLTSGVRGTYDAAREGLQTNYYGTKHVIEALLPLLQASSDGRIVNVSSEWGLLRLITNEELKQELNDVEKLTEARLDEVLDAFLNDFKAGELGARGWPEHFSAYKVSKVTMNAYSRILARRHPELRVNCAHPGYVNTDMTIHSGPLTPEEGAANVVKVALLPEGGVTGAFFADGEEAPFV

SEQ ID NO: 15171 - DNA, 724 bp, Panicum virgatum
  misc_feature: Ceres CLONE 1781117
  misc_feature: Encodes the peptide sequence at SEQ ID NO. 15172
accatcatcacgagacggccgcgcgctgcccgcccgcaacggaactggcaggggactggtggtaggctgaccccgcgaggagggagccatggctcagatcttgctccacggcacgctccacgccaccatcttcgaggcggagtcgctctccaacccgcaccgcgcatccggcggcgcccccaagttcatccgcaagcttgtggaggggatcgaggacaccgtgggtgtcggcaaaggcaccacgaagatatatgccaccattgatctagagaaagcccgggtcgggcgtacccggatgatctccaacgagcccgtcaatcctcgatggtacgagtcgttccacatctactgcgcccacctcgccgccgatgtcatcttcaccgtcaagatcgataaccccattggggcgtccctcattgggagggcttacctgcctgtcaaggacctcctggatggtgaggagatcgataagtggcttcaaatctgtgatgacaaccgtgagcctgttggtgacagcaagatccatgtcaagcttcagtactttgatgttgccatggaccgcaactgggcgagaggtgtccggagcaccaagtatcctggtgttccttacacctttttctcacagagacagggatgtaaggttactctataccaggatgctcatgtcccagacaactttattcccaagatccctcttgctgatggcaagaactatgagccacac

SEQ ID NO: 15172 - protein, 211 aa, Panicum virgatum
  misc_feature: Ceres CLONE 1781117
  misc_feature (10)..(114): Pfam Name: C2 Pfam Description: C2 domain
  misc_feature: SWISSPROT Homolog: EC 3.1.4.4 Phospholipase D
MAQILLHGTLHATIFEAESLSNPHRASGGAPKFIRKLVEGIEDTVGVGKGTTKIYATIDLEKARVGRTRMISNEPVNPRWYESFHIYCAHLAADVIFTVKIDNPIGASLIGRAYLPVKDLLDGEEIDKWLQICDDNREPVGDSKIHVKLQYFDVAMDRNWARGVRSTKYPGVPYTFFSQRQGCKVTLYQDAHVPDNFIPKIPLADGKNYEP

SEQ ID NO: 15173 - DNA, 631 bp, Panicum virgatum
  misc_feature: Ceres CLONE 1781117-R
  misc_feature: Encodes the peptide sequence at SEQ ID NO. 15174
gatcgccatgggtggataccagccgtaccacctggcaaccaggcagcctgcccgtggccagatccatggcttccggatggcgctgtggtacgagcacctgggcatgctggacgatgtgttccagcgcccggagagcgtggagtgcgtgcagaaggtgaacaagattgccgagaaatactgggatatgtactcgagcgatgacctggagcaggacctcccgggccacctcctcagctaccccattggcgttgactctgacggcaacgtcaccgagatgccagggatggagttcttccccgacacccgtgcccgcgtctttggcaccaagtcggattacctcccacccatcctcaccacatagaggggcagactgggagtgccgtgccttctctcttgtctggcctcagcttggtgtcttgttctttgtgtttcagacaccaaaggttcagatgatagtgttattatagttattgagtgataataagtgcattgtgcatggttgggacgataggatgaagagttgtttattactaatactgcatacagattgtgttgtgtccctgtccggtgtagtttgtatggcttgctgcgttgcagtgccgtttgtatgatgagactccatcaatttcac

SEQ ID NO: 15174 - protein, 119 aa, Panicum virgatum
  misc_feature: Ceres CLONE 1781117-R
  misc_feature: SWISSPROT Homolog: EC 3.1.4.4 Phospholipase D
IAMGGYQPYHLATRQPARGQIHGFRMALWYEHLGMLDDVFQRPESVECVQKVNKIAEKYWDMYSSDDLEQDLPGHLLSYPIGVDSDGNVTEMPGMEFFPDTRARVFGTKSDYLPPILTT

SEQ ID NO: 15175 - DNA, 677 bp, Panicum virgatum
  misc_feature: Ceres CLONE 1781145
  misc_feature: Encodes the peptide sequence at SEQ ID NO. 15176
aaaaagaaatggtgtcgtcgtctcgacgcagcaccataggagggagggcgccacgatgctgagccccgcgctggcgtgctgcaagctctacatctccgaggcccgcaacgcgccggcgctgcgcgccatcgagcgcgccgcggcggggctccgtccggcggccgtgctcgtcaacgcgttcgccgacgacgcctacaaccgtgtcggctacacgctcgtctccccactagcgggcgccggcggtgactcggccccgccaccgctgcatcgcgcggcgttcggcgtggtcgcggcggcgctcgaggccgtcgacttcggcgtccacgccggcgcgcacccgcggctcggcgtcgtcgaccacatcgccttccatcccctggccggcgcccacctcgacgacgttgccgcgctcaccagggccgtggcggctgacatcggagacaagcttcaagtgccaacatatctgtatggagcagctcacaaagatggcagaacgctggcgtcaatcaggaggcagctcggctacttcatgcccaactctcccggcgagcaatggcgcggcgcgccggactcctcatccctgcccgtcgccccggacgccggccccgcgacgccgtcgaggtcgaagggcgtggtggccatcggcgcgaccgcctgggtcgacaactacaacgtgc

SEQ ID NO: 15176 - protein, 207 aa, Panicum virgatum
  misc_feature: Ceres CLONE 1781145
  misc_feature (5)..(200): Pfam Name: FTCD_N Pfam Description: Formiminotransferase domain, N-terminal subdomain
MLSPALACCKLYISEARNAPALRAIERAAAGLRPAAVLVNAFADDAYNRVGYTLVSPLAGAGGDSAPPPLHRAAFGVVAAALEAVDFGVHAGAHPRLGVVDHIAFHPLAGAHLDDVAALTRAVAADIGDKLQVPTYLYGAAHKDGRTLASIRRQLGYFMPNSPGEQWRGAPDSSSLPVAPDAGPATPSRSKGVVAIGATAWVDNYNV

SEQ ID NO: 15177 - DNA, 2556 bp, Panicum virgatum
  misc_feature: Ceres CLONE 1781154
  misc_feature: Encodes the peptide sequence at SEQ ID NO. 15178
gtcgccaaagcttaacacacccgcgcacgccgccccatcgcccccaccccccgcctcgccgcccttccatctctctctctctctctcgcgccgtctcgccgccctcgccccccgccgcgatccagggagccagcgagcggccggccatggccgcgggggcgatccgggtcaccatggaggtgggcgccgacggcgtcgcgctcatcaccatcgccaacccgcccgtcaacgcgctccaccccatcagtgctggaggcaagttctgcggaggatttgatatcaatgttttcacgaaggttcatcagactggggatgtgtcgcttatgccagatgtatctgttgagcttgtgtcaaacatgatggaagagggcaaaaaaccttctgttgcagctattcaaggccttgctctgggtggtggcctagaattggctatgggttgtcatgctcggatatctacccctgaagctcagcttggattaccagagctgacgctgggcatcatccctggatttggaggaacccagcgtctgccaaggcttgtaggtctgcccaaagcaattgaaatgatgctgcaaagtaggttcattactgcaaaggaagggaaggaacgtggtctgattgatgcgctctgcactcctgatgaattgataaagatgtcacgtctctgggctctggagattgctaattgccaaaagccttggataagatctcttggcagaactgataagcttggatcattgtctgaagctcgtgctgtattaagtgcagcaagacagcaagcgaagaaggttgcaccaaacatgccacagcaccaggcctgccttgatgtaattgaagaaggcgtatcatatggaggccatgccggtgttttgaaggaagccaaggtgttcaaggagttggttgtagcaccaacatcaagggctcttgtccatgttttctttgctcaacgttccaccacaaaggtgccaggtgtaacagatggtcaactgaaacccaggcaaattagaaaagtcgctgttattggtggtggtctgatgggctctggaatagcaacagcacttcttgttagcaacatttctgttgtactcaaggaagtaaaccctcagtttctgcgaaggggagagaaaatgatagcaggtaatcttgagggcctggtgaaaagaggctcattaacaaaggataagatgaacaaggccatgtcacttctcaagggtgcattggattattcagatttcaaggatgttgatatggttattgaggctgttattgagaagattcctttgaagcaatcgatatttgctgatattgagagaatctgccctaaacattgcatacttgcaacaaacacgtctaccatcgatttgaatgtcgttggtgagaagacaaattctcaagatagaattataggggctcattttttcagccctgctcatattatgcccttgcttgaaattgtccgaacagagaagacatcaccacaagctatccttgatctcatcactgttgggaagatcataaagaaagtccctgttgtggttggcaactgcacaggatttgcagttaaccgtacattttttccttacacactgggttctcaagttcttgttagtcttggcattgatgtttttagaattgatcgagtaataagcaacttcggcatgccaatgggaccttttcaactccaagatgtagctgggtatggagtagccttggcagtaaaggacatctatgctgcggcctttggagaacgatatttggactctgaccttgtggacttgatggtaaaggatgggcggcagggaaagatgaatggcaaagggtactacatttatgagaagggtgggaagccaaagcctgatcctagtgttcagcgtgtgattgaagagtacagaaaaggtgcaaagacaatgcccggtagaaagcctgttactttaacggatcaagatattttggagatgattttcttcccagttgtgaatgaggcgtgcagggttatggatgaaaatgttgtaattcgggcttctgatcttgatattgcttctgttctcgggatgggctttcccaagtacaggggtggtcttgtcttctgggctgacactgttggggcaccttacatatattcaaagctaagcaagtgggctgaactttacggtccctacttcaaaccgtcatcgtacttggaacaaagagctaagagtggtgtaccactgagcgcaccaagcgcatcaccgcaaggttcggcgaggtcgcgcatgtgaggtgctgctcagctgttggtagaagaattaatgagcaccgtctgccctgttcatcagtccacctctgctaacacgagaggcggccagaaaaggatggcagaataaatggttttgcatagccgtttatatggtacaaattttgctgccttggactggaactatggcagggtttctttggacacagtagcaaatccagtgtggcaagcattcttgtatctgcccaatgtatgtattacatattgtatgtcacgatcattcgtaccaagctcaataataaagaaggaaatgtgcagccagc

SEQ ID NO: 15178 - protein, 703 aa, Panicum virgatum
  misc_feature: Ceres CLONE 1781154
  misc_feature (288)..(467): Pfam Name: 3HCDH_N Pfam Description: 3-hydroxyacyl-CoA dehydrogenase, NAD binding domain
  misc_feature (18)..(163): Pfam Name: ECH Pfam Description: Enoyl-CoA hydratase/isomerase family
  misc_feature (469)..(562): Pfam Name: 3HCDH Pfam Description: 3-hydroxyacyl-CoA dehydrogenase, C-terminal domain
  misc_feature (286)..(553): SWISSPROT Homolog: EC 1.1.1.157 3-hydroxybutyryl-CoA dehydrogenase
  misc_feature (68)..(180): SWISSPROT Homolog: EC 4.2.1.55 3-hydroxybutyryl-CoA dehydratase
MAAGAIRVTMEVGADGVALITIANPPVNALHPISAGGKFCGGFDINVFTKVHQTGDVSLMPDVSVELVSNMMEEGKKPSVAAIQGLALGGGLELAMGCHARISTPEAQLGLPELTLGIIPGFGGTQRLPRLVGLPKAIEMMLQSRFITAKEGKERGLIDALCTPDELIKMSRLWALEIANCQKPWIRSLGRTDKLGSLSEARAVLSAARQQAKKVAPNMPQHQACLDVIEEGVSYGGHAGVLKEAKVFKELVVAPTSRALVHVFFAQRSTTKVPGVTDGQLKPRQIRKVAVIGGGLMGSGIATALLVSNISVVLKEVNPQFLRRGEKMIAGNLEGLVKRGSLTKDKMNKAMSLLKGALDYSDFKDVDMVIEAVIEKIPLKQSIFADIERICPKHCILATNTSTIDLNVVGEKTNSQDRIIGAHFFSPAHIMPLLEIVRTEKTSPQAILDLITVGKIIKKVPVVVGNCTGFAVNRTFFPYTLGSQVLVSLGIDVFRIDRVISNFGMPMGPFQLQDVAGYGVALAVKDIYAAAFGERYLDSDLVDLMVKDGRQGKMNGKGYYIYEKGGKPKPDPSVQRVIEEYRKGAKTMPGRKPVTLTDQDILEMIFFPVVNEACRVMDENVVIRASDLDIASVLGMGFPKYRGGLVFWADTVGAPYIYSKLSKWAELYGPYFKPSSYLEQRAKSGVPLSAPSASPQGSARSRM

SEQ ID NO: 15179 - DNA, 1980 bp, Panicum virgatum
  misc_feature: Ceres CLONE 1781155
  misc_feature: Encodes the peptide sequence at SEQ ID NO. 15180
acctggcactggcagtctggcacctgtgcatcatcgaaaccatcatcattccctttccctgcttcgaatcctccgcccgtcgccaaaacccacgctccccccaccctcgccgtcgccgcctccgcctgctcacctcgcctcctcttaaacgtctcggccccaccgcctctcgcgctagctcccgcacccaggcccaacgcgatccggccggccgccgggctccgcttctgcggcctccggcgcgaggccctcgggctccgctcggcccgctcctcgccgcgggtggtggccgccaggcggagcgtggcggctgcggcgacggcggggaatggcgcggccgggagcggcggcttcgactacgacctcgtgatcatcggagccggcgtaggcggccacggcgccgccctcctcgccgtcgagaaggtctcctcaccaggatatgacagacagggtgttgctgaccatgcaaataatcttgcctctaaaatacgcagcaacttgactaattcaatgaaagctctgggtgtggatatactgactggtattggtacaattgtggggaagcaaaaagtgagatatgaaaaagctggttttccagacaatgaaatcactgctagaaacatcataattgccaccggatctgttccttttgtccccaagggcattgaaatagatggtaaaactgtattcactagtgatcatgcactaaaacttgagtcagtccccgactggatagctattgttggaagtggttacattggacttgaattcagtgatgtatacacggctctgggaagtgaggttacttttgttgaagctcttgatcaattaatgcctgggtttgatcctgagattgggaaattggcgcagaggattcttattaatcctcgtaaaattgattatcacactggtgtttttgcgagcaagattaccccagcaaaggatggtaaacctgttctaattgagttgattgatgctaagacaaaagaacacaaggagacacttgaggtggatgccacacttatagctactggaagggcacccttcaccaaaggacttggcttggaaaatatcaatgttattacacaacgtggttttgttcctgttgatgaacggatgcaagttatggatgcagatggcaatgtggttcctaatttgtattgcattggagatgccaatggtaagcttatgcttgctcatgcagccagtgcacaaggaatctcagttgtggagcaaatcagtgggagagacaacatcctaaatcacctaagcatcccagctgcctgtttcactcatcctgagatcagcatggttgggttgacagagccacaagctagggagcaggctgacaaggaaggatttgaagtaagtgttgtaaagaccagtttttaggctaacacaaaggctctggcggagaatgaaggagatgaacttgctaaaatgatttatcgtcctgacaccggagaaattcttggagttcacattttgaggttgcatgctgcagacctcatccacgaggcatcaaatgccattgcccttggaactcgtgtgcaagacatcaagtttgccgttcatgcacacccaaccttgtcggaggttctggatgagctcttcaaggctgccaagtttaatgctggtgtttcgcattctgtaaatgagccagttgcggcgtagagagaaacaagagtgggaaagaaaccatctgcaacagcccaactccagttatacgtccttagtaactccagttatatatccttagtgctagatgtatcttgtactcgtataaaactgatttttgtagccattcgcggggcattttcattagggactagtacggacacttcctatttattgagggaaagggagatccatttgtcctccctatgtattttttttaaagaagtcatccctatgtatgagagaactccaaattttgcagccctttgtaaagagtaaatgtgtgatgcctttactttgtcg

SEQ ID NO: 15180 - protein, 463 aa, Panicum virgatum
  misc_feature: Ceres CLONE 1781155
  misc_feature (244)..(345): Pfam Name: Pyr_redox Pfam Description: Pyridine nucleotide-disulphide oxidoreductase
  misc_feature (121)..(396): Pfam Name: Pyr_redox_2 Pfam Description: Pyridine nucleotide-disulphide oxidoreductase
  misc_feature: SWISSPROT Homolog: EC 1.8.1.4 Dihydrolipoyl dehydrogenase
TWHWQSGTCASSKPSSFPFPASNPPPVAKTHAPPTLAVAASACSPRLLLNVSAPPPLALAPAPRPNAIRPAAGLRFCGLRREALGLRSARSSPRVVAARRSVAAAATAGNGAAGSGGFDYDLVIIGAGVGGHGAALLAVEKVSSPGYDRQGVADHANNLASKIRSNLTNSMKALGVDILTGIGTIVGKQKVRYEKAGFPDNEITARNIIIATGSVPFVPKGIEIDGKTVFTSDHALKLESVPDWIAIVGSGYIGLEFSDVYTALGSEVTFVEALDQLMPGFDPEIGKLAQRILINPRKIDYHTGVFASKITPAKDGKPVLIELIDAKTKEHKETLEVDATLIATGRAPFTKGLGLENINVITQRGFVPVDERMQVMDADGNVVPNLYCIGDANGKLMLAHAASAQGISVVEQISGRDNILNHLSIPAACFTHPEISMVGLTEPQAREQADKEGFEVSVVKTSF

SEQ ID NO: 15181 - DNA, 1647 bp, Panicum virgatum
  misc_feature: Ceres CLONE 1781161
  misc_feature: Encodes the peptide sequence at SEQ ID NO. 15182
acttgtgtgctcatgctgtgctacagagctacctcaaagcttcgtgcgtctgctcctttttcagcggaggcttgggggtagtagaggtagaagacggcttcgctgttcgtgcaggagcgaagctgtatccaggtagagctagacgtcagctcactagctcagtcgtcagtattcatcagcagacagcagtacaagctaggaagagaaagggacatttctctgtttgcaggacacgtacaccggggccgaatcgtgacgacatggacggcaatgcgaggccagcagcgaatcagaagaagcccatcgtcccggacgacgacctcgtggagctgctgtggcacaacgggagcgtcgtcgcgcatccccaggcgcaccagcggccggagccctccgaccgcccgggcagtagcggcctcaccggcgaggagaccgccgcgtggttcccggacaccctcgacgacgcgtttgagaaggacctgtacacgcagctctggtacagtagcattgtcgacgccgccccgcaccacggggacacgctcccgggccctagctcgccgccgccgccgccgccgccggagctggcgcacccggtgacgccgccggtggggagcggcggcgtcgaatcgagctgggccggcgacatctgttcgaccttctgcggcagcaaccaggtgcccaggatgccggcaggggtcaacaggggggaggacgcgtcattgcagtcggaggtgccgcacggtgccggcgccggcacatcgtcgtccggcgggtccggaagcaactatgggggatccgggctgccgagtgacagcggccacgtccagaaagggaaggggatgtgtagagacgactcggatagtcggagtgaggatgccgagtgtgaggaaactgaggagaccaaatcatcgaggcgatgcggaacgaagcgcaggactcgcacagctgaagttcataatctctctgagaggagaagaagagaccggatcaatgaaaagatgcgcgccttgcaagagctgataccgcactgcaacaagactgacaaagcgtcgatattagatgagacaattgagtatctgaagtccctccagatgcaagttcagatcatgtggatgacttctgggatggcaccgatgatgtttcctggtgctcaccaattcatgtcaccaatggctctaggcatgaattcagcttgcatcactgcagcacaaggcctaagtcagatgccaagactaccatacatgaaccttcccctgccaaatcacatccctttgaactcatctccagctatgaatccaattaattcaccaagtatcgcgaacgagatccaaaatgtatcttatggaggcaagtaatcacttccttcacccaggtggcgcgcaaacatcggtacctcaggtaccaggaacccatgtttatggacctgaaatactacaagctgaacagcacaataggatactggaagtaccagctagtactgtcgtgccaacctctagggcaggacaaccgcgtacttatggcggagcttagaaaccaatcttgtaaggtgttgcactgataaaacggataatgcacagataactgaagctgtatatcactacatactatataaaaagaagtgccagcagtgtatgcagctatttttttgac

SEQ ID NO: 15182 - protein, 363 aa, Panicum virgatum
  misc_feature: Ceres CLONE 1781161
  misc_feature (227)..(276): Pfam Name: HLH Pfam Description: Helix-loop-helix DNA-binding domain
  misc_feature: The sequence is a functional homolog of SEQ ID NO 1139 in the 10/374,780 US patent application
  misc_feature: The sequence is a functional homolog of SEQ ID NO 1337 in the 10/412,699 US patent application
  misc_feature: The sequence is a functional homolog of SEQ ID NO 1141 in the 10/374,780 US patent application
  misc_feature: The sequence is a functional homolog of SEQ ID NO 1339 in the 10/412,699 US patent application
MDGNARPAANQKKPIVPDDDLVELLWHNGSVVAHPQAHQRPEPSDRPGSSGLTGEETAAWFPDTLDDAFEKDLYTQLWYSSIVDAAPHHGDTLPGPSSPPPPPPPELAHPVTPPVGSGGVESSWAGDICSTFCGSNQVPRMPAGVNRGEDASLQSEVPHGAGAGTSSSGGSGSNYGGSGLPSDSGHVQKGKGMCRDDSDSRSEDAECEETEETKSSRRCGTKRRTRTAEVHNLSERRRRDRINEKMRALQELIPHCNKTDKASILDETIEYLKSLQMQVQIMWMTSGMAPMMFPGAHQFMSPMALGMNSACITAAQGLSQMPRLPYMNLPLPNHIPLNSSPAMNPINSPSIANEIQNVSYGGK

SEQ ID NO: 15183 - DNA, 652 bp, Panicum virgatum
  misc_feature: Ceres CLONE 1781166
  misc_feature: Encodes the peptide sequence at SEQ ID NO. 15184
attcttcccctcccccgtccatcaagtaattctcgggagcgatcgaaatctaagcgaagcgaagacgcctcccctcatcctctcatgatgatgatttttgtgaccaccctcgccggcacgatcatcttgttggaggtggggtcttctgacatcgttgacgatgtggaggccatgatccaggacgaggagggcctcccccaggaccagcatctgctgatctttggtgggcagcttgtggatgatggcccccccctggacgactacatcatcaagaaggactccctcctcctgttggtgctccggctgggtggtgtgatgatcatttttgtgaccaccctcgctggcaccatcatcttggtggaggaggagtcctctgacatcattgacgatgtggaggccatcatccaggacgaggacggcctcccccaggaccagcatctgatgatcttcggtggcaagcaggtggaggatggccccctcctggactactacaacatcaaggaagactccactctcctcctgctgctccggctgcgtggtggtatgatcatctttgtcacgactcttgctggcacgatcatctcgttggaggtgtagtctgctgacatcgtcgacgatgtgaagaagatcatccaggacgaggacggcatcc

SEQ ID NO: 15184 - protein, 170 aa, Panicum virgatum
  misc_feature: Ceres CLONE 1781166
  misc_feature (7)..(75): Pfam Name: ubiquitin Pfam Description: Ubiquitin family
  misc_feature (83)..(151): Pfam Name: ubiquitin Pfam Description: Ubiquitin family
  misc_feature: Useful for making plants with modulated cold sensitivity
MMMIFVTTLAGTIILLEVGSSDIVDDVEAMIQDEEGLPQDQHLLIFGGQLVDDGPPLDDYIIKKDSLLLLVLRLGGVMIIFVTTLAGTIILVEEESSDIIDDVEAIIQDEDGLPQDQHLMIFGGKQVEDGPLLDYYNIKEDSTLLLLLRLRGGMIIFVTTLAGTIISLEV

SEQ ID NO: 15185 - DNA, 731 bp, Panicum virgatum
  misc_feature: Ceres CLONE 1781176
  misc_feature: Encodes the peptide sequence at SEQ ID NO. 15186
aaagcttcaaatccctccccctccgcttttccctctccctcttcctcctcctccacccccttttccaaccccagcgagaaccttccaaaagcctcccgggaggttccctcgccatcgccagtccgacccgaccgggaagcgctcgcgcgcggccctcccccgagccgagctcgccggagccatggagaagtacgagctgctcaaggacatcggcgccggcaacttcggcgtggcgcggctgatgcggaacaaggagaccaaggagctcgtcgccatgaagtacatcccccgcggccaaaagattgacgagaatgtggcgagggagatcatcaaccaccgctcgctgcggcaccccaacatcatccggttcaaggaggtggtgctcacgccgacgcatctggcgatcgtgatggagtacgccgccggcggcgagctgttcgaccggatctgcaacgccggcaggttcagcgaagacgaggcgaggtacttcttccagcagctgatttgcggcgtgagctactgccacttcatgcaaatttgccatcgcgacctgaagctggagaacacgctgctggacggcagcccggcgccccgcctcaagatctgcgacttcggttactccaagtcgtcgctgctgcactcgaagcccaagtcgacggtgggcacgccggcgtacatcgccccggaggtgctctcccgccgggaatacgacggcaagacagccgacgtgg

SEQ ID NO: 15186 - protein, 183 aa, Panicum virgatum
  misc_feature: Ceres CLONE 1781176
  misc_feature (4)..(183): Pfam Name: Pkinase Pfam Description: Protein kinase domain
  misc_feature: SWISSPROT Homolog: EC 2.7.11.1 Non-specific serine/threonine protein kinase
  misc_feature: Useful for biocontainment applications
  misc_feature: Useful for making plants with modulated biomass
  misc_feature: Useful for making plants with modulated time to senescence
  misc_feature: Useful for making plants with modulated water use efficiency
MEKYELLKDIGAGNFGVARLMRNKETKELVAMKYIPRGQKIDENVAREIINHRSLRHPNIIRFKEVVLTPTHLAIVMEYAAGGELFDRICNAGRFSEDEARYFFQQLICGVSYCHFMQICHRDLKLENTLLDGSPAPRLKICDFGYSKSSLLHSKPKSTVGTPAYIAPEVLSRREYDGKTADV

SEQ ID NO: 15187 - DNA, 665 bp, Panicum virgatum
  misc_feature: Ceres CLONE 1781176-R
  misc_feature: Encodes the peptide sequence at SEQ ID NO. 15188
atcatgtcaatccaatataaaattccggagtatgtccatgtatcccaagactgcaaggaactgctctcgagaatcttcatcgcaaactccgcgaagagaataacgattagggagatcaggaaccacccctggttcctaaagaacctgcctagggagctcacagaagctgctcaggcaatgtactacaagaaggacaatagtgctccaacctattctgtgcagtccgaggaggagatcatgaagatcgtcgagaaggcacgtacaccgcctccttcctccacccctgtggctggctttggttgggcagaggaggacgagcaggaggacagcaagaaaccagagaaggccgaggaggaagaggatggcgaggatgagtatgacaagcaagtgaaacaagtccatgccagcggcgagtttcagatcagctgagggtttcgcaacgagagagatcgcaaacagatgtactgtggtagcaactgatgatgaacctcataccctacattcctgatagtttgtggtcttgatttcaagttttctttcattttttcctatttgatgctgcaacagtgtaaattattgaagtggttccaacactgtatttgtaaggactgattaagctagcaagtccaacaaaattatgaaataaaacatctcgttgagcatgc

SEQ ID NO: 15188 - protein, 142 aa, Panicum virgatum
  misc_feature: Ceres CLONE 1781176-R
  misc_feature: SWISSPROT Homolog: EC 2.7.11.1 Non-specific serine/threonine protein kinase
  misc_feature: Useful for biocontainment applications
  misc_feature: Useful for making plants with modulated biomass
  misc_feature: Useful for making plants with modulated time to senescence
IMSIQYKIPEYVHVSQDCKELLSRIFIANSAKRITIREIRNHPWFLKNLPRELTEAAQAMYYKKDNSAPTYSVQSEEEIMKIVEKARTPPPSSTPVAGFGWAEEDEQEDSKKPEKAEEEEDGEDEYDKQVKQVHASGEFQIS

SEQ ID NO: 15189 - DNA, 713 bp, Panicum virgatum
  misc_feature: Ceres CLONE 1781179
  misc_feature: Encodes the peptide sequence at SEQ ID NO. 15190
gaacttgtgctaccagctagcagcagcagtcagtagcggtagtgttcttgctgcggacgcggccggccggctcgacgtccacgatgaggctccgcgactccgccgcgatggtggctctggtgctcgcgctcacctgctccgttgcagtgggctacgatcccctggaccccaacggcaacatcaccatcaagtgggatgtcatctcctggacgcccgacgggtacgtggccatggtgacgatgagcaactaccagatgtaccgccacatcatggcgcccgggtggacagtggggtggtcgtgggccaagaaggaggtgatctggtccatggtcggcgcgcaggccacggagcagggcgactgctccaagttcaaggccggcatcccgcactgctgcaagcgcacccccgaccgccgccgccggacgcaggcgctcatgacctgggcgctcacctgcacctactcgcagcagctcgcctccaagtacccctcctgctgcgtctccttctcctccttctacaacagcaccatcgtgccctgcgcccgctgcgcctgcggctgcggccacggcggccacggcgccgccggctgcatcgccggcgactccaagcgggcgctctcccccggcgtcaacacgccgcgcaaggacggccagccgctgctccagtgcacgccgcacatgtgcccggtgcgcgtccactggcacgtcaagctc

SEQ ID NO: 15190 - protein, 209 aa, Panicum virgatum
  misc_feature: Ceres CLONE 1781179
  misc_feature (47)..(128): Pfam Name: Phytochel_synth Pfam Description: Phytochelatin synthetase-like conserved region
MRLRDSAAMVALVLALTCSVAVGYDPLDPNGNITIKWDVISWTPDGYVAMVTMSNYQMYRHIMAPGWTVGWSWAKKEVIWSMVGAQATEQGDCSKFKAGIPHCCKRTPDRRRRTQALMTWALTCTYSQQLASKYPSCCVSFSSFYNSTIVPCARCACGCGHGGHGAAGCIAGDSKRALSPGVNTPRKDGQPLLQCTPHMCPVRVHWHVK

SEQ ID NO: 15191 - DNA, 647 bp, Panicum virgatum
  misc_feature: Ceres CLONE 1781179-R
  misc_feature: Encodes the peptide sequence at SEQ ID NO. 15192
ctggacaacgtcaccgaggtcttcagcttccagtacaagccgctgctcccctacggcgccatcaacgacaccggcatgttctacgggctcaagttctacaacgacctgctcatggaggccgggcccttcggcaacgtgcagtccgaggtgctcatgcgcaaggacgcaagaaccttcaccttcagccagggctgggcgttcccgcggaagatctacttcaacggcgacgagtgcaagatgccgccgccggactcgtacccctacctgcccaactccgccccgctcgcggctccggtcatcgccaccgcggcctcggcgttcctgctggtggcgctgctcctggtggcgtgatcggtcatgggaattgggatgggctgccagggagcagagtaggcatggcgctctggagactgaaacgcttggcaatgtcatgtgtgttgttgcctgtgcagctgcacatagagagactagcagaccaatcaggctggcagagatcctggcacttttgagtctccaattactttttagacagcctgatcgagaacaaatgatagtatacatagtagagcacaaccttttttctgtggtttcgtcatgtacacataatgcagattattaattgttcgaatatatgaatcgaattgctg

SEQ ID NO: 15192 - protein, 116 aa, Panicum virgatum
  misc_feature: Ceres CLONE 1781179-R
  misc_feature: Useful for making plants with altered carbohydrate content
  misc_feature: Useful for making plants with altered cell wall content and/or composition
  misc_feature: Useful for making plants with altered lignin content
  misc_feature: The sequence is a functional homolog of SEQ ID NO 4 in US patent 7109001
LDNVTEVFSFQYKPLLPYGAINDTGMFYGLKFYNDLLMEAGPFGNVQSEVLMRKDARTFTFSQGWAFPRKIYFNGDECKMPPPDSYPYLPNSAPLAAPVIATAASAFLLVALLLVA

SEQ ID NO: 15193 - DNA, 1947 bp, Panicum virgatum
  misc_feature: Ceres CLONE 1781194
  misc_feature: Encodes the peptide sequence at SEQ ID NO. 15194
cgtatcctccctcccgtcgagacggctccggagagtgcgaccgtttcaacacgaatccgccgcgatccttcaccaataagagttggcttcatcctcctctgctctgacgacaccaaaagagaagagttcctctctccaagataacacctggtcttctgtacgcgtattgcgtacaccaactgggtgatcatctgacataaaagttggggcttcgtttcataggatccgcgcgagtggtatggtcggttgattccgtctgagccaggctgcagcttgcagttctttttggaggggaagcctgcaggattctcgatcggagaacatgttttctttcaggtccaggccatcttccaatggaaacaaagtcccagactcgggcttcttggacgaatcagacatgcaaaaacaactgaacagactgcaggaggagctgaggaaggagagagaggagaaggcgcgtgccctagatgagatcgaagagctcaggaagacgaacacgaataggaacaaaaagttgaaaagcaatggggccgaagggcaggtggaccttgcagacagattacagcagttggaaggtgaactggaggctgcaagagattcagagaagaagatgctgctgtctttggaggcccaaacaaagcagcttgagcagactaaggtatctctggaggaggccaagcttgagatagcttcactaagagacagcagcaaaagtttagaagcctttaatcccggtaagctgccagtgaagaatttgaggagaaggggcgtgatgtccttctcctttgctgatccgggtgaagtggagacatggtcactacaacgagagctcaaactcgctgtggaatccgaggagaagtgcaagaaggccatggatgacctggccatagccttgaaagagcaaagcacagaggccagagaggcaaaagggaagcttctattggcacaatctgagttgaataatgcaaggactgaagtggagagcttgaaagcctcgttagaaaatgcaacggacaagctccagatggcagtggaagaggcagggcgactaaaggtcgagtcagatgaattggcagcagcatcaaaagagaaagagaggggactcgttgattgcatcaagatgtttgaggaggagctaagtaaaggaaagcaagagaatgaaaagttgattgaatcacagagggtgatcagagatgaaaattctaggcttagggaaatgctgaagcatgcagtgggtgaagctaatgtagcaagggaatcactggagattgccagggtggagaactctcgccttaatgaacagatcttcgagaaagagagtgccttacagaatatcaagcaagaatatgaatcccttaaggtcagtgaggcagcagcacagagtagtattagagagttgaaggatatgattgatgctatgttcagttcagaatcgaccaaaacctcagcagaagcatctcctcgggatgccaagcgaggtgagatgaaagtaagttcagtggcagcagatgatgtgtattttgatggccaaagatctactcgcctggaggacatcaagaatcctggaaaacagaaaaagaagacaattctcagaaagtttagtgaaataatgaagaaaagcaactctcaaaatgcaatctagtatttatgaaagcagtataggttccattttctttattcaaagcccttgagcacatgacatatggaatgccaaagatttcactccaagagatgaaaagctatttgcggtgaccttttgttttactttgtgtcacggatttaatgtacagagaatagaacatgaaaagtggaatagcttgcaatatgttctttgtatcttgatgttcctaagtagcccacacattaacttgggtgtggtgtaagggttctctacctttctctttctttttatataaagatacacagttctcctgcatcttcaagggg

SEQ ID NO: 15194 - protein, 439 aa, Panicum virgatum
  misc_feature: Ceres CLONE 1781194
  misc_feature: SWISSPROT Homolog: EC 2.7.11.1 Non-specific serine/threonine protein kinase
MFSFRSRPSSNGNKVPDSGFLDESDMQKQLNRLQEELRKEREEKARALDEIEELRKTNTNRNKKLKSNGAEGQVDLADRLQQLEGELEAARDSEKKMLLSLEAQTKQLEQTKVSLEEAKLEIASLRDSSKSLEAFNPGKLPVKNLRRRGVMSFSFADPGEVETWSLQRELKLAVESEEKCKKAMDDLAIALKEQSTEAREAKGKLLLAQSELNNARTEVESLKASLENATDKLQMAVEEAGRLKVESDELAAASKEKERGLVDCIKMFEEELSKGKQENEKLIESQRVIRDENSRLREMLKHAVGEANVARESLEIARVENSRLNEQIFEKESALQNIKQEYESLKVSEAAAQSSIRELKDMIDAMFSSESTKTSAEASPRDAKRGEMKVSSVAADDVYFDGQRSTRLEDIKNPGKQKKKTILRKFSEIMKKSNSQNAI

SEQ ID NO: 15195 - DNA, 737 bp, Panicum virgatum
  misc_feature: Ceres CLONE 1781195
  misc_feature: Encodes the peptide sequence at SEQ ID NO. 15196
ttctgaatgcctgtcgtgctccccatgctctgctcctcccctgctgctgccaaagcctttactttccttgggcccctgcacggagtccctgacgagccagcgatattttccaattcgcaatcaccagactgcaagagctacctgggcaactccctgttcgtgttcggcgagtttggcggcaacgactacaacgcgatgctgttcggcaactacaacacggaccaggcgagcacgtacacgccgcagatcgtgaacaccatcgccgccggcgtggagaagctggtggcgatgggggccaaggacgtggtggtgcccggggtgctccccatcggctgcttccccatctacctcaccctctacggcacctccagcagcggcgactacgacggcctcggctacctcaagaagttcaacgacctctccaccaaccacaacagccagctcaaggcccagctcgccagcctccaggccaagtacccctccgcccgcatcatgtacgccgacttctactccggcgtctacgacatggtccggagccccggcagctacggtgagcgagctcccctacccgtttaatttctttctcctcttcctcttcctcctcgccgccgccatggcagccgtacccgttgaactctcatggtgagctcgacgtcggcgcggtcggcggactggccgcgctgccgacgcgcatgtgtgtggtcggatgggggacacaacgccaggagtccaggacg

SEQ ID NO: 15196 - protein, 189 aa, Panicum virgatum
  misc_feature: Ceres CLONE 1781195
  misc_feature: SWISSPROT Homolog: EC 3.2.1.51 Alpha-L-fucosidase
MPVVLPMLCSSPAAAKAFTFLGPLHGVPDEPAIFSNSQSPDCKSYLGNSLFVFGEFGGNDYNAMLFGNYNTDQASTYTPQIVNTIAAGVEKLVAMGAKDVVVPGVLPIGCFPIYLTLYGTSSSGDYDGLGYLKKFNDLSTNHNSQLKAQLASLQAKYPSARIMYADFYSGVYDMVRSPGSYGERAPLPV

SEQ ID NO: 15197 - DNA, 669 bp, Panicum virgatum
  misc_feature: Ceres CLONE 1781195-R
gcgccgcgggcggaaacgtgggcgtgccgtgcgccgcggcggcgagtagaaaaacaataggggctcacgctcgtaacacggcgcatttgtttaggcgccgggatctcgcaccggcccccccaatcatgggacggtgatggcgggcgcgccggcccggtgtcgcagctcccccaaccgacacatgcgatctccaagctctggtctgagtctgagtgtctgactcttttttttttttcctcgccggggtttctggtggctgtgcgtgcagggttcagcacggcgttccagacgtgctgcggcgccggcggcggcaagttcaactaccagaacagcgcgcggtgcgggatgtcgggcgcggcggcgtgctccaacccggcggcgcacctcagctgggacggcatccacctcaccgaggccgcctacaagcagatcaccgacggctggctcagcggcgcctactgcaacccggccatcctccacagctgaagcacgagagccgagagggagggaagggggcgatcaagatcgccccgttaaaatatttttattttttattgtcactattaattatctgcgtctgcgttgccggagaaaaaaaggcgtctcgatcggcaacggcggcagcatgtggaataacaatctttatacaacatgttcgtcgttcctctc

SEQ ID NO: 15198 - DNA, 645 bp, Panicum virgatum
  misc_feature: Ceres CLONE 1781209-R
  misc_feature: Encodes the peptide sequence at SEQ ID NO. 15199
agttcccttcatggacaccgccaccacagtatactactgggcatggcaattttggagcagagaacagccatgaggtcgccgcgaccatgcctactcctggctttgagaatggcagttggaacaccaatgattatcatgtcctaaatgatgcctgcaaggtcgagctcgcatatgatccagctccagtcagctcatctgaagcttgcttgtcatcatttgttccattgtcggaaatctgccccaacatgagcaatagtagcagtatggaggagaaccaccagactaatcctggccttggcacacctacgcaagctttccccaaaagaaccggctttgatgttgtgccctgccctgataggggctcggtcatctcgcgctataaggagaagaggaagacaagaagattcgacaggcaggttcggtatgaatcacgcaaagttcgtgctgatggcaggctcaggatcaaggggcgttttgcaaaggcaaaccagacttaaaatttaaggagcaaactgattagcagtgaagataatacaaaatctgccatagttttgtttgccttcagttccatagctgatagctcatagcctcatacacagtttgaatgttgtatgtatattgccgtcatgtggatacacttattcg

SEQ ID NO: 15199 - protein, 164 aa, Panicum virgatum
  misc_feature: Ceres CLONE 1781209-R
  misc_feature (119)..(163): Pfam Name: CCT Pfam Description: CCT motif
FPSWTPPPQYTTGHGNFGAENSHEVAATMPTPGFENGSWNTNDYHVLNDACKVELAYDPAPVSSSEACLSSFVPLSEICPNMSNSSSMEENHQTNPGLGTPTQAFPKRTGFDVVPCPDRGSVISRYKEKRKTRRFDRQVRYESRKVRADGRLRIKGRFAKANQT

SEQ ID NO: 15200 - DNA, 286 bp, Panicum virgatum
  misc_feature: Ceres CLONE 1781209
ccttcccatcggttcggctgacggaaagaggaatggaatgcgcccggtcccgtcacattcacctcgtcgggagtggtggttagaatgagctggaccgttgcacttgctttggccctaatacgatgtcatgtcggttacgtcccttcctttatcgcagcgtgcgccaggattccccggcgaggtgtaagtcgggggctgcctttaggttcccgattttgtgcttaatggcccctccaccccgaaaaactatattagggtgatgaatcacggggggttccatctccct

SEQ ID NO: 15201 - DNA, 637 bp, Panicum virgatum
  misc_feature: Ceres CLONE 1781219
  misc_feature: Encodes the peptide sequence at SEQ ID NO. 15202
ccctacccgagtgccgcagagaaagggctcttcgcactcgcctctcgccgcgcgttcggagcttctcctcccgtttcccgccgccgccgccggccacccttccgacgacagccgtgagggagtgcatctcagtccacgatcggccagggcggtgtccaggtcggaaacgcgtgatgggagctgcaccggctcgggcatggcattcagcctgatggtcagatgcgcagagacaagacagttggaggaggagatgatgcattccaccccttcttcagtgagactggaggtggggagcatggtccgcgtgctgtgtttgttgatcgtgatccccctgtcattgatgacgtgaggactggaacttaccgcctgcttttccagcctgagcatctcgtcaatgacaaggaggatgctgccaactgctttgcctgtggtcactacaccattgtgaaggagattgtcgacctatgccttgacagcatcaggaagcttgccgagtactgcactagtctccctcgcgtcctcgcgatctatactgtgggtggaagaacaggctctggcgttgcttccctcctccttgagcgcctgtctgtagactatggcaagaagtccaagctcgggattcctgtgtatccgtctc

SEQ ID NO: 15202 - protein, 139 aa, Panicum virgatum
  misc_feature: Ceres CLONE 1781219
  misc_feature (14)..(139): Pfam Name: Tubulin Pfam Description: Tubulin/FtsZ family, GTPase domain
  misc_feature: Useful for making plants with altered cell wall content and/or composition
MRRDKTVGGGDDAFHPFFSETGGGEHGPRAVFVDRDPPVIDDVRTGTYRLLFQPEHLVNDKEDAANCFACGHYTIVKEIVDLCLDSIRKLAEYCTSLPRVLAIYTVGGRTGSGVASLLLERLSVDYGKKSKLGIPVYPS

SEQ ID NO: 15203 - DNA, 728 bp, Panicum virgatum
  misc_feature: Ceres CLONE 1781223
  misc_feature: Encodes the peptide sequence at SEQ ID NO. 15204
agccgccgccgctcccagcccgtgctccgctcctcctcgccgccgccgccgcacctccgcagcgaaagcgcttcggaacacttccgtcaacatggggaagacacgtggtatgggagctgggcgcaagctcaagacccaccgcaggaaccagaggtgggctgacaaagcatacaagaagagccatttgggcaatgagtggaagaaaccctttgctgggtcttctcatgccaagggcatcgttctggagaagattggtattgaggccaaacagccgaactctgctatccgtaagtgtgctcgtgttcagcttgtgaagaatggcaagaagattgctgctttcgtgccaaatgatggttgcttgaactacatcgaggaaaatgacgaggtgttgattgctggatttggtcggaagggtcacgccgtgggagatattcccggtgtacgattcaaggtcgtcaaggtctcgggtgtgtctctgcttgcccttttcaaggagaagaaggagaagccaaggtcttaaattgctctcgacactatcagcaagcatggagtagaaaatttgaaggctttagatgtttaagaatggctgcttgctatgtttacagcgcactcttgctgttgttaacctaagattctgttggtgaaaacttcccgtcagacttttcttctgttaagagaatagtactatcatgagttttgttcaccgaggatgttagtccccttgtctt

SEQ ID NO: 15204 - protein, 142 aa, Panicum virgatum; identical to SEQ ID NO: 12276
  misc_feature: Ceres CLONE 1781223
  misc_feature (8)..(141): Pfam Name: Ribosomal_S12 Pfam Description: Ribosomal protein S12

SEQ ID NO: 15205 - DNA, 1515 bp, Panicum virgatum
  misc_feature: Ceres CLONE 1781224
  misc_feature: Encodes the peptide sequence at SEQ ID NO. 15206
acttcgccggcgcggcctcgtcctcggccactcccgcgaccgcgagctcgcctcggcctcgtcccccacccgccggtccgtaccacgcccgccgcagcgccggccatggacgccgtcctacctcccctcctcatcggtggcgtactctccgtctccgtctctaccgccaccaaatccgccagccgaggcatttcagcaccccgccgttcgccccccgccctccgttcaatcgctcgccaccggggccggcaccgtttcaccctcctcgccgctgcttcagagtcgccttccaccccgctggccgccgctttgtccgagagccgctcgcggtctccctcaaggtgggtagtggtgatggatagccccccggcggccgcgggaggcagcgtggtctcccgcgcggacgctgtggattattacgcctccacgctggccggggttgtggggagtgagaaggaggcgcagatgcgcatatacgaggcttcatgggaggggagctacgagttccgctgcgagatcgacgaggaagcgtcaaaggagcttgcaaagatgcctggagtattatctgttcgtccagatatggatcataaattggagatggataatgatggttttagtctctcggcagctaaccttgtaagcatcagcgatgatgcttctaaatcttcaagtgggaaaaatgagttttggcttgttcgaatggagaagcctggagtcgaagtcgtgacaaaggcacaaatggtggaccactatacccaaatccttatgaaagtattggggaacgaacaggatgcccaggttagcatatatcacatttcatgggaaagggattatggtttctgctgtcacattgatgaagaatgtgcaaaggagttggctgatgttcctggagtgttatctgttcaaccagatacaaactttggatcagacaacaaaaattacaaaggtatagatggcttcaaatcatctgaagggactggagcagccgatatcaaaactaaaaggctctttgttacaggcctttcattttatacatctgagaaaacattgcgggcagcctttgagccttttggtgagctggtagaagtaaagataataatggacaagatatctaaaagatctaaagggtatgccttcatagaatatactactgaggaggctggaggtgctgctttgaaaggaatgaatggacagataataaacggctggatgatagttgttgatgttgctaaaaccagatcaagagaccatcaatccggtcgacctaatcaaacatttcgaccaccctatcgtacgagatgactgtttagtgtatagaattaagcagctgtagagtagagataagcactagttgggagtcgagctgcctgttctgattgcagttcggtgcccttctcttttgctaatttgctggaggatactcccagctatatatgtaaatgcagctgaagtgtacaattactaacatctactaaacaatttactgaaatttttttctgtgataagctcacgact

SEQ ID NO: 15206 - protein, 398 aa, Panicum virgatum
  misc_feature: Ceres CLONE 1781224
  misc_feature (301)..(372): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MDAVLPPLLIGGVLSVSVSTATKSASRGISAPRRSPPALRSIARHRGRHRFTLLAAASESPSTPLAAALSESRSRSPSRWVVVMDSPPAAAGGSVVSRADAVDYYASTLAGVVGSEKEAQMRIYEASWEGSYEFRCEIDEEASKELAKMPGVLSVRPDMDHKLEMDNDGFSLSAANLVSISDDASKSSSGKNEFWLVRMEKPGVEVVTKAQMVDHYTQILMKVLGNEQDAQVSIYHISWERDYGFCCHIDEECAKELADVPGVLSVQPDTNFGSDNKNYKGIDGFKSSEGTGAADIKTKRLFVTGLSFYTSEKTLRAAFEPFGELVEVKIIMDKISKRSKGYAFIEYTTEEAGGAALKGMNGQIINGWMIVVDVAKTRSRDHQSGRPNQTFRPPYRTR

SEQ ID NO: 15207 - DNA, 676 bp, Panicum virgatum
  misc_feature: Ceres CLONE 1781237-R
  misc_feature: Encodes the peptide sequence at SEQ ID NO. 15208
gtgccccggacatcttcgagagccccgccgtggtgtccctcacccgcgccgggatcgagaacctgctgcgcctggagaagcgcgcggagccctggctcgtggtgctgtacgcgccctggtgccccttctgccaggccatggaggcctcctacgtggagctggccgacaagctggccggggccggcgtgaaggtggtcaagttccgcgccgacggcgagcagaagccgtttgcgcaagcggagctgcagctgcagagcttccccaccgtgctcctgttcccgacccgcaccgccaggcccatcaagtacccatccgagaagagggacgtcgactcgctcctcgccttcgtcaacagcctccggtgagagtgagagaccgcccgccagggagcgagaaccatcgttctctgtcagaattgtacttagagagggaggaggtatctgagagagggaactggggatgataggaagagagggatggggttcagaaatacttcagatggagatcatgcatctctagctgttgtcactgcaaactgttgcaggtaaaaacccgaagcctgaggtccggtgttataaggcaaaaggtcgaggttatttgtgtgtacttatagctagtggtgagttggtgacagaggattgtaagggtaaaatcaaataagaaaatcagttttggc

SEQ ID NO: 15208 - protein, 120 aa, Panicum virgatum
  misc_feature: Ceres CLONE 1781237-R
  misc_feature (9)..(119): Pfam Name: Thioredoxin Pfam Description: Thioredoxin
  misc_feature: SWISSPROT Homolog: EC 1.8.4.9 Adenylyl-sulfate reductase (glutathione)
  misc_feature: Useful for making plants with modulated nitrogen use efficiency
APDIFESPAVVSLTRAGIENLLRLEKRAEPWLVVLYAPWCPFCQAMEASYVELADKLAGAGVKVVKFRADGEQKPFAQAELQLQSFPTVLLFPTRTARPIKYPSEKRDVDSLLAFVNSLR

SEQ ID NO: 15209 - DNA, 138 bp, Panicum virgatum
  misc_feature: Ceres CLONE 1781237
tgggactcgctctccttccgcccctgggtggtccccgcggtatcagaaccaacaccgccgctccggactccgcgtctgcccacatgcaatggcgcgggcctatgtggaggcagggctgggtcctagcagtctcttgat

SEQ ID NO: 15210 - DNA, 732 bp, Panicum virgatum
  misc_feature: Ceres CLONE 1781241
  misc_feature: Encodes the peptide sequence at SEQ ID NO. 15211
aaaaggaaggcctccacctcctcctctcctctcactccgcagctcccatccacctgctcccccttccgatcctcagctagtcgccttctcggaccagcggagatgggcacctcctccacggcgtcgctggccgcggcggcgctgctgctgctggtctccatggccgccgcggcggacatgtcgatcgtgtcctacggcgagcgcagcgaggaggagacgcgccggatgtacgccgagtggatggccacgcacggccgggcctacaacgccatcggcgaggaggagcgccggtaccaggtgttcaaggacaacctccgctacatcgacgcccacaacgccgccgccgacgcgggcgtccactccttccgcctcggcctcaaccgcttcgccgacctcaccaacgaggagtaccgcgccacctacctcggcgtcagggccaagccgcagagggagaggaagctcagcgccaggtaccacgccgaagacaacgaggagctcccggaatccgtcgactggagggccaagggcgccgtcgtcgaggtcaaggaccagggcagctgcgggagttgctgggctttctcaacaatagcagctgtggaaggcatcaaccagattgttacgggcgacctgatctctttatctgagcaggagcttgttgactgcgacacctcatacaacgagggggtgcatggaggtctgatggactatgcgtttgagttcatcatcaacaac

SEQ ID NO: 15211 - protein, 209 aa, Panicum virgatum
  misc_feature: Ceres CLONE 1781241
  misc_feature (43)..(103): Pfam Name: Inhibitor_I29 Pfam Description: Cathepsin propeptide inhibitor domain (I29)
  misc_feature (132)..(209): Pfam Name: Peptidase_C1 Pfam Description: Papain family cysteine protease
  misc_feature: SWISSPROT Homolog: EC 3.4.22.14 Actinidain
MGTSSTASLAAAALLLLVSMAAAADMSIVSYGERSEEETRRMYAEWMATHGRAYNAIGEEERRYQVFKDNLRYIDAHNAAADAGVHSFRLGLNRFADLTNEEYRATYLGVRAKPQRERKLSARYHAEDNEELPESVDWRAKGAVVEVKDQGSCGSCWAFSTIAAVEGINQIVTGDLISLSEQELVDCDTSYNEGVHGGLMDYAFEFIIN

SEQ ID NO: 15212 - DNA, 649 bp, Panicum virgatum
  misc_feature: Ceres CLONE 1781241-R
  misc_feature: Encodes the peptide sequence at SEQ ID NO. 15213
acgccgccgtcccccgccccgccgcccgccgtgtgcgacaactactactcctgcccggacagcaccacctgctgctgcatctacgagtacggcaagtactgcttctcctggggctgctgcccgctcgagggcgccacctgctgcgacgaccactacagctgctgcccccatgactaccccatctgcaacgtcagggagggaacctgcctcatgggcaaggacagcccactgtcagtgaaggctctgaagcgcaccctggccaagccgcactgggctttctctggcaacgcagctgacggcatgaagagcagcgcttgaacaatctccagcaagatatcaggcagccaacatccacggtgatcggagctcctgcaaaggatcacccggtgcttaattgaccaagaaaaagcgtggcgcggcggccgctgtttaagtgtatccgtataataggtgctcctgtacataagcctgaaaaaatgggtttgagttgttcgaactgctgccaaatttgcttttacatattatattatatatgtaagattcagctagctctgctaagctcctcgtcgcgcagttcggacgaactgcgattgatgtttatggaaattgatattggaacaagaagcaatgataatgctatattcattcc

SEQ ID NO: 15213 - protein, 105 aa, Panicum virgatum
  misc_feature: Ceres CLONE 1781241-R
  misc_feature (24)..(71): Pfam Name: Granulin Pfam Description: Granulin
TPPSPAPPPAVCDNYYSCPDSTTCCCIYEYGKYCFSWGCCPLEGATCCDDHYSCCPHDYPICNVREGTCLMGKDSPLSVKALKRTLAKPHWAFSGNAADGMKSSA

SEQ ID NO: 15214 - DNA, 1721 bp, Panicum virgatum
  misc_feature: Ceres CLONE 1781261
  misc_feature: Encodes the peptide sequence at SEQ ID NO. 15215
gagggtgtgccatgcacctgctagctagtctactgcacacataggctttgcaaagcaaggcgcagtgcccattgcttctttagcgagtcgtctctgctactagctacttgcagaaccaaaactagcagagtgcaatggatcttaataaatctgtgagcgtgttacacagcatccagggtcgtatcaacgacatggggctggcggctccgccttttgttgtcatgggtgtgaccctgatatgtatttggttagtccactatctcatcaaacagataaaccgtagacggcgcttgcaggcggtgctgccgcctggttctatgggactaccactccttggagaaacactcgagttcttcgctcggagtcctgcactcgacctgctgcctttcttcaagcgacgaatggagaggtacggtcctattttcaagacaaacttggtcggtaaggacttgattgtctctcttgacccggacgtcaaccactacgttctgcagcaagaggagaagtccttccacatatggtttccggagtcgttcatgagactcctgggcgaggagaacatcgccaaatgttatgggtccctgcacaagaacactaggaacatgattcgtcgagtctttggcccagagaacctcaggctggtgctgctccatgacatgcagggtgccgtggagaagactcttagctcctggcacgacagacaaagcgttgaactcaaaccagccctctcaagtatgatatttggtattgctgccaaatggatgatcggttacgaggcgtcggttttatcaggggatctgtggaaaaattttgatgcgttcaaccaaggactattgtcctttccactttatatccctggaacagcgttctacagatgtatgcagggacgcaataatgtcatgaaaaccttgaagcaagtgcttgacgagagacgaaagaaggcagaaacaccggaaaggatggatttcattgacgttatagtcagcgagttaaacaagcagaatcctgcgctctcagaaaaccttgctttaaatgtgctattcttgatgatctttgctagctttgagacaacatcatctggactaactgcagcactcaagtttctatcggacaaccctaaagcatggcaagaactagaggcggagcatcagcagatccgggaaagaagggctgatccggactcagaagtcacttgggaggaatacaaatccatgaaattcacctcccatgttataaatgaatcattaaggctagccaacgtcgcccctgtgttgtttaggaaagcaacacaagatgtgcaagtaaaaggttacactattccagagggatggatagtgatgatctgtcctccagcagttcatttgaatcctaccacatatgaggatcccagtgtcttcaatccatggagatggaaggatctttcggaaccagttgggggatccaaggacttcattgcctttggatcaggattgaggttatgtgttggtatagactttgcaaggcttcaaatgactatgttcttccacttcttggtcaccaagtatagattgaaggtggtcagtggtggggacatggtgttaagtcctggactagggtttcctaatggatttcaaatccaacttgaacgcaaaaaataattttgtctgtagcatctacagtacctcagcaaattttctcattgtttatgcatgtagttgtgttatcaactcaaataatgtacc

SEQ ID NO: 15215 - protein, 500 aa, Panicum virgatum
  misc_feature: Ceres CLONE 1781261
  misc_feature (58)..(496): Pfam Name: p450 Pfam Description: Cytochrome P450
  misc_feature: SWISSPROT Homolog: EC 1.14.13.93 (+)-abscisic acid 8'-hydroxylase
MDLNKSVSVLHSIQGRINDMGLAAPPFVVMGVTLICIWLVHYLIKQINRRRRLQAVLPPGSMGLPLLGETLEFFARSPALDLLPFFKRRMERYGPIFKTNLVGKDLIVSLDPDVNHYVLQQEEKSFHIWFPESFMRLLGEENIAKCYGSLHKNTRNMIRRVFGPENLRLVLLHDMQGAVEKTLSSWHDRQSVELKPALSSMIFGIAAKWMIGYEASVLSGDLWKNFDAFNQGLLSFPLYIPGTAFYRCMQGRNNVMKTLKQVLDERRKKAETPERMDFIDVIVSELNKQNPALSENLALNVLFLMIFASFETTSSGLTAALKFLSDNPKAWQELEAEHQQIRERRADPDSEVTWEEYKSMKFTSHVINESLRLANVAPVLFRKATQDVQVKGYTIPEGWIVMICPPAVHLNPTTYEDPSVFNPWRWKDLSEPVGGSKDFIAFGSGLRLCVGIDFARLQMTMFFHFLVTKYRLKVVSGGDMVLSPGLGFPNGFQIQLERKK

SEQ ID NO: 15216 - DNA, 2345 bp, Panicum virgatum
  misc_feature: Ceres CLONE 1781320
  misc_feature: Encodes the peptide sequence at SEQ ID NO. 15217
cttccgtttttattctaagcttggcgctcgcctcgcgcagccagcgagcgggcctagcctacgaggagctgcacgagaagaaaagggagaggaaaccagagcgagttcttctcggctcgggcatcgccattggctggggctagtcgctcgctccgggcttttgcgtcctcacgctagctagctactggaggaagacgcgtaagcaccgagcttcttgggagagaataaaccagctgcacggcagcatgaagggcggcggcgcgggcgacaaggccgggaggggcggcggcaagctgcagcagccgctgcgcctggagtcgcagcggttcaggctgctgtccatcgtcgtcggctgcttcgtcatctgcctcgtcttcctcctctcctcccgccccgacgccaccgccttcgacaccgtgagccccagggcgtcgctggagggcgcgcgccggcggccggccgccgtcaagaccctccaaacctcctccaccgccggcgtcggtggggatgtccatgtggacatccggccgcagcagcagcagggggggagcctgcgtcagagcgtcgagcagagcgccggcgacaagacggccacagaatgggtcagagacacggtgatcgtggaggagaggagcgacgccgaggccagcgaagctgcggcggagccggaggaggccgagcgcaacgtcgacggcaatgccgctgccgcggcgtccaaccccgacgaccagccagcaccaggcgccgagacggaggaggtccgagacgccgccgcgacagccaccgcacaacccgccgcggagaccacggcgaccgcgcccgaccggccagaggggaagccgcgagctgccggcggcggtcagagcaagctccaggagcagccagctcggcagccgcaagaggagcgccacgagccagcacgtaggggcaacgggacggcgaaagcaacgcccgaccaaaccttgtcaactggatccaacggcggggaccaccagcagccgctgtgcgacttctccgacttccgcagcgacatctgcgacatggccggcgacatccgcatggacgccaacgcgtcggcgttcgtggtcgtcgacccggcggcgagcggggccgacggcggccagtggcaccgggtccggccgtacccgcgcaagggcgacgagacgtgcatgggccggatcacggaggtcacggtgcggtcggcgggcggcgccgcgccgcggtgcacgcgggagcacgccgcgccggcggtggtgttctccatcggcgggtacacgggcaacatcttccacgacttctctgacgtgctggtgccgctgtacaacacggcgcggcggtacggcggcgacgtgcagctggtgatggcggacgtgtcgtcgtggtggctggtcaagtacgacaagctcctgcgcgcgctgtcgcggcacgcgccgcaggacctcgccagggccggcgccgccggggaggtccactgcttccggcgggccgtggtgagcctgcgcgcgcacaaggagctcatcatcgagcgggcgcgcagcgcggacggactcgcgacgccggacttcacgcggttcgtccggcgcgcgctgtcgctgccccgcgacgcgccgacgcgtctcggcgacggcacgggccggaagccccggctcctggtcatctcccgccaccacacgcggctgctcctgaacctcgacgccgtggtccgcgcggcggaggaggtcgggttcgaggccgtggtgaacgagtccgacgtgggcaacgacatcgcgcaggtcggggcgctcgtcaactcgtgcgacgcgctggtgggcgtgcacggcgccgggctcaccaacatgatgttcctgccgccgggggcgaccctggtgcagatcgtgccgtggggagggctgcagtggatggcgcgggcggactacggcgacccggcggaggcgatggggctccggtacatccagtacgaggtggccgtcggcgagagcacgctcaaggacaagttccccccggggcacaagatcttcaccgacccgacgtcgctgcacaagaagggcttcatgttcatcaggcagacgctcatggacggccaggacatcgccgtcgacgtcggccgcttcagggaggtgctgctccaggtgctcaacaacctctcgcagtagacggctctgcctgcgtatgcccgatcgagtacacacagctgcatagtacaagtatatacagtacaccggtgctatgtatacgtatattcatttagttggagctttgtatcattatacggataacggatgtacactttggcataatctttttcccctgaaagattacaatgaaacctctgcggttagtggtcc

SEQ ID NO: 15217 - protein, 635 aa, Panicum virgatum
  misc_feature: Ceres CLONE 1781320
  misc_feature: Useful for making plants with altered carbohydrate content
MKGGGAGDKAGRGGGKLQQPLRLESQRFRLLSIVVGCFVICLVFLLSSRPDATAFDTVSPRASLEGARRRPAAVKTLQTSSTAGVGGDVHVDIRPQQQQGGSLRQSVEQSAGDKTATEWVRDTVIVEERSDAEASEAAAEPEEAERNVDGNAAAAASNPDDQPAPGAETEEVRDAAATATAQPAAETTATAPDRPEGKPRAAGGGQSKLQEQPARQPQEERHEPARRGNGTAKATPDQTLSTGSNGGDHQQPLCDFSDFRSDICDMAGDIRMDANASAFVVVDPAASGADGGQWHRVRPYPRKGDETCMGRITEVTVRSAGGAAPRCTREHAAPAVVFSIGGYTGNIFHDFSDVLVPLYNTARRYGGDVQLVMADVSSWWLVKYDKLLRALSRHAPQDLARAGAAGEVHCFRRAVVSLRAHKELIIERARSADGLATPDFTRFVRRALSLPRDAPTRLGDGTGRKPRLLVISRHHTRLLLNLDAVVRAAEEVGFEAVVNESDVGNDIAQVGALVNSCDALVGVHGAGLTNMMFLPPGATLVQIVPWGGLQWMARADYGDPAEAMGLRYIQYEVAVGESTLKDKFPPGHKIFTDPTSLHKKGFMFIRQTLMDGQDIAVDVGRFREVLLQVLNNLSQ

SEQ ID NO: 15218 - DNA, 887 bp, Panicum virgatum
  misc_feature: Ceres CLONE 1781323
  misc_feature: Encodes the peptide sequence at SEQ ID NO. 15219
accatgcgcgtccagcgactgctgagcctgaggatggcatcgcactcgtgcccccgccccgccgccgtggcgccgcgcgcctcacgcccgctctcctccctcctcctcgccccctcgccggccgccgcgcccttctcgtgcgcggcgcggccgtgccggggcctcgcggcggcgtccccgtcgcgcggcccggcgggacagaggttgcccggcgtgtcggcgatgtcgtcatcgaccccgccgccagggcccgtgcagaagtcggaggaggagtggcaggccatcctcacgccggagcagttcaacatcctccgcctcaagggcaccgagtaccctggaacaggtgaatatgacaagttttttgatgagggcatttataaatgtgctggatgtggaactcccttatacaaatcatctacaaagttcgactcagggtgtggctggccggcattctatgagggacttcctggggccataagacagacgccggaccccgatgggaggcggacagagatcacatgtgctgcctgtggaggacatttggggcatatattcaaaggggaagggtttaagacgcctaccaacacgcgacattgtgttaacagcatttctctcaagttcattccagcctgacggctgatgaacaccaacgtgaaacctgacgacagaatgggagcttggcctttgttgggtgttttcacagtgtaggcagatgaacgttgttgtctgccgttgatcattatgttactcatcctttagacgacataccatcctgtttgtgaaagcttaataaattttgtgcgaacaagcttgaacgaagttttgcctgaacttttgtcatttcattaccctccttttcccatttggaaacaaaaaaggactggcgt

SEQ ID NO: 15219 - protein, 209 aa, Panicum virgatum
  misc_feature: Ceres CLONE 1781323
  misc_feature (88)..(209): Pfam Name: SelR Pfam Description: SelR domain
  misc_feature: SWISSPROT Homolog: EC 1.8.4.12 Peptide-methionine (R)-S-oxide reductase
  misc_feature: Useful for making plants with modulated heat sensitivity
MRVQRLLSLRMASHSCPRPAAVAPRASRPLSSLLLAPSPAAAPFSCAARPCRGLAAASPSRGPAGQRLPGVSAMSSSTPPPGPVQKSEEEWQAILTPEQFNILRLKGTEYPGTGEYDKFFDEGIYKCAGCGTPLYKSSTKFDSGCGWPAFYEGLPGAIRQTPDPDGRRTEITCAACGGHLGHIFKGEGFKTPTNTRHCVNSISLKFIPA

SEQ ID NO: 15220 - DNA, 681 bp, Panicum virgatum
  misc_feature: Ceres CLONE 1781325
  misc_feature: Encodes the peptide sequence at SEQ ID NO. 15221
gcaagggaggcgcagaggcagagaggccgcctgcgaagcgccggcgcgtgcgataaggcactgacgagacggcatggccgccacggcgtactccacggcgcttctcggcggggcgcgcctcgccgccgtcggcggcgccgccgtgccgtcctccgtcctcgtcccgcggcgtaacctgctgacgcctctccggctccaagatgcgccgaggctgtcgctgctccgggcgaaggcctccgacgacgacacctcggccgacgagctcatcgccgacttgaaagccaagcttatcctggaagcgaagacttcaaacttcacaggcaatcggctggggttgcgtacgcctagaactcagcaacatcttcaacagacttcaccacaacattctccttctgagcagcagtgggacgccatcgagaacaagaccaccgtcatcacatacgccggcggcgccatcgtcgctctttggctgacctccgtcatcgtcggcgccatcaactccgtgcctctgcttccaaagatcatggagctcgtcggtcttggatacaccggatggttcgtctaccgctaccttctcttcaaggaaagcaggaaagagttggctagcgacatcgagtcactcaagaaaaagattgctgggacagagtagtaaaatgtttgctcccgtgattttttttggat

SEQ ID NO: 15221 - protein, 191 aa, Panicum virgatum
  misc_feature: Ceres CLONE 1781325
  misc_feature: SWISSPROT Homolog: EC 6.1.1.9 Valine--tRNA ligase
MAATAYSTALLGGARLAAVGGAAVPSSVLVPRRNLLTPLRLQDAPRLSLLRAKASDDDTSADELIADLKAKLILEAKTSNFTGNRLGLRTPRTQQHLQQTSPQHSPSEQQWDAIENKTTVITYAGGAIVALWLTSVIVGAINSVPLLPKIMELVGLGYTGWFVYRYLLFKESRKELASDIESLKKKIAGTE

SEQ ID NO: 15222 - DNA, 670 bp, Panicum virgatum
  misc_feature: Ceres CLONE 1781327
  misc_feature: Encodes the peptide sequence at SEQ ID NO. 15223
atccacgagcgaaccggcagcgcaggcgcagggagaggggagccgaggccgagcacggagcacaagcaggatgccgacgctgatcctgagcaccaacgtgccagtggacgccgtcgtcgctgccgacatcctcaaggactgctccaaggcagtcgccaggatcatcggcaagcccgaatcctacgtcatggtgtcgataaacggctcggtgcccatgtcgttcgcggcgagcgaagaaccgacggcgtacggtgagctcgtctccattggcgggatcggccccggcgtcaacgggaagctaagcgcggccgtggctgagatcctcgagaccaagctcccggtcagcaggtccagattctacatcaaattcgatgatgtgcagagattcaactttggcttcaatggatcgacattctaaagaaaactccatcagagaatgatgatcgctgcgtccaagcgatcacctcaacctgcccacacataccaccatcagttcttcatcaataaatggggatggtcaagtgcttcatttgtatctcctatacctccaatggatattccgctcatgtttgagacagcactaaattatatgctttatttcaactgaatgcagcacagcatgccaccatgtacctcattcctcatttcatgatactttgttcttcagcag

SEQ ID NO: 15223 - protein, 115 aa, Panicum virgatum
  misc_feature: Ceres CLONE 1781327
  misc_feature (2)..(115): Pfam Name: MIF Pfam Description: Macrophage migration inhibitory factor (MIF)
  misc_feature: SWISSPROT Homolog: EC 5.3.2.1 Phenylpyruvate tautomerase
MPTLILSTNVPVDAVVAADILKDCSKAVARIIGKPESYVMVSINGSVPMSFAASEEPTAYGELVSIGGIGPGVNGKLSAAVAEILETKLPVSRSRFYIKFDDVQRFNFGFNGSTF

SEQ ID NO: 15224 - DNA, 800 bp, Panicum virgatum
  misc_feature: Ceres CLONE 1781335
  misc_feature: Encodes the peptide sequence at SEQ ID NO. 15225
acaatggatggatgcagaccagacagagaggccccgccatccgccaagaatgaagataagcctccacggctgcacccaccccatcccctcatttcattccgctttgagcttttgcttgcagctccagcaccaagcgcaggcccctcttgcattggtggctatctacgccatggccaccgtcctgagctgcaggctccgcgcgccggccagcttcatccccggcctccgcgccgccccggctcccgccgtcgccgccatgcccgccgccaagcaggttgttgcccgcggcgccaggctgcgcgcgcaggccacctacaacgtgaagctgatcacgcccgacggcgaggtggagctgcaggtgcccgacgacgtgtacatcctggaccaggccgaggaggaggggatcgacctgccctactcgtgccgcgcggggtcctgctcctcctgcgccggcaaggtcgtctccggcagcgtcgaccagtccgaccagagcttcctggaagacgaccaggtcgccggcggctgggtgctcacctgcgccgcgtaccccacctccgacgtcgtcgtcgagacccacaaggaggaggagctcacctcctcctcgtaatgcttgcattattgcttatcatcgatctccgctgattacatttaatttcttggttacgtaagtgtcgtgctactatgcttaattggtttgcagttgagctataatgcatgctgtggaaatttatatttattttgcaataatatagctattttatttatttttgttgttgaagtaataaatcatatcatgtacg

SEQ ID NO: 15225 - protein, 145 aa, Panicum virgatum
  misc_feature: Ceres CLONE 1781335
  misc_feature (54)..(129): Pfam Name: Fer2 Pfam Description: 2Fe-2S iron-sulfur cluster binding domain
MATVLSCRLRAPASFIPGLRAAPAPAVAAMPAAKQVVARGARLRAQATYNVKLITPDGEVELQVPDDVYILDQAEEEGIDLPYSCRAGSCSSCAGKVVSGSVDQSDQSFLEDDQVAGGWVLTCAAYPTSDVVVETHKEEELTSSS

SEQ ID NO: 15226 - DNA, 618 bp, Panicum virgatum
  misc_feature: Ceres CLONE 1781337
  misc_feature: Encodes the peptide sequence at SEQ ID NO. 15227
attcccccccctctccctcactctatactccccatccacactaatgcgccagtcgctttgctaaccacaaccgccgatcgaccatgaataatcaccaccacgatatcggacgctctgatgatcaagaacgccaagcgcatgcccgcggtggtggccttgcccgttgtggtggcggcggcggccctggtggcgtcggcgtcggcggccatgacgtgcggccaggaggattcggcgctggcgccgtgcatcccgtacgcgacggagaacgcgagcgcgctgccgtcatcgtgctgcggccgcctgcgctccctccacagagcggcgcggacgacctcagaccggcgagcgacgtgccggtgcctcacgagcctggccagcacagcccagtcgatgaacatgcccaccgtccccaccatccccggcaactgcggcgtctccgtgccattccccatcaacctgtccactgacagcaacaaggccaactaataaattgtgcatcaatatcataatcctaccagctgatgaggaatctcagctccatcctctcataagctatctgctagctacagagctatatacaggataatataatagagtcgacgcatcctcaacagtccc

SEQ ID NO: 15227 - protein, 122 aa, Panicum virgatum
  misc_feature: Ceres CLONE 1781337
  misc_feature (33)..(118): Pfam Name: Tryp_alpha_amyl Pfam Description: Protease inhibitor/seed storage/LTP family
MIKNAKRMPAVVALPVVVAAAALVASASAAMTCGQEDSALAPCIPYATENASALPSSCCGRLRSLHRAARTTSDRRATCRCLTSLASTAQSMNMPTVPTIPGNCGVSVPFPINLSTDSNKAN

SEQ ID NO: 15228 - DNA, 1707 bp, Panicum virgatum
  misc_feature: Ceres CLONE 1781339
  misc_feature: Encodes the peptide sequence at SEQ ID NO. 15229
gacacaccgtgagaagagaaagaattggggggacccttgcaaaccccgagtcccccaccatggcgtccctcctccgccgccgccgccacgccgcgcgcccatgcgccgccgcctccgcctccacccgcctacttcgtgccttctctgcgctccccgacgttgatccctcggcgtcccccgccgcaaccggtaccccggccgctcccacctccacctccgctcgttcctccgccgtgctcgacctccagctcgccgtccgcgccgaggccgacccggcccgcatccactccctagtcgcctccgcgctctccaaccacgacctcccgcgcctccacacatcgcggcagctcttctccctggccacctcccgcctgacccgcctccgccgccccgacctcgccgcctcgctcctccaccagctcctcgcctccgcgccgccctccccgggcctcctggcgcgcgcgctttccctcttcccgggccccgacgacgcgctccgggccttctccgcctcgccccccgccgcccgctccgacgtctcgctctcggcgctcctgtccgcgctcctccgcgctggccgcctcaaagatctcaagtccaccttcgcctccgcggagtcctcgctcggggtcgcgcccgcccgcgcctctcacaatgtgctccttcacgcgctggtcaagaactccgagctcgctgctgcccggaagctgctcgacgaaatggccaacaagaagttgaagcaccgccctgccccggacatcatatcctacaacactgtccttgctgggtactccgtgcagggcgataaggagggatttgagaagcttctgaaggagatcagtgcgagcaagctggagccaaatgttgtcacctacaactgccggatacagtggtttgccaagaaaggtgagacagtcaagggggaggagctgcttgatgtgatggaatcaaaggaggtggcgccgaattaccttacctacaatgctctcgtgcaaggatactgcaaggaggggaatgttgggccagcgatgcgggtgttcaagaggatgaaggtcatgaagaggcgggaggggagaagtgacttgggtgtgtctgcacattcacagacatatgtggtgctgtttaagagcttggtggagaaagagaagcttgatgacgcactgtggatttgtaagagctgctttgcgatgaaggcagcaccaccatttgaggctgttaagggtttggttgaggggttggtgaagagtgggaagtctgaagaggctaggaatgttgttgccaagatggatttacttgtgaaaggtgatgctaagcttgcttgggggaaggttgtgggggaactgtctcttgaagatggagcaccaagtacaaatccatgatttggtagaggcatctgcgttacttctgattgcttcatgtgttttggaccttgaacaatgacgatgacgaagaagataggctttcccatgggatccagtgctgtcttcgagttgtcactgggttgttttttttttaaaaaaaaatccatggttagatcaggatgtgatggatgtctctctaaagctgaatggtaagaggtgccattccataatccctttactgtaagatgttgctctatttttgtgtcttctaataatatttaaaatgatgttaaattttaacatttgttgaagtggtgagggaatcatgatagattatacatctatt

SEQ ID NO: 15229 - protein, 439 aa, Panicum virgatum
  misc_feature: Ceres CLONE 1781339
  misc_feature (270)..(304): Pfam Name: PPR Pfam Description: PPR repeat
  misc_feature (305)..(339): Pfam Name: PPR Pfam Description: PPR repeat
  misc_feature (235)..(269): Pfam Name: PPR Pfam Description: PPR repeat
MASLLRRRRHAARPCAAASASTRLLRAFSALPDVDPSASPAATGTPAAPTSTSARSSAVLDLQLAVRAEADPARIHSLVASALSNHDLPRLHTSRQLFSLATSRLTRLRRPDLAASLLHQLLASAPPSPGLLARALSLFPGPDDALRAFSASPPAARSDVSLSALLSALLRAGRLKDLKSTFASAESSLGVAPARASHNVLLHALVKNSELAAARKLLDEMANKKLKHRPAPDIISYNTVLAGYSVQGDKEGFEKLLKEISASKLEPNVVTYNCRIQWFAKKGETVKGEELLDVMESKEVAPNYLTYNALVQGYCKEGNVGPAMRVFKRMKVMKRREGRSDLGVSAHSQTYVVLFKSLVEKEKLDDALWICKSCFAMKAAPPFEAVKGLVEGLVKSGKSEEARNVVAKMDLLVKGDAKLAWGKVVGELSLEDGAPSTNP

SEQ ID NO: 15230 - DNA, 693 bp, Panicum virgatum
  misc_feature: Ceres CLONE 1781374
  misc_feature: Encodes the peptide sequence at SEQ ID NO. 15231
ggggggcgacgacggagacctgctgcagaggagctagcagcagcagctagcagtctcgtctcggcggcatggcggcggcggtggcggtggcggcggccgctctcatggcggcggcggcgctgctcgcgctgtggctcctcgcgtggcggccgcgcgcggtggcgcgggcgttcgcgcggcagggggtccgtggcccgccctacacgttcctggccgggtccctgccggagatgaagcggctgctggtggccggccgggtcggggtggcgcccctcgacgccacctgccacgacatcatgccagtcctgctgccgcagttccacagatgggtcgccgactatgggaaaacatttctgttctggatcggtcccattcccgccctcttctctactgatctccagctggttaagcaagtgctcgcggacaggacgggcctgtaccagaaggacttcctggtccccgtgctcaactccctcttcggcaacggggtcgtgttcatcaatggagacgactggaaacggcaccggaaggtggttcttccggccttcacccatgacaagatcaagagcatgtcggcggtggcggcggaggtcacgaagcagatgatgcagcaatggcgcgagcaggcccgccaaagcggcgggcagggagcggcggccgagatagacatgatcgtcgccttcaacgaacctg

SEQ ID NO: 15231 - protein, 208 aa, Panicum virgatum
  misc_feature: Ceres CLONE 1781374
  misc_feature: SWISSPROT Homolog: EC 1.3.3.9 Secologanin synthase
MAAAVAVAAAALMAAAALLALWLLAWRPRAVARAFARQGVRGPPYTFLAGSLPEMKRLLVAGRVGVAPLDATCHDIMPVLLPQFHRWVADYGKTFLFWIGPIPALFSTDLQLVKQVLADRTGLYQKDFLVPVLNSLFGNGVVFINGDDWKRHRKVVLPAFTHDKIKSMSAVAAEVTKQMMQQWREQARQSGGQGAAAEIDMIVAFNEP

SEQ ID NO: 15232 - DNA, 1954 bp, Panicum virgatum
  misc_feature: Ceres CLONE 1781385
  misc_feature: Encodes the peptide sequence at SEQ ID NO. 15233
gagaccggagacaggcggagagaggtctcccacaaattctccccgcttggctctggttcagtaccagtgccttcagtggctcattgtttggcttcagatccggaagggatctcataattcagagagctgagttgcggcaaggggagtgagagataaaaatggggatcggagatggatcctcaaacgggagccaacaatcagcgcgtaaggaaataagagatgagaccacgccacttcttccagtcaaggtggaggaggaggatgggtttcatgagttcaacggtgcttcattctcaggggcagttttcaatctgtcgaccaccatagttggggctggaattatggccctgccagcaagtatcaagatgctgggaatcatcccaggaattctgatgatcatcattgtggcgctgctcacagaggcatccatcgacatgcttgtcaggtgcagccaccagggcaagattacatcatatgggtggctgatgggtgaggtttttggacaatgggggagaattgcactgcaggcatccgtcatcataaacaacgtcggcgtgctaattgtttacatgattatcattggtgatgtattgtctggaacaacatcatctggcgttcatcatcgtggtatattggagggctggtatggagctcatttgtggaattcccgtcctattgttcttcttgctacagctcttctggtgtttgctccactggtgagctttaagcgtttggattcattgaggtacacatctgcgctatctgttgccctggcagtggtttttgtcgtaattactgctggaattgctatcatcaagctcttcaatggaactgtagcaatgcccaaactttttccagaattagatggtcttaattctatctggaatctttttacagctgtgcctgttcttgttactgcttacatctgccactataacgttcacagcattgacaatgaacttgaagacagaacacagatcaaacctatcgtgcgaacatctctggtcctgtgctccagtgtttacattgccacaagcttctttgcatatctcctctttggtgagggcacactggatgacgtgcttgccaactttgatgcaaatctaggcatcccgttcagctcagtctttgatgatatagtgcgagtgagctatgctgcacatgtcatgcttgtctttcccattgtcttctttgcccttcggctcaacttgaatggattgctcttccctacatggaggcacatttctcgtgacaataagagatttgcgatcatcaccatcgctctccttacagtaatttatcttgctgcaattcttataccaagcatctgggacgcattccagtttactggtgccacagccgctgtccttatcggtttcatctttcctgccatggtcgtacttagggattcttatggaattgctaccaagcgtgacaagatccttgctgtgaccatgatcgtgcttgctgttctctcaaattctgttgccttatacagtgatgcaatgaacatgttccgtaaaaaggaggtggcctaaacttcaggcttaaaaggagagttgcccgtcgatgcaggaagcacagattcgtatggcaaaattcagattctatgaatgaatatgctgatgcacttgcatgcatgaagggatatgatctctttgttcacacctgagaatccagccaattgaagaattggatgcttgaagttgtgtggttttctgtacacaaatcggctcagcgtccagttgagttgcttgcaatatatgtgtattcgatgtgcttgtattagcggagaagagagtatggctcggaaaaggctttcttccacaataatgtaaagttgtaccaatgtccgtgtttagttaaaatgtttcaaatgtggatgacaagaataagaagaatataatgataaccgttcccatgttaccatcatttcatttatacgggaactcgc

SEQ ID NO: 15233 - protein, 459 aa, Panicum virgatum
  misc_feature: Ceres CLONE 1781385
  misc_feature (41)..(446): Pfam Name: Aa_trans Pfam Description: Transmembrane amino acid transporter protein
MGIGDGSSNGSQQSARKEIRDETTPLLPVKVEEEDGFHEFNGASFSGAVFNLSTTIVGAGIMALPASIKMLGIIPGILMIIIVALLTEASIDMLVRCSHQGKITSYGWLMGEVFGQWGRIALQASVIINNVGVLIVYMIIIGDVLSGTTSSGVHHRGILEGWYGAHLWNSRPIVLLATALLVFAPLVSFKRLDSLRYTSALSVALAVVFVVITAGIAIIKLFNGTVAMPKLFPELDGLNSIWNLFTAVPVLVTAYICHYNVHSIDNELEDRTQIKPIVRTSLVLCSSVYIATSFFAYLLFGEGTLDDVLANFDANLGIPFSSVFDDIVRVSYAAHVMLVFPIVFFALRLNLNGLLFPTWRHISRDNKRFAIITIALLTVIYLAAILIPSIWDAFQFTGATAAVLIGFIFPAMVVLRDSYGIATKRDKILAVTMIVLAVLSNSVALYSDAMNMFRKKEVA

SEQ ID NO: 15234 - DNA, 2012 bp, Panicum virgatum
  misc_feature: Ceres CLONE 1781400
  misc_feature: Encodes the peptide sequence at SEQ ID NO. 15235
aacaacccaccatccccgccccgcccgacccttgcgattcccctccgccacccacctcccagctcgccgtcgtccggcccccatcccccgccccccccctccggtgccaccgaggtgaaggggtgggctcgctcaggtctcaggtgcaagatggccgccgcggcggtcctggcgctgctgatggtgtcggcgctggcgggggccgcggccggcggtgacatcgtccaccacgacgacgaggcacccaagatccccggatgcaacaacgacttcatcctggtaaaagtgcaaagctgggtcaacggcaaggagggtgatgaatttgttggagttggtgctcgctttggccccaaaattgtctccaaggagaagcacgcaaaccgaactaaactcacgctggcagaccctattgagtgctgctctcctccaaaagacaaggtttctggggatattcttttagttcaaaggggcaagtgcaaattcacaaagaaagcaaagtttgctgaagctaccggtgcttctgccatagtaatcataaaccatgtccacgaattgtacaagatggtctgtgaaaggaatgagacagatcttgacatacatatacctgcagttcttctaccaaaagatgcaggttctgctttacacacacttcttacaaacggtaacgcagtttctgtgcagctgtactctccagaccgtcctgtagttgatactgcagaggtatttctatggctcatggctgtcggtacagtcctcggtgcttcatactggtctgcatggagtgctagagaagcagttattgaacaagagaagctcctgaaggatggccatgaaggcctactgaatgttgaggctggaggttctagtggcatggtagatatcaatgtggtatcagcgataatgtttgtggtggttgcgtcatgcttcttaattatgctctacaaactcatgtcttactggtttgtggagctactggtggtaatcttctgcatcggcggtgtagagggtttgcaaacatgcttggttgctctgttatcaagatggttcaagcctgctgcagaatcttttgtgaaagtacctttcattggagctgtttcacatcttactctggcagtttgtccattttgcattgcatttgctgttgtatgggctgttttccgccaacttccgtatgcttggattgggcaagatattcttggtatcacactgatagttacagtcatccaaattgtcagagtacccaacctcaaggtgggttcagttcttctcagttgtgccttcctgtatgacatcttctgggtgttcgtctccaagaggtgatttcatgagagtgtgatgattgtggttgcacgtggtgataagactgacgaggatggcgtgcccatgttgctaaaaattccacgaatgtttgatccttggggtgggtacagcatcattggctttggtgatatccttcttcctgggctggtagttgctttcgcactaagatacgattttgttgcaaagaagggccttcagtctggttactttttgtggtcaatggtggcctatggttccggacttctgatcacatatgttgcactgaacctgatggatgggcatggccaacctgcccttctgtacattgtgcccttcacactcggaacgttgatcgcgctcgggtggaagagaggagagctgcagaacctgtggatgaggggacagcctgagagagtgtgcacgcatatgcatatcccgctgctgcctgcgagcccaaaataacgagtgcgtggccggggtaggcacttgaaccagaatgcacgctgcgtcgacatcctgctaataggttaataactagtagtgattaaatatattgcccagcaatattgacgcgtgtatttgatcgagacactttactgatgtacgtatatgtatatgtatccttatgaatttttagttcatcatgcctgtgtgatggacaaaaaatcactttgctccatcttgtcatgtcaaatatatatagctaggaatag

SEQ ID NO: 15235 - protein, 389 aa, Panicum virgatum
  misc_feature: Ceres CLONE 1781400
  misc_feature (72)..(168): Pfam Name: PA Pfam Description: PA domain
  misc_feature (236)..(389): Pfam Name: Peptidase_A22B Pfam Description: Signal peptide peptidase
MAAAAVLALLMVSALAGAAAGGDIVHHDDEAPKIPGCNNDFILVKVQSWVNGKEGDEFVGVGARFGPKIVSKEKHANRTKLTLADPIECCSPPKDKVSGDILLVQRGKCKFTKKAKFAEATGASAIVIINHVHELYKMVCERNETDLDIHIPAVLLPKDAGSALHTLLTNGNAVSVQLYSPDRPVVDTAEVFLWLMAVGTVLGASYWSAWSAREAVIEQEKLLKDGHEGLLNVEAGGSSGMVDINVVSAIMFVVVASCFLIMLYKLMSYWFVELLVVIFCIGGVEGLQTCLVALLSRWFKPAAESFVKVPFIGAVSHLTLAVCPFCIAFAVVWAVFRQLPYAWIGQDILGITLIVTVIQIVRVPNLKVGSVLLSCAFLYDIFWVFVSKR

SEQ ID NO: 15236 - DNA, 343 bp, Panicum virgatum
  misc_feature: Ceres CLONE 1781416
  misc_feature: Encodes the peptide sequence at SEQ ID NO. 15237
gactggcgcaaccacctgtcgccggagatggcggcgcggctggaccagatcgtcggcgaggcgctgcaagggtcggggctcacgttgggtggcgtcgccggcgccgcgcgcgacgacgacgacgactctgcgtgagccgccggcacgtttggcgacatgcagatgcaaatgcaggtgacgctggaactggtattcactcgcgtgattcctgagcgttttgctgagtaaatgggggtgctatgcgcacctccaaggctcagaaccagaataagtttactcaacatgcatgtatgtgcgagcgactttgttttaatctcatatgcctatgccttgttaattccat

SEQ ID NO: 15237 - protein, 44 aa, Panicum virgatum
  misc_feature: Ceres CLONE 1781416
  misc_feature: Useful for making plants with modulated salt sensitivity
  misc_feature: Useful for making plants with modulated drought sensitivity
  misc_feature: Useful for making plants with modulated water use efficiency
DWRNHLSPEMAARLDQIVGEALQGSGLTLGGVAGAARDDDDDSA

SEQ ID NO: 15238 - DNA, 1498 bp, Panicum virgatum
  misc_feature: Ceres CLONE 1781425
  misc_feature: Encodes the peptide sequence at SEQ ID NO. 15239
ggggtcactgacatcttggcacacctgttcttcttctgctcctccccacaacccacaaccaggcaaccaatcccctccgccatggccgccgccggctccgaccccgccgccgactcgcagcccccgcccccgatccaccccttccgcccgacgccctccacaacgtcctgctacgcctccacctgcgcgacgccgtcgcctgccgccccgtctcgcgcctcttccacgacaccctctccgcgcagttcctcgcgctgctccccaccctgcgcctcctcctcctccgccacccgcgccccgaaggcggaggatgcctccacgccttcgaccccgcgcgccgccactggctccgcctccccttcgcccacttcctcccctaccactccttctcccccgtcgcctcctccacctccctcctctacctctggctcgacacctccacatccgccccctcgcccctcctcccctcctcctcctcctcctccacctcgcccaaatcgctcgccgtctgcaaccccttcgccgctacctaccgcctcctgcccccgctcggatccgcctgggcgcgccacggcaccgtcctcgccggccccgccggcaccgtcctcgtcctcaccgagctcgccgcgctctcctacacgccctccggatccgccaagtggatgaagcatcccctctcgctcccctccaagccccggagccccatactcgcctccgccgcagcagccgtcttcgccctctgcgacgtcggcaccccctggcgcagccagtggaaactcttctcctgcccgctcgccatgctcaccggcggctgggcgcccgtcgagcgcgccgcctggggagacgtcttcgagatcctcaagcgcccccgcctccttgccggggccggcggccgccgagtcctaatgatcggcggcctcaggtcctccttcgccatggacgccccgtgctccacggtgctgatcctccgactagatctggccaccatggagtgggacgaagctggccgcatgccgcccaacatgtaccgctgcttcactggcctctgcgaggctgcttcgcaggccaacagcgcaatgcccaccgcagcggctgctggcaacaacaaggtcaaggtctttggaggccatggcaaggtgtggttcgctggaaagcgggtgcgtgggaagcttgcaatgtgggaggaggaggagaccgggggcagcggtggcaagtgggactgggtggatgctgttcctggttatggcgatggtgtataccgtggatttgtgttcgatggtggctttacagcgattccttgatgctgatggaaactcctgtatcctagtccggtgcgtgactaaatgaccaagttaagattttcatttcatatgggacatctatccattgcgtgtttgggaactgatatgtccccgaatttccttttatttacaatgtttagcatcatgaaatgttgtacttgattaatggaaaatgaaccttaagttgtttgtttcag

SEQ ID NO: 15239 - protein, 212 aa, Panicum virgatum
  misc_feature: Ceres CLONE 1781425
  misc_feature (67)..(118): Pfam Name: Kelch_2 Pfam Description: Kelch motif
MKHPLSLPSKPRSPILASAAAAVFALCDVGTPWRSQWKLFSCPLAMLTGGWAPVERAAWGDVFEILKRPRLLAGAGGRRVLMIGGLRSSFAMDAPCSTVLILRLDLATMEWDEAGRMPPNMYRCFTGLCEAASQANSAMPTAAAAGNNKVKVFGGHGKVWFAGKRVRGKLAMWEEEETGGSGGKWDWVDAVPGYGDGVYRGFVFDGGFTAIP

SEQ ID NO: 15240 - DNA, 719 bp, Panicum virgatum
  misc_feature: Ceres CLONE 1781427
  misc_feature: Encodes the peptide sequence at SEQ ID NO. 15241
actcgcgcacccgccgcggccgtcggctctactagctcgcaacggcaggaaccaggagcagggagaggggatggagcagtacgaggtggtgcagcagatcggccggggcgcctacggctccgcctacctcgtcctccaccgggccgagcgcaagaggtacgtgatgaagaagatccgcctctccaagcagaacgacaagttccagcggaccgcctaccaggagatgtccctaatggcaagcctcagcaacccgtacatcgtcgagtacaaggacggttgggtggacgaggggacctccgtctgcatcgtcacaagctactgcgaaggaggcgacatggcggagaggatcaagaaggcaagaggcgtactcttctctgaagagagggtctgccggtggttcacacaattgctcctcgcccttgattacctgcactgtaaccgggtgctccaccgcgatctcaagtgttccaacattttattgacaagggataacaacatcagacttgctgactttgggttggcgaaactgctcatggaggaccttgcctcatcggtcgtaggaaccccaaactacatgtgtccagaaatactagcagacataccttatggatacaaatctgacatatggtcacttggttgctgtatgtttgagattttggcacaccgccctgcattcagagctacagacatggcagcattggttacaaaataaacagata

SEQ ID NO: 15241 - protein, 213 aa, Panicum virgatum
  misc_feature: Ceres CLONE 1781427
  misc_feature (4)..(213): Pfam Name: Pkinase Pfam Description: Protein kinase domain
  misc_feature: SWISSPROT Homolog: EC 2.7.11.1 Non-specific serine/threonine protein kinase
MEQYEVVQQIGRGAYGSAYLVLHRAERKRYVMKKIRLSKQNDKFQRTAYQEMSLMASLSNPYIVEYKDGWVDEGTSVCIVTSYCEGGDMAERIKKARGVLFSEERVCRWFTQLLLALDYLHCNRVLHRDLKCSNILLTRDNNIRLADFGLAKLLMEDLASSVVGTPNYMCPEILADIPYGYKSDIWSLGCCMFEILAHRPAFRATDMAALVTK

SEQ ID NO: 15242 - DNA, 1792 bp, Panicum virgatum
  misc_feature: Ceres CLONE 1781430
  misc_feature: Encodes the peptide sequence at SEQ ID NO. 15243
gcccaaacacgcttcgcccttctttttcctttgcccaactcgtctcgtcttcgttcccctttcctcctccgcatcccggcttctcctcaccgcgtcaaaccccagcaccaagcaaccgcccccgcccccgccgcccctcccctcccctcccgaatctgccgccgcggtgcctaatccggccgatcccccctccgatccgcgggtgcccgccgcaaaggcggcgcctttgggcctcccccgatgtatagcaacttcaaggagcaggcaatcgagtacgtcaagcaggcggtccaggaggacaatgccggcaactatgtcaaggcgttcccgctctacatgaacgcgctcgagtacttcaagacccacctcaagtacgagaagaaccccaagatcaaggaggcaatcaccgccaagttcaccgagtacctccgccgcgccgaggagatccgggccgtcctcgatgagggcggcgcggggcccggggccaacggcggcgacgcggccgtcgccacgcgccccaagaccaagggcaaggacggggacggcggcaacggcggggacgactccgagcagtccaagctgagggcggggctcaattccgccatcatcaccgagaagccgaacgtcaagtggaacgacgtcgccggcctcgagagcgccaagcaggcgctgcaggaggccgtcatattgcccgtcaagttcccgcagttcttcacgggcaagcggaggccttggagggcttttcttttgtatggcccccctggaacgggaaagtcttatttggcaaaagctgttgcaaccgaggctgattcaacatttttcagtatatcttcatcagatctggtttcaaagtggatgggtgaaagtgagaaattagttgcgaaccttttcgaaatggctcgtgaaaatgccccttcaattatctttatcgatgaaattgattctttatgcggtcaacgtggagaaggcaatgaaagcgaagcttcaaggagaatcaagactgaactacttgtgcaaatgcagggtgttggccataatgatgataaagttcttgttcttgctgctacaaatacaccatatgctctggaccaggctgtgcggcgaagatttgacaagcgtatctacattccgctacctgacatgaaagcaaggcagcatatgtttaaggtccatctcggggatacaccccacagcttaacagaaagtgattttgagagcttggcccgtcgaacagatgggttttctggttcagatattgctgtttgtgtgaaggatgtgttatttgaacctgtccgcaaaacacaggatgccatgttcttctttaaggcagatggtgacatgtggatgccctgtggaccaaagcagccgggtgccatccagaccaccatgcaggagctagcatccaagggccttgctgcgaagattcttccaccacccatctccaggacagattttgaaaaggtcctgtcgaggcagaggccgacagttagcaagaaggacctggaggtgcacgagaggttcaccaaggagtttggcgaggagggctgatacaccgctcgcggacactcacccatgcacagctgcaccacagaaatgtatattgtttatgactttgattgttctgcatgcaagttggattcacaggattgtacattcggtagcccaactaaggttgatcatggctgcggctttatcatgtgttgggctatcgatgtgcgtctgttgtcatcttatttcgattttacacatacatggaatttttccacaggtgtataaaggaataataattctt

SEQ ID NO: 15243 - protein, 435 aa, Panicum virgatum
  misc_feature: Ceres CLONE 1781430
  misc_feature (167)..(352): Pfam Name: AAA Pfam Description: ATPase family associated with various cellular activities (AAA)
  misc_feature (367)..(432): Pfam Name: Vps4_C Pfam Description: Vps4 C terminal oligomerisation domain
  misc_feature (5)..(73): Pfam Name: MIT Pfam Description: MIT (microtubule interacting and transport) domain
  misc_feature (118)..(353): SWISSPROT Homolog: EC 3.6.4.3 Microtubule-severing ATPase
  misc_feature (7)..(73): SWISSPROT Homolog: EC 2.7.11.1 Non-specific serine/threonine protein kinase
MYSNFKEQAIEYVKQAVQEDNAGNYVKAFPLYMNALEYFKTHLKYEKNPKIKEAITAKFTEYLRRAEEIRAVLDEGGAGPGANGGDAAVATRPKTKGKDGDGGNGGDDSEQSKLRAGLNSAIITEKPNVKWNDVAGLESAKQALQEAVILPVKFPQFFTGKRRPWRAFLLYGPPGTGKSYLAKAVATEADSTFFSISSSDLVSKWMGESEKLVANLFEMARENAPSIIFIDEIDSLCGQRGEGNESEASRRIKTELLVQMQGVGHNDDKVLVLAATNTPYALDQAVRRRFDKRIYIPLPDMKARQHMFKVHLGDTPHSLTESDFESLARRTDGFSGSDIAVCVKDVLFEPVRKTQDAMFFFKADGDMWMPCGPKQPGAIQTTMQELASKGLAAKILPPPISRTDFEKVLSRQRPTVSKKDLEVHERFTKEFGEEG

SEQ ID NO: 15244 - DNA, 362 bp, Panicum virgatum
  misc_feature: Ceres CLONE 1781434
  misc_feature: Encodes the peptide sequence at SEQ ID NO. 15245
cccgtcccgacgaggtaggaggaaggccggccggcgacccgggggagaggaggatggggaagactgcggtgaggatgaaggcggtggtgtgcgcactgtcgccgttcctccagacggtgatgccggggctgtggaacgacatcgccaccaacatccaccacgtggccaccgagaactggatctccggcacgctcctcctccgccccgtcgtcggcacctagccaatatgcgatgtggtacagggagaaggcagatctatcctactgatactgattgacaggtggtccgacttgactgccacgggcgctggatttttcgtgatggattatatagcctcccaggatgattcacatttgttggat

SEQ ID NO: 15245 - protein, 55 aa, Panicum virgatum
  misc_feature: Ceres CLONE 1781434
  misc_feature: Useful for making plants with modulated nitrogen use efficiency
MGKTAVRMKAVVCALSPFLQTVMPGLWNDIATNIHHVATENWISGTLLLRPVVGT

SEQ ID NO: 15246 - DNA, 674 bp, Panicum virgatum
  misc_feature: Ceres CLONE 1781434-R
tttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacctgagcgtcgatttttgtgatgctcgtcaggggggcggagcctatcgac

SEQ ID NO: 15247 - DNA, 595 bp, Panicum virgatum
  misc_feature: Ceres CLONE 1781523
  misc_feature: Encodes the peptide sequence at SEQ ID NO. 15248
aaccctcctccagccccagtccgtccacgctcgttcccttgccgcgccgccgccgcctgctccgtccccggccctccggcagagcggctcgtgcatcgccacagtggaaccggtgaccatggtgatccctccaccagaaagggcggctagagtcacccgttttctgaagccctacctgttgaggatgcatttctcaaacaagtatgtatccgctcaggtcatccataccccaacagcgactgttgcatgttcagcaagctcgcaagagaagctcctgaaaccaaacatggtatcgacccgtgatgtttcagctgcggcgaagattggaaagttgctcggtgagcgccttctgctcaagggaatacctgcagtgtccatccacatgaagagagaacagaagtaccatgggaaagtcaaagctgtaatagattctgttagagaagctggagtcaaattgttgtgattgtatgtcgaaattattgatctcagttagcatttgaagttcactgagctgtgtttctgaagtttgctattttgaaatatggtgctaagtgggacatttctaagtcattaataaaaggactttgtattgctg

SEQ ID NO: 15248 - protein, 114 aa, Panicum virgatum
  misc_feature: Ceres CLONE 1781523
  misc_feature (4)..(113): Pfam Name: Ribosomal_L18p Pfam Description: Ribosomal L18p/L5e family
MVIPPPERAARVTRFLKPYLLRMHFSNKYVSAQVIHTPTATVACSASSQEKLLKPNMVSTRDVSAAAKIGKLLGERLLLKGIPAVSIHMKREQKYHGKVKAVIDSVREAGVKLL

SEQ ID NO: 15249 - DNA, 2341 bp, Panicum virgatum
  misc_feature: Ceres CLONE 1781524
  misc_feature: Encodes the peptide sequence at SEQ ID NO. 15250
cccccacccccctcccctaaaacagttgacggctgcaccgccgagtcgccgactccaccctcgctccccctccgctcctccccccagccggatcctccccacgccgccgcggcgccgctctccgccgcccgggtcgtgcagagccgatccctcaacgccatccttcgttagctaaacaatgaggcagcagactggtaaacgtccccgccaacatagggaatatgaaagagaagaaaggaaggaccaaaacaagaggccatttgcccatgctcaggaaagctataataatgatgggctggttgtttaccgtatactttgtccagacagtgtaattggtagtgtcataggaaagaatggcaatgtgataaatgctatcaggcaacaagcaaatgccaaagtcaaggttgttgacccctaccctggtgcagacaaaagggtcatcttggtatattgctatgtcaagcatagagaccttgatgctgatgagggtgatgacaatgaacctgtttgcccagctcaagatgcattacttagggtgcataatgcaattgttgatgcactagatacgctacataagaatcgtagagactctgaaaagaagaaaatagaagctaacatccttgtaccagctagtcaggctgcaagtgttataggaaaatctggtgttgtcatcaagtatctccggtcaacatctaaagcattcattaaagtgagcccaaaagatccaagcgacgttactcattcatgtgctatgagttttgataattttgttcagataactggtggtgctgaagctgttaaaaaggcactgtatggagtatcaaccatcctctacaagtatccatcaaaagagaacattcctcttgaaacctctgttcctgaacctactccgagcattatagtcccttctgaacttcctgtctatccagctagtaacttttactcagccccagatgctgctataccttctggacatccaagcctgtctatcttagggtcaacacctcatgttcctgaacttctatctgctgatggtcacggtcgactgcctatttatcaatctgtacttccaattattccagcatatagtaccccaaaatgttcaggtgaacttgagtttcgtgttttgtgccctggtaataagattgggctggttattggtagagctgggtctactataaagggtataaggcaagggagtggtgcaaggatagatgttgatgacgcgaagaatgacaaggaggaaagtataatcaccattacatccactgagaccaccgatgatgttaagtctgcagctgtggaagctgttttactgcttcaagcaaagatcaacgattatgaggaagatagaataaatctacgccttcttgtcccaactaaggttatcggctgtcttattggcaggggtggttctatagtcaatgacatgaggaagaagactaaggcagacatccgcatttcaaagggcgataagccccggagagcatcttccagcgatgagcttgttgaggtatctggagaggctgacaagctgcgtgatgctcttgttcagatagtattaagacttagggaagatgttctgaaagagagtgtggacagacagaattctgacagggatggcaagttatccattgccaccactgattccttatatggaagcagtcttcctttgcctgcattattacctcactctcacagccaacaaatcgctcccttgagctatgatcgaaggggtgaaactgagcgtggtctggaagtattccctcgtactagttcgtatgggtatagctccttgcaggtcgcagatgatgatggctatggaggactttcatcatatgcatcaaagtcatatgaagggcatgtaccgcgggtggaaatgactatccctgctagtgccctgtcaaaagtaatggggaaacgtggcacaaacttggaaaacattagaaagatttctggagctcacgttgaaattattgaatcaaaatcatctcgtcatgaccatgttgcttacatatctggcacatctgaggagaggcaatcagcagagaatctgatcaaagctttcataatgtctacctaggattccttcctgcagtttgaaaaggctagctcatctcttcaatcagtctcatttgacttctcttgccatccatagtttccttgggttcgtgaaggacatcgaatgcagtgttttcctccacccgtccaagttcccaataaatatcatgcgtatctgagggaggtgtactcccatagtgtggacaaagcactctgtgttccttagatccccaactgttacttctttctgttggcattatcatcgtgattcgagcgtctt

SEQ ID NO: 15250 - protein, 634 aa, Panicum virgatum
  misc_feature: Ceres CLONE 1781524
  misc_feature (394)..(460): Pfam Name: KH_1 Pfam Description: KH domain
  misc_feature (313)..(377): Pfam Name: KH_1 Pfam Description: KH domain
  misc_feature (144)..(214): Pfam Name: KH_1 Pfam Description: KH domain
  misc_feature (565)..(627): Pfam Name: KH_1 Pfam Description: KH domain
  misc_feature (42)..(94): Pfam Name: KH_1 Pfam Description: KH domain
MRQQTGKRPRQHREYEREERKDQNKRPFAHAQESYNNDGLVVYRILCPDSVIGSVIGKNGNVINAIRQQANAKVKVVDPYPGADKRVILVYCYVKHRDLDADEGDDNEPVCPAQDALLRVHNAIVDALDTLHKNRRDSEKKKIEANILVPASQAASVIGKSGVVIKYLRSTSKAFIKVSPKDPSDVTHSCAMSFDNFVQITGGAEAVKKALYGVSTILYKYPSKENIPLETSVPEPTPSIIVPSELPVYPASNFYSAPDAAIPSGHPSLSILGSTPHVPELLSADGHGRLPIYQSVLPIIPAYSTPKCSGELEFRVLCPGNKIGLVIGRAGSTIKGIRQGSGARIDVDDAKNDKEESIITITSTETTDDVKSAAVEAVLLLQAKINDYEEDRINLRLLVPTKVIGCLIGRGGSIVNDMRKKTKADIRISKGDKPRRASSSDELVEVSGEADKLRDALVQIVLRLREDVLKESVDRQNSDRDGKLSIATTDSLYGSSLPLPALLPHSHSQQIAPLSYDRRGETERGLEVFPRTSSYGYSSLQVADDDGYGGLSSYASKSYEGHVPRVEMTIPASALSKVMGKRGTNLENIRKISGAHVEIIESKSSRHDHVAYISGTSEERQSAENLIKAFIMST

SEQ ID NO: 15251 - DNA, 1588 bp, Panicum virgatum
  misc_feature: Ceres CLONE 1781530
  misc_feature: Encodes the peptide sequence at SEQ ID NO. 15252
acacactgctgtctcccgtctccgttccagcctccgcgcgagatctgctcctcgcgctccccctccccctccctggcgcgccccgccacggcccgatccatccctcgagcgcggcctccgaattcccccggcgatggtcgtgtgcaaatgccgcaaggcgacgagggtttactgcttcgtccaccaggtccctgtctgcggtgagtgcatatgcttcccggagcatcagctgtgcgtggtaaaaaactatgctgaatgggttattaattcggattatgattggccgcaacactgttcatcttgcaattcagttctggaagctggaagtgaagaaaccacacgattgggttgcttacatgtgatgcacacaaaatgcttgatatcgtatatccaaagttttccaacccaaacagcaccagctggatatgtctgcccctcatgttccacgcctgtaaattgaactcaatctccctctccctgcaagcgcatgtgtaaatcggctgcttcaactctgaggatcacacaatcttttgatcttttactataactttcctaacagatatggccaccatcaagcattaaagatacaggttctcgtcttcatgcaaaactgaaagaagaaataatccagactggcttggagaagaatgtatttggaaatcattttgtgacaatatctaaagctgatactcggacccctcctgcttttgcatcagatcctcttaaacatttatccagttctggtgatagagaatcgaatggtgctaacataattagctcaactcaagatgcgtctttgccatcaacactgcattctgcaatgtacgcttctgctagtttaggatctgggacatctatccatgttgaaccagaaattgttgaaatagagggtcctagtcccgtgataacacaattcccagaactggagtctaacttcatcagaagtccgagcccacatgggcctggtgccatgacaagaaaaggtgctaccagcgttgatagacaaaattcagagatttcttattatgctgatgacgaagatggaaatcgtaaaaagtataccaaaaggggtacatttcgtcatagatttctaaggatgctgctgcctttctggtctagtgcactgccaacactaccagtcacagcaccttcaaaaaaggagagtgatggcccagagggtcgcccccggcagagatcatcaagaatggatcccacgaagattttacttgcaatggctatattggcatgtatagcaacgatgggaattctctattaccggttgtcccagcgcagtctttctgaaaacttcgttgaggatgagattcagtagcacactgatattttcgaccttgcaatcttgtactgttctgctgctgattcgaagggttttaccctcctgttttttttcttttttccccctttctgtgggcctttttggtggttttagggtgggtagttgttagttacatataagagttatagttgactgctgctatgttctgattcgtgctcttatttatgtaactataatgccatacaatattgtattatctgccgctgaggagaaatcatagaaaatataccatct

SEQ ID NO: 15252 - protein, 108 aa, Panicum virgatum
  misc_feature: Ceres CLONE 1781530
  misc_feature (54)..(103): Pfam Name: zf-C3HC4 Pfam Description: Zinc finger, C3HC4 type (RING finger)
MVVCKCRKATRVYCFVHQVPVCGECICFPEHQLCVVKNYAEWVINSDYDWPQHCSSCNSVLEAGSEETTRLGCLHVMHTKCLISYIQSFPTQTAPAGYVCPSCSTPVN

SEQ ID NO: 15253 - DNA, 2650 bp, Panicum virgatum
  misc_feature: Ceres CLONE 1781535
  misc_feature: Encodes the peptide sequence at SEQ ID NO. 15254
aaagcagagcagccagccactcgctttcttcgcaaccacgtctcctcccctcaaatccccacccccaaatccagccggcccaaaccctagcccgatcccaatccccccctcccctcccctccaatcctcctcctccccctgcttccttcgccgctaagcatatccctctctccgcctggatctcgacgaggatgacggtgatggagctcaaggcgctgccgctgggcttccgcttccaccccaccgacgaggagctcatccgccactacctcaagggcaagatcaccggccagatcaactccgaggtcgaggtcatccccgagatcgacgtctgcaagtgcgagccgtgggacctcccagataaatcactgatccggtcggatgatcccgagtggttcttcttcgcgcccaaggaccgcaagtaccccaatgggagcaggtcaaatagggccaccgaagctggatactggaaggccaccggcaaggacaggatcatcaagtccaagggtgacaaacgcaagcagcacatcattggcatgaagaagacccttgtgttccaccgtggacgcgcacccaagggtgagcggacagggtggatcatgcacgagtaccgcaccactgagccggagtttgagtccggcgagcagggtggttatgttctttatcgcctcttccggaagcaagaggagaaacctgagcgccctagcccagatgaagtagataggagtggctactcgcctactccttctcgctcgtcacctgacaacatagaggtgaatgaggaagcaaacacgccgttaaatagggagtctccagagtctggtctgcatgaaagtccgattgagctgccaaattctgtggaaaccaatgctatgccgatgagaaggtggctggctgacagaaatgataacttggtggctactgcagcggatgtttcccatatgatgcctattaatggacatgctaatgtacccgaggttgattcttctgctggtgcttcagctcagttcgttcatccacagaatgggaatggtggttttaacaattttgtgcctgatattgcccccaatataccgcatggaaatgcattcttctctgatttccagcaaggagcttttggttttgatggcaacatgaatcctcccgatgccctggatgctttcttgaaccaaacacttgttgatcctgatgaacattcatcaacaacatcaaaagttcagtatgactcggacattcctacagaatttgataaccacggggttgcacagggtgaagaatgctggtgggcaaatctagatttcttgtcagatgagccaaatcctctgaattcacaatatgagaatacaccgttacttcattatgacacaaatgaccaggatgtactttcagtggactctgctgctgattccttgcatgatctgttcaataacatggaggattcaagtgcaaggagggctggaatgaacattgaatatggtcttcagggaactgggatttctcttatgcccggagagttacagccctctgtgcagccaaactacctgttcactaaccagggcactgcacaaagaaggatccggctacagttgcctgctgatttggagagtggggagagcataactagagatgagagtgaagatgaagtatcgtgtgttgtaactccgaactatctgaatgaagctgaagaggagtccacggcagataaggatgtggtttctgatggagatgaagctgggtcaacagggattgttattagaagccggcctgctccaagttcaagttcagagagttcattgacccaacaagggactgcagtgcgaaggctccggctgcagtcacacctcatgacaggaccatgtcctagtactgatgatacttcaagttgcatcataaatgagcagaaagtcaccacaaagcagagaaatctgagattggagaggatgcaagtacaaactttgccgaaactgttgatggtatattggacagatgcggtgatagtgaacaaaagaacatgcctgaacatgttgctgaaacagctgttccagaagccaaatctgttccaaggctgcggaaggcttctgagaagagtggcaaggatgctatcaagcaggaggatggtcttgagccccacgtgagagcaccagcgcagaagaggggcttccaaccttacatggtctggctggttctttcggtgcccctgctgttgcttctctgtgtcggggtgtatgggtggatatgaaaggtatcccggtgcagtgtagggcgtcacattttgcgcacgcaggttcccagcatctacacctggtggtatgttgtcatgtgtacataactgtcttttctcccggccagcagaggaaactgaaaatccaaaaaaaaaaagaggtagcactttaggaggaagaaaaagaaaaaaaaagaaccattattagaggcatagtagtacgtccttagttttttttttatttcagctgttgctgcagatgctggtaagtcgatgtggtagctgttgtttagttgcaagccattccctcgcctgctggctttatttcctgatgtaatgtagcaagaccctgttagacggggtgccggaagtctgatgaaccttggtaatgtcttgtcttcttgttattgtagatagtatttcagttcc

SEQ ID NO: 15254 - protein, 647 aa, Panicum virgatum
  misc_feature: Ceres CLONE 1781535
  misc_feature (9)..(143): Pfam Name: NAM Pfam Description: No apical meristem (NAM) protein
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: Useful for making plants with modulated oxidative stress sensitivity
MTVMELKALPLGFRFHPTDEELIRHYLKGKITGQINSEVEVIPEIDVCKCEPWDLPDKSLIRSDDPEWFFFAPKDRKYPNGSRSNRATEAGYWKATGKDRIIKSKGDKRKQHIIGMKKTLVFHRGRAPKGERTGWIMHEYRTTEPEFESGEQGGYVLYRLFRKQEEKPERPSPDEVDRSGYSPTPSRSSPDNIEVNEEANTPLNRESPESGLHESPIELPNSVETNAMPMRRWLADRNDNLVATAADVSHMMPINGHANVPEVDSSAGASAQFVHPQNGNGGFNNFVPDIAPNIPHGNAFFSDFQQGAFGFDGNMNPPDALDAFLNQTLVDPDEHSSTTSKVQYDSDIPTEFDNHGVAQGEECWWANLDFLSDEPNPLNSQYENTPLLHYDTNDQDVLSVDSAADSLHDLFNNMEDSSARRAGMNIEYGLQGTGISLMPGELQPSVQPNYLFTNQGTAQRRIRLQLPADLESGESITRDESEDEVSCVVTPNYLNEAEEESTADKDVVSDGDEAGSTGIVIRSRPAPSSSSESSLTQQGTAVRRLRLQSHLMTGPCPSTDDTSSCIINEQKVTTKQRNLRLERMQVQTLPKLLMVYWTDAVIVNKRTCLNMLLKQLFQKPNLFQGCGRLLRRVARMLSSRRMVLSPT

SEQ ID NO: 15255 - DNA, 1871 bp, Panicum virgatum
  misc_feature: Ceres CLONE 1781546
  misc_feature: Encodes the peptide sequence at SEQ ID NO. 15256
attgcagaaaaacaaaaactctaaataggaacctcgaagttaaacactctgttctgttggttgaatcagccgaaatcagccaattttttcagcagattctctcttacagatcattattaaatcaaccgaaactaatcaactttcccaccagccgaatggagtgaaaatggctttcttcgtcgtttgcatttcctcgcttctgatcatctctatctcttggtatgtgttccagctgctcgccgcccgccgccgcaagcttcctcctggccccacaccgctcccattcatcggcaacctcctcgacgtcgcgagcgagctgccacaccgctccctggcacgcctcgccagacgccacggccccctcatgacggtccgtctaggcacgctagtcgccgtcgtcgcctcatctccgtccaccgcccgcgaggtcctccagacgcacaacggcagcctcaccggccgcagcccgccggacgcatggctcgccttgggccacgctgccaactccgtcttcgtcctcccgccgggccgcatgtggcgcgcgctgcgcaggatcgggacggagcacctgctctcagcgaggcagctcgacagcacgcgactgcggccggtgctgcgggacgccgtcctcgaccttgtccgccgcgtgtcggggatggcggcggcggggcggcccgtggaggtcggccgcgccgcgttcgcggcgatgatggacctccagtggcgagccatgttctcggcgggcctggatgacgcggcggcgcgcgcgctgcacgacgccgcgcgggaggccgtggcgctgtccctgaagcccaacgtctcggacttcttcccggcgctcgccgcggccgacctccagggcgtgcggcgccgcttcgcgagaagggttgcgatggtttaccagatgatcgacgagcagatcgagcggcggatgcggaagcggccggaaactggcggtgggagctcgggcgagaaggacctgttagacgtggtgctcgacatctcggagcaagggaagggcgacggcgtagtgatcgtcaacagagaagtgataaggacatttctcacggacatatttctggcgacggtcgacacaatctcgagcacaatcgagtggggaatggcagagctactacagcaccccgacgcgatgagcaaggtgcaggaagagctcaggagtgttctcgggtccaaggcactcgtggaacaccccgacgtcgaccgtctcccctacctccgagcagccatcagggaaacgctccggctgcacccggtggtgccgctggtgccgaacgaggcagaggagacggtggagatccagggccacgccgtgcccaagggctgcaccgtactggtgaacctctgggcggtgcaccgcgacgccgcggcgtggccggagccgaactggttcatgccggagcggttcctgcggcggcgtcctgaggaggccggcttcttggggaccacggagttcgagttcatcccgttcagcgccgggcggcgcgtctgcctcgggttgccgctcgcgacacggatggtccacgccatgctcggttcgctgcttcaccacttcgagtgggcactcccgggggaggtgaaggaaaatggggtggacatggcggagagtctggggttgacgatgattatggctaccccgctgcaagctatagcgaagagtgtgcgctagatgacgcctagctggatttaatttggattattattcgagctgtagctgtgtgctgctttgtgggcgtggtctctgttgtttcttctcccgaagtacaaggcacgtgcatgtattgtcagatagtatgtacattgcaacttcattgcaggatgtcaaataaatacagtctatgcatggtgagttc

SEQ ID NO: 15256 - protein, 440 aa, Panicum virgatum
  misc_feature: Ceres CLONE 1781546
  misc_feature (1)..(438): Pfam Name: p450 Pfam Description: Cytochrome P450
  misc_feature: SWISSPROT Homolog: EC 1.14.13.21 Flavonoid 3'-monooxygenase
MTVRLGTLVAVVASSPSTAREVLQTHNGSLTGRSPPDAWLALGHAANSVFVLPPGRMWRALRRIGTEHLLSARQLDSTRLRPVLRDAVLDLVRRVSGMAAAGRPVEVGRAAFAAMMDLQWRAMFSAGLDDAAARALHDAAREAVALSLKPNVSDFFPALAAADLQGVRRRFARRVAMVYQMIDEQIERRMRKRPETGGGSSGEKDLLDVVLDISEQGKGDGVVIVNREVIRTFLTDIFLATVDTISSTIEWGMAELLQHPDAMSKVQEELRSVLGSKALVEHPDVDRLPYLRAAIRETLRLHPVVPLVPNEAEETVEIQGHAVPKGCTVLVNLWAVHRDAAAWPEPNWFMPERFLRRRPEEAGFLGTTEFEFIPFSAGRRVCLGLPLATRMVHAMLGSLLHHFEWALPGEVKENGVDMAESLGLTMIMATPLQAIAKSVR

SEQ ID NO: 15257 - DNA, 701 bp, Panicum virgatum
  misc_feature: Ceres CLONE 1781580
  misc_feature: Encodes the peptide sequence at SEQ ID NO. 15258
agtgcggcactgctccttcccggcgctgcttatctccccgctccctccttccagcgcgtcgccatgaacacagccatggccaccgcttccttatccctcaaaggccgcccttgccagggcgcggccaagaacctctcctccccgctcctcggcgcccccgcctccttcctccggccgctggcgcccgcgcccagcgccgcccgtcggcccggcgcttggtgccaaggatgtgaacatcatggcgttctgcaaggaatacaatgccaagacggccgagaaggccggctacatcatccccgtcgagatcaccgtcttcgatgacaagagctttactttcgtcttgaagacaccaccagcctccgttctgctccttaaggctgcaggtgtcgaaaagggttcaaaagagccacagcgagaaaaggttggcaaagtaacagcagatcaagtccgtgcgatagctcaagagaagttgccggacttgaactgcaagagcatcgactctgctatgaggatcattgctggcactgccgctaacataggcattgatgttgaccctccaatccttcagaagaaggaaaaagtcctcttgtagtttgttttgctggcacccacagatcaaattatcaatcgctttctgtagattctgccttcctttttgttcgtcaattcgcagtgccaacttgaagttttcctctggtgtc

SEQ ID NO: 15258 - protein, 117 aa, Panicum virgatum
  misc_feature: Ceres CLONE 1781580
  misc_feature (36)..(104): Pfam Name: Ribosomal_L11 Pfam Description: Ribosomal protein L11, RNA binding domain
  misc_feature (1)..(31): Pfam Name: Ribosomal_L11_N Pfam Description: Ribosomal protein L11, N-terminal domain
MAFCKEYNAKTAEKAGYIIPVEITVFDDKSFTFVLKTPPASVLLLKAAGVEKGSKEPQREKVGKVTADQVRAIAQEKLPDLNCKSIDSAMRIIAGTAANIGIDVDPPILQKKEKVLL

SEQ ID NO: 15259 - DNA, 2391 bp, Panicum virgatum
  misc_feature: Ceres CLONE 1781581
  misc_feature: Encodes the peptide sequence at SEQ ID NO. 15260
acggaggcacaaaaggaaaaccgccaccgtaaatgctgatggagcaaaggcaaaaacaaatagtattccaaagagtactctctattccaaacttacaagcttctctctctccgatcatatccacacaccaacccagccgtatgaacaaaatcctccctatttaagacgggcgtcgcgtcgctggcttcaactacgccccaaaatccacccttggtccattactccatttgctcgaatccccagcccccccgttcctgatcgattctagaaatttcaccctttctccagaatttttttggcttgtttcggtctggggttgcagcgctccgctgctcctaggtttgattttcgagcggtagcttgcatctccgtgggtaaagattggattttgagcggatttggggggcgtttctgcctgattcgggacctctcacctctgtgagtgtgaggtaaggtcccggggttggatttcggggtgggggatttttgatggtccattgagattcggccggagcgaagatgacgatcgacatgtccatgcccgggagctccgggcttctgaacgctgtggggaagaggaacatgaacttcttcagcaaccgctatgtgctcgcgctcacgggcgccgcagggatcggcggattcctcttcggctacgacacaggtgtcatatctggagcccttttgtatatccgtgatgaatttccagctatcagagacaattacttcctacaggaaactattgttagcatggccttagtcggagccatgcttggagctgctgggggtggttggataaatgatgcatatggtcgcaagaagtctactcttcttgctgatttgatgtttgcacttggctcaattgtcatgtgtgctgctggcggtccttacattctaatactcggaaggctcctcgttgggttaggcgtgggtgtggcatcggtcacggcaccagtatacattgctgaagctgctccatcagaaattaggggaggtttggtgtcgactaatgtactcatgattactggtggccaattcttctcctaccttatcaatctcggctttactgaggttcctggaacatggcgctggatgcttggagttgctgctgtgcctgccattgtacagtttgtgctgatgctttttctgccagaatctccccgttggctttactggaaggatgagaaagcacaagctattgctgtcctggagaagatctacgactctgatcgtttggaagaaaaggtagagctgcttgcttcatcttccatgcatgaattccaggctgacaatactgcaagctatttggacatcttcaagtcaaaggaattaaggctagcattttttgctggagctggtcttcaggccttccaacaattcactgggatcaacaccgtcatgtattacagccccacgatcgtccagatggctggtttcacttccaacaaattggccttgctcctttccctcattgttgctgcgatgaatgctgctgggaccattgttggaatctaccttatcgaccgttgtggccgccgccacctggctcttacaagcttgtccggtgtcgtgatctcccttgtcatcctcgctatggccttcatactgcagtcatcatccagcctctgcatggctgccgctaacggcacctgccaaggcgtgctaggctggttcgcggtggcaggccttgccctgtacatcgccttcttctctccaggcatgggcccagtcccgtgggctgtgaactcggagatctaccctgaggcataccgtggaatgtgcgggggcatgtcggccaccgtcaactggatctccaacctcatcgtggcgcagacgttcctctcaatcgtggggctggttgggaccggcgtgaccttcctgatcatcgctggaatcgctgtgctggccttcatcttcgtggcactgtacgtgccggagacgaagggcctgagctttgagcaggtggagcagctctggaaggagagagcgtggggaagccgtggcaactgtcagagccttttgggtgctgcgccgtaggctataaacattttagcattgatcaagcatggcagcaacggtggcggcagttttaagatggctgcgttgcgcttgatcgcctgcatccagcttaaaagaaggttcgtaagaaagctggatgcagatccaaactgtactctgtggttctgttgcctgattgtatgtaatggccgtagtgcatagtggaaaatgttcagtgtcggtaaaaggatcaggtcttgccgttacgttgggttgtgccagaagattgcctgtagacccacagatttgggttatattttgtacagctttcggcgccgaatgtgccggagagaagacaattcaaattgtttggaaactgagaaaaatctcctc

SEQ ID NO: 15260 - protein, 505 aa, Panicum virgatum
  misc_feature: Ceres CLONE 1781581
  misc_feature (33)..(486): Pfam Name: Sugar_tr Pfam Description: Sugar (and other) transporter
MTIDMSMPGSSGLLNAVGKRNMNFFSNRYVLALTGAAGIGGFLFGYDTGVISGALLYIRDEFPAIRDNYFLQETIVSMALVGAMLGAAGGGWINDAYGRKKSTLLADLMFALGSIVMCAAGGPYILILGRLLVGLGVGVASVTAPVYIAEAAPSEIRGGLVSTNVLMITGGQFFSYLINLGFTEVPGTWRWMLGVAAVPAIVQFVLMLFLPESPRWLYWKDEKAQAIAVLEKIYDSDRLEEKVELLASSSMHEFQADNTASYLDIFKSKELRLAFFAGAGLQAFQQFTGINTVMYYSPTIVQMAGFTSNKLALLLSLIVAAMNAAGTIVGIYLIDRCGRRHLALTSLSGVVISLVILAMAFILQSSSSLCMAAANGTCQGVLGWFAVAGLALYIAFFSPGMGPVPWAVNSEIYPEAYRGMCGGMSATVNWISNLIVAQTFLSIVGLVGTGVTFLIIAGIAVLAFIFVALYVPETKGLSFEQVEQLWKERAWGSRGNCQSLLGAAP

SEQ ID NO: 15261 - DNA, 1304 bp, Panicum virgatum
  misc_feature: Ceres CLONE 1781589
  misc_feature: Encodes the peptide sequence at SEQ ID NO. 15262
agcaaacgcgaagccaaggcagcgagccagatctcgcctgcccgccgcggctgtgaacaggacagccaccgtcgccggatcggaccaagcgccggagctccgggaatccaccggagcagaagcggcagcagatcccgagagcagagcagtgggtagctgccaaggcaaaaggaggcggcgaagatgctgccgacgaccgcgtccaaggggcgcggggccgcccgctccgccccgccgctcttcggcccctacctccgccgcatcgttaagtggcaacaaatggatattgaatacacgttttggcaaatggttcatctctgtacttcaccaaaagtagtctatcagcacaccaaatatcacaagcaaacaaagaaccagtgggctcgggatgatcctgcatttgttgtcattctgattcttttcctcgtgttcgcaacatcagcttactgtgcagcgtatggagagagtgcctcacatgctgctctaacaatcacttcggttgtgttcttccatttcttgtttgctgggatagttttggccacactttgctggtttcttacaaattcttacttgagagaggaacctaacagccatgttgttgagcaacgtgtggagtggctctatgcatttgatgttcactgtaactcgttctttcctgcatttgtcatcctatatgtacttcaatattttctgtcacctctattggtcgcgcatggcttctttccagctcttttatcgaatctactctttgtggtggcaatttcttattatcactacctgaactttctaggatatgatgttcttccatttttggacagaacaacattcttcctgtacccaattggtcttgtcatcatcctgtccccacttatgatactaatagggttcaatccgacaagatactttctaagcttgtacttcggttaagcccgacagctatattgctgagtacaagaaaaatatggtggcaggactaatggcatatttggatacaatactttctgaagtagtagcagtttagatctcttgtatgaactggggtgagcgaggttcagaaaagctcagagcattgtttggatgtatcaggtgcccgtggcaggccagcatagaagactaaagccttttgattgatatctatatccctttttgatgtcaacttgttcataatatgagctgttttctttggtttgggccagtgaccagtgtataattctagtgggaactacagtgttgtacatcactttggcatcagggttgcacgtatcacgctctacatcagtcgtcccttgcaagtttattgtttc

SEQ ID NO: 15262 - protein, 247 aa, Panicum virgatum
  misc_feature: Ceres CLONE 1781589
  misc_feature (17)..(247): Pfam Name: UNC-50 Pfam Description: UNC-50 family
MLPTTASKGRGAARSAPPLFGPYLRRIVKWQQMDIEYTFWQMVHLCTSPKVVYQHTKYHKQTKNQWARDDPAFVVILILFLVFATSAYCAAYGESASHAALTITSVVFFHFLFAGIVLATLCWFLTNSYLREEPNSHVVEQRVEWLYAFDVHCNSFFPAFVILYVLQYFLSPLLVAHGFFPALLSNLLFVVAISYYHYLNFLGYDVLPFLDRTTFFLYPIGLVIILSPLMILIGFNPTRYFLSLYFG

SEQ ID NO: 15263 - DNA, 887 bp, Panicum virgatum
  misc_feature: Ceres CLONE 1781606
  misc_feature: Encodes the peptide sequence at SEQ ID NO. 15264
ctcccgcgttatccgaaatacctggcgaagcacacacctcactccgtcgagaacccgaagcagaactacaccgcaccaatggcagcgcgcctcgccgtccaggctccgtccgcgagcctgccacgggccgggaacacgtcccctggccccaagccgccgccgagcaacagcgtgcagcagaagccagccgccaccagccgcaggctagcggcggcgtcggcggctgcgctcgtggcgtcccggctgctggcgcccgcggcgagcagcgccgccgccggcgccggcgcgttcgacctgcgcatcacgctgccggagcagtccagcgaggaggccgaggcggtggtgcgggtccacgcgcggaacctgctgcgggtgaagccgctcgccgacgccggggcgtggcgggagctgcaggcggcgctgcgcgccagcgcgtccaacctcaagcaggacctctacgccatcatccaggcgaggcccgcggggcagcgccccgacctccgcaggctctactccgacctcttcaacagcgtcaccagcatggactacgcggccagagacaaggacgaggtccacgtgcaggaatactacagcaagatggcctctgccctcgaggaaattttcgccaagatcatgtagttgctcatgcgtttatctaggatagacggagaatggattttttaccctcttcaaaaagaagaagaaaaattaggaactcacattcgcatgcagggagcaacaaatggcgaccggcaaaaaggctttcattcttgcaatgtagctagttttgtttttaaagtactatttagctactagttcttgtgaacttcctctgctacatctatttaccctagcatcttaaggaggaacacagaagaatcatagtt

SEQ ID NO: 15264 - protein, 186 aa, Panicum virgatum
  misc_feature: Ceres CLONE 1781606
  misc_feature (17)..(186): Pfam Name: PsbQ Pfam Description: Oxygen evolving enhancer protein 3 (PsbQ)
MAARLAVQAPSASLPRAGNTSPGPKPPPSNSVQQKPAATSRRLAAASAAALVASRLLAPAASSAAAGAGAFDLRITLPEQSSEEAEAVVRVHARNLLRVKPLADAGAWRELQAALRASASNLKQDLYAIIQARPAGQRPDLRRLYSDLFNSVTSMDYAARDKDEVHVQEYYSKMASALEEIFAKIM

SEQ ID NO: 15265 - DNA, 1204 bp, Panicum virgatum
  misc_feature: Ceres CLONE 1781645
  misc_feature: Encodes the peptide sequence at SEQ ID NO. 15266
tcccctcttcacctcacccatctccttcctactccgcagtcctcgccacttccaagcaacaaacccatggctctcgtccgccagcgccgccagctgccgcacctcaccctcccgctcgaccacttcgccctgcgcctgccgccgcagccgcagcccgccgccgccgcgccgtccacctccgcctccgacgcccgcctctcggattacgagaagatctccgtcctcgggcacggcaacggcggcaccgtctataaggtgcgccaccgccggtccgcgcagccactcgcgctcaagctcttcgcagccggggacccctccgcggcgcgcgaggccgagatactcaagctcgccgcggacgcgccccacgtcgtgcgcctccacgcggtgatcccgtcagcgtcggcgggggaggcgcccgcggcgctggcgctggagctcatgcccgggggctccctcgcgggcttgctccgccggctgggccgcccgatggcggagcgccccatcgccgccgtggcgcggcaggcgctcctcgggctcgcggcgctgcacgcgctccgcgtcgtgcaccgcgacctgaagccgtcgaacctgctcgtgggcgccggcggcgaggtcaagatcgccgacttcggcgcgggcaaggtgctgcgccggcggctcgacccctgcgcgtcctacgtcggcacggcggcgtacatgtcgccggagcggttcgacccggaggcgtactcgggcgactacgacccctacgccgccgacgtgtggagcctcggggtggccatcctggagctgtacctgggccacttcccgctcctgcccgagggccagcgcccggactgggccgcgctcatgtgcgccatctgcttcggcgaggcgccggagccgccggccgcggcgtcggaggagttccgggacttcgtggcgcggtgcctggagaagaaggccgggcagcgcgcgtccgtggccgagctgctggagcacccgttcgttgccgggcgggacgcggccggcgcgcagcaggcgctcgcggcgctcgtcgcggaggcggagcagggcgacctgtagcccaactgccagccgggccggttaattaattcattcactagcaggagatttaggagagtcgggacgagatgatgtgtacataagagttacgccacgtggacgaataacctgtcataggtggcgttttcttgcttttctt

SEQ ID NO: 15266 - protein, 332 aa, Panicum virgatum
  misc_feature: Ceres CLONE 1781645
  misc_feature (47)..(308): Pfam Name: Pkinase Pfam Description: Protein kinase domain
  misc_feature: SWISSPROT Homolog: EC 2.7.12.2 Mitogen-activated protein kinase kinase
MALVRQRRQLPHLTLPLDHFALRLPPQPQPAAAAPSTSASDARLSDYEKISVLGHGNGGTVYKVRHRRSAQPLALKLFAAGDPSAAREAEILKLAADAPHVVRLHAVIPSASAGEAPAALALELMPGGSLAGLLRRLGRPMAERPIAAVARQALLGLAALHALRVVHRDLKPSNLLVGAGGEVKIADFGAGKVLRRRLDPCASYVGTAAYMSPERFDPEAYSGDYDPYAADVWSLGVAILELYLGHFPLLPEGQRPDWAALMCAICFGEAPEPPAAASEEFRDFVARCLEKKAGQRASVAELLEHPFVAGRDAAGAQQALAALVAEAEQGDL

SEQ ID NO: 15267 - DNA, 364 bp, Panicum virgatum
  misc_feature: Ceres CLONE 1781651
  misc_feature: Encodes the peptide sequence at SEQ ID NO. 15268
gcgggagtgatggcgaccaacaggagcggcggcaacctcggggaggcggatctgaaggggaagaaggtgtttgtgcgcgccgaccccaacgtgccgatcgaggacgcccagaaaaacgccgaacatctccgaatccgcgcgtccgtcccgaccattaagttccttcttgaggagggcgctcaggtcggcctcgcaagccacctgggccgtccgaaaggcgtcaccccgaaggaccgctcgaagcctcttgttcctcgcttatccgagctccttggtgttgatgtggagatgaacagtgattgccttggtgaggaagttgacacattggctgctgcttggctggaaggtagactcctgctcgtat

SEQ ID NO: 15268 - protein, 118 aa, Panicum virgatum
  misc_feature: Ceres CLONE 1781651
  misc_feature: SWISSPROT Homolog: EC 2.7.2.3 Phosphoglycerate kinase
MATNRSGGNLGEADLKGKKVFVRADPNVPIEDAQKNAEHLRIRASVPTIKFLLEEGAQVGLASHLGRPKGVTPKDRSKPLVPRLSELLGVDVEMNSDCLGEEVDTLAAAWLEGRLLLV

SEQ ID NO: 15269 - DNA, 670 bp, Panicum virgatum
  misc_feature: Ceres CLONE 1781651-R
  misc_feature: Encodes the peptide sequence at SEQ ID NO. 15270
ttttgacgcagcacttggtataatcccaggtttgaaggttaagggtaccgactacgaactccttgatggcacttgtgtaagggattacattgatgtcactgacctggtcgatgcgcatgttaaggcactcaacaaggcagaaagaggcagagttggcatatacaatgttggcacaggaaaaggtcggtcagtaaaggagtttgttgaagcctgcaagaaggcgacaggagtcgatatcaaggttgactacttcccccgcagaccaggtgactacgccgaggtgtacagcgaccccgctaagatcaatcgggagctgaactggacggcgcagcacaccgacctccacgagagcctcagggtggcgtggacatggcagaaggcgcaccgaagtgggtacgagccaccccaggccatgattttgtgaagatgatggttgcctcgtagcaagcaaccatctggccgaagcttaggtgaacataaaattattagagacttctccttgagggctcatagtcggtcactcacatatggtgaattatatatacatagtgctcatggtcatttgttcgattcttgagggttcatatttattgaaggtcttagttgatcattgtaataacattatacatattcattgtatgttatataatataataaataataaaattcc

SEQ ID NO: 15270 - protein, 140 aa, Panicum virgatum
  misc_feature: Ceres CLONE 1781651-R
  misc_feature: SWISSPROT Homolog: EC 5.1.3.5 UDP-arabinose 4-epimerase
  misc_feature: Useful for making plants with altered carbohydrate content
  misc_feature: Useful for making plants with altered cell wall content and/or composition
FDAALGIIPGLKVKGTDYELLDGTCVRDYIDVTDLVDAHVKALNKAERGRVGIYNVGTGKGRSVKEFVEACKKATGVDIKVDYFPRRPGDYAEVYSDPAKINRELNWTAQHTDLHESLRVAWTWQKAHRSGYEPPQAMIL

SEQ ID NO: 15271 - DNA, 708 bp, Panicum virgatum
  misc_feature: Ceres CLONE 1781672
  misc_feature: Encodes the peptide sequence at SEQ ID NO. 15272
agggcgcactgcaccttgcttagaaaccacttgatcgcagcctctccttggctgctgctcagcttctctctctctctctctctctctctctctctcacctcaccggagcgtgcaggcggttcttggtacgcacgcttccccatatataccccccggccatacatagagcgagccacaagcagccaccgatcggggaggagcgcgcacccgccgatcgccattgcaagtggcaacggccaccgacgttgccccgccttctaatttgtcgccgtcgtcggagtagacagagaggggaggatccgagaatgggacggctctcctgcggcggcggcgtgcagcccaagctccgcaaggggctctggtcgcccgaggaagacgagaagctgtacaatcacatcatccgccacggcgtcggctgctggagctccgtccccaagctcgcagggctgcagcgctgcggcaagagctgccgcctgcggtggatcaactacctccgccccgacctgaagcgcggcagcttctcgcagcaggagggggacctcatcctcgcgctccacgagatcctcgggaacaggtggtcgcagatcgcgtcgcacctgccggggcggacggacaacgagatcaagaacttctggaacagctgcctcaagaagaagctccggcagcgcggcatcgacccgagcacgcacaagcccatcgccggcgccg

SEQ ID NO: 15272 - protein, 134 aa, Panicum virgatum
  misc_feature: Ceres CLONE 1781672
  misc_feature (16)..(63): Pfam Name: Myb_DNA-binding Pfam Description: Myb-like DNA-binding domain
  misc_feature (69)..(114): Pfam Name: Myb_DNA-binding Pfam Description: Myb-like DNA-binding domain
  misc_feature: The sequence is a functional homolog of SEQ ID NO 136 in the 10/412,699 US patent application
  misc_feature: The sequence is a functional homolog of SEQ ID NO 325 in the 11/479,226 US patent application
  misc_feature: The sequence is a functional homolog of SEQ ID NO 1660 in the 11/479,226 US patent application
  misc_feature: The sequence is a functional homolog of SEQ ID NO 840 in the 10/412,699 US patent application
  misc_feature: Useful for biocontainment applications
  misc_feature: The sequence is a functional homolog of SEQ ID NO 188 in the 10/412,699 US patent application
  misc_feature: The sequence is a functional homolog of SEQ ID NO 2274 in the 10/374,780 US patent application
  misc_feature: The sequence is a functional homolog of SEQ ID NO 704 in the 10/225,066 US patent application
  misc_feature: The sequence is a functional homolog of SEQ ID NO 428 in the 10/374,780 US patent application
  misc_feature: The sequence is a functional homolog of SEQ ID NO 54 in the 11/375,241 US patent application
  misc_feature: The sequence is a functional homolog of SEQ ID NO 870 in the 10/225,066 US patent application
  misc_feature: The sequence is a functional homolog of SEQ ID NO 504 in the 10/666,642 US patent application
  misc_feature: The sequence is a functional homolog of SEQ ID NO 896 in the 11/435,388 US patent application
  misc_feature: The sequence is a functional homolog of SEQ ID NO 108 in the 10/412,699 US patent application
  misc_feature: The sequence is a functional homolog of SEQ ID NO 1740 in the 10/412,699 US patent application
  misc_feature: The sequence is a functional homolog of SEQ ID NO 1964 in the 10/374,780 US patent application
  misc_feature: The sequence is a functional homolog of SEQ ID NO 255 in the 11/479,226 US patent application
  misc_feature: The sequence is a functional homolog of SEQ ID NO 908 in the 11/435,388 US patent application
  misc_feature: The sequence is a functional homolog of SEQ ID NO 1070 in the 10/374,780 US patent application
  misc_feature: The sequence is a functional homolog of SEQ ID NO 992 in the 11/435,388 US patent application
  misc_feature: Useful for making plants with modulated biomass
  misc_feature: The sequence is a functional homolog of SEQ ID NO 1006 in the 11/435,388 US patent application
  misc_feature: The sequence is a functional homolog of SEQ ID NO 1008 in the 11/435,388 US patent application
  misc_feature: Useful for making plants with altered lignin content
  misc_feature: Useful for making plants with altered alkaloid content
  misc_feature: Useful for making plants with modulated nitrogen use efficiency
  misc_feature: The sequence is a functional homolog of SEQ ID NO 2221 in the 10/666,642 US patent application
  misc_feature: The sequence is a functional homolog of SEQ ID NO 998 in the 11/435,388 US patent application
  misc_feature: The sequence is a functional homolog of SEQ ID NO 1000 in the 11/435,388 US patent application
  misc_feature: The sequence is a functional homolog of SEQ ID NO 2223 in the 10/666,642 US patent application
  misc_feature: The sequence is a functional homolog of SEQ ID NO 1917 in the 10/374,780 US patent application
  misc_feature: The sequence is a functional homolog of SEQ ID NO 1065 in the 10/374,780 US patent application
  misc_feature: The sequence is a functional homolog of SEQ ID NO 1307 in the 10/412,699 US patent application
  misc_feature: The sequence is a functional homolog of SEQ ID NO 986 in the 11/435,388 US patent application
  misc_feature: The sequence is a functional homolog of SEQ ID NO 1052 in the 11/479,226 US patent application
  misc_feature: The sequence is a functional homolog of SEQ ID NO 456 in the 10/412,699 US patent application
  misc_feature: The sequence is a functional homolog of SEQ ID NO 1072 in the 10/374,780 US patent application
  misc_feature: The sequence is a functional homolog of SEQ ID NO 996 in the 11/435,388 US patent application
  misc_feature: Useful for making plants with altered cell wall content and/or composition
  misc_feature: The sequence is a functional homolog of SEQ ID NO 1004 in the 11/435,388 US patent application
  misc_feature: The sequence is a functional homolog of SEQ ID NO 1068 in the 10/374,780 US patent application
  misc_feature: The sequence is a functional homolog of SEQ ID NO 984 in the 11/435,388 US patent application
  misc_feature: The sequence is a functional homolog of SEQ ID NO 2574 in the 10/374,780 US patent application
  misc_feature: The sequence is a functional homolog of SEQ ID NO 278 in the 10/225,066 US patent application
  misc_feature: The sequence is a functional homolog of SEQ ID NO 1002 in the 11/435,388 US patent application
  misc_feature: The sequence is a functional homolog of SEQ ID NO 442 in the 10/412,699 US patent application
  misc_feature: The sequence is a functional homolog of SEQ ID NO 1067 in the 10/374,780 US patent application
  misc_feature: The sequence is a functional homolog of SEQ ID NO 1309 in the 10/412,699 US patent application
  misc_feature: The sequence is a functional homolog of SEQ ID NO 1071 in the 10/374,780 US patent application
  misc_feature: The sequence is a functional homolog of SEQ ID NO 994 in the 11/435,388 US patent application
  misc_feature: The sequence is a functional homolog of SEQ ID NO 1010 in the 11/435,388 US patent application
  misc_feature: The sequence is a functional homolog of SEQ ID NO 1011 in the 11/479,226 US patent application
  misc_feature: The sequence is a functional homolog of SEQ ID NO 434 in the 10/412,699 US patent application
  misc_feature: The sequence is a functional homolog of SEQ ID NO 1069 in the 10/374,780 US patent application
  misc_feature: The sequence is a functional homolog of SEQ ID NO 988 in the 11/435,388 US patent application
  misc_feature: The sequence is a functional homolog of SEQ ID NO 1064 in the 10/374,780 US patent application
  misc_feature: The sequence is a functional homolog of SEQ ID NO 1306 in the 10/412,699 US patent application
  misc_feature: The sequence is a functional homolog of SEQ ID NO 990 in the 11/435,388 US patent application
  misc_feature: The sequence is a functional homolog of SEQ ID NO 2564 in the 10/374,780 US patent application
  misc_feature: The sequence is a functional homolog of SEQ ID NO 276 in the 10/225,066 US patent application
  misc_feature: The sequence is a functional homolog of SEQ ID NO 818 in the 10/412,699 US patent application
  misc_feature: The sequence is a functional homolog of SEQ ID NO 1073 in the 10/374,780 US patent application
  misc_feature: The sequence is a functional homolog of SEQ ID NO 2394 in the 10/374,780 US patent application
  misc_feature: The sequence is a functional homolog of SEQ ID NO 544 in the 10/225,066 US patent application
  misc_feature: The sequence is a functional homolog of SEQ ID NO 999 in the 11/479,226 US patent application
  misc_feature: The sequence is a functional homolog of SEQ ID NO 836 in the 10/412,699 US patent application
  misc_feature: The sequence is a functional homolog of SEQ ID NO 296 in the 11/479,226 US patent application
  misc_feature: The sequence is a functional homolog of SEQ ID NO 134 in the 10/412,699 US patent application
  misc_feature: The sequence is a functional homolog of SEQ ID NO 321 in the 11/479,226 US patent application
  misc_feature: The sequence is a functional homolog of SEQ ID NO 1040 in the 10/225,066 US patent application
  misc_feature: The sequence is a functional homolog of SEQ ID NO 2864 in the 10/374,780 US patent application
  misc_feature: The sequence is a functional homolog of SEQ ID NO 168 in the 10/412,699 US patent application
  misc_feature: The sequence is a functional homolog of SEQ ID NO 377 in the 11/479,226 US patent application
  misc_feature: The sequence is a functional homolog of SEQ ID NO 58 in the 10/666,642 US patent application
  misc_feature: The sequence is a functional homolog of SEQ ID NO 824 in the 10/412,699 US patent application
  misc_feature: The sequence is a functional homolog of SEQ ID NO 1066 in the 10/374,780 US patent application
  misc_feature: The sequence is a functional homolog of SEQ ID NO 1308 in the 10/412,699 US patent application
  misc_feature: The sequence is a functional homolog of SEQ ID NO 1094 in the 10/225,066 US patent application
  misc_feature: The sequence is a functional homolog of SEQ ID NO 386 in the 10/374,780 US patent application
  misc_feature: The sequence is a functional homolog of SEQ ID NO 1684 in the 11/479,226 US patent application
  misc_feature: The sequence is a functional homolog of SEQ ID NO 2582 in the 10/374,780 US patent application
  misc_feature: The sequence is a functional homolog of SEQ ID NO 30 in the 11/375,241 US patent application
  misc_feature: The sequence is a functional homolog of SEQ ID NO 854 in the 10/412,699 US patent application
  misc_feature: The sequence is a functional homolog of SEQ ID NO 1411 in the 11/479,226 US patent application
  misc_feature: The sequence is a functional homolog of SEQ ID NO 2492 in the 10/374,780 US patent application
  misc_feature: The sequence is a functional homolog of SEQ ID NO 52 in the 10/225,066 US patent application
  misc_feature: Useful for making plants with altered terpenoid content
  misc_feature: The sequence is a functional homolog of SEQ ID NO 430 in the 10/412,699 US patent application
  misc_feature: The sequence is a functional homolog of SEQ ID NO 995 in the 11/479,226 US patent application
  misc_feature: The sequence is a functional homolog of SEQ ID NO 271 in the 11/479,226 US patent application
  misc_feature: The sequence is a functional homolog of SEQ ID NO 1041 in the 11/479,226 US patent application
  misc_feature: The sequence is a functional homolog of SEQ ID NO 112 in the 10/225,066 US patent application
  misc_feature: The sequence is a functional homolog of SEQ ID NO 20 in the 11/375,241 US patent application
  misc_feature: The sequence is a functional homolog of SEQ ID NO 2052 in the 10/374,780 US patent application
  misc_feature: The sequence is a functional homolog of SEQ ID NO 450 in the 10/412,699 US patent application
  misc_feature: The sequence is a functional homolog of SEQ ID NO 112 in the 10/412,699 US patent application
  misc_feature: The sequence is a functional homolog of SEQ ID NO 267 in the 11/479,226 US patent application
  misc_feature: The sequence is a functional homolog of SEQ ID NO 110 in the 10/412,699 US patent application
  misc_feature: The sequence is a functional homolog of SEQ ID NO 259 in the 11/479,226 US patent application
  misc_feature: The sequence is a functional homolog of SEQ ID NO 1033 in the 10/412,699 US patent application
  misc_feature: The sequence is a functional homolog of SEQ ID NO 540 in the 10/374,780 US patent application
  misc_feature: The sequence is a functional homolog of SEQ ID NO 122 in the 10/412,699 US patent application
  misc_feature: The sequence is a functional homolog of SEQ ID NO 126 in the 11/375,241 US patent application
  misc_feature: The sequence is a functional homolog of SEQ ID NO 148 in the 10/286,264 US patent application
  misc_feature: The sequence is a functional homolog of SEQ ID NO 34 in the 10/374,780 US patent application
  misc_feature: The sequence is a functional homolog of SEQ ID NO 438 in the 10/225,066 US patent application
  misc_feature: Useful for making plants with altered carbohydrate content
  misc_feature: The sequence is a functional homolog of SEQ ID NO 112 in the 11/375,241 US patent application
  misc_feature: The sequence is a functional homolog of SEQ ID NO 2398 in the 10/374,780 US patent application
  misc_feature: The sequence is a functional homolog of SEQ ID NO 466 in the 10/412,699 US patent application
  misc_feature: The sequence is a functional homolog of SEQ ID NO 580 in the 10/225,066 US patent application
  misc_feature: The sequence is a functional homolog of SEQ ID NO 2572 in the 10/374,780 US patent application
  misc_feature: The sequence is a functional homolog of SEQ ID NO 636 in the 10/225,066 US patent application
  misc_feature: The sequence is a functional homolog of SEQ ID NO 838 in the 10/412,699 US patent application
  misc_feature: The sequence is a functional homolog of SEQ ID NO 116 in the 11/375,241 US patent application
  misc_feature: The sequence is a functional homolog of SEQ ID NO 1648 in the 11/479,226 US patent application
  misc_feature: The sequence is a functional homolog of SEQ ID NO 2566 in the 10/374,780 US patent application
  misc_feature: The sequence is a functional homolog of SEQ ID NO 632 in the 10/225,066 US patent application
  misc_feature: The sequence is a functional homolog of SEQ ID NO 650 in the 11/435,388 US patent application
  misc_feature: The sequence is a functional homolog of SEQ ID NO 826 in the 10/412,699 US patent application
  misc_feature: The sequence is a functional homolog of SEQ ID NO 18 in the 11/375,241 US patent application
  misc_feature: The sequence is a functional homolog of SEQ ID NO 426 in the 10/374,780 US patent application
  misc_feature: The sequence is a functional homolog of SEQ ID NO 458 in the 10/225,066 US patent application
  misc_feature: The sequence is a functional homolog of SEQ ID NO 1118 in the 10/225,066 US patent application
  misc_feature: The sequence is a functional homolog of SEQ ID NO 1396 in the 11/479,226 US patent application
  misc_feature: The sequence is a functional homolog of SEQ ID NO 2488 in the 10/374,780 US patent application
  misc_feature: The sequence is a functional homolog of SEQ ID NO 658 in the 10/412,699 US patent application
  misc_feature: The sequence is a functional homolog of SEQ ID NO 116 in the 10/412,699 US patent application
  misc_feature: The sequence is a functional homolog of SEQ ID NO 280 in the 11/479,226 US patent application
  misc_feature: The sequence is a functional homolog of SEQ ID NO 569 in the 10/374,780 US patent application
  misc_feature: The sequence is a functional homolog of SEQ ID NO 1680 in the 11/479,226 US patent application
  misc_feature: The sequence is a functional homolog of SEQ ID NO 202 in the 10/666,642 US patent application
  misc_feature: The sequence is a functional homolog of SEQ ID NO 852 in the 10/412,699 US patent application
  misc_feature: The sequence is a functional homolog of SEQ ID NO 156 in the 10/412,699 US patent application
  misc_feature: The sequence is a functional homolog of SEQ ID NO 164 in the 10/412,699 US patent application
  misc_feature: The sequence is a functional homolog of SEQ ID NO 1754 in the 10/412,699 US patent application
  misc_feature: The sequence is a functional homolog of SEQ ID NO 1978 in the 10/374,780 US patent application
  misc_feature: The sequence is a functional homolog of SEQ ID NO 353 in the 11/479,226 US patent application
  misc_feature: The sequence is a functional homolog of SEQ ID NO 369 in the 11/479,226 US patent application
  misc_feature: The sequence is a functional homolog of SEQ ID NO 40 in the 10/374,780 US patent application
  misc_feature: The sequence is a functional homolog of SEQ ID NO 776 in the 10/225,066 US patent application
  misc_feature: The sequence is a functional homolog of SEQ ID NO 148 in the 10/412,699 US patent application
  misc_feature: The sequence is a functional homolog of SEQ ID NO 2266 in the 10/374,780 US patent application
  misc_feature: The sequence is a functional homolog of SEQ ID NO 341 in the 11/479,226 US patent application
  misc_feature: The sequence is a functional homolog of SEQ ID NO 58 in the 11/375,241 US patent application
  misc_feature: The sequence is a functional homolog of SEQ ID NO 160 in the 10/412,699 US patent application
  misc_feature: The sequence is a functional homolog of SEQ ID NO 214 in the 10/225,068 US patent application
  misc_feature: The sequence is a functional homolog of SEQ ID NO 2270 in the 10/374,780 US patent application
  misc_feature: The sequence is a functional homolog of SEQ ID NO 361 in the 11/479,226 US patent application
  misc_feature: The sequence is a functional homolog of SEQ ID NO 462 in the 10/225,066 US patent application
  misc_feature: The sequence is a functional homolog of SEQ ID NO 482 in the 11/435,388 US patent application
  misc_feature: The sequence is a functional homolog of SEQ ID NO 1901 in the 11/479,226 US patent application
  misc_feature: The sequence is a functional homolog of SEQ ID NO 310 in the 10/374,780 US patent application
  misc_feature: The sequence is a functional homolog of SEQ ID NO 842 in the 10/225,066 US patent application
  misc_feature: The sequence is a functional homolog of SEQ ID NO 2570 in the 10/374,780 US patent application
  misc_feature: The sequence is a functional homolog of SEQ ID NO 634 in the 10/225,066 US patent application
  misc_feature: The sequence is a functional homolog of SEQ ID NO 832 in the 10/412,699 US patent application
  misc_feature: The sequence is a functional homolog of SEQ ID NO 1056 in the 11/479,226 US patent application
  misc_feature: The sequence is a functional homolog of SEQ ID NO 144 in the 10/374,780 US patent application
  misc_feature: The sequence is a functional homolog of SEQ ID NO 458 in the 10/412,699 US patent application
  misc_feature: The sequence is a functional homolog of SEQ ID NO 756 in the 10/225,066 US patent application
  misc_feature: The sequence is a functional homolog of SEQ ID NO 2 in the 10/225,068 US patent application
  misc_feature: The sequence is a functional homolog of SEQ ID NO 22 in the 10/225,068 US patent application
  misc_feature: The sequence is a functional homolog of SEQ ID NO 230 in the 10/225,066 US patent application
  misc_feature: The sequence is a functional homolog of SEQ ID NO 258 in the 10/374,780 US patent application
  misc_feature: The sequence is a functional homolog of SEQ ID NO 442 in the 11/435,388 US patent application
  misc_feature: The sequence is a functional homolog of SEQ ID NO 842 in the 10/412,699 US patent application
  misc_feature: The sequence is a functional homolog of SEQ ID NO 98 in the 11/375,241 US patent application
  misc_feature: The sequence is a functional homolog of SEQ ID NO 1074 in the 10/412,699 US patent application
  misc_feature: The sequence is a functional homolog of SEQ ID NO 590 in the 10/374,780 US patent application
  misc_feature: The sequence is a functional homolog of SEQ ID NO 726 in the 11/435,388 US patent application
  misc_feature: The sequence is a functional homolog of SEQ ID NO 446 in the 10/412,699 US patent application
  misc_feature: The sequence is a functional homolog of SEQ ID NO 822 in the 10/412,699 US patent application
  misc_feature: The sequence is a functional homolog of SEQ ID NO 170 in the 10/412,699 US patent application
  misc_feature: The sequence is a functional homolog of SEQ ID NO 1756 in the 10/412,699 US patent application
  misc_feature: The sequence is a functional homolog of SEQ ID NO 1980 in the 10/374,780 US patent application
  misc_feature: The sequence is a functional homolog of SEQ ID NO 750 in the 10/225,066 US patent application
  misc_feature: The sequence is a functional homolog of SEQ ID NO 592 in the 10/374,780 US patent application
  misc_feature: The sequence is a functional homolog of SEQ ID NO 786 in the 11/435,388 US patent application
  misc_feature: The sequence is a functional homolog of SEQ ID NO 1681 in the 10/374,780 US patent application
  misc_feature: The sequence is a functional homolog of SEQ ID NO 36 in US patent 7193132
  misc_feature: The sequence is a functional homolog of SEQ ID NO 124 in the 10/412,699 US patent application
  misc_feature: The sequence is a functional homolog of SEQ ID NO 1742 in the 10/412,699 US patent application
  misc_feature: The sequence is a functional homolog of SEQ ID NO 1966 in the 10/374,780 US patent application
  misc_feature: The sequence is a functional homolog of SEQ ID NO 299 in the 11/479,226 US patent application
  misc_feature: The sequence is a functional homolog of SEQ ID NO 178 in the 10/412,699 US patent application
  misc_feature: The sequence is a functional homolog of SEQ ID NO 389 in the 11/479,226 US patent application
  misc_feature: The sequence is a functional homolog of SEQ ID NO 266 in the 10/374,780 US patent application
  misc_feature: The sequence is a functional homolog of SEQ ID NO 536 in the 11/435,388 US patent application
  misc_feature: The sequence is a functional homolog of SEQ ID NO 640 in the 10/225,066 US patent application
  misc_feature: The sequence is a functional homolog of SEQ ID NO 856 in the 10/412,699 US patent application
  misc_feature: Useful for making plants with modulated low light sensitivity
  misc_feature: The sequence is a functional homolog of SEQ ID NO 792 in the 11/435,388 US patent application
  misc_feature: The sequence is a functional homolog of SEQ ID NO 788 in the 11/435,388 US patent application
  misc_feature: The sequence is a functional homolog of SEQ ID NO 184 in the 10/412,699 US patent application
  misc_feature: The sequence is a functional homolog of SEQ ID NO 397 in the 11/479,226 US patent application
  misc_feature: The sequence is a functional homolog of SEQ ID NO 46 in the 10/374,780 US patent application
  misc_feature: The sequence is a functional homolog of SEQ ID NO 590 in the 11/435,388 US patent application
  misc_feature: The sequence is a functional homolog of SEQ ID NO 6 in the 10/225,068 US patent application
  misc_feature: The sequence is a functional homolog of SEQ ID NO 794 in the 11/435,388 US patent application
  misc_feature: Useful for making plants with modulated flowering time
  misc_feature: The sequence is a functional homolog of SEQ ID NO 593 in the 10/374,780 US patent application
  misc_feature: The sequence is a functional homolog of SEQ ID NO 782 in the 11/435,388 US patent application
  misc_feature: The sequence is a functional homolog of SEQ ID NO 1100 in the 10/225,066 US patent application
  misc_feature: The sequence is a functional homolog of SEQ ID NO 158 in the 10/412,699 US patent application
  misc_feature: The sequence is a functional homolog of SEQ ID NO 2268 in the 10/374,780 US patent application
  misc_feature: The sequence is a functional homolog of SEQ ID NO 357 in the 11/479,226 US patent application
  misc_feature: The sequence is a functional homolog of SEQ ID NO 480 in the 11/435,388 US patent application
  misc_feature: The sequence is a functional homolog of SEQ ID NO 1672 in the 11/479,226 US patent application
  misc_feature: The sequence is a functional homolog of SEQ ID NO 846 in the 10/412,699 US patent application
  misc_feature: The sequence is a functional homolog of SEQ ID NO 790 in the 11/435,388 US patent application
  misc_feature: The sequence is a functional homolog of SEQ ID NO 1566 in the 10/374,780 US patent application
  misc_feature: The sequence is a functional homolog of SEQ ID NO 200 in the 10/666,642 US patent application
  misc_feature: The sequence is a functional homolog of SEQ ID NO 830 in the 10/412,699 US patent application
  misc_feature: The sequence is a functional homolog of SEQ ID NO 796 in the 11/435,388 US patent application
  misc_feature: The sequence is a functional homolog of SEQ ID NO 263 in the 11/479,226 US patent application
  misc_feature: The sequence is a functional homolog of SEQ ID NO 478 in the 11/435,388 US patent application
  misc_feature: The sequence is a functional homolog of SEQ ID NO 54 in the 10/666,642 US patent application
  misc_feature: The sequence is a functional homolog of SEQ ID NO 1072 in the 10/412,699 US patent application
  misc_feature: The sequence is a functional homolog of SEQ ID NO 1073 in the 10/412,699 US patent application
  misc_feature: The sequence is a functional homolog of SEQ ID NO 588 in the 10/374,780 US patent application
  misc_feature: The sequence is a functional homolog of SEQ ID NO 589 in the 10/374,780 US patent application
  misc_feature: The sequence is a functional homolog of SEQ ID NO 730 in the 11/435,388 US patent application
  misc_feature: The sequence is a functional homolog of SEQ ID NO 1071 in the 10/412,699 US patent application
  misc_feature: The sequence is a functional homolog of SEQ ID NO 587 in the 10/374,780 US patent application
  misc_feature: The sequence is a functional homolog of SEQ ID NO 728 in the 11/435,388 US patent application
  misc_feature: The sequence is a functional homolog of SEQ ID NO 743 in the 10/666,642 US patent application
  misc_feature: The sequence is a functional homolog of SEQ ID NO 1656 in the 11/479,226 US patent application
  misc_feature: The sequence is a functional homolog of SEQ ID NO 834 in the 10/412,699 US patent application
  misc_feature: The sequence is a functional homolog of SEQ ID NO 1563 in the 10/374,780 US patent application
  misc_feature: The sequence is a functional homolog of SEQ ID NO 1572 in the 10/374,780 US patent application
  misc_feature: Useful for making plants with modulated drought sensitivity
  misc_feature: The sequence is a functional homolog of SEQ ID NO 1746 in the 10/412,699 US patent application
  misc_feature: The sequence is a functional homolog of SEQ ID NO 1970 in the 10/374,780 US patent application
  misc_feature: The sequence is a functional homolog of SEQ ID NO 452 in the 10/225,066 US patent application
  misc_feature: The sequence is a functional homolog of SEQ ID NO 584 in the 11/435,388 US patent application
  misc_feature: The sequence is a functional homolog of SEQ ID NO 594 in the 10/374,780 US patent application
  misc_feature: The sequence is a functional homolog of SEQ ID NO 784 in the 11/435,388 US patent application
  misc_feature: The sequence is a functional homolog of SEQ ID NO 1914 in the 10/412,699 US patent application
  misc_feature: The sequence is a functional homolog of SEQ ID NO 2174 in the 10/374,780 US patent application
  misc_feature: The sequence is a functional homolog of SEQ ID NO 956 in the 10/225,066 US patent application
  misc_feature: The sequence is a functional homolog of SEQ ID NO 232 in the 10/225,066 US patent application
  misc_feature: The sequence is a functional homolog of SEQ ID NO 264 in the 10/374,780 US patent application
  misc_feature: The sequence is a functional homolog of SEQ ID NO 534 in the 11/435,388 US patent application
  misc_feature: The sequence is a functional homolog of SEQ ID NO 1626 in the 10/412,699 US patent application
  misc_feature: The sequence is a functional homolog of SEQ ID NO 979 in the 10/666,642 US patent application
  misc_feature: The sequence is a functional homolog of SEQ ID NO 1434 in the 10/666,642 US patent application
  misc_feature: The sequence is a functional homolog of SEQ ID NO 1850 in the 10/412,699 US patent application
  misc_feature: The sequence is a functional homolog of SEQ ID NO 848 in the 10/412,699 US patent application
  misc_feature: The sequence is a functional homolog of SEQ ID NO 1540 in the 10/374,780 US patent application
  misc_feature: The sequence is a functional homolog of SEQ ID NO 1634 in the 10/412,699 US patent application
  misc_feature: The sequence is a functional homolog of SEQ ID NO 126 in the 10/412,699 US patent application
  misc_feature: The sequence is a functional homolog of SEQ ID NO 2178 in the 10/374,780 US patent application
  misc_feature: The sequence is a functional homolog of SEQ ID NO 196 in the 10/225,066 US patent application
  misc_feature: The sequence is a functional homolog of SEQ ID NO 2900 in the 10/374,780 US patent application
  misc_feature: The sequence is a functional homolog of SEQ ID NO 1031 in the 11/479,226 US patent application
  misc_feature: The sequence is a functional homolog of SEQ ID NO 1804 in the 10/412,699 US patent application
  misc_feature: The sequence is a functional homolog of SEQ ID NO 2050 in the 10/374,780 US patent application
  misc_feature: The sequence is a functional homolog of SEQ ID NO 444 in the 10/412,699 US patent application
  misc_feature: The sequence is a functional homolog of SEQ ID NO 598 in the 10/225,066 US patent application
  misc_feature: The sequence is a functional homolog of SEQ ID NO 620 in the 11/435,388 US patent application
  misc_feature: Useful for making plants with enhanced nutritional value
  misc_feature: Useful for making plants with modulated heat sensitivity
  misc_feature: The sequence is a functional homolog of SEQ ID NO 1688 in the 11/479,226 US patent application
  misc_feature: The sequence is a functional homolog of SEQ ID NO 1852 in the 10/412,699 US patent application
  misc_feature: The sequence is a functional homolog of SEQ ID NO 2094 in the 10/374,780 US patent application
  misc_feature: The sequence is a functional homolog of SEQ ID NO 1692 in the 11/479,226 US patent application
  misc_feature: The sequence is a functional homolog of SEQ ID NO 1408 in the 11/479,226 US patent application
  misc_feature: The sequence is a functional homolog of SEQ ID NO 664 in the 10/412,699 US patent application
  misc_feature: The sequence is a functional homolog of SEQ ID NO 1565 in the 10/374,780 US patent application
  misc_feature: The sequence is a functional homolog of SEQ ID NO 168 in the 10/225,066 US patent application
  misc_feature: The sequence is a functional homolog of SEQ ID NO 2718 in the 10/374,780 US patent application
  misc_feature: The sequence is a functional homolog of SEQ ID NO 2556 in the 10/374,780 US patent application
  misc_feature: The sequence is a functional homolog of SEQ ID NO 272 in the 10/225,066 US patent application
  misc_feature: The sequence is a functional homolog of SEQ ID NO 528 in the 11/435,388 US patent application
  misc_feature: The sequence is a functional homolog of SEQ ID NO 1916 in the 10/412,699 US patent application
  misc_feature: The sequence is a functional homolog of SEQ ID NO 2176 in the 10/374,780 US patent application
  misc_feature: The sequence is a functional homolog of SEQ ID NO 1541 in the 10/374,780 US patent application
  misc_feature: The sequence is a functional homolog of SEQ ID NO 1635 in the 10/412,699 US patent application
  misc_feature: The sequence is a functional homolog of SEQ ID NO 1015 in the 11/479,226 US patent application
  misc_feature: The sequence is a functional homolog of SEQ ID NO 138 in the 10/374,780 US patent application
  misc_feature: The sequence is a functional homolog of SEQ ID NO 436 in the 10/412,699 US patent application
  misc_feature: The sequence is a functional homolog of SEQ ID NO 60 in the 11/375,241 US patent application
  misc_feature: The sequence is a functional homolog of SEQ ID NO 186 in the 10/412,699 US patent application
  misc_feature: The sequence is a functional homolog of SEQ ID NO 1564 in the 10/374,780 US patent application
  misc_feature: The sequence is a functional homolog of SEQ ID NO 156 in the 10/225,068 US patent application
  misc_feature: The sequence is a functional homolog of SEQ ID NO 262 in the 10/374,780 US patent application
  misc_feature: The sequence is a functional homolog of SEQ ID NO 282 in the 10/225,066 US patent application
  misc_feature: The sequence is a functional homolog of SEQ ID NO 176 in the 10/412,699 US patent application
  misc_feature: The sequence is a functional homolog of SEQ ID NO 385 in the 11/479,226 US patent application
  misc_feature: The sequence is a functional homolog of SEQ ID NO 2696 in the 10/374,780 US patent application
  misc_feature: The sequence is a functional homolog of SEQ ID NO 344 in the 10/225,066 US patent application
  misc_feature: The sequence is a functional homolog of SEQ ID NO 1652 in the 11/479,226 US patent application
  misc_feature: The sequence is a functional homolog of SEQ ID NO 2568 in the 10/374,780 US patent application
  misc_feature: The sequence is a functional homolog of SEQ ID NO 60 in the 10/225,066 US patent application
  misc_feature: The sequence is a functional homolog of SEQ ID NO 828 in the 10/412,699 US patent application
  misc_feature: The sequence is a functional homolog of SEQ ID NO 2898 in the 10/374,780 US patent application
  misc_feature: The sequence is a functional homolog of SEQ ID NO 494 in the 10/225,066 US patent application
  misc_feature: The sequence is a functional homolog of SEQ ID NO 150 in the 10/412,699 US patent application
  misc_feature: The sequence is a functional homolog of SEQ ID NO 830 in the 11/435,388 US patent application
MGRLSCGGGVQPKLRKGLWSPEEDEKLYNHIIRHGVGCWSSVPKLAGLQRCGKSCRLRWINYLRPDLKRGSFSQQEGDLILALHEILGNRWSQIASHLPGRTDNEIKNFWNSCLKKKLRQRGIDPSTHKPIAGA

SEQ ID NO: 15273 - DNA, 664 bp, Panicum virgatum
  misc_feature: Ceres CLONE 1781672-R
cggacgccggcgggttcgtcgccgactacagcagcgtgctggacgtgtcgaagaacctggggtacggggagagctccagcaacagtagcaactggacctgcgccgagatgagctgcgcggtgctcgacagcgaggtgctgcactgggcctccggcggcggcggcggcgacgccgcgaagccggagccgtacacggagctggagcggcagcagcacagcggaggctacggcggcgtggagcaggcggtggacgacgacgacgcgctggagcacaagttctcgctgccctgcggccaagagcagagcctagcgcatttcgacttcaacttggaatacttctgatcttttctctctctcgtttgcccttcattcacctttgcctccctgaactatcgatccattccccaacgttttacacacaagaggaagaaagaagcattggaagattagggattgcacttagtagtaaccactatgttaatttcctctagcccacaccacactcctttttttcccccataccttttctgtataccctgcttctgcttggtcagaagaacagacagacagtgagtggtagatacgagaatattgtgtacgtactataaacaaagattttttttcctgtaaagaataaattaattaaacctgcagttgtgttgtgc

SEQ ID NO: 15274 - DNA, 1945 bp, Panicum virgatum
  misc_feature: Ceres CLONE 1781674
  misc_feature: Encodes the peptide sequence at SEQ ID NO. 15275
gctccccaagatgaatgctactacataggtagagtcgtagagagtgttcttgtggtgatcatctgacctagatagagtgccgagatgggagaggctgaggaagcaccagaaggcagcagccatggtgaggcattggtgctcatcatgtccatggcgtcctcttcactggcctgctctgtctcacagttcccagcgaagtggcaatccatcaaggacaagcttcaacagctctgctgcagcctaaattcattgtgctgcagcgtcggcgtcgtcgacggcaatggcgatgacgaggagcatcctgtgttgctcgagcttctgcagtcggcgtcagcaaccttgaggagcatccaggctgttgcttctcaatgcagcgatgggtcatacaagggtggaaggctccgtctgaggagtgacctggacaacctgagctgcaagcttgatgcacacatgaagcagctcaaggagatggcttcctccggggtgccgtcgccgtcgaaggccattgttaccgtaaggcccggcgccgatgccagcgcaggtgagaagacgttctacctcaaggatctcttctccaggatcaggattggtggcaccgtccagaggagccaggcattgggcaccattagagagctcttggcagaagatgaattgtgtgcaaaggttgtcgctctcgacatcgacgacggcatcaccttcctcaccgggtttctcgagtcgacggacgcgtgcatccaagaagaggctgcaggtgctgtcgccattgttgcgagctccgagcgttacagaggaatgctggttaaggcagggatgatcgcccccctcgtccagctgctggagaacacagacacggccagtgagctgggcaaggagagagctgctcaggcgctgagggagctgacggagaactcggacaacgtgtgggccgtctgcgcgcacggcggcctcaccactctgttgcacgcctgcgcagcagacgccggcggcagcagcaagctgatcagctcatcttttgcagtgctgaggaacctgagccgggtggaggaagtgaagatgttcatggtagagcaaggggtggtcacggagctggtgaagctctcccagaagaaggaagaggtccgcaagctcggcgccgtcgaattgctccatgccatggctctggatgatgccgatgtcagagaggaagccgtcagcatgggggtgatccagtcactccttcagttgatataccctgaccttccatactcatacaaggccagggaggtcgctcttgcagccatttggttcttctgcttttcttctgcaaactccatagatgacctcatcagctcagatgttcttggttggctgctcttctatctcaacaatggcgactacgctgttctcgaatgcactctcaagatcctgaggcatctctctgaagtttccgaggagtacaaccggatgatgggaagagcagggtatttgagtgccctctcaagcttgcttggggcgaaatcatgccgagttcgggaaatggcagctcaggtgctttccagcttactgatacttcaccctaaccgcaccatttttattcaagatggcgataatttggacaggctgctgcagctgcttgatccagctgagggtaagttgatagcaaaggacttgatcctctctgctattatgtccttgactgagaccaacagtggaaagaagaaaattgtgacatcagagcacttctgcagcctgaaagaactagcagattctggtgacttcaatgccaagaagatcgtcaggaaactatctactaacagactgcaaaccattttcagtaaaatatggagtgtttaagttatttctaacccttacttttcactaagatttagctatagtttgtcttgtccatagtttttgctttgcttgtaatctcaacatatccatcagtatgattcgtgtgtgatgt

SEQ ID NO: 15275 - protein, 582 aa, Panicum virgatum
  misc_feature: Ceres CLONE 1781674
  misc_feature (231)..(274): Pfam Name: Arm Pfam Description: Armadillo/beta-catenin-like repeat
MGEAEEAPEGSSHGEALVLIMSMASSSLACSVSQFPAKWQSIKDKLQQLCCSLNSLCCSVGVVDGNGDDEEHPVLLELLQSASATLRSIQAVASQCSDGSYKGGRLRLRSDLDNLSCKLDAHMKQLKEMASSGVPSPSKAIVTVRPGADASAGEKTFYLKDLFSRIRIGGTVQRSQALGTIRELLAEDELCAKVVALDIDDGITFLTGFLESTDACIQEEAAGAVAIVASSERYRGMLVKAGMIAPLVQLLENTDTASELGKERAAQALRELTENSDNVWAVCAHGGLTTLLHACAADAGGSSKLISSSFAVLRNLSRVEEVKMFMVEQGVVTELVKLSQKKEEVRKLGAVELLHAMALDDADVREEAVSMGVIQSLLQLIYPDLPYSYKAREVALAAIWFFCFSSANSIDDLISSDVLGWLLFYLNNGDYAVLECTLKILRHLSEVSEEYNRMMGRAGYLSALSSLLGAKSCRVREMAAQVLSSLLILHPNRTIFIQDGDNLDRLLQLLDPAEGKLIAKDLILSAIMSLTETNSGKKKIVTSEHFCSLKELADSGDFNAKKIVRKLSTNRLQTIFSKIWSV

SEQ ID NO: 15276 - DNA, 660 bp, Panicum virgatum
  misc_feature: Ceres CLONE 1781676-R
  misc_feature: Encodes the peptide sequence at SEQ ID NO. 15277
agaggcggaggaagaaggcgatggcgcgcggcgtggcggcgggggcgaagggcggcgcggccggcgggaagaagaagggctccgtcaccttcacgatcgactgcaccaagcccgtggaggacaagatcatggagatcgccacgctcgagaagttcctgcaggagcgcatcaaggtcgccggcggcaaggccggcaacctcggcgagggcgtcaccgtctcccgcgacaagaccaaggtcaccgtcacctccgaggggcctttctccaagaggtacctcaagtacttgaccaagaagtacctgaagaagcacaatgtgcgtgactggctccgggtcatcgcgtcgaacaaggaccgcagcgtctatgagctacggtacttcaacattgccgagaatgagggtgaggaggaggattaggcgcactaccttatctatgtcttgtgaacttttggacgtgttggaacagtcttgctgtagcctttcaagggatgagttttgatgtttaaattgatgtcctgatgtgtttgaagagtggtgaacttccatgtgatgcttagataatctgagtccaaaaatgtttgttcttgcttgtctgtgaaacacatcatcagcgatttatcgttaggttgtcgctatgattgtctatcgaactggttatatc

SEQ ID NO: 15277 - protein, 131 aa, Panicum virgatum; identical to SEQ ID NO: 12248
  misc_feature: Ceres CLONE 1781676-R
  misc_feature (17)..(131): Pfam Name: Ribosomal_L22e Pfam Description: Ribosomal L22e protein family

SEQ ID NO: 15278 - DNA, 716 bp, Panicum virgatum
  misc_feature: Ceres CLONE 1781676
acacttgtctcgtcgtccactcggctctcgtccccgccccgccttatctcctctcccgcgctccaccaccatccccaccaaaaccagtcggagctcaggtcaccagcacggccgcacctcgatcgcgcccgcccgcgtcggaaagcagagcagagcacgcgagatggtgggcgccgcacccatggccgcgccgccgctcgcggccctccgcctcggcggcctcctccgggtctcctgctccgcgtccaagagcaacggcggccccaagcagcagcagcagctagcgcggcggcggcagcagcagcagctgcccgctcctccgctgagctccgcggcggtgccgctgctgctggctgcggcggcgctgccgccggacgcgctggcggcggggggcgagttcgggatcctcgagggccggagcttcgcgctgctgcacccgctcgtcatgggcgggctcttcggctacacgctctgggccgggtaccttggctggcagtggcgccgggtgcgcaccgtccaggacgagatcaacgacctcaagaagcagctcaagcccgccgccgcggcggcgccggccgcggtcggggccggggacgcctcctcctccgctgcgccgccgcctcccgcgcccaagtcgccggccgagatcaagatcgacgagctcaccgaggagcgcaagargctgctcaaggggtcgttccgggaccggcacttca

SEQ ID NO: 15279 - DNA, 678 bp, Panicum virgatum
  misc_feature: Ceres CLONE 1781688
  misc_feature: Encodes the peptide sequence at SEQ ID NO. 15280
atacccattctgttcccctcccaaacaaaacttgctttgaaatctcgcttcactgcgaacgctgcagcggaggaagaaagaagaagaaaaaaaacaattcgtagcggaaatcagcaagcaaaagaaaataatttccataagaaatcgcccaatcccccttcctccttttctcttgaggcttcggaacgtgcggggaacttagccaggatggtggcgatcgagaaccagagccaggtcgcgcgggcggcggcggcggaggcggtgccggcagcggggccgcggatccccaaggaggcgcgacggctgctgcacgacctggcggcggcgtgggcggacgtgtcggactgccgcgcgctccaggtcgtgccgctcaagggcgccatgaccaacgaggtgtaccaggtgcgctggctcaccggcgtcccctccgctggcggcgaggcggaggagccccggggggagagggaggtgaggaaggtgctcgtgcggatatacggcgacggcgtcgacctcttcttcgaccgcgaggacgaggtgcgcaccttcgagtgcatgtcccgccacggccagggtccccgcctcctcggccgcttccccaacggccgcgtcgaggagttcatccacgcaaggacactgtcagctgccgaccttcgagatcctgagatttcagctctcgtt

SEQ ID NO: 15280 - protein, 156 aa, Panicum virgatum
  misc_feature: Ceres CLONE 1781688
  misc_feature (1)..(50): Pfam Name: Choline_kin_N Pfam Description: Choline kinase N terminus
  misc_feature: SWISSPROT Homolog: EC 2.7.1.82 Ethanolamine kinase
MVAIENQSQVARAAAAEAVPAAGPRIPKEARRLLHDLAAAWADVSDCRALQVVPLKGAMTNEVYQVRWLTGVPSAGGEAEEPRGEREVRKVLVRIYGDGVDLFFDREDEVRTFECMSRHGQGPRLLGRFPNGRVEEFIHARTLSAADLRDPEISAL

SEQ ID NO: 15281 - DNA, 1109 bp, Panicum virgatum
  misc_feature: Ceres CLONE 1781692
  misc_feature: Encodes the peptide sequence at SEQ ID NO. 15282
aaaaaaaaaaaaaaaaaaagctccgtgcaccacatggacatggaggtcaaggaaggcaagccggcttctctactaccaccgtcccgtctgggctacctgcttattctgcatccccgtctggctcttctagctcatcgcgtcggttctcggatcgtcttcgtctctgctcgtgcggcggagctcatttctgattaggatcttgccggcttcttgtttcatttttcatgcaaaccatggcaggtcggacacgggcgccaagatcttgaatgggtttgctgagttgggctatggttgggttgcagggatggagagcgacgaggagataaggagagtgccggagctgggcctggagctccccggcggcgcttccacgtcgggcagggaggccggagttggcgccggcggcccggagcgcgcccagtcgtccacggcgcaggccagctcgcgccgccgcgtgcgcagccccgccgacaaggagcacaagcgcctcaaaagattactgaggaaccgggtgtcagcccaacaggcaagagagaggaagaaggcttatctgactgacctagaggtgaaggtaaaggacctggagaagaagaactcagagatcgaagagaagctctccaccctccagaacgagaaccagatgctccgacagatactgaagaacaccactgtaagcagaagaggcccaggcagcactgctagtggagagggccaatagcacagaagctgaggacaaatagttatgcttttatgccaaaaaatatatatatatacttatgtggaatggatttggtcagggcgttttctagccgaagaagagaaccccaaaaaaactggggtgaagaaattgtgaagacggtcatatagtatcgcactgtattactatccgaccaggggcggatccagcttgtgggtctggaggggctcgagcccctccgacatccgtgtccgatgtacagatcgttcagggggaaaacttgtggaatgcttgaacatatatcgtatcattttgagacatttaacatctttacataccccctggtctgcaattagtttgtaaatgagattgtgcattagagtaatcaatatcagttctggaactagtgagt

SEQ ID NO: 15282 - protein, 137 aa, Panicum virgatum
  misc_feature: Ceres CLONE 1781692
  misc_feature (56)..(119): Pfam Name: bZIP_1 Pfam Description: bZIP transcription factor
  misc_feature: The sequence is a functional homolog of SEQ ID NO 206 in the 10/225,066 US patent application
  misc_feature: The sequence is a functional homolog of SEQ ID NO 2356 in the 10/374,780 US patent application
  misc_feature: The sequence is a functional homolog of SEQ ID NO 827 in the 11/479,226 US patent application
  misc_feature: Useful for making plants with modulated light quality sensitivity
  misc_feature: Useful for making plants with altered alkaloid content
  misc_feature: Useful for making plants with altered terpenoid content
MESDEEIRRVPELGLELPGGASTSGREAGVGAGGPERAQSSTAQASSRRRVRSPADKEHKRLKRLLRNRVSAQQARERKKAYLTDLEVKVKDLEKKNSEIEEKLSTLQNENQMLRQILKNTTVSRRGPGSTASGEGQ

SEQ ID NO: 15283 - DNA, 629 bp, Panicum virgatum
  misc_feature: Ceres CLONE 1781693
  misc_feature: Encodes the peptide sequence at SEQ ID NO. 15284
ttcaagagaaagggcgatgacctcttttatgagcacactctgaccctgactgaatctctctgcggcttccagtttgttctgacccacttggataacaggcagctgctaatcaaatcaaagcccggtgaagttgtcaagcctgactcgttcaaggcgatcaacgatgagggcatgcccatgtaccagaggcccttcatgaagggcaaactgtacatccacttctcggtggagttccccgactctttgaacccggagcagtgcaaggccctggaggctgtcctcccggccaagccagcatcgcagtacacggacatggagctagatgagtgtgaggagacgatgccgtacgatgtgaacatcgaggaggagctgcggaggcggcagcaacagcaccaggaggcctacgacgaggacgaggacatgccgggcggcgcgcagagggtgcagtgcgcccagcagtaggcgctgtaggcagatttgtttgacggtggcggcaaatttgttgtttcgctctatgcgagtactgttgggtcccaaagttttctcgcgtattatgtgatgatactttcggttctaaaaatactacaatattcgctcagtggagcagaaggttttgcgtgttttccgtt

SEQ ID NO: 15284 - protein, 153 aa, Panicum virgatum
  misc_feature: Ceres CLONE 1781693
  misc_feature (1)..(94): Pfam Name: DnaJ_C Pfam Description: DnaJ C terminal region
FKRKGDDLFYEHTLTLTESLCGFQFVLTHLDNRQLLIKSKPGEVVKPDSFKAINDEGMPMYQRPFMKGKLYIHFSVEFPDSLNPEQCKALEAVLPAKPASQYTDMELDECEETMPYDVNIEEELRRRQQQHQEAYDEDEDMPGGAQRVQCAQQ

SEQ ID NO: 15285 - DNA, 745 bp, Panicum virgatum
  misc_feature: Ceres CLONE 1781712
  misc_feature: Encodes the peptide sequence at SEQ ID NO. 15286
cggcgctttccggccgagctcattttttctgcccccgcaccacgcccggctgcgtttcggagatcaggtaggaagcggagccctgctagcgctagcgagtgaggagccgcgcgaacgagggtttttgatccgaatcccatggccggcgccggggcggacggggagcgccggatcggcgtggcgatggactactcggacagctccaagaaggcgctggcgtgggccgtcgacaacctgctccgccacggggacaccctcgtcgtcctccacgtcctgcaccacggcggggaggaggccaagcacacgctctgggccaagtccggatccccgctgatccctctctccgagttccgggagcccgaggtgatgaagaactacggcgtcaaagccgacgccgaggtgctcgacatgatcgacacggcggcgcgccagaagctgctcaaggtggtggccaagctttactggggcgacgccagggagaagatctgcgacggcgtcgaggagctcaagatcgactccctcgtcatgggcagccgcggcctcggcccgatccagaggatccttttgggaagtgtgacaaactacgtgctgtcgcacgcatcgtgcccggtgacagtcgtcaaggggaagtaatgacccggccaacctaccagctatatgatcgaggatggtagcatgcagtttgtgtggattaagcactgtgaatctgtgatcggtgttaccgcatttgaataaagtgtggctt

SEQ ID NO: 15286 - protein, 164 aa, Panicum virgatum
  misc_feature: Ceres CLONE 1781712
  misc_feature (8)..(162): Pfam Name: Usp Pfam Description: Universal stress protein family
  misc_feature: Useful for making plants with altered lignin content
  misc_feature: Useful for making plants with modulated biomass
  misc_feature: Useful for making plants with altered alkaloid content
MAGAGADGERRIGVAMDYSDSSKKALAWAVDNLLRHGDTLVVLHVLHHGGEEAKHTLWAKSGSPLIPLSEFREPEVMKNYGVKADAEVLDMIDTAARQKLLKVVAKLYWGDAREKICDGVEELKIDSLVMGSRGLGPIQRILLGSVTNYVLSHASCPVTVVKGK

SEQ ID NO: 15287 - DNA, 681 bp, Panicum virgatum
  misc_feature: Ceres CLONE 1781712-R
tgtgaatcagctagagaaagcaaactgcagagtagcacacgtacagcaaaaagcccagccttcaggttccagcgcaacgtgattccaagggagatggagatggaggggaagaagatgagccggctgccggaggtgaccatcgacacagcgtcaaggccggcggcgggcgttggcggcggcatcgacgcggggaaggcggcgggcaaggagccgaccagcccgggcacgccgtcctcggtggacgccggccgccgcagcggcaaggagaggcgcgcggagaacggcgtccccctgcccgggtggaagctcgacgccctctgccaggaatcctgcccgtcgccgaccatgagggcgcgctttccttacttctaaaagccgccggcgatggcgctcgctgcaggcctgcatgagtttcaatcaagcggcaaagcctagtggtttgaatgcccgatgatgttcctgggcgtcatctccttgtccttgacatttttcttgttgtgcatgtacatatgaatccatggaactcggagcttttcatgtgtcttgtcagtgctcagattgcacaaatggtgaaccatcagtcgattgtatgatgattgtacatgattatctgaaacaatccttcaggcttcagtagatgtatgtacaagttttactacttatattctatgaaattgattc

SEQ ID NO: 15288 - DNA, 2352 bp, Panicum virgatum
  misc_feature: Ceres CLONE 1781730
  misc_feature: Encodes the peptide sequence at SEQ ID NO. 15289
gccgcttgcctgcccctctctctccctcgcccccaccgcgcgcccgggggggaaggggaaagcagcgagcgccgcgccactccgcccgcccgccatggcgccgccggggtgggccgtcgccctcgccgcactctgcctcgccgcgctagcgccgctcgccgcggggttctacctccccggcgtcgtgccccacgacttcgagatgaaagatcctctcccggtgaaagtcaacaagctgacttcaatcaagacccaactgccctactcctactattctctcccattctgcaagccggatacaatagttgacagtgctgaaaaccttggtgaagttcttcgtggtgaccgcattgagaactctccatatacgtttgaaatgagggagcctcagatgtgtcaaattgtttgcaagatttctgtcggggagaaagaagcaaaacttctcaaggaaaagattgaagacgagtaccgcgtcaacatgattcttgacaacctacctctagttgttcctattcaaagaatggatcaagaagatgcttatttctatcagcatggattccatgttggagctaaaggaaaattcttggggagcaaggatgaaaagtacttcatccacaaccatttgtcctttacggtgaaatatcacagggatgaacaaagggatgtttccaggattgtggcctttgaagtgaaaccatacagtgttaagcatgaatatgaagggcagtggaatgataagaagacccgcctgacaacatgtgatcctcatgctcagcgtgtaattacatcatccgaatctcctcaggaggttgaagttggcaaggacatcatatttacttatgatgtggatttcaaggagagtgatatcaaatgggcatctcggtgggacagctatttgctaatgacagatgatcagatccactggttctccattgtgaattctctcatgatcgttctcttcctttctggaatggttgcaatgatcatgctccgtaccctttaccgggatatctccaaatataaccagcttgagactcaggaggaggcccacgaagagactggatggaagcttgtccatggtgatgttttcaggcctccatcaaactctgacttgctctgtgtctatgttggcactggtgtccagttctttggcatgctgcttgtcaccatggtatttgcagttcttggcttcctttctccatcaaataggggtggactaatgacagctatgctcctgctgtgggtattcatggggcttcttgctggctactcttcttcacgtctctacaagttgttcaagggctcagaatggaagaacattgccttgaggacagccttcactttccctggcagcgtgtttgctattttcttcttcttgaatgctcttatctgggggcagaagtcctcaggagctgtaccattcactaccatgtttgctcttgtgctcctttggttcggtatctcagtgccattggtttttgttggaagcttccttggcttcaagaaacctaccattgaagatcctgtgaagacaaacaagataccgaggcagatccctgagcaggcctggtacatgaacccaatcttttcaattttgatcggaggaatccttccctttggagctgtgttcattgagcttttcttcatccttacgtccatctggctgcaacagttctactacatctttgggttcctcttcctcgtcttcctgatccttatcatcacatgtgctgagatctcaattgtgctatgctacttccagctctgcagtgaggattacctgtgatggtggaggtcatacttgacatcgggttcctctgctctctacctgttcttgtatgcaaccttctatttcttcacaaagctagagatcaccaagtttgtctctgccgttctgtactttggctacatgctcattgcctcgtatgccttctttgccttgactggcacgattgggttctatgcttgcttcctgttcacaaggctgatttactcttccgtcaagattgaataaggttcaagtgatctcttgcctaattctttgtttccacgaagaaggattctgcggataaaaaattctacagagaagccctgaaattagctaagcaacctttggttttcagttctcaaagctggtagttatgatgaggtgacgattcgttatcatataattcaggtattatagctagtatagtgactttttgtcttctctattttgttttctattttgggctgtgcctttggactgcaaggatgtatgcttattatgcactccttgcagagcgacctgtatacgaatgctgagtaatctatttcttgttcatgtcagaatctatgtacttgttgacttcc

SEQ ID NO: 15289 - protein, 563 aa, Panicum virgatum
  misc_feature: Ceres CLONE 1781730
  misc_feature (55)..(563): Pfam Name: EMP70 Pfam Description: Endomembrane protein 70
  misc_feature: Useful for making plants with altered cell wall content and/or composition
MAPPGWAVALAALCLAALAPLAAGFYLPGVVPHDFEMKDPLPVKVNKLTSIKTQLPYSYYSLPFCKPDTIVDSAENLGEVLRGDRIENSPYTFEMREPQMCQIVCKISVGEKEAKLLKEKIEDEYRVNMILDNLPLVVPIQRMDQEDAYFYQHGFHVGAKGKFLGSKDEKYFIHNHLSFTVKYHRDEQRDVSRIVAFEVKPYSVKHEYEGQWNDKKTRLTTCDPHAQRVITSSESPQEVEVGKDIIFTYDVDFKESDIKWASRWDSYLLMTDDQIHWFSIVNSLMIVLFLSGMVAMIMLRTLYRDISKYNQLETQEEAHEETGWKLVHGDVFRPPSNSDLLCVYVGTGVQFFGMLLVTMVFAVLGFLSPSNRGGLMTAMLLLWVFMGLLAGYSSSRLYKLFKGSEWKNIALRTAFTFPGSVFAIFFFLNALIWGQKSSGAVPFTTMFALVLLWFGISVPLVFVGSFLGFKKPTIEDPVKTNKIPRQIPEQAWYMNPIFSILIGGILPFGAVFIELFFILTSIWLQQFYYIFGFLFLVFLILIITCAEISIVLCYFQLCSEDYL

SEQ ID NO: 15290 - DNA, 2671 bp, Panicum virgatum
  misc_feature: Ceres CLONE 1781768
  misc_feature: Encodes the peptide sequence at SEQ ID NO. 15291
aacccgtctctctctcctcccttctctctcctaaccgaagagaagaggggacgaaggaaacctcgcgcgagggatcgcgggaggcggaggacccgcggccggtggaggtggctcgcgccggcgccgtgcgagatggagtacatatcccctgagagaaatctggaggggacttgtggagatcctgggccattatttggagaccaagatagtagcctgttggaccacttggattatcagggaggaggaattccacagcatgagtctccaacactggatgatggacttttagtcgatccagctgatgcaattccgtatttatctgcagactctctgcccttcatgaatgatcaaatcacatgcaatgttatgaaatctgcttcaactagttcagaatcatcactgaagcagcttcaagaacctcttaatgtagagtctgatatacatatacagaatgatgcaactgaacaaaatattcacaatagtaactctgaagaacaggtcgcttctgtggactgtgatgtgcatcagaacactgaagtgattggttccgtgctgcctccagagcttcctgaaagcagtggtaatgatacatcaaactttcaaccagaagctgcatattctgatgtgtatcatggtgactctttgttaactgaaaatagcaataaggattgccagcttaacaatagcagtgctgatgatgacgaaattccaaactctcctgcacttcagttggaaaatgaggacatggaaaagttacatgagacttctcacaatgaaaagagtgggtcagaggatgatcaaataaatggtaggaaatctagccccattgatggtagggacaaagagaactttaacacttcagctgaacgacctccctctagggtacagatggagcaggaaaatcctggtactagaaatggcagtttgactccagataatcgttttgattcgcctcctgacaggtttgcaagactggaaagggacacaccgtctcctgatgggagggtatcccctgataggttcgcaagactagaaagggatacaccatcttcagatggaagggtatctcctccggtcagcagtccaaatgcccatcattccgagaagatggagtcgaagtgccatgccaaagatgttgctgatttagctcatgctgaaagcccgcctgaaagacgtcggtccagatcttctgaaaagcatgatcccaaccgcaaaagagtttcttcaagggagttgtctccgcatggacagaaaagacggagggagtcgcgacatggtgataggtcaccacggaggtcaccacggcgaagatctgcatctccccgaagaagatctacaccccctagaagaagatctatatcccctcgaaaaagatctatatcccctcgaaggtcctcatgcaagagggactcaccaaagaggggaggctcacctaggaggaggcactcacctaggaggagggaatcaccgaggaagagagactcaccaaggaggagggattcaccaaagaggagaagggactccccaaggaagagggataggtcaaaatcaaggtcaccttcaagaaaacatgatagacatagaagggaacatgatagatctcggtcaaggtctccccacccaagggatcaccacagacgatctccaagaaggcattcaccaaggcgcagatcaccctcaagccatcggcatcgttcaccaagaagacattggtcaccacctgctaacaggaagactggactgggtaagcctggaaagaatctgttcattgcaggatttagctatgccaccactgagcgagatttagagaagaaattttgcaaatttggacgcgtaacaagtgcgcgtgttgtccgtgataaacgaactggagattcccggggctttggattcttatccttggagaaggatgaggatgctgatgcagcgattcgttcttgtgacgagactgagtggaatggtaggatcattcttgtggagaagtcgaaggcacctacatggtgaatcatccaccttggatccccatgtaccattgttcaagagggacctcattgcttcactttgcacagattttactggtcagaaaacataacttattatcggtatgacatactcggtacatgtcgcaagatcacctgaacctggcttttgatgctgtactaggagtaagagtaataaaatgcacttccttgctgacagttatagaagaataagatgtaacgtcacgccttagcttgtttcaggaccctgctgctgataagagggacttagtgggtaccttttagtgtctgcaacctctacacctgaaatgcaatactgtgcctgttggtgaactatcagtacccttcttcgacttcgtcttggactcgggttcgctgacgacacaagtcaattccaggagattcaagcttgtgaggctgttactagtcaaggattaagttagtagttcaataatctatatatatataggcttcatatgtttgcatcctctgagtgaggggtttaacaagtgccctatagtttgtgttttgaattccagatggttggtgttaaatatggtcaccgtgtttagcctcatcatgccttttctgctgacatggtttttctgcctgtactcttgaacccagatatatctgtctgttcacgcgaatcgaatttgagcttggatgcc

SEQ ID NO: 15291 - protein, 623 aa, Panicum virgatum
  misc_feature: Ceres CLONE 1781768
  misc_feature (544)..(615): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MEYISPERNLEGTCGDPGPLFGDQDSSLLDHLDYQGGGIPQHESPTLDDGLLVDPADAIPYLSADSLPFMNDQITCNVMKSASTSSESSLKQLQEPLNVESDIHIQNDATEQNIHNSNSEEQVASVDCDVHQNTEVIGSVLPPELPESSGNDTSNFQPEAAYSDVYHGDSLLTENSNKDCQLNNSSADDDEIPNSPALQLENEDMEKLHETSHNEKSGSEDDQINGRKSSPIDGRDKENFNTSAERPPSRVQMEQENPGTRNGSLTPDNRFDSPPDRFARLERDTPSPDGRVSPDRFARLERDTPSSDGRVSPPVSSPNAHHSEKMESKCHAKDVADLAHAESPPERRRSRSSEKHDPNRKRVSSRELSPHGQKRRRESRHGDRSPRRSPRRRSASPRRRSTPPRRRSISPRKRSISPRRSSCKRDSPKRGGSPRRRHSPRRRESPRKRDSPRRRDSPKRRRDSPRKRDRSKSRSPSRKHDRHRREHDRSRSRSPHPRDHHRRSPRRHSPRRRSPSSHRHRSPRRHWSPPANRKTGLGKPGKNLFIAGFSYATTERDLEKKFCKFGRVTSARVVRDKRTGDSRGFGFLSLEKDEDADAAIRSCDETEWNGRIILVEKSKAPTW

SEQ ID NO: 15292 - DNA, 921 bp, Panicum virgatum
  misc_feature: Ceres CLONE 1781787
  misc_feature: Encodes the peptide sequence at SEQ ID NO. 15293
cgcacgcccgccgtcgctgtcgcgcgctcgcgtccctccctccgccgcgcgcctcgccccctgccccctcccgcacaaagccgccgtcgagccaggccacccacctgcttcctcctccccgcgcaccacgtgatctgctcgagcgcgcagctgctgccatcccaccatggccaccgcctgccgcttcgccgcgcagctcggcctcgccacgctgccccgcggccgcgcacccgccggcgtcgtcgtggccgtcgcccaatgcggctccaaggtctccagaggcgtcgccgtcagggcgacgtccggcggcgagggcgtgacggaggatgtgccggagatcgtcaaggctgcccaggacgcgtgggacaaagttgaggacaagtacgccgtggccgccatcggcgtcgccgccatcgtcgcgctctggacggcggcaggggctctcaaggccatcgacaagcttcctctcctgcctggtgtccttgagattgttggaatcggctatactgggtggttcacataccgcaacctcgtcttccagccagacagggaagctcttatcagtaaggtcaagagcacttacaaagaaatcaccgggagcagcagctgatgaagcatcatttacaagatgggatctgtaagcagatgctagaattgcatccgtgagcactgaactgccatgcaagtgaaagtgctaacatttgagactggatcatgtactgtttctggtccgtcctctgactcaagtcagagagaaacctttgctgatgagttagtcgtttgcttattttgatgtaatatttataacatataccagttcctttccagacttccgcgcactgggaagcatcatatgagattgaagaggacattgattggctcgttgctttttaaacaattcagatctataatattttggct

SEQ ID NO: 15293 - protein, 147 aa, Panicum virgatum
  misc_feature: Ceres CLONE 1781787
  misc_feature: SWISSPROT Homolog: EC 6.1.1.9 Valine--tRNA ligase
MATACRFAAQLGLATLPRGRAPAGVVVAVAQCGSKVSRGVAVRATSGGEGVTEDVPEIVKAAQDAWDKVEDKYAVAAIGVAAIVALWTAAGALKAIDKLPLLPGVLEIVGIGYTGWFTYRNLVFQPDREALISKVKSTYKEITGSSS

SEQ ID NO: 15294 - DNA, 1833 bp, Panicum virgatum
  misc_feature: Ceres CLONE 1781788
  misc_feature: Encodes the peptide sequence at SEQ ID NO. 15295
attctgggtcgtcgcttaccacgccgcactacgtccacagaacatcccatgccgtcgtctcaccgtggcgtcctccttctccttgccatggtggcgagcctctccaccgtcgtaagatcaaaggacagccagttcacgttggtggacttccaatcgccgccgcccccgccgattgtagcgcctgctctcgtcggagaatggctgacggctccacgatcattgttgctgctgctcctcccggtctccatcttgctcgcacgctactcgttcgctgccaagagggcgaggaagatgaggcagcagcaagacgaccagctaccgccatcgcctccggcactgcccatcctcgggcacctccacctcgtgggctcactcccgcacgtctccctccgtagcctcgccaggaagcacggccacgacctcatgctgctccgcctcggcgccatgccggtcgtcgtcgtgtcgtcgccgtccgccgcgcaggcggtgctgcgcacgcacgacctcgtgttcgcgtccaggccgcactctctagtcgccgagatcctcctctacggcccgtccgacgttggcttcgtgccgcacggggactactggcggcaggcgaggaagctcgtcaccacgcacctgctcaccgtcaagaaggtgcagtctctacgccacgcccgcgaggaagaagtgagcacggtgatggccaagatcggcaaggcggccggcgccggcgccgcagtggacgtgggcgatctgctcggctcgttcgcgaacgacctggcctgccgcgccgttatgggaaagtcatcatcccggaacgagggccggaggaagctgttcctgcagctcgtcgtggacacgtccccgcttctgggaggcttccacgtcgaggacttcttcccattcctcgctcgcttcggcgtgctcagtaggttggttcgcgccaagtcggagatattgaggaggaggtgggacgagctgctggacaggctgatcgatgaccatgagagcaaggacgaatcgatggcggcggcgagtgatccgaaggacgaggatgacgacttcataaatgtcttgctctctgttcggcaggagtatggccttaccagagagcgcatcaaagctatcctgcttgacgtgttcttcgggggaatagacacagcagctacggtgcttgagaacaccgtggttgagctcatgaagaagccacgcgtaatgaagaaactccaagccgaggtgaggagcatcgtgcccaagggacaagaaatcgtcagcgaggccgacctgaacggcatggcctacctgagagcagtcataaaggagtcgctccggctgcgcaacgtgacgccgctccttgcgccgcacttctccatggcaagctgcagcgtcgacggtgtggtggtccccgccggggtgcgcgttctgatcaacgtctgggccatcgccagggacgcgcgcttctgggaggacgcggaggagttcgtccccgagaggttcctcgacgggggcagcgcggcagacgtcggcttcaaggggaacgacttccagttcctgccgttcagcgccgggcgcaggcagtgccccgggatgaacttcgggatggccgccatcgaggtcatgctggcgaacctcgtgcaccgcttcgaatgggagatgccggcggggaaggacgcgcgcgacattgacatgtccgaggagttcgggctcgtgatgcaccggaaggagaagctcctcttggttcccaaactacgagtgtagctccataagttcatatgctgcatccaagtgttccaacacatattgcatatttgtatatatgaagaataatgccggattgatgat

SEQ ID NO: 15295 - protein, 553 aa, Panicum virgatum
  misc_feature: Ceres CLONE 1781788
  misc_feature (78)..(548): Pfam Name: p450 Pfam Description: Cytochrome P450
  misc_feature: SWISSPROT Homolog: EC 1.14.13.68 4-hydroxyphenylacetaldehyde oxime monooxygenase
MVASLSTVVRSKDSQFTLVDFQSPPPPPIVAPALVGEWLTAPRSLLLLLLPVSILLARYSFAAKRARKMRQQQDDQLPPSPPALPILGHLHLVGSLPHVSLRSLARKHGHDLMLLRLGAMPVVVVSSPSAAQAVLRTHDLVFASRPHSLVAEILLYGPSDVGFVPHGDYWRQARKLVTTHLLTVKKVQSLRHAREEEVSTVMAKIGKAAGAGAAVDVGDLLGSFANDLACRAVMGKSSSRNEGRRKLFLQLVVDTSPLLGGFHVEDFFPFLARFGVLSRLVRAKSEILRRRWDELLDRLIDDHESKDESMAAASDPKDEDDDFINVLLSVRQEYGLTRERIKAILLDVFFGGIDTAATVLENTVVELMKKPRVMKKLQAEVRSIVPKGQEIVSEADLNGMAYLRAVIKESLRLRNVTPLLAPHFSMASCSVDGVVVPAGVRVLINVWAIARDARFWEDAEEFVPERFLDGGSAADVGFKGNDFQFLPFSAGRRQCPGMNFGMAAIEVMLANLVHRFEWEMPAGKDARDIDMSEEFGLVMHRKEKLLLVPKLRV

SEQ ID NO: 15296 - DNA, 1647 bp, Panicum virgatum
  misc_feature: Ceres CLONE 1781798
  misc_feature: Encodes the peptide sequence at SEQ ID NO. 15297
gttcacttcacccgctccgtgcgccgccgcacaccgccgccagcctaactccaccgaataacggcagcgagccgccgcccgccccaccaaccccccaaaatgccggcgatgctggcggcgcagtttacgggcctccctctatcccagtcacctgcgccacagcccagcttccgcctcggcctccggccttcgccggcggcgagggcccgctctctcgctccgcgggtcgcggcctccgcggccgccgtatcggctataccggcggcggaggcgcccccggttgcggaccgcaccgtcgtccgtatcgggctccccagcaagggccgcatggccgagcaaaccctaagcctcctcaagagttgccaattgtcagtgagacagctcaacccgcggcagtacactgcggacatcccgctgatcccaaacttggaggtttggtttcagaggcccaaagatattgttcgtaaactgcagtcaggggatcttgaccttggtattgtgggttttgacatagtcagtgagtacgggaagggcaatgaggatttagtagttgtccacggtgctcttgagtttggacattgtcgtttgtcccttgcggtacctaaggaaggcatttttgaaaacataaatactctagaggatttgttgaagatgcctgaatggacagaagaaaggccactacgtgttgttacaggatttggatatctaggtgataagttcttaagagagaaaggttttaagcatgttcgctttttatctgctgatggagctcttgagtcatatcctcctatgggtatggctgatgctattgtggatctcgtgagtagtgggacgaccttgcgtgagaataatttgaaggaaattgaagatggtgtggttgtgcaaagccaggccactcttgtagcgagtaggaaatctctgcacaagcgtaaaggtgtgttggagattactcatgagttgcttgaaagattagaagctcacctcagagcaaccacagagttaatggtcacagcaaacatgagggacaacagtgcagaagaagtggcagagagagttcttagccagacatcgctatgtggattgcagggcccgactataagtcctgtctactgcagacgtgatggcaaagttgatgtggaatactatgctattaatgtggttgttccacaaaagttgctttacaagtctatccaacaattgagatctattggtggcagcggagtcttagtaacaaagctgacccacatatttgacgaggagacgccaaggtggcgcaatctgctctcagagctggggttatagcttggcacatggtcagcttccggtctcttccaactttctccgttctgcaccgcactatttggtccttactgaagtatataaacaacccatatgcagaagtgagctgccgtgtggaatatctgtcagtgtacgtgtacctcttcgggaaattttggtctgtactccagtcatctgttggaccgtccgcgttcccagcggtgtgttcatagcggttgtatgtgcgtgtgtatttgttcatagcctgactttactccttgtggcgccgagtaatcggcaatatcatgtttcaataaagagccggtaaggttcgttgccccttgtggcaagtctcgtgccctgtgtttc

SEQ ID NO: 15297 - protein, 324 aa, Panicum virgatum
  misc_feature: Ceres CLONE 1781798
  misc_feature (39)..(219): Pfam Name: HisG Pfam Description: ATP phosphoribosyltransferase
  misc_feature (220)..(307): Pfam Name: HisG_C Pfam Description: HisG, C-terminal domain
  misc_feature: SWISSPROT Homolog: EC 2.4.2.17 ATP phosphoribosyltransferase
MAEQTLSLLKSCQLSVRQLNPRQYTADIPLIPNLEVWFQRPKDIVRKLQSGDLDLGIVGFDIVSEYGKGNEDLVVVHGALEFGHCRLSLAVPKEGIFENINTLEDLLKMPEWTEERPLRVVTGFGYLGDKFLREKGFKHVRFLSADGALESYPPMGMADAIVDLVSSGTTLRENNLKEIEDGVVVQSQATLVASRKSLHKRKGVLEITHELLERLEAHLRATTELMVTANMRDNSAEEVAERVLSQTSLCGLQGPTISPVYCRRDGKVDVEYYAINVVVPQKLLYKSIQQLRSIGGSGVLVTKLTHIFDEETPRWRNLLSELGL

SEQ ID NO: 15298 - DNA, 715 bp, Panicum virgatum
  misc_feature: Ceres CLONE 1781808
  misc_feature: Encodes the peptide sequence at SEQ ID NO. 15299
acctccagctttccaagccccggaaccttatctccatccaaatcctcatcccaccccatcccgagcgagcgtcatggccgccgcgctcttctccacctccctttcaaccagcttcctcgccctatcctccccgaaacccgccgcaaccgcggcctccgccttcctccccttcaggctgccgctgctcgctgtgtcggcgccgggaaggcgggtgttcgagcccgtggccgtcgcggtctcgtcagagtacgagaccgagggcgcggagcaggaggatgagggagccgaggagttctccgaggacctgaagctgttcgtcggaaacctgccgttcagcgtcgacagcgcgcagctcgccgggctctttgagcaggccggctccgtcgagatggtcgaggttgtatatgatagaatgactggacgaagccgtggatttgggttcgtgacaatgtcctcagctcaagcagctggagccgctgttgagcaattcaatggttatgtgagtatacttccatgttttagtctacctttctcctggtatgcttctggagcagatgagctacctaattgaagattttttttttataattgaagaaagaaaaatgatatagcacgtaaaagaagtagtgtcggcattgtaataatgcaatgtcgatgttttgtgctgatcattaagactttcatatgtttggtttgcagcgaagtatgcattgtt

SEQ ID NO: 15299 - protein, 165 aa, Panicum virgatum
  misc_feature: Ceres CLONE 1781808
  misc_feature (80)..(152): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: The sequence is a functional homolog of SEQ ID NO 22 in US patent 7244875
MAAALFSTSLSTSFLALSSPKPAATAASAFLPFRLPLLAVSAPGRRVFEPVAVAVSSEYETEGAEQEDEGAEEFSEDLKLFVGNLPFSVDSAQLAGLFEQAGSVEMVEVVYDRMTGRSRGFGFVTMSSAQAAGAAVEQFNGYVSILPCFSLPFSWYASGADELPN

SEQ ID NO: 15300 - DNA, 732 bp, Panicum virgatum
  misc_feature: Ceres CLONE 1781809
  misc_feature: Encodes the peptide sequence at SEQ ID NO. 15301
acctcgtacagttcatcaagtaaagccacatcagatcacacacaatctagctgcagaaatggcgtcgacggtggcgagcctctctaccccggcggcggcctttgcggccgcagacgtagtcccgaggaggaagatcgccggccgcgtctggttccccgtggcacgccgcgtcggcttcgcggtgaggtcgagcgggccggggacgccgccggggatctcggacaaggtgtcagagagcatcaagaaggcagaggagacgtgcgcggacgagaaggtctccggagagtgcgcggcggcgtgggacgaggtggaggagctcagcgccgcggcgagccacgcccgggacaagctcaaggagaacagcgacccgctggagaactactgcaaggagaaccccgagaccgacgagtgccgcatctacgacaactagaccatgcctgtatccagtggcggagccaggggggctggcaggggccatgcccccccccccccccgccaagcttggtgtaagtctactataatacatatataatgatgattgtataagtataaaattaaagaatacactaatctactgtagacatagaaaactgatttttagttattacctgtgtcaatatattttaactgtatatttcacaaagtaggatctttgagtaatcatgatcatttttaggtttttagctgatataatttgtttgtatttaactttttagatgtcatggatagtat

SEQ ID NO: 15301 - protein, 123 aa, Panicum virgatum
  misc_feature: Ceres CLONE 1781809
  misc_feature (53)..(123): Pfam Name: CP12 Pfam Description: CP12 domain
  misc_feature: SWISSPROT Homolog: EC 1.2.1.13 Glyceraldehyde-3-phosphate dehydrogenase (NADP(+)) (phosphorylating)
MASTVASLSTPAAAFAAADVVPRRKIAGRVWFPVARRVGFAVRSSGPGTPPGISDKVSESIKKAEETCADEKVSGECAAAWDEVEELSAAASHARDKLKENSDPLENYCKENPETDECRIYDN

SEQ ID NO: 15302 - DNA, 709 bp, Panicum virgatum
  misc_feature: Ceres CLONE 1781810
  misc_feature: Encodes the peptide sequence at SEQ ID NO. 15303
agcgctgaaaaattctctcgaaaagcatcccaaaaagggggaaggaaaaaaaaaaagctcgtctccttccccgcagcttgccagcatctacccggaagtcagcgagcgagagaggccgtgcgcggcgatggggtcgagcgaggcggagaagccgctgcggcggatcgcggcgtcgttcgaggagctcgccgccgtcgccaagcagcagcccccgggggccatggacgccgcggcgttctcccacgcctgctccaacgtctccgtcctcttcggctacctcggcatcgccttcaagttcgccgagatggactacgtcgccaaggttaatgatttgctggaagcatccaattcagtttcaacattgccctcgatggttgagttagacattcagaaggatactgtcaggacagtaggtagccatacaaggaatctgcttagagtgaagcgtggtattgatatggttaaggttctgtttgagaaaatgctggttacagagggcaactcgcttagggatgcagcatcagtagcttatgctcaggtgtttgctccccatcatggatgggtcataaggaaagcagttgctgctggaatgtacgctcttccctcaaagtcccaactgttgaagaaactgaatgaagatgaggagtcggcaaaggctcaactgcaaaacttcgtcaggtcatcagcaccagtaatccgctacgtagaa

SEQ ID NO: 15303 - protein, 193 aa, Panicum virgatum
  misc_feature: Ceres CLONE 1781810
  misc_feature (25)..(193): Pfam Name: GLTP Pfam Description: Glycolipid transfer protein (GLTP)
MGSSEAEKPLRRIAASFEELAAVAKQQPPGAMDAAAFSHACSNVSVLFGYLGIAFKFAEMDYVAKVNDLLEASNSVSTLPSMVELDIQKDTVRTVGSHTRNLLRVKRGIDMVKVLFEKMLVTEGNSLRDAASVAYAQVFAPHHGWVIRKAVAAGMYALPSKSQLLKKLNEDEESAKAQLQNFVRSSAPVIRYV

SEQ ID NO: 15304 - DNA, 717 bp, Panicum virgatum
  misc_feature: Ceres CLONE 1781833
  misc_feature: Encodes the peptide sequence at SEQ ID NO. 15305
aacaaccaccagtgacttcgcagcctcctcttcccccaaccaatccgaatcccagccgaaccccccccagcagccgcgtcgatggcccccaaggcggagaagaagccggcggcgaagaagcccgcggaggaggagcccgcgacggagaaggccccggcggggaagaagcccaaggccgagaagcggctccccgcgggcaagtccgccggcaaggagggcggcgagggcaagaaggggaagaagaaggccaagaagtcggtggagacgtacaagatctacatcttcaaggtgctgaagcaggtgcaccccgacatcggcatctcctccaaggccatgtccatcatgaactccttcatcaacgacatcttcgagaagctcgccggcgaggcagccaagctcgcgcgctacaacaagaagcccaccatcacctcccgcgagatccagacctcggtgcgcctcgtcctccccggcgagctcgccaagcacgctgtctccgagggcaccaaggccgtcaccaagttcacctcgtcttagatgccaggctttcccctctgctctttattggcgaaaggctcctggtagtgatgctagtttgctcggtttggctggtaggatgatgtagctaggtgctggtggctcctgataatgttatttctgtacgaagtgagaagtgaaatctgttaatgttatcagatgcaatattaatggtgcttgttt

SEQ ID NO: 15305 - protein, 150 aa, Panicum virgatum
  misc_feature: Ceres CLONE 1781833
  misc_feature (57)..(127): Pfam Name: Histone Pfam Description: Core histone H2A/H2B/H3/H4
  misc_feature: Useful for biocontainment applications
  misc_feature: Useful for making plants with modulated flowering time
MAPKAEKKPAAKKPAEEEPATEKAPAGKKPKAEKRLPAGKSAGKEGGEGKKGKKKAKKSVETYKIYIFKVLKQVHPDIGISSKAMSIMNSFINDIFEKLAGEAAKLARYNKKPTITSREIQTSVRLVLPGELAKHAVSEGTKAVTKFTSS

SEQ ID NO: 15306 - DNA, 589 bp, Panicum virgatum
  misc_feature: Ceres CLONE 1781840
  misc_feature: Encodes the peptide sequence at SEQ ID NO. 15307
atcacaaactaagccaaacacaaggcatctcaaccaccacaccttcttcagcaccagttcctgctcgcgatcatctggatcagcatgtcttgctgccgcggcaactgcgagtgcggcgccgactgcaactgcacctcatgcaccgggtgcaagatgttccctgacaaggagggcacctccgccaccaccatcatggtcatcacccccgccagccacaaggggagactccggcgggttcgaggcgggaagggacagcggctgctgcgactgcaacacctggacgtgcggcacctactgcggctgctcctgctgcagctgcaactgaggcagccgccgcgatggaggacgaaggggaaaggagaacccccaccgcgtactatactatatattagcaggccatcgtttaaataagatcttgattggaaactggaaatggtgcttcatcgaagactactgtatcaaggaaattgatgtgcctgcctgttgggagaacaagtcacatgctcccttgaaatgaagacattactacagtttggaaaaaaagaaaaaaaaaaagaaaaaaagaattgtctctctctctctccgccgc

SEQ ID NO: 15307 - protein, 108 aa, Panicum virgatum
  misc_feature: Ceres CLONE 1781840
  misc_feature (1)..(55): Pfam Name: Metallothio_2 Pfam Description: Metallothionein
MSCCRGNCECGADCNCTSCTGCKMFPDKEGTSATTIMVITPASHKGRLRRVRGGKGQRLLRLQHLDVRHLLRLLLLQLQLRQPPRWRTKGKGEPPPRTILYISRPSFK

SEQ ID NO: 15308 - DNA, 1007 bp, Panicum virgatum
  misc_feature: Ceres CLONE 1781843
  misc_feature: Encodes the peptide sequence at SEQ ID NO. 15309
gtctctgcctccgatcttgtcttcttcttcctcgtctactccctccctctcccggccggagatccgccccgcagcctacgcggcagatcggcggcgatgcagttcttcggcgggtcgtcgctgacctcggtcgcgccggaggcgagcccggccccggcggcgcccccaggcacgggcacgggcgccaacgcgcaggtgctctacgtcttcaaccgcaacggcgtctgcctgctctaccgcgagtggcaccgcccgctccgcaccctcgaccccacccaggaccacaagctcatgttcggcctcctcttctccctccgctcattcaccgccaagatcgacccgaccacggctgaaaaggggaatcttggcgtgccgctactgccaggccaaggccgttcattctacagcttcaagacaaacacgtacaaactcaacttcatggagagcccttctggtattaagcttattctaattacacatccaaggactggtgatcagcgagattcgctgaagcatatctacaatctatatgttgagtatgttgtaaaaaatcctctgtatgctcctggcacaccaatcaagtgtgaacttttcaataaacatctcgatcaatatgtgagaacattaatctgatatccttgagacagggttggtgcggcattagctaaaatggggcccatgttctttagcatggtgggttcaccatgctgtttgatcactgtctcaagggtgatagaggattttctggtggaagacttgccgtgtttccacagttgcaccatgtatttagatggacagatggtacaaagctgctgtctacttgtcttgtataccgacttcaatttgattagcactattgtggcaacactcctgtagattacttgtttgatcatgatggatgccctcgaggtgggaactgtattgtcgcatttggtgtgatatgttgccttcagatgactaatccatgagttatcgtgccactgttcaagttttcctcttcagttgcg

SEQ ID NO: 15309 - protein, 178 aa, Panicum virgatum
  misc_feature: Ceres CLONE 1781843
  misc_feature (32)..(177): Pfam Name: Sybindin Pfam Description: Sybindin-like family
MQFFGGSSLTSVAPEASPAPAAPPGTGTGANAQVLYVFNRNGVCLLYREWHRPLRTLDPTQDHKLMFGLLFSLRSFTAKIDPTTAEKGNLGVPLLPGQGRSFYSFKTNTYKLNFMESPSGIKLILITHPRTGDQRDSLKHIYNLYVEYVVKNPLYAPGTPIKCELFNKHLDQYVRTLI

SEQ ID NO: 15310 - DNA, 718 bp, Panicum virgatum
  misc_feature: Ceres CLONE 1781853
  misc_feature: Encodes the peptide sequence at SEQ ID NO. 15311
ccggctgtgctcccacgtccggtgcgggcggcgcgagacccggcggcacgagttccggcggtgctccgtgtgcggcgccgccaactactgctcccgcgcgtgccaggcgctggactggaagcgcgcccacaaggcgcagtgcgttcccatggaccggtggctcgccgccaacgccgccgcggcggccccgcagtgacgccgcggcgcgcctccccaacggctgacatgacgtaccagtcctactactagagtactagcccctcggcccaccgtagacctggcgtagcgaaggaaggaaaggcgcagcagatggaaatgcacctcggctctttttccccactcttttggtccctactatcctttttctctcttttgcgcctctgctgtctaggcgtcgccttgtcagatgtacgtattctactagggaagaggagccgagggatacccgcgcccgtttctgtttttttgagctcttgttttgtctcggttaaagttaccgctagaactcaaatccttcttttctttttctaaccgaggttgggagccggttgaggttcctctggattttgtcgactttccacggccaggcggcagctcggcgttaatcttaaacctggtgtgattagcagcggccatcggatggggtgtcaggtgtgtgcctgtgtctcggggcctgggaggtttgagctttctctctggccgctcatgctgttgggag

SEQ ID NO: 15311 - protein, 64 aa, Panicum virgatum
  misc_feature: Ceres CLONE 1781853
  misc_feature (6)..(47): Pfam Name: zf-MYND Pfam Description: MYND finger
  misc_feature: Useful for making plants with altered lignin content
RLCSHVRCGRRETRRHEFRRCSVCGAANYCSRACQALDWKRAHKAQCVPMDRWLAANAAAAAPQ

SEQ ID NO: 15312 - DNA, 1919 bp, Panicum virgatum
  misc_feature: Ceres CLONE 1781860
  misc_feature: Encodes the peptide sequence at SEQ ID NO. 15313
acctcgccacgcccacgcacatctatctatcctcgcaccaccagcacctggcggcgccttgatcccatctcctccacgcaggcttgcacgccgcgccgacccagccaccatggaccagctccccaagcgcccggccaactacgtgccgctgagccccgtcggcttcctgccgcgcgccaatgccgtctacggcgaccgcctgtccgtggtctacggccgcgtccgcttcacctggagccagacgtaccagcgctgccgccgcctcgcctccgcgctcctcgcgctcggcgtccgccggggcgacgtcgtctccgtcctcgcgcccaacgtgccggccatatacgagatgcacttcgccgtgcccatggccggcgccgtgctcaacaccatcaacacgcgcctcgacgccaacgccgtcgccaccatcctgcgccactctgaggccaagctcctcttcgtcgactacgagtacgcgcgcctcgccggcgacgcgctccagctcctcgccgccgacgccgggctcgtcccgctcgttgccgtcatcgacgacctcgacgcgcccaccggggtccggctaggcgagctcgagtacgaggggctcgtcgcgcgcggcgacccggacgccgacctgcctccactcaccgacgagtgggacgccgtgacgctcaactacacgtccggcaccacctccgcgcccaagggcgtcgtctacagccaccgcggcgcgtacctcagcaccaccagcctgctgctgcagtggggggtgggcaccgagcccgtctacctgtggacgctccccatgttccactgcaacggctggaccttcacgtggggcatggcggcgcgcggcggcgtcaacgtgtgcatccgcgacgcgcgccccgcggacatctaccgcgccatcgcgcgccaccgcgtcacccacatgtgctgcgcgcccgtggtgttcagcatcctcctcgagggcggcgacgccaccaccaagcagccgcggcagctcgaggccccggtgcacgtcctcaccggcggcgccccgccgccggccgcgctgctggagcgcgtcgagcggatcggcttccgcgtcacgcacgcgtacggtctcacggaggcgacggggcccgcgctcgcatgcgagtggcgcgaccagtgggaccgcctgccgcttcccgagcgcgcgcgcctcaaggcgcgccagggggtcagcgtcctctccctcgccgacgccgacgtcaaggacgctgacaccatgcagagcgtgccgcgcgacggcaaaaccgtcggcgagatcgtcctccgcggcagcagcgtcatgaaggggtacctcaacaaccccaaggccaacgaggaggccttcaggggcggctggttcctgacgggcgacgtcggcgtcgtgcacccggacgggtacatcgagatcaaggacaggtccaaggacgtgatcatcagcggcggcgagaacatctgcagcaaggaggtggaggaggtgctgttccggcaccccgccgtggcggacgcggcggtggtggcgatgccgcatccgcgctggggcgagacgccctgcgccttcgtcgtggccagggacaaggccgcccacgtctccgaggacgacgtgctcgccttctgcaccaagcgcatggcaaaattcatggtgcctaagaaggtggtggtcctcgaagccctacccagaaatggactgggaaaggtcgagaaggtcaagctccgggagctggcacgtaaactggcgccaacggtgccggcgcagaagcccaaggggaagacgacgacgacaacgacgacggtcggcgggcgccgcgacgagcagccggtggcgcacgtcatggccatgtcatggtcaaggctatagccctgctatactgtaactgtggtaaccgttgctacgtacgtacgcttcttttgcc

SEQ ID NO: 15313 - protein, 584 aa, Panicum virgatum
  misc_feature: Ceres CLONE 1781860
  misc_feature (41)..(471): Pfam Name: AMP-binding Pfam Description: AMP-binding enzyme
  misc_feature: SWISSPROT Homolog: EC 6.2.1.26 o-succinylbenzoate--CoA ligase
MDQLPKRPANYVPLSPVGFLPRANAVYGDRLSVVYGRVRFTWSQTYQRCRRLASALLALGVRRGDVVSVLAPNVPAIYEMHFAVPMAGAVLNTINTRLDANAVATILRHSEAKLLFVDYEYARLAGDALQLLAADAGLVPLVAVIDDLDAPTGVRLGELEYEGLVARGDPDADLPPLTDEWDAVTLNYTSGTTSAPKGVVYSHRGAYLSTTSLLLQWGVGTEPVYLWTLPMFHCNGWTFTWGMAARGGVNVCIRDARPADIYRAIARHRVTHMCCAPVVFSILLEGGDATTKQPRQLEAPVHVLTGGAPPPAALLERVERIGFRVTHAYGLTEATGPALACEWRDQWDRLPLPERARLKARQGVSVLSLADADVKDADTMQSVPRDGKTVGEIVLRGSSVMKGYLNNPKANEEAFRGGWFLTGDVGVVHPDGYIEIKDRSKDVIISGGENICSKEVEEVLFRHPAVADAAVVAMPHPRWGETPCAFVVARDKAAHVSEDDVLAFCTKRMAKFMVPKKVVVLEALPRNGLGKVEKVKLRELARKLAPTVPAQKPKGKTTTTTTTVGGRRDEQPVAHVMAMSWSRL

SEQ ID NO: 15314 - DNA, 1481 bp, Panicum virgatum
  misc_feature: Ceres CLONE 1781864
  misc_feature: Encodes the peptide sequence at SEQ ID NO. 15315
ggccagcctcagtcccgcacgaccagacccagtaaaatatttgcccattccgccggcgagatggcccaccgccgcctgctcgtcctcgccgtcctcgccctctcggccgccgcggccgcggccgagcccggcttcgccgagtccaacccaatccgccccgtcaccgaccgcgcggtctccgcgctcgagtccaccgtcctcgccgcgctcggccgcacccgcgacgcgctccgcttcgcgcgctacgccgtcaggtacggcaagagctacgagaacgtggcggaggtccacaagcggttccggatcttctccgagagcctcgagctcgtccgctccacgaaccagaagggcctcccctaccgcctcggcatcaaccgcttcgcggacatgagctgggaggatttccgctcgacccggctcggcgccgcgcagaactgctccgccactctcgccggcaaccaccggatgcgcgccgccgccgcgctcccggagacgaaagactggagggaggatgggattgtgagcccagtgaaaaaccaaggccactgtggatcctgctggaccttcagcactactggtgcacttgaggctgcatacacgcaggcaactggcaagcccgtctctctttctgagcaacagcttgttgactgtgctggtgcatacaacaatttctgatgcaacggaggccttccgtcccaggcctttgaatacatcaaacacaatggtggccttgacactgaggaatcttacccttacaagggtgtaaatggactctgccaattcaaggcttcaaatgttggagtcaaagttttggactcagttaacataaccctgggtgctgagaatgaactgaaggatgccgttggtctggttcgccctgttagcgttgcctttgaggtgatcaacggtttccggctgtacaagagcagagtttacactagtgaccactgcggaactactcctatggatgtgaaccatgctgttctggctgttggctatggtgttgaaaatggtatcccctactggctcatcaagaactcatggggcgctgactggggtgacgagggttacttcaagatggaaatgggcaagaacatgtgcggtgttgctacttgtgcatcctaccctgttgtcgcggcatgaggaccacacggattgttccatgctttatttgcttggcgtcaataatacatgtttagcctgagcatggtgatgggttatacacataccctgtgttgtgaatagatcgtcgtgaagggaatgaattagcccctgcttgtacgtcccccccttatggttgtgtaggtagattgtcagttggggctccaaactactcaatacgtgtccatgctattctatcgaggtgaaattgccattaaacatggtaccatatgcagattacagcccggacacttttatcatataataatgtactatatgcagattatatatcatcatggtcatatctctgaattatcttc

SEQ ID NO: 15315 - protein, 204 aa, Panicum virgatum
  misc_feature: Ceres CLONE 1781864
  misc_feature (59)..(115): Pfam Name: Inhibitor_I29 Pfam Description: Cathepsin propeptide inhibitor domain (I29)
  misc_feature: SWISSPROT Homolog: EC 3.4.22.16 Cathepsin H
MAHRRLLVLAVLALSAAAAAAEPGFAESNPIRPVTDRAVSALESTVLAALGRTRDALRFARYAVRYGKSYENVAEVHKRFRIFSESLELVRSTNQKGLPYRLGINRFADMSWEDFRSTRLGAAQNCSATLAGNHRMRAAAALPETKDWREDGIVSPVKNQGHCGSCWTFSTTGALEAAYTQATGKPVSLSEQQLVDCAGAYNNF

SEQ ID NO: 15316 - DNA, 733 bp, Panicum virgatum
  misc_feature: Ceres CLONE 1781868
  misc_feature: Encodes the peptide sequence at SEQ ID NO. 15317
gtattctgatacatggagatggtagctttgctggccagggtgtggtctacgagacgctccatctaagtgccctcccgaactacactactggtggaaccatacatattgttgttaacaaccaagttgccttcacgacggatccaagagctggcaggtcctcccagtactgcacagatgttgccaaagccctgaatgctcctatattccatgtaaatggtgatgatttagaggctgtcgtccgtgtctgtgagcttgcagcagagtggcgccagacttttcactcagatgtggttgtcgatctaatctgctaccgccgttttgggcataatgaaatcgatgaaccctccttcacacagccaaagatgtatcaggtcattaagaaccatcccagctcattgaagctttatgagcagaaactgctaggatcaggagacgtctcgaaagaagatgtccagaggatccatgacaaggtgaaccatatcttgaatgaagaatttacaaagagcaagcactatgttcccaacaagagggattggctctctgcttactggactggctttaagtcgcccgagcaaatatcacgtgttcgcaacactggggtcaaaccggagatactgaaacgtgttggacaagcaattactacactgcctgaaaacttcaacccacacagagcagtgaagaagatttttgagcttcgagcagctatgattgagagtggcgaaagaattgattg

SEQ ID NO: 15317 - protein, 243 aa, Panicum virgatum
  misc_feature: Ceres CLONE 1781868
  misc_feature (1)..(175): Pfam Name: E1_dh Pfam Description: Dehydrogenase E1 component
  misc_feature: SWISSPROT Homolog: EC 1.2.4.2 Oxoglutarate dehydrogenase (succinyl-transferring)
ILIHGDGSFAGQGVVYETLHLSALPNYTTGGTIHIVVNNQVAFTTDPRAGRSSQYCTDVAKALNAPIFHVNGDDLEAVVRVCELAAEWRQTFHSDVVVDLICYRRFGHNEIDEPSFTQPKMYQVIKNHPSSLKLYEQKLLGSGDVSKEDVQRIHDKVNHILNEEFTKSKHYVPNKRDWLSAYWTGFKSPEQISRVRNTGVKPEILKRVGQAITTLPENFNPHRAVKKIFELRAAMIESGERID

SEQ ID NO: 15318 - DNA, 719 bp, Panicum virgatum
  misc_feature: Ceres CLONE 1781887
  misc_feature: Encodes the peptide sequence at SEQ ID NO. 15319
gagaacatgcgtggcatttgctttgaggtctgtgatgttgttcttcatgctgatgccattcacaggggtggtggtcaggtcattccaactgccaggagggtcatctatgcttctcagctcacggccaagccaagactgctggagccagtgtaccttgtggagatccaggctcctgagaatgcacttggtggtatctacggtgttctgaaccagaagagagggcacgtgtttgaggagatgcagaggccgggtaccccgctctacaacatcaaggcttacctccctgtcattgagtcctttgggttctccagccagctgagggctgcaacctctggtcaggcgttccctcagtgtgtgttcgaccactgggacatgatgggctctgatcctttggaggctggctcccaggctgctcagctggtgttggacatccgcaagaggaagggtctcaaggagcagatgaccccgctttctgagttcgaggacaagctctaaatttttggccttttgtggtactgttaccccctgatggtttaatcgtccattcgtctgctgtaatggaactatttttgtatttcatttcctttagtggtcaaatgcttctgtttctgaacatcattagccatatggtagtgccctgctaaaactgttgttatcctttgtgatgtaacagatgaaacagagttggtatttgtggttatgagggtggtatttgtagt

SEQ ID NO: 15319 - protein, 164 aa, Panicum virgatum
  misc_feature: Ceres CLONE 1781887
  misc_feature (45)..(133): Pfam Name: EFG_C Pfam Description: Elongation factor G C-terminus
ENMRGICFEVCDVVLHADAIHRGGGQVIPTARRVIYASQLTAKPRLLEPVYLVEIQAPENALGGIYGVLNQKRGHVFEEMQRPGTPLYNIKAYLPVIESFGFSSQLRAATSGQAFPQCVFDHWDMMGSDPLEAGSQAAQLVLDIRKRKGLKEQMTPLSEFEDKL

SEQ ID NO: 15320 - DNA, 732 bp, Panicum virgatum
  misc_feature: Ceres CLONE 1781921
  misc_feature: Encodes the peptide sequence at SEQ ID NO. 15321
aaaccctaccccgcgcagccgcagcccgccgccgccgccgcctcgtcgaactccggcgcgtgcccgagccccgccagccgctgccgccatgtcgctgatcgcgggggaggacttccagcacatcctgcgtctgctcaacaccaacgtggatggcaagcagaagatcatgttcgcgctcacctccatcaagggtgtcggccgccgcttctccaacatcgtctgcaagaaggccgacatcgacatgaacaagcgggctggtgagctcacgccagatgagcttgagcgcctcatgactgtggttgccaacccccgccagttcaaggtgcctgactggttccttaacaggaagaaggactacaaggatggtaggttctcccaggttgtttctaacgccctcgacatgaagctcagggatgaccttgagaggctgaagaagatcaggaaccaccgtggtctgcgtcactactggggccttcgtgtccgtggccagcacaccaagaccaccggaaggcgtggaaagactgttggtgtgtcgaagaagagataagccccatgtccaagcgccctgtattggcccatagcttgtgtcttgagtatgcaaacctttgtgccatgttttgctggatatgtttatctctaggatagatgttgagctgtttgggttcatgaatacttgtagcggctccattggtgcctgtgttcgaagcgcgggttgaatttcagtgttctgtg

SEQ ID NO: 15321 - protein, 152 aa, Panicum virgatum
  misc_feature: Ceres CLONE 1781921
  misc_feature (14)..(142): Pfam Name: Ribosomal_S13 Pfam Description: Ribosomal protein S13/S18
MSLIAGEDFQHILRLLNTNVDGKQKIMFALTSIKGVGRRFSNIVCKKADIDMNKRAGELTPDELERLMTVVANPRQFKVPDWFLNRKKDYKDGRFSQVVSNALDMKLRDDLERLKKIRNHRGLRHYWGLRVRGQHTKTTGRRGKTVGVSKKR

SEQ ID NO: 15322 - DNA, 676 bp, Panicum virgatum
  misc_feature: Ceres CLONE 1781928
  misc_feature: Encodes the peptide sequence at SEQ ID NO. 15323
atatgcctcattgatagtcaattgaatactcaacaggcctatccacaagagaatgttggggtattcgttcaacgaggtcgcggtggacctctctctgtagttgagtacagtgaaatggatgcagctatgactactgaaattaatcaatcaacagggcgcctccgttattgttggagcaatatctgcctgaatatgttcactttggactttttgaaccaagtggcaaacagccttgaaaaggacagtgtatatcatctagctgagaagaagattccttccatccatgggtatacaacgggcctgaagcttgaacagtttatattcgatgctttcacttactccccatccacagcactttttgaggtcttgcgggaagaggaatttgcaccagtaaagaatgccaacggcgcaacatatgacactcctgatagcgcgaaactcatgctgctccgtctccatagcagatgggttgttgctgcaggcggcttcttgacgcattctgtgcccttgtatatgacaggcgttgaagtttctccactttcctcctacgctggggagaacctggaagccatatgccgtgggcgaacattccatgcgccgagcgagatatcattttagatagggctgttcatgacagcaaaagccgaatgcaaaggattgatgtggatggccaggt

SEQ ID NO: 15323 - protein, 205 aa, Panicum virgatum
  misc_feature: Ceres CLONE 1781928
  misc_feature: SWISSPROT Homolog: EC 2.7.7.23 UDP-N-acetylglucosamine diphosphorylase
ICLIDSQLNTQQAYPQENVGVFVQRGRGGPLSVVEYSEMDAAMTTEINQSTGRLRYCWSNICLNMFTLDFLNQVANSLEKDSVYHLAEKKIPSIHGYTTGLKLEQFIFDAFTYSPSTALFEVLREEEFAPVKNANGATYDTPDSAKLMLLRLHSRWVVAAGGFLTHSVPLYMTGVEVSPLSSYAGENLEAICRGRTFHAPSEISF

SEQ ID NO: 15324 - DNA, 684 bp, Panicum virgatum
  misc_feature: Ceres CLONE 1781953
  misc_feature: Encodes the peptide sequence at SEQ ID NO. 15325
gtctctttctccccccttcttcgtggcccctctcaccgtggtttgcgtgctgttcttccttcctacccgccttcccaactagattggttgatccgtacctttctctgcctctctcctgcttcatcccgctcatcgattctatcgcagattggttacagggaaggggaggggcgcgccgatggcggagctggtggggccgcgggtgtacagctgctgccattgccggaaccacgtctgcctccacgacgacatcatctccaaggcctttcagggaaggaatggtcgtgcatttctgttttctcatgccatgaacatagctgtggggcctaaggaggataggcaactcatgacagggcttcacacggttgctgatatctactgctgtgattgccgcgaagtactgggttggaaatatgagagagcttatgaggaatcgcagagatacaaggaagggaagttcatattcgagaaagcaaagattgttaaagagaattggtagtgattaatgatttggctatcagaagtcaattgtgaaagatgcggtcaatgtctttgtacatagctgtcggcaatcgcctgtaggttccaatatttgggtggcatgattgtgttcatgccatttgtaatctgcacttgttctgttcatttctgtacagaagacagatatgtgcttatctgtttggc

SEQ ID NO: 15325 - protein, 106 aa, Panicum virgatum
  misc_feature: Ceres CLONE 1781953
  misc_feature (1)..(104): Pfam Name: Yippee Pfam Description: Yippee putative zinc-binding protein
MAELVGPRVYSCCHCRNHVCLHDDIISKAFQGRNGRAFLFSHAMNIAVGPKEDRQLMTGLHTVADIYCCDCREVLGWKYERAYEESQRYKEGKFIFEKAKIVKENW

SEQ ID NO: 15326 - DNA, 722 bp, Panicum virgatum
  misc_feature: Ceres CLONE 1781959
  misc_feature: Encodes the peptide sequence at SEQ ID NO. 15327
atcacgccgcgacgcctccttgtcctctctctctctctctccacaacccggagctcgaaaccctaggcgcgtgcggcggaggcggcgaggcatggccatggacccggacgcggtggccaaggccttcgtggagcactactaccggaccttcgacaccaaccgcgccgcgctggtgtcgctgtaccaggagacctcaatgctcaccttcgagggccagaagctccagggccccgccgccatcgccggcaagctcggctcgctccccttccagcactgcgagcaccagatcgtcaccgtcgactgccagccgtcggggccccagggaggcatgctcgtcttcgtctccggctccatccgcaccgcccccgacgagcaccccatgaagttctcccaggcgttccatttgatgcctgctggaaattccttctacgtgcagaatgacatgttccgcctgaactatggttaaagacagtcaagagttgccggaagcgaagtgattaagggtttcatgttgaattgattaatatgaatgatgctgctactcttgcccgtttgttggctgctgctgtttgctgcaagaaaattgctagacttgatatgcttgttggataatttcttattttggatcatgtactctggttgcatgggcaccggttctgtggattgtgaatgaaaacggtccagatctattcatgtgagggatctccggtttgtcctggttg

SEQ ID NO: 15327 - protein, 124 aa, Panicum virgatum; identical to SEQ ID NO: 13109
  misc_feature: Ceres CLONE 1781959
  misc_feature (8)..(121): Pfam Name: NTF2 Pfam Description: Nuclear transport factor 2 (NTF2) domain

SEQ ID NO: 15328 - DNA, 966 bp, Panicum virgatum
  misc_feature: Ceres CLONE 1781982
  misc_feature: Encodes the peptide sequence at SEQ ID NO. 15329
attcccctcccaccaccgcctccctcccattgcgttgcgcccggcccattccttcatccccaccggcaccggcagcgcaagaagaagaagaagatgaagctctccgtccagtccctggccaggaagctctccctcccgtccccgaagcggtcctggagtagcggcagcaagaaggacggcagcgggaagcgctccctgtcgcgcagcgaggcgccgtccttcgcgtcggcgtcgtcctcctccgacgacgacacgctcgcgcgctcctccacgccgcggtccgtgctctcgctgtcccccgccgagatcccgcgccgggagctggaggccgtgctgcggcgcctcggccacggggagccctccgacgacgagctggacgccgtggccgccatggccgcgcagccgcccgcgcccggcggggaggacgacctcatggaggcgttccgggtcttcgacgccgacggcgacggccgcatcaccgccgaggagctccgcgccgtcatggaggccatcctcggcggcggcgccgagggctgcagcctcgacgactgccgccgcatgatcggcggcgtcgacgccgacggcgacggcttcgtcggcttccaggacttcgcgcgcatgatgatgaacgccaccaccgtcccaacgacaaccttcttgttgtgaacttgtgaacctcacctgaccaaacaagattggccccagccctgatgcgcgctcagagtatcatcatcaatctgctccgcgagatcattttccttttgagcgcgcaggatgataggctgctctgttactactagtagtaggattaagagaaagcgcttgcttgctaatccatgcacgattagccgtgcatgcaagctcgttgtaaaattatttgtcgcgagagagtatgttataacggtaaggcgaatgcttggttctttcgattttcttttcaaaatttaaatccgaattcctaccgct

SEQ ID NO: 15329 - protein, 190 aa, Panicum virgatum
  misc_feature: Ceres CLONE 1781982
  misc_feature (112)..(140): Pfam Name: efhand Pfam Description: EF hand
  misc_feature (152)..(180): Pfam Name: efhand Pfam Description: EF hand
MKLSVQSLARKLSLPSPKRSWSSGSKKDGSGKRSLSRSEAPSFASASSSSDDDTLARSSTPRSVLSLSPAEIPRRELEAVLRRLGHGEPSDDELDAVAAMAAQPPAPGGEDDLMEAFRVFDADGDGRITAEELRAVMEAILGGGAEGCSLDDCRRMIGGVDADGDGFVGFQDFARMMMNATTVPTTTFLL

SEQ ID NO: 15330 - DNA, 959 bp, Panicum virgatum
  misc_feature: Ceres CLONE 1782000
  misc_feature: Encodes the peptide sequence at SEQ ID NO. 15331
gctaatccccgcccccatcgagtctctcccccatccccctccccctcccgaaaccggattcgcggtctcgtctagcagccgagtcggcacgccggcgcgggcggccatggaggacgaggagcacgaggtgtacggccaggagatccccgtcgacggcgaggacgtcaacatgtccggggccggcgacgacgccgccaagctgcaggagctcgacgagatgaagcgccgcctcaaggagatggaggaggaggcggccgcgctccgcgagatgcaggccaaggccgccaaggagatgcaaggtgtagatcctaatgcaaccacatctgaaaacaaagaggagatggatgctcagtcagtattcattggaaatgttgattatgcctgcactccagaagaagtacagcagcacttcaattcttgcggaactgtcaacagagtgacaatactgactgacaagtttgggcagcctaaaggttttgcttatgtggaatttgttgaagttgaagctgttcaggaagctattaagctgaacgagtcagagttgcatggccgccaactcaaggtggcaccaaagaggactaatgttcctgggatgaagcaaccccgcgaccgaggtttcaatccttaccatggccacccctacatgaggccatatggttatagtccctatggctatgggcgattccccagattccgccgcccacacagaccttatttttgaagctcaggtctccatagagttgtgtcagcgcatggagcatagtcggttcagattcaggaggaagctgggccttactcctgctttctgttatttcatagcttaacaccatcctgggtttatgttctcagacatgtttttgaattgacgatgcttaaggcttgtactgtactgtattgtcgtctttcagtgacggttgtgcaaaacaattacgatttggttacacggaagatactattgt

SEQ ID NO: 15331 - protein, 204 aa, Panicum virgatum
  misc_feature: Ceres CLONE 1782000
  misc_feature (84)..(153): Pfam Name: RRM_1 Pfam Description: RNA recognition motif. (a.k.a. RRM, RBD, or RNP domain)
MEDEEHEVYGQEIPVDGEDVNMSGAGDDAAKLQELDEMKRRLKEMEEEAAALREMQAKAAKEMQGVDPNATTSENKEEMDAQSVFIGNVDYACTPEEVQQHFNSCGTVNRVTILTDKFGQPKGFAYVEFVEVEAVQEAIKLNESELHGRQLKVAPKRTNVPGMKQPRDRGFNPYHGHPYMRPYGYSPYGYGRFPRFRRPHRPYF

SEQ ID NO: 15332 - DNA, 606 bp, Panicum virgatum
  misc_feature: Ceres CLONE 1782009
  misc_feature: Encodes the peptide sequence at SEQ ID NO. 15333
agcttatggcttatcatctgcgcctccccatctctcccctgctcctcctcctccttgtgatccatccaaaccaggggtagccctgtcggactccgaggagcaccacttcgagtcgaaggccgacgctggggcgtcccatacccacccgcgcggggccggtaccccccgcaagaacggattcctcgtcctccagggccgcccctgccaggtggtggaggtttctacctctaagactggtaagcacggccgtgctgattgccactttgttgccatcgacatattcaatgggaaaaagcttgaagatattgtcccatcttcccctaattgtgatgtgccgcatgtgaaccgcactgagtatcagctgattgacatatctgaggatggatttgtgagccttcttacttctgatggccacaccaaggatgatcttagacttccaactgatgagactctcctgggccagatcaaggaaggatttgacagcgggaaggaccttatggtgactgtccagtctgcgatgggggaggagcaatatctgcacgctgatcgatgtcggccccaagtagctacccaaagaaggccgatcttggaacagagggagcaact

SEQ ID NO: 15333 - protein, 201 aa, Panicum virgatum
  misc_feature: Ceres CLONE 1782009
  misc_feature (113)..(182): Pfam Name: eIF-5a Pfam Description: Eukaryotic initiation factor 5A hypusine, DNA-binding OB fold
AYGLSSAPPHLSPAPPPPCDPSKPGVALSDSEEHHFESKADAGASHTHPRGAGTPRKNGFLVLQGRPCQVVEVSTSKTGKHGRADCHFVAIDIFNGKKLEDIVPSSPNCDVPHVNRTEYQLIDISEDGFVSLLTSDGHTKDDLRLPTDETLLGQIKEGFDSGKDLMVTVQSAMGEEQYLHADRCRPQVATQRRPILEQREQ

SEQ ID NO: 15334 - DNA, 735 bp, Panicum virgatum
  misc_feature: Ceres CLONE 1782013
  misc_feature: Encodes the peptide sequence at SEQ ID NO. 15335
actcggctcgccagctcttttcccttccgcttctcgccgacaggaaactagggttttgctcccggaatctccctctccgccgccgccgcccggccgcgcgccggagataccaccgcatccctcatccgatccgaccttttttatcgccggatcccgtccaagatgcttcccctctcgctcctcaaaactgcccaggggcatcccatgctcgtggagctgaagaatggagagacgtacaacgggcatctggtcaactgcgacacgtggatgaacatccaccttagggaggtcatttgcacctcaaaggatggtgacaggttttggaggatgccggagtgttacatccgagggaacaccattaagtatcttcgagttccggatgaggttattgacaaagttcaggaggaaacttccaaaagccgatcagataggaagccaccaggtgttggccgcggaaaaggaaggggagacgttggtgctaaacctggcggcagaggcattggacgtggccaagatgatggaggcagaggcagtggtggccggggaaggggtggagttggtgggaaaggtggtaacaaaggtggaggccgtggccgtggctgaagctggtcgtcacatcggagaatgccgctttttaaggcctgtagctgtgttgcatagattgcttaggacgtgaatcatggagctggaatttggttggttgttttccgtgacaaaaaccaaaatggttggtgt

SEQ ID NO: 15335 - protein, 146 aa, Panicum virgatum
  misc_feature: Ceres CLONE 1782013
  misc_feature (5)..(71): Pfam Name: LSM Pfam Description: LSM domain
MLPLSLLKTAQGHPMLVELKNGETYNGHLVNCDTWMNIHLREVICTSKDGDRFWRMPECYIRGNTIKYLRVPDEVIDKVQEETSKSRSDRKPPGVGRGKGRGDVGAKPGGRGIGRGQDDGGRGSGGRGRGGVGGKGGNKGGGRGRG

SEQ ID NO: 15336 - DNA, 634 bp, Panicum virgatum
  misc_feature: Ceres CLONE 1782060
  misc_feature: Encodes the peptide sequence at SEQ ID NO. 15337
ctcctgcgcgtcgcaacccagcacgccaagatagggtctgagacccccgccgccgacggcgccgcccgcaagcggcccggcggcggcgatgcccccgccccggcgcccgccgacaagcgccgccgcccggagcccccatcgttctccgccaccacccgcgacgacgccgccgacctcgcgcgcgcgctccgcgaccagatcgtctccggggagcgcaagttcgaggacatcgccgccgagaactccgactgcaattcggccaagcgcggcggcgacctcggttcatttgggaggggtaagatgcaaaaggcttttgagaagtctgcgtttgctctgaaggtgggggagataagtgacgtgattgatacagagagtggtgtgcacatcatcaagaggaccggctaacagcgtcctccggtctcagtccatatagctggaaagtgccctgaagaagctccatggtttcctgcttgattgacgaacttgtgtgtattcgcttgtgagcttgataattgatttcttttttttgtgcttccgtgacagacatgtagtttaaacggttatcacggcaagacgggatcagattgttttgaatgtgacaaagattacactcgctatgttgattgttcctgtc

SEQ ID NO: 15337 - protein, 134 aa, Panicum virgatum
  misc_feature: Ceres CLONE 1782060
  misc_feature (43)..(134): Pfam Name: Rotamase Pfam Description: PPIC-type PPIASE domain
  misc_feature: SWISSPROT Homolog: EC 5.2.1.8 Peptidylprolyl isomerase
LLRVATQHAKIGSETPAADGAARKRPGGGDAPAPAPADKRRRPEPPSFSATTRDDAADLARALRDQIVSGERKFEDIAAENSDCNSAKRGGDLGSFGRGKMQKAFEKSAFALKVGEISDVIDTESGVHIIKRTG

SEQ ID NO: 15338 - DNA, 840 bp, Panicum virgatum
  misc_feature: Ceres CLONE 1782100
  misc_feature: Encodes the peptide sequence at SEQ ID NO. 15339
gcggagctgaccttcctgcctccttcctcctacctcgatccctcctccgatcctctcgtcaattccatccctcggctatctacaagctaaggtaacacgtaccatcgcggtcgcggcatcgccgccatgaagcttagcgtgccgttcttcggctcctcctccggcaagaaggtgaccaataagaggacgcgatcaaaggacggcaagagcggctccttcggctccaccacgtcgtcctcgtcggcgtccgacgagtgcgcgtccgccctcacgacgccgcgcaccgtcctgccgctgccgccggcgtccgcgtccgcgtcgggggccgagagaagacacccggcggcgcccctgacgagggagaacctggagaccgccctgcggcgggtggtctcgagcgaggaggagctggccgagatgctcgccgaggcggcggggtccggggtcctgctggaggagatcgcggccgaggcccaggcggcggcagcggacgagggcgagctcagggacacgttcgcggtgttcgacgccgacggggacggcaggatctcggccgaggagctcctcgccgtgctcgcctcgctcggggacgaccggtgctccgtcgaggactgccgccgcatgatcggcggcgtcgacgtcgacggcgacggcttcgtctgcttcaatgagttcgcgcgcatgatgacgcaaggggtttgatatgtcgggggcgtgcctactagctttttgcagctgtgttctttgatgccgtcgtcgatggccctgtttggttacccgtgccagggagtcctgtaaattttgagcattaattacggtattaaataaagttattttacg

SEQ ID NO: 15339 - protein, 191 aa, Panicum virgatum
  misc_feature: Ceres CLONE 1782100
  misc_feature (125)..(153): Pfam Name: efhand Pfam Description: EF hand
  misc_feature (162)..(190): Pfam Name: efhand Pfam Description: EF hand
  misc_feature: Useful for making plants with modulated salt sensitivity
MKLSVPFFGSSSGKKVTNKRTRSKDGKSGSFGSTTSSSSASDECASALTTPRTVLPLPPASASASGAERRHPAAPLTRENLETALRRVVSSEEELAEMLAEAAGSGVLLEEIAAEAQAAAADEGELRDTFAVFDADGDGRISAEELLAVLASLGDDRCSVEDCRRMIGGVDVDGDGFVCFNEFARMMTQGV

SEQ ID NO: 15340 - DNA, 861 bp, Panicum virgatum
  misc_feature: Ceres CLONE 1782110
  misc_feature: Encodes the peptide sequence at SEQ ID NO. 15341
acctgacggagcacaccgccacacgtcaccctgtcgagaacccgaagcagagctacgccgcaccaatggcagcgcgcctcgccgtccaggcgccgtccgcgagcctgccacgggccgggaacacgccccctggccccaagccgccgccgccgagcaacagcgtgcagcggccccagaagcagaagccggccgccaccagccggaggctagcgacggcggcgctcctggcgtcccggctgctggcgcccgcggcgggcagcgccgccgcggccggcgcgttcgacctgcgcatcacgctgccggagcagtccagcgaggaggccgaggccgtggtgcggacccacgcgcggaacctcctgcgggtgaagcggctcgccgacgccggggcgtggcgggagctgcaggcggcgctgcgcgccagcgcgtccaacctcaagcaggacctgtacgccatcatccaggcgaggcccgcggggcagcgccccgacctccgcaggctctactccgacctcttcaacagcgtcaccagcatggactacgcggccagagacaaggacgaggtacaggtgcaggaatactacagcaaaatggcctctgccttggaggaaattttcgccaagatcatgtagttgctcatccgtttatctaggttagatggagaatggattttttttccttataaaacaagaagaagaaaactaggaagttggaatcacattcacatgcaaggagcaacaaatggcgaccggcaaaaaggctttcattcttgcaatgtagctagtttttttttaaggaactatgtgctactagttcttgtgaacttcctttgctacatctatttactctagcatcataaggcgg

SEQ ID NO: 15341 - protein, 187 aa, Panicum virgatum
  misc_feature: Ceres CLONE 1782110
  misc_feature (17)..(187): Pfam Name: PsbQ Pfam Description: Oxygen evolving enhancer protein 3 (PsbQ)
MAARLAVQAPSASLPRAGNTPPGPKPPPPSNSVQRPQKQKPAATSRRLATAALLASRLLAPAAGSAAAAGAFDLRITLPEQSSEEAEAVVRTHARNLLRVKRLADAGAWRELQAALRASASNLKQDLYAIIQARPAGQRPDLRRLYSDLFNSVTSMDYAARDKDEVQVQEYYSKMASALEEIFAKIM

SEQ ID NO: 15342 - DNA, 961 bp, Panicum virgatum
  misc_feature: Ceres CLONE 1782114
  misc_feature: Encodes the peptide sequence at SEQ ID NO. 15343
gtctctctctctctctctctcgacccttcctgctggtcagtgagttctgaccaacgccactacacccagccgaccaaatcgccggagaagggcgcgctatggagccggcggtagagaagaaggaggccgaacagaaggagcagcagctaccgcaagcgcgcaaggaagacgcgcccgccgccgccgctgcagaggaggacgaggcagattcggaggagaccgagcgccgcaaccgcgacctcaaggccggccttcacccccttaggcgcaagctcgttctctggtacacgcgtcggacgcctggggcgaggtcgcagtcgtacgaggacaacatcaagaagatcattgatttcagcactgtcgaatcattctgggtttgctactgccacctcgcgcgcccgtcttctctgccgagccccactgatcttcatctcttcaaggatggcatccggcccctctgggaggaccctgcaaatcagaatggtggcaagtggataattaggttcaagaaggctgtttcaggtcgtttctgggaagatttggtgctggtgctagtaggcgaccaacttgaatatagtgatgatgtttgtggtgttgtgcttagtgtccgttttaatgaagacattttaagtgtttggaatcggaacgcatctgaccaccaggctgtgatgacattaagggattcaatcaagagacaccttaagctgccacacagctatttgatggagtacaaaccacatgatgcttcgcggcgtgacaactcgtcctacaggaacacatggctgcgaggataagctccatgattcgcctgcttcggaactatttcactgtgatctccggtgcttgacttttcaacatcagttctgaagaaagtagactctatgtaccaagcatgcgacctattatgcaatgtactagtcaaacgcaatacactataatgctcaaccatcctttatttacc

SEQ ID NO: 15343 - protein, 231 aa, Panicum virgatum
  misc_feature: Ceres CLONE 1782114
  misc_feature (25)..(231): Pfam Name: IF4E Pfam Description: Eukaryotic initiation factor 4E
MEPAVEKKEAEQKEQQLPQARKEDAPAAAAAEEDEADSEETERRNRDLKAGLHPLRRKLVLWYTRRTPGARSQSYEDNIKKIIDFSTVESFWVCYCHLARPSSLPSPTDLHLFKDGIRPLWEDPANQNGGKWIIRFKKAVSGRFWEDLVLVLVGDQLEYSDDVCGVVLSVRFNEDILSVWNRNASDHQAVMTLRDSIKRHLKLPHSYLMEYKPHDASRRDNSSYRNTWLRG

SEQ ID NO: 15344 - DNA, 817 bp, Panicum virgatum
  misc_feature: Ceres CLONE 1782116
  misc_feature: Encodes the peptide sequence at SEQ ID NO. 15345
aggcaggccgcttcactagcctgacggacggataggacacgagccgcgccgctggctgcgagcaatggaagctgcggcagggtcggagaagggtgccagcccgaggaatccggcggatgcagccgccgccgccgccgccgccgccttcggcgaggagcaagaggcgctcgtgctcagcgcgtggaacgccatgaagggcgactcggcgttgcttgcgctcaagttcttcctgaggatctttgagatcgcgccgggcgccaagcagatgttccccttcctgcgcgacgccggcgacgcgcccctggagaaccaccccaagctcaaggcgcacgccgtggccgtcttcgtcatggcttgcgagtccgcgacgcagctgaggaacaccggcgacgtgaaggtgagggaggcggcgctgaagcggctgggcgcgacgcacgtcaaggccggcgtcgccgacgcgcacttcgaggtggtgaagacggcgctgctggacaccatccgggacgcggtcccggacatgtggacgccggagatgaaggcggcgtgggaggaggcctacgaccagctcgccgccgccatcaaggaggagatgaagaacgccgccgccgcctgagttcgtcgtgaagaccttaacactctgtcacacgcatcccctgctgctgcgaagaacgcgcgttgctggggagagcttggagctgccactgctgctggctgctgctactccacgaagatgtcgctactactagagtactagtccactactgtgttctgttttgtcaagtgccagccacgtcattgatgaataaaacttaattgt

SEQ ID NO: 15345 - protein, 182 aa, Panicum virgatum
  misc_feature: Ceres CLONE 1782116
  misc_feature (32)..(142): Pfam Name: Globin Pfam Description: Globin
  misc_feature: SWISSPROT Homolog: EC 1.14.12.17 Nitric oxide dioxygenase
  misc_feature: Useful for making plants with modulated cold sensitivity
  misc_feature: Useful for making plants with modulated salt sensitivity
MEAAAGSEKGASPRNPADAAAAAAAAAFGEEQEALVLSAWNAMKGDSALLALKFFLRIFEIAPGAKQMFPFLRDAGDAPLENHPKLKAHAVAVFVMACESATQLRNTGDVKVREAALKRLGATHVKAGVADAHFEVVKTALLDTIRDAVPDMWTPEMKAAWEEAYDQLAAAIKEEMKNAAAA

SEQ ID NO: 15346 - DNA, 609 bp, Panicum virgatum
  misc_feature: Ceres CLONE 1782155
  misc_feature: Encodes the peptide sequence at SEQ ID NO. 15347
gaaacaaccaaccaaccggagcagactcgagagcacgaggaaggggccaaggagagggcggcgccggcatggaggacttctacgtcaccatcccctacggcctgctggtcctcggcggcggcgtcgcgggctacctcaagcgcgggagcgcaccctcgctggccgcgggggccggattcggaggggcgctcctcctcgccggcgcgctcagcgcctggaccttcgtgcgcggcgggggtggcgccggcgccgtcttcgccaccgtcctccagatcgtttgtgcagtggtattaactgttgtcatggaagtaagatatgtcaaaacaagaaagataatgcccgctggaattattgctgctatcagtgcaatcatgttgatattttacgtgtacaaggtatcaactggtggtaacaaggtttacatcccggtgagtaccgagtgagtctgctgcagacgcggtcttctaatgtggtgtacatgctgtttcaatggacaattaactgtgaaagtgtgaagacaacaaaatcatctctgttgtcatgatgtgcccatcaattgtattctagtgaggcaaacactgccctggaaaaaaaattatctcagctgtc

SEQ ID NO: 15347 - protein, 124 aa, Panicum virgatum
  misc_feature: Ceres CLONE 1782155
  misc_feature (4)..(110): Pfam Name: TMEM14 Pfam Description: Transmembrane proteins 14C
MEDFYVTIPYGLLVLGGGVAGYLKRGSAPSLAAGAGFGGALLLAGALSAWTFVRGGGGAGAVFATVLQIVCAVVLTVVMEVRYVKTRKIMPAGIIAAISAIMLIFYVYKVSTGGNKVYIPVSTE

SEQ ID NO: 15348 - DNA, 953 bp, Panicum virgatum
  misc_feature: Ceres CLONE 1782164
  misc_feature: Encodes the peptide sequence at SEQ ID NO. 15349
ctctttctcgctcgcccggcccgcgccgaaccctaaccaagggagttgagttgagttgagtcaccggttgcagccatgagtaagttgcaatccgaggctctcaaggatgccatctcccagatcgttggggatgccaaggagaagaataggaagttcaccgagaccgttgagcttcagattggtctgaagaactacaacccgcagaaggacaagcgtttcagcggctctgttaagctgcctcacatcccccgcccaaagatgaaagtgtgcatgcttggtgatgcccagcacgttgaggaggctgagaagattgaacttgactacatggatgtcgaggcgctcaagaaaatgaacaagaacaagaagcttgtcaagaagcttgccaagaagtaccatgctttcttagcatcagaggctatcatcaagcagattccccgtctccttggtcctggtctcaacaaggcaggcaagttccctacactggttacccaccaggagtctcttgaatccaaagtgaacgagacaaaagctacagtcaagttccagttgaagaaagttctttgcatgggtgttgctgtgggtaacctgtccatggaggagaagcagatccagcagaacatccagatgagcgtcaacttccttgtgtcccttctgaagaaaaactggcagaatgtgagatgcctatacatcaagagcaccatggggaagccatacagggtgttctaagtcttgccgcgattcttgtgaagttgataaaatactaaggcctctccagctgggcttgtcttaaaacttagatatgtacccatcaattctgtacctgttactgaggatgttgaagtatttggtccttaatctagtgtttcctttaatagaacttttggaggaatgcttttgggattacacagttgcaacttttgtttaaggttctttggccgctccgcagttttgat

SEQ ID NO: 15349 - protein, 216 aa, Panicum virgatum
  misc_feature: Ceres CLONE 1782164
  misc_feature (10)..(212): Pfam Name: Ribosomal_L1 Pfam Description: Ribosomal protein L1p/L10e family
MSKLQSEALKDAISQIVGDAKEKNRKFTETVELQIGLKNYNPQKDKRFSGSVKLPHIPRPKMKVCMLGDAQHVEEAEKIELDYMDVEALKKMNKNKKLVKKLAKKYHAFLASEAIIKQIPRLLGPGLNKAGKFPTLVTHQESLESKVNETKATVKFQLKKVLCMGVAVGNLSMEEKQIQQNIQMSVNFLVSLLKKNWQNVRCLYIKSTMGKPYRVF

SEQ ID NO: 15350 - DNA, 1029 bp, Panicum virgatum
  misc_feature: Ceres CLONE 1782178
  misc_feature: Encodes the peptide sequence at SEQ ID NO. 15351
atcttttccgcatcccaatccatccagcagttcatccgatccgtccactataaaaccccccagtccatctcctcgtgtctactaagcaatctctcatacccacacttaggcgtccttggccgctgcatctctcggtttctcaatggcgccctccgctatgatccgctgcgccgccgccgtcgcgacgctcgccctcctcgccgctggcggcgaggccgcggtgttcaccgtggtgaaccagtgccccttcacggtgtgggcggcctccgtgccggtgggcggcgggcgccagctgaaccgcggcgagacgtggcgcatcagcgtgcccgccggcacgacggcggcgcgcatctgggcgcgcacggggtgccagttcgacgcggccgggcgcgggagctgccgcacgggggactgcggcggggtgctgcgctgcacggggtacgggcgcgcgcccaacacgctggcggagttcgcgctgaagcagttcaacaacctcgacttcttcgacatctccctcatcgacggcttcaacgtgcccatgagcttcctccccgacggcgggtccgggtgcggccggggcccccggtgcttggcggacgtgaacgcgcggtgccccgcggagctgcggcaggacggggcgtgcaacaacgcgtgcccggtgttcaagaaggacgagtactgctgcgtcggctcggcggcaggcagctgcgggccgaccaactactcgaggtacttcaaggggcagtgcccggacgcgtacagctaccccaaggacgacgccaccagcaccttcacatgccccgccggaacaaactacaaggtcgtcttctgcccctaaataaggccctgaagatggcgacaggactgcatactactagcacgaagaaataagaactggccggcttgtgcagcagccgacacaaccccgggcttgtagaatccagtgtcctcaactggagaagctaatcaataaggacgtgtgatttctatatcaccataataaagtcattcagaacctttgcttaattc

SEQ ID NO: 15351 - protein, 231 aa, Panicum virgatum
  misc_feature: Ceres CLONE 1782178
  misc_feature (32)..(231): Pfam Name: Thaumatin Pfam Description: Thaumatin family
MAPSAMIRCAAAVATLALLAAGGEAAVFTVVNQCPFTVWAASVPVGGGRQLNRGETWRISVPAGTTAARIWARTGCQFDAAGRGSCRTGDCGGVLRCTGYGRAPNTLAEFALKQFNNLDFFDISLIDGFNVPMSFLPDGGSGCGRGPRCLADVNARCPAELRQDGACNNACPVFKKDEYCCVGSAAGSCGPTNYSRYFKGQCPDAYSYPKDDATSTFTCPAGTNYKVVFCP

SEQ ID NO: 15352 - DNA, 898 bp, Panicum virgatum
  misc_feature: Ceres CLONE 1782198
  misc_feature: Encodes the peptide sequence at SEQ ID NO. 15353
ggcctaccacagcaagaatagtgatctgcacagctcgtgtgtcatatcctcattgctcgtacgcccggcagcggcaggccagcgcatcatcacggtcagataaggctaagctcgtcgtcatggcaaccgccctgcccctcgtcgcgctgctcgtcgccgggtgcgcggcgctggcctcggccacgacgttcaccgtcggcgagtcgcagggctggacgaccggcgccaactacgacagttgggccaacggcaagagcttcgccgtcggggacacgctagtgttccggtacgtgagcaaggcgcacacggtgacggaggtgaccaagagcggctacgacacctgctccggctccggcgccaacgcgctgagcgacgacgacagcggctccaccaccgtcacgctcaccacccccggcacgcactacttcatctgcaacgtgcccgggcactgcgccagcggcatgaagttcgccatcaccgtctccgccacgcgctccggcgccgccgcgtccgcggccgccccgcaggttccggtggcctccgtcgctgtcgccgcagccgccgcgatcaagctcttgttcttctgacggcggagctgagcacggccgtctcgatcttcggagtctcagggtagagacagtgcatgcattgcaggctacacgttcttagccgctgacgacattctcgtgtaataatccatcagaaattgctgtccatatttctgctacgttttctggcgattgctcgtcgtgcagcagctcgtgtactacttacgctgccgtggcgtgtccttttgacgtctgtggctgtgtgtactgtattcgtcatcaggtgtacatcatgtctgatcgttttttgttgggtgtgaaaataaaatttgctcctcttgtgttcaatg

SEQ ID NO: 15353 - protein, 155 aa, Panicum virgatum
  misc_feature: Ceres CLONE 1782198
  misc_feature (32)..(115): Pfam Name: Cu_bind_like Pfam Description: Plastocyanin-like domain
MATALPLVALLVAGCAALASATTFTVGESQGWTTGANYDSWANGKSFAVGDTLVFRYVSKAHTVTEVTKSGYDTCSGSGANALSDDDSGSTTVTLTTPGTHYFICNVPGHCASGMKFAITVSATRSGAAASAAAPQVPVASVAVAAAAAIKLLFF

SEQ ID NO: 15354 - DNA, 675 bp, Panicum virgatum
  misc_feature: Ceres CLONE 1782206
  misc_feature: Encodes the peptide sequence at SEQ ID NO. 15355
accgccgttcgcgctccactttccaagcccccaaatcctccaacctccccgtgccgccgtggaattgaatcgcagcctcctcgctccgctccgatggcccgcaccaagcagacggcgcgcaagtcgaccggcggcaaggcgccgcggaagcagctggcgaccaaggccgcccgcaagtcggcgccggccaccggcggcgtgaagaagccgcaccggttccgccccggcaccgtcgcgctccgcgagatccgcaagtaccagaagagcacggagcttctcatccgcaagctccccttccagcgcctcgtccgggagatcgcgcaggacttcaagacggacctccggttccagtcctcggctgtggcggcgctgcaggaggccgcggaggcgtacctggtggggctgttcgaggacaccaatctctgcgccatccacgccaagcgcgtcaccatcatgccaaaggacatccagctcgcgcgccgcatcaggggcgagagggcctgagcgatggcgctcctcgtcaccgttctttcgatttctctggcctgtcgggctagcctgctctgctggaactagaatgggaatcatttcttgccggcttggttggtgtatcctggtgatgctctggatgttggccttgctcaattaaatgggaaaaatggtctgtgttccctg

SEQ ID NO: 15355 - protein, 136 aa, Panicum virgatum; identical to SEQ ID NO: 10238
  misc_feature: Ceres CLONE 1782206
  misc_feature (58)..(132): Pfam Name: Histone Pfam Description: Core histone H2A/H2B/H3/H4

SEQ ID NO: 15356 - DNA, 592 bp, Panicum virgatum
  misc_feature: Ceres CLONE 1782219
  misc_feature: Encodes the peptide sequence at SEQ ID NO. 15357
aactcaacccagctactccaactctccgcaccctgacacccatctcgatctcttctctgcatcacattacgagctgcaagccagcaaacactctctgcaccgcctcttggtcttgggcgtcggccatcgtcaccgctgagcttcatctccttcgatccatggagccgatctcggcgtccgtcccccggcccgcgtgcgcggcgtaccggcggcggcggcggacgacggcgaagcccgtgggcggcctcgctgggcggggcaacgccgtgctgaagcagcacaagacgaggctgtacatcctcggcaggtgcgtctccatgctcttgtgctggcgcgaccacgacgccgactgatgaccgcggccggctgcgcgatcgagcttgctggaggggatcggccggactgccgtgagtgggggtctgaccattgggtttcggactttcggtgtagggcggcttgcggtgtattacagtaaaccggttggtaaattatattggactgattataggtgacgatgaaaaatgcagaagtgtaaatgaatggaataatatacatgtatactgaggcgatcattttcttgtgcttctctatc

SEQ ID NO: 15357 - protein, 64 aa, Panicum virgatum
  misc_feature: Ceres CLONE 1782219
  misc_feature (39)..(57): Pfam Name: DVL Pfam Description: DVL family
MEPISASVPRPACAAYRRRRRTTAKPVGGLAGRGNAVLKQHKTRLYILGRCVSMLLCWRDHDAD

SEQ ID NO: 15358 - DNA, 723 bp, Panicum virgatum
  misc_feature: Ceres CLONE 1782221
  misc_feature: Encodes the peptide sequence at SEQ ID NO. 15359
tcgagcagtcgtacgacaccgacatccgcgccaacacctccgggttccgcaacggcgtgcccatcggcccgccggagttcgtctccatcttcttcaactacccggccggcctccgcgagctcctgctctacaccgcccggcgctacaacaaccccgtcatctacgtcaccgagaacggcatcgccgaggagaacagcgcgcgcatcccgctcagggaggcgctcaaggacgggcaccggatcgagttccactccaggcacctgcagttcgtgaaccacgccatcaggaacggcgtcaaggtaaagggctacttcacctggaccttcatggactgcttcgaatggggcgacgggtacctcgaccgcttcggcctcatcttcatcgaccgcctcaacgggctcaagcgctatcgcaagcagtccagctactggatcgagaagttcctgaagcgctagacggtttaattatatttgagtcgcagtccacactggtcacgagggccatccatatcgatcgatctcatcctgtttcgatcgactagctgctggtggtgccatgccgttgctgctgccatgccatggcatcttctagctagtttgttgccgaggggccggggtgtatttgtttccagagagcgatagctgttttgtgggcctgtagtctactatgggtcgggggtgctgctgtgattgtgtgtgcttggtgcttgcagagagggagggg

SEQ ID NO: 15359 - protein, 150 aa, Panicum virgatum
  misc_feature: Ceres CLONE 1782221
  misc_feature: SWISSPROT Homolog: EC 3.2.1.21 Beta-glucosidase
  misc_feature: Useful for making plants with altered carbohydrate content
  misc_feature: Useful for making plants with modulated biomass
  misc_feature: Useful for making plants with altered cell wall content and/or composition
EQSYDTDIRANTSGFRNGVPIGPPEFVSIFFNYPAGLRELLLYTARRYNNPVIYVTENGIAEENSARIPLREALKDGHRIEFHSRHLQFVNHAIRNGVKVKGYFTWTFMDCFEWGDGYLDRFGLIFIDRLNGLKRYRKQSSYWIEKFLKR

SEQ ID NO: 15360 - DNA, 693 bp, Panicum virgatum
  misc_feature: Ceres CLONE 1782237
  misc_feature: Encodes the peptide sequence at SEQ ID NO. 15361
tcctgcgccggcccgccgcggcgggcggcgcgctggcggcgcgcacctcggcccgccgctccacgccgcggtcgacgccaagctccacgccatctgcaacggcacggacgtagcgccgcagaaccagagccagagccagagccagagccaaagccagagccagagccagagcaacgccactgcggcaaccgccgcaacgactccgagtacattctcctcggcgagcccggacatcaagatcgagccgggctgctccgggtccgagagctcgtcgtccgcggatggcgacgtgtcctcgaccgactcctccgacgtggttccggagatgcagctcctcgacttctcagaagcgccatgggacgaatccgagagcctccacctgcgcaagtacccctcgctggagatcgactgggaatccatcctttcataatgcaaaggctctgctcgtctcgtccccgcagttcctgatcaaactgttcttggttgctctgtacttcacagaatcacagctccaaagatcaaagtggttgtcttggtggttaggtacttgtcagtttaggttttgggtttgatcatgtctagcatcaacccctggtctgcttggtttcttaaatggcattgccaggaaggaggtctctcccgcactttggattaaggaaattactactatgcatgcaaaggtctcatgtatac

SEQ ID NO: 15361 - protein, 142 aa, Panicum virgatum
  misc_feature: Ceres CLONE 1782237
  misc_feature: The sequence is a functional homolog of SEQ ID NO 1289 in the 10/374,780 US patent application
  misc_feature: The sequence is a functional homolog of SEQ ID NO 1435 in the 10/412,699 US patent application
PAPARRGGRRAGGAHLGPPLHAAVDAKLHAICNGTDVAPQNQSQSQSQSQSQSQSQSNATAATAATTPSTFSSASPDIKIEPGCSGSESSSSADGDVSSTDSSDVVPEMQLLDFSEAPWDESESLHLRKYPSLEIDWESILS

SEQ ID NO: 15362 - DNA, 720 bp, Panicum virgatum
  misc_feature: Ceres CLONE 1782238
  misc_feature: Encodes the peptide sequence at SEQ ID NO. 15363
aaccacccgccgcgcgctcccgccacccggcttcctctggtccgccccccttcccccccctcaagccaaaacgctcggctccctcccccactttccatctctcttcttgttcccccggaggacgaggaggaggaggaagaagaagggtagcgagagggagggcggaagaggatgagcgcatccaggttcataaagtgcgtcacggtcggggacggcgccgtcggcaagacctgcatgctcatctcctacacctccaacaccttccccaccgactatgttccaacggtgtttgacaacttcagtgctaacgtcgtggttgatggtaacactgtcaacctcgggctatgggacactgcaggtcaagaggattataacagactgagaccactgagttatcgtggagctgatgttttccttctggccttctcactgatcagtaaggctagctatgagaatgtttcgaagaagtggatacctgaactgaagcattatgcacccggtgtgccaataattctcgtggggacaaagcttgatcttcgagatgacaagcagttctttgtggaccaccctggtgctgttccaatcactactgctcagggagaggagctaagaaagcaaataggcgcaccatactacatcgaatgcagctcaaagacccaactaaatgtaaagggtgtcttcgatgcggccataaaggttgtgctgcagccacccaaggcg

SEQ ID NO: 15363 - protein, 182 aa, Panicum virgatum
  misc_feature: Ceres CLONE 1782238
  misc_feature (8)..(179): Pfam Name: Ras Pfam Description: Ras family
  misc_feature (8)..(121): Pfam Name: Miro Pfam Description: Miro-like protein
  misc_feature: SWISSPROT Homolog: EC 2.7.11.1 Non-specific serine/threonine protein kinase
  misc_feature: Useful for making plants with modulated nitrogen use efficiency
MSASRFIKCVTVGDGAVGKTCMLISYTSNTFPTDYVPTVFDNFSANVVVDGNTVNLGLWDTAGQEDYNRLRPLSYRGADVFLLAFSLISKASYENVSKKWIPELKHYAPGVPIILVGTKLDLRDDKQFFVDHPGAVPITTAQGEELRKQIGAPYYIECSSKTQLNVKGVFDAAIKVVLQPPK

SEQ ID NO: 15364 - DNA, 798 bp, Panicum virgatum
  misc_feature: Ceres CLONE 1782252
  misc_feature: Encodes the peptide sequence at SEQ ID NO. 15365
ggctttccctaatctcattctctctcctcaatagggagttgggacccgtcctgccctgccctgccgtcgtcttcccctgcctcaccctaatccccttctccgccgctctccctgccggtctccgcgctccctccccaccccgcccacgccgcgtcagattggtcgggtcgggggtactcgggtgaggtccgcgcggcgcggcgacggccgatggcggagctggtggggccgcgcgtttacagctgctgcaactgccggaaccacgtctgcctccacgacgacatcatctccaaggcctttcaggggaggaatggccgtgcctttctgttctctcatgccatgaacgtagttgtgggggcaaaggaggataggcagcttatgacagggctacacacggttgctgatatctactgtagtgattgccgagaggtgctgggctggaagtatgagagagcatacgaggagacacagaaatacaaggaaggaaaattcatatttgagaagtcaaagattatcaaagagaactggtagtatccaaggcttgacacacgtaacgtttctctgaagataaattggtgattatgtgtgtttttgaatgtttgtgtccttgtacatagctgttctccatggggttcaatcctaaggcttcatgttgttgcctcagggacatttgtaaagcacactttttcctgttcgtctgtgtgaataagatacagtctgtcgttatttgttatggaatcatggcctctaatgtgcataacttagtgggccctcaagtaaattttacaatctttgccc

SEQ ID NO: 15365 - protein, 106 aa, Panicum virgatum
  misc_feature: Ceres CLONE 1782252
  misc_feature (1)..(104): Pfam Name: Yippee Pfam Description: Yippee putative zinc-binding protein
MAELVGPRVYSCCNCRNHVCLHDDIISKAFQGRNGRAFLFSHAMNVVVGAKEDRQLMTGLHTVADIYCSDCREVLGWKYERAYEETQKYKEGKFIFEKSKIIKENW

SEQ ID NO: 15366 - DNA, 445 bp, Panicum virgatum
  misc_feature: Ceres CLONE 1782257-R
  misc_feature: Encodes the peptide sequence at SEQ ID NO. 15367
gcggatttggtgaagggagccaaggacaagcagctgagggttaagggacccgtcaggatccctactaaggttctccacatcaccacccgcaagtccccatgtggtaaaggaacaaacacatgggatcgctttgagttccgtatccacaagagggtgattgacctgatcagctcccccgatgtggtgaagcagatcacctccatcaccattgagcctggtgtcgaggtcgaggtgaccatcgcggatgtgtaatgccatgcagtttagctgtcatagactatccatatattgcattggtttagtttttgtgctccctttgtgtgcttgtatgagacatctgagtgattattagcatccaagactgtttttgcgccgcctactataatcctaccatagctgtttgtctggtctaaaggcctgtgctacttgaaattttgattcagtc

SEQ ID NO: 15367 - protein, 83 aa, Panicum virgatum
  misc_feature: Ceres CLONE 1782257-R
  misc_feature (1)..(78): Pfam Name: Ribosomal_S10 Pfam Description: Ribosomal protein S10p/S20e
  misc_feature: Useful for making plants with modulated biomass
  misc_feature: Useful for making plants with modulated flowering time
  misc_feature: Useful for making plants with modulated phosphate use efficiency
ADLVKGAKDKQLRVKGPVRIPTKVLHITTRKSPCGKGTNTWDRFEFRIHKRVIDLISSPDVVKQITSITIEPGVEVEVTIADV

SEQ ID NO: 15368 - DNA, 423 bp, Panicum virgatum
  misc_feature: Ceres CLONE 1782257
  misc_feature (82)..(82): n is a, c, t, g, unknown, or other
  misc_feature (86)..(86): n is a, c, t, g, unknown, or other
  misc_feature (87)..(87): n is a, c, t, g, unknown, or other
  misc_feature (109)..(109): n is a, c, t, g, unknown, or other
aaaaccctacctcgcagcgccgcctagcccaagcagccgagcgaggaagcgaagactccccacccccccccccccaactttntttnnttttttttttttttttttgttntgtttttttgtggccttggggggtatgttggggtggcggggggccccggggttgcgttttccgctgtttttgtttcccttttctcgctgtgcctggcggatttgggggaagttttttgggtttttttgtagggggggcagggcgaggcggtgggggtttagggggccgttggggttgctttttggggttttccgctctcccccctgggggtccgttttggtgaagggactgaatcctgggagttgttttggtttccggtcctcgggtgggtggtttaccttgtgggtttccccgttttggggtagggggtttcc

SEQ ID NO: 15369 - DNA, 624 bp, Panicum virgatum
  misc_feature: Ceres CLONE 1782312
  misc_feature: Encodes the peptide sequence at SEQ ID NO. 15370
aacaaagtttctactcctatcctaatagaccagggggaggatgacaagttcctggctgagcagctgctaccttacaacttcgaggaggcgtacaaggccgccggggttcctctggtcttgcgcatgcagcctggatatgatcattcctactttttcatcgctacattcattgatgatcacattgcgcaccatgctcagtttctgaagagcgcctgacctcgaagtctcctgtaatgtgaggaagctatcaaaagaagagagttggggaggcagctctgtgatttctgcggtgcccggtccgaagcctgtcactatatcccgctgccgacagtcttttggactttctcatgtctgctaggtgctagcttcaggtgaacaatatagctacatgcaaataagacgaaagacttgtctctgttgtagcaggaatgggatctcgatggtgcatttgagtgtagtttccttgtctttggttgtgcgcaattattggcccctgatgcagccacttgtggtgtaagaaatgattgcccatgcgtgcaattgactcttctttgcttctgcaggggaggaaaactgtatgaccagggcggtttatatgattgtatcgccgtcgcccttcctcct

SEQ ID NO: 15370 - protein, 71 aa, Panicum virgatum
  misc_feature: Ceres CLONE 1782312
  misc_feature: SWISSPROT Homolog: EC 3.1.2.12 S-formylglutathione hydrolase
  misc_feature: Useful for making plants with altered cell wall content and/or composition
  misc_feature: Useful for making plants with modulated biomass
NKVSTPILIDQGEDDKFLAEQLLPYNFEEAYKAAGVPLVLRMQPGYDHSYFFIATFIDDHIAHHAQFLKSA

SEQ ID NO: 15371 - DNA, 665 bp, Panicum virgatum
  misc_feature: Ceres CLONE 1782313
  misc_feature: Encodes the peptide sequence at SEQ ID NO. 15372
agcagttggacacaccaccgagttaagaggcgagaggttgacgtataagcagctagagcagtggctggaggatccctcgtcaaggtcgtttcagttcaagatttctaagagaagaagagaagagaggggagaagatgcaggactgggcgccggtgttcatctcgctggtgctcttcatcctgctgtcgccgggcctgctgttccagatccccggcaagtgccggatcatcgagttcggcaacttccacaccagcgctctctccatcctcgtccactccatcctcttcttcgctctcattgccatcttcctcatcgccatcggcgtgcacatgtacctcgggtcctagctggtagctttttttagcctgatgcctacctgcctgccgatggtgttcgtcgatcagcttgcagctcgatcgtgttcttctctgctagtcgcccatctctaattaaggggttcttttttctatacacatgtattgaataacaatgtatgtaccatccatgcatgttcatttctttcttcttctaataataataacaaattgaagttcagtctttaatttgctttggcatataggagtatttgtcttcgtgcattgttatccttgttcaaagtgtggtatggcacaagaatcgagcaggctcgttccttgcctctaatc

SEQ ID NO: 15372 - protein, 70 aa, Panicum virgatum; identical to SEQ ID NO: 14710
  misc_feature: Ceres CLONE 1782313
  misc_feature: Useful for making plants with altered cell wall content and/or composition

SEQ ID NO: 15373 - DNA, 956 bp, Panicum virgatum
  misc_feature: Ceres CLONE 1782330
  misc_feature: Encodes the peptide sequence at SEQ ID NO. 15374
gagctgagctggtggggggcaaaaagcggaggacggacggaggcgcattcatgagctccctgtatggtatctcctgcttcgccgccggccttgctggcaacatcttcgcgctcgccctcttcctgtcgccggtgccgacgttcaaaagggtggtgaaggccaagtcgacggagcgcttcgatgggctgccctacctgctgtccctcctcaactgctgcatctgcctctggtacggcctcccctgggtctccgacggcggcagggccctcgtcgccaccgtcaacggcaccggcgcgctgttccagctcgcctacatttcgctcttcgtcctctacgccgacagcaccaggacgcggctcaagatcgtggggctcctggcgctcgaagccttcgtgttcgcggtcatcgcgcacgcgagcatcgccttcttcgaacagccggctcggcagctgttcgttggctgcgtgagcatggcgtctctgatctccatgttcgcctccccactggccgtcatgggtttggtgatccggaccgagtgcgtggagttcatgcccttctacctgtccctctccaccttcctgatgagcgcctccttcgcaatgtacgggcttctgctgctcgatttcttcatatacctccccaatgtcatcggagtcgtcctgggagcaatgcagctggtgctgtacgcttactacagcaggaaatggaagggcagcgaatcgtctgcgccgttgctcgcctgatcaaaaccgaactgatcagtcagctgggtgtgccggcgcgcgctgggattcaggaagaaagaggagggcgatgggtgttttctaggggagtgagagatgccactagctgtccgtatctgtggttggtgcaggggtggaacagaaggaaaacacatccatccgaatacccttcctcctgagtatcaacatgttggtagtgcagttttgtttcgg

SEQ ID NO: 15374 - protein, 230 aa, Panicum virgatum
  misc_feature: Ceres CLONE 1782330
  misc_feature (134)..(220): Pfam Name: MtN3_slv Pfam Description: MtN3/saliva family
  misc_feature (10)..(100): Pfam Name: MtN3_slv Pfam Description: MtN3/saliva family
MSSLYGISCFAAGLAGNIFALALFLSPVPTFKRVVKAKSTERFDGLPYLLSLLNCCICLWYGLPWVSDGGRALVATVNGTGALFQLAYISLFVLYADSTRTRLKIVGLLALEAFVFAVIAHASIAFFEQPARQLFVGCVSMASLISMFASPLAVMGLVIRTECVEFMPFYLSLSTFLMSASFAMYGLLLLDFFIYLPNVIGVVLGAMQLVLYAYYSRKWKGSESSAPLLA

SEQ ID NO: 15375 - DNA, 795 bp, Panicum virgatum
  misc_feature: Ceres CLONE 1782373
  misc_feature: Encodes the peptide sequence at SEQ ID NO. 15376
gtctcatccatcccctcacggcatcaccactaccgtctccttccttcctcctcgcagagccgaaagccgaggcgaaaccaatcgcggaggcgaagcgaagccgccgcgagaggagagggagaggaggcgaggagggatggggcggaagcggaaggagctgctgtcgtcggcgccgtggcggacgggggaggcggcggaggacgaggaggcggccaggctcagccgcgagggtaaggtcagcgtcaccaacaaccccggcgagacggccaccatgaacgtcccccgcagcaggcgccaggacctcgacctcgccgttgacgacttcgacgaggaggagatcgaccccgagctgcgctactccttccagcggaacagcaggtttttgaagagagtttttagtgtggatacacttgtcaagcctcttccccctgtaatggcatacagtgtatctcgtaatgtaaactttttcttccggatcttcacacagttctgggatgaagaaggaattgccaacgcacagaagtcccttggactggggaatgatgatggttcccgccgaatgcgctgattgtagtcaaagtttctgtactgagctcagaactctttgtcctaggcactggagatctgttatatatgcttcaaaagacagctgtggcgtttcttaagtttggattgtaattctgtttattttagtgtttctttcatgtatttctgcttgtaccatatattcaaattcaacatcgtgtactcacagtctgttcccttttctatttgatctcgaacaaaattgggtgg

SEQ ID NO: 15376 - protein, 143 aa, Panicum virgatum
  misc_feature: Ceres CLONE 1782373
  misc_feature: Useful for making plants with modulated nitrogen use efficiency
MGRKRKELLSSAPWRTGEAAEDEEAARLSREGKVSVTNNPGETATMNVPRSRRQDLDLAVDDFDEEEIDPELRYSFQRNSRFLKRVFSVDTLVKPLPPVMAYSVSRNVNFFFRIFTQFWDEEGIANAQKSLGLGNDDGSRRMR

SEQ ID NO: 15377 - DNA, 725 bp, Panicum virgatum
  misc_feature: Ceres CLONE 1782395
  misc_feature: Encodes the peptide sequence at SEQ ID NO. 15378
acgacatcttctcgcgcctgctcaaggagcgcatcgtctgcatccacggccccatcaccgacgacacggcctccctcgtcgttgcgcagctgctcttcctcgagtccgagaaccccgccaagcccgtccacctctacatcaattcccccggcggggtcgtcaccgcgagcctcgccatatacgacaccatgcagtacatccgctcccccgtcaccacgctctgcatcggccaggcggcctccatggcctcgctcctgctcgccgccggggcgcggggggagaggcgggcgctgccgaacgcgcgggtcatgatccaccagccctccggcggcgcgtcggggcaggcctccgatatcgccatccacgccaaggagatcctcaaggtgcgggaccggctcaacaagatctacgccaaacacacgggacaggccatcgaccgcatcgagcagtgcatggagcgggacatgttcatggacccggaggaggcgcacgattgggggctcatcgacgaggtcatcgaacaccgccctgtctcgcttgtgtctgatgccgttggcagtgatccgccgaacctcggtggaggcggaaatggggcgaataaggggactgaagagccatcctcggcttgatggatggtatcaaggtgcaattattttgcgttcccattagctgtcctgttggatttaaggtttcattcatatatgagggtgaataacttatttttc

SEQ ID NO: 15378 - protein, 208 aa, Panicum virgatum
  misc_feature: Ceres CLONE 1782395
  misc_feature (1)..(175): Pfam Name: CLP_protease Pfam Description: Clp protease
  misc_feature: SWISSPROT Homolog: EC 3.4.21.92 Endopeptidase Clp
DIFSRLLKERIVCIHGPITDDTASLVVAQLLFLESENPAKPVHLYINSPGGVVTASLAIYDTMQYIRSPVTTLCIGQAASMASLLLAAGARGERRALPNARVMIHQPSGGASGQASDIAIHAKEILKVRDRLNKIYAKHTGQAIDRIEQCMERDMFMDPEEAHDWGLIDEVIEHRPVSLVSDAVGSDPPNLGGGGNGANKGTEEPSSA

SEQ ID NO: 15379 - DNA, 725 bp, Panicum virgatum
  misc_feature: Ceres CLONE 1782414
  misc_feature: Encodes the peptide sequence at SEQ ID NO. 15380
ctcttccagcgccgcctccctccgccctcctgcgccgccgccactgccacccccgcagcccgcagccgggcgaccgcagccatggcagactcgaaggccgccgcggcggtgaccctccgcacgcgcaagttcatgaccaaccgcctcctctcccgcaagcagttcgtgctcgaggttatccaccccggccgcgccaacgtctccaaggcggagctcaaggagcggctggcgaaggtgtacgaggtcagggaccccaactgcatcttcgtcttcaagttccgcacccacttcggaggcggcaagtccaccggcttcggcctcatctacgacaacctcgaggccgccaagaagttcgagcccaagtaccgcctcatcaggaatggccttgcaaccaaggtagagaagtcacgcaagcagatgaaggaacggaagaacagggcaaagaagatccgtggtgtgaagaagacaaaggctggagatgccaagaagaagtaaggaaagagataattgccttgccatcttcatcttacctgcctctggcttgttgaggacggtgtcctttttggcaatgctgaatgtttaattagacctagaaaggattttgccagaattatgaatgttgaggctctcgtagtactttgtggtcagttttgaggaatattgtcagacactagcatatatacttgattgtcatggttcttctgctatcttcattttgatttgtt

SEQ ID NO: 15380 - protein, 137 aa, Panicum virgatum; identical to SEQ ID NO: 12336
  misc_feature: Ceres CLONE 1782414
  misc_feature (28)..(111): Pfam Name: Ribosomal_S24e Pfam Description: Ribosomal protein S24e

SEQ ID NO: 15381 - DNA, 721 bp, Panicum virgatum
  misc_feature: Ceres CLONE 1782417
  misc_feature: Encodes the peptide sequence at SEQ ID NO. 15382
atcttctcagtagtacactcgctagctagctaagctgctatataaattaaattaaagctagtagtactgatcgatcggcatcgccggccggagatcgacatgacgacgatgatgaagaagcagcagcaagctgtggtgctgctgctgctgctgatggtggccgccggcggcgcgtctgcggcgtcgtgcaacgccgggcagctgacggtgtgcgcttcggcgctgacgtcgggcggcaagccctcggcggcgtgctgctccaacctcaaggcgcagcaggggtgcttctgccagttcgccaagaaccccgcattcgcgcgctacatcaacagccccaccgcgcgcaaggtcgtcgcatcctgcggcgtcgcactcccacgctgctagatagctacctcgctcattagttagctagctagctagctagcttatctgtatctatctatacatacatatatatgatcgctcgctcgctcgctcgatcttagtcgtctacgtgtggcttgctgctgttcatccagccgctcgctacgtgtgtgtgtatatagacacacacacacgcgacggataaataaaagatgcatgggttgcctccgggccgctccctatatagctactttgttgtgtattactagtatcaatcaatcctactttctgatgtcttcactacatgtgaaaagctgataatcttatagatgtacctactccatgtaataatttt

SEQ ID NO: 15382 - protein, 95 aa, Panicum virgatum
  misc_feature: Ceres CLONE 1782417
  misc_feature (30)..(95): Pfam Name: Tryp_alpha_amyl Pfam Description: Protease inhibitor/seed storage/LTP family
  misc_feature: Useful for making plants with modulated biomass
MTTMMKKQQQAVVLLLLLMVAAGGASAASCNAGQLTVCASALTSGGKPSAACCSNLKAQQGCFCQFAKNPAFARYINSPTARKVVASCGVALPRC

SEQ ID NO: 15383 - DNA, 901 bp, Panicum virgatum
  misc_feature: Ceres CLONE 1782432
  misc_feature: Encodes the peptide sequence at SEQ ID NO. 15384
gcgaactcccccttctttcgactcgccccgcgccccctttggatttcgccggattcgatgaagaagatcttcggcgccaagaagaacaaggaacccccgcccaccatccaggacgcaaccgaccgaatcaccaagcgcggcgacaccgtcgatgagaagatcaagaagctcgatgccgagctcgcgcgctacaaggagcagatcaagaagacgcgcccaggccccgcgcaggaggccgtcaaggcacgggccatgagggtcctcaagcagcggaggatgtatgaaggacagcgtgacatgctatacaaccaaacatataaccttgaccaagttgctttttcagcggagggacttaaagatgctcaacaaactatgactgcaatgaagactgccaacaaagagctgaaaggaatgatgaaaactgtcaagctcgaagatatagatagcatgcaagatgagatgatggatcttatggacgtgagcaatgagatacaagaaactcttggtagaagctacaacgtccctgatgacattgatgaggaagaactcatgggcgaacttgatgctctggaagctgatatggactttgaatcagagtcagtcccgtcataccttcaaccagatcaagaatctgaactcaacttacctgctgcaccaactggccatgcagcagccccaccacaccagcagcaggaggatgaactgggattgcctacagtgccccaagcatccattcgtacgtaggcacggatcttggtcaggatggaatgatattcacagttgaatgtaaccttttttgtgttatgtaccactatgatttgtggatggtgtaaatttgattgaattggattgatcgggacataataagcaatatcatcctcgtgtactcggtgatggtcgg

SEQ ID NO: 15384 - protein, 228 aa, Panicum virgatum; identical to SEQ ID NO: 9869
  misc_feature: Ceres CLONE 1782432
  misc_feature (12)..(204): Pfam Name: Snf7 Pfam Description: Snf7

SEQ ID NO: 15385 - DNA, 833 bp, Panicum virgatum
  misc_feature: Ceres CLONE 1782471
  misc_feature: Encodes the peptide sequence at SEQ ID NO. 15386
attcgcaaacaaatccaaggcctctcgagacgaggcgaacccgtcccctccattccctccgctgctgcgcatcaacgcccaatctgatggaagctgcggcggctactacctcctccctgatcctcttctccagtcccaggagatcactcacaagcttaaacacttcctcctcattgcttcggccctcttgcagcagctgctccgttcccagtgccaagcagcagcatccggtttgcctggatgtgccaaggttacacagcagcaagaagaagagcatcctgaggtgttcctccagccttgctgatggtccatccaccgttggttcttcagtaagatgggttcttgaccctgcaggcgacggcgattggcgccacatcggctacaaagttgcacgccccggcgcgttcgagatagcctccgatgcggtgaccgttggtcgggtcgctgacaaagctgacatcgtcctccccattgccacagtttctggcacgcacgctcggctggagaagaaagacgggaggctgctggtgacggacctgggcagcaccaacggaacctacatcaacgagcggcgcctcaaccctggcttcgcaattcccattgaccccggcagcctactcatctttggtgacatccacctggcgatgtttcgtgtgaggaagatgatagttgaggtgcccagcgagacggataaaacccaacaagaaaccaagaccgaggtagtatcagctgcagttgaagatactacaagctagcaagctctgatgtgttcctagtgccccactagctactagtagaatgttcggaataaaaacctacacggtcatggactc

SEQ ID NO: 15386 - protein, 222 aa, Panicum virgatum
  misc_feature: Ceres CLONE 1782471
  misc_feature (114)..(181): Pfam Name: FHA Pfam Description: FHA domain
  misc_feature: SWISSPROT Homolog: EC 1.14.13.90 Zeaxanthin epoxidase
MEAAAATTSSLILFSSPRRSLTSLNTSSSLLRPSCSSCSVPSAKQQHPVCLDVPRLHSSKKKSILRCSSSLADGPSTVGSSVRWVLDPAGDGDWRHIGYKVARPGAFEIASDAVTVGRVADKADIVLPIATVSGTHARLEKKDGRLLVTDLGSTNGTYINERRLNPGFAIPIDPGSLLIFGDIHLAMFRVRKMIVEVPSETDKTQQETKTEVVSAAVEDTTS

SEQ ID NO: 15387 - DNA, 792 bp, Panicum virgatum
  misc_feature: Ceres CLONE 1782512
  misc_feature: Encodes the peptide sequence at SEQ ID NO. 15388
aaaaatcattggacacaaacacaaacacgccaaaaggtgaggagcgcacgcaacgagtgagcaggcggagcccagcgagacgggcgggagagatcgccgaatccttatccacctcgccgcgccatggccgccgccgccgccgccgtccacctctccacccacgcccgcctccgcctccgccgctcgccggccgacccgccctccacctcctcccgccgcccgaccctcctgcgctgccgcgcgttcaagcaggagcccgacgggggcagcagcggcaccgacccgaccgaggcgcggaagcgcaggaagaaggggccgctgtacaagctcaaggccgcgatccaggggctcgcgggctcccgctcagccgccgcggaggcgtacgggggagagtaccagcgcgccgtcgggaaggcggaggagatcttcttctcggttactactcagctaggaaaatatgttatcactatgatgagcagtggtgttgtactcggggttggatttcagctatcaggtggagacagccaaatgaatgaactaatttggtacagctggcttggtggggtgattatcggtacaatgataggtacaaacagtgtcctagaggaacactgcaaagctggacctcgcaatgtcgtcataactggaagcacaagagggttaggaaaagcacttgctcgtgagtttcttctttcaggagaccgtgttgttattacgtcacgaagtcctgaatcagttcttcagactatcaaagaacttgaagagaacattcaggagggcttatcagtagcc

SEQ ID NO: 15388 - protein, 222 aa, Panicum virgatum
  misc_feature: Ceres CLONE 1782512
  misc_feature: SWISSPROT Homolog: EC 1.1.1.62 Estradiol 17-beta-dehydrogenase
MAAAAAAVHLSTHARLRLRRSPADPPSTSSRRPTLLRCRAFKQEPDGGSSGTDPTEARKRRKKGPLYKLKAAIQGLAGSRSAAAEAYGGEYQRAVGKAEEIFFSVTTQLGKYVITMMSSGVVLGVGFQLSGGDSQMNELIWYSWLGGVIIGTMIGTNSVLEEHCKAGPRNVVITGSTRGLGKALAREFLLSGDRVVITSRSPESVLQTIKELEENIQEGLSV

SEQ ID NO: 15389 - DNA, 585 bp, Panicum virgatum
  misc_feature: Ceres CLONE 1782520
  misc_feature: Encodes the peptide sequence at SEQ ID NO. 15390
acatgagcaccggcggcgcggacaagcccagcggcggcggcggcggcggcgcggtgaagacgccgtccgacttcctcaagtccatccgtggccgccccgtcgtcgtcaagctcaactccggcgtagactacagaggtattctcgcttgccttgatggttatatgaacatcgcgatggagcagaccgaggagtatgtaaatggtcagctgaagaacaagtatggcgacgccttcataagaggcaacaatgttttatacatcagcacgtcgaagcggacactcaccgatggcgcgtagggctgagtggagccctcccttttctgtcgtgtaactcccaagccattaacttggttgcactctgactcgatgcttcttttcaatctctgtacttgctgtctggaggaagtctgggaaagggaagatgtatcagatgctattcttgatgtaactggcattttgcttccccgtatcagcttttaggatatggataagatttgtgtttgctggtcgttgctttgcgccagtgttgtttaggcgttaatggtttggatcaactcttttgattctgtgatatgtggtgagtttc

SEQ ID NO: 15390 - protein, 97 aa, Panicum virgatum
  misc_feature: Ceres CLONE 1782520
  misc_feature (23)..(88): Pfam Name: LSM Pfam Description: LSM domain
MSTGGADKPSGGGGGGAVKTPSDFLKSIRGRPVVVKLNSGVDYRGILACLDGYMNIAMEQTEEYVNGQLKNKYGDAFIRGNNVLYISTSKRTLTDGA

SEQ ID NO: 15391 - DNA, 862 bp, Panicum virgatum
  misc_feature: Ceres CLONE 1782540
  misc_feature: Encodes the peptide sequence at SEQ ID NO. 15392
acaagcacgggcacccagccggagcagcagccaagcgccacacgccgccgacgcgaaccagccaaccaaccggctggtgggtaggcaggttaggtaggcagctcggctcacgatggcgccgcgccgcgccgccctcttcgccgccgcgctcctcctggcctccgccgccgcggcggtctccgggttccacctcggtggggacgagagcgggctcgtacggggcgtgctcgccgcgctccgcgagcgggccgaggccgaggacgccgcgcgcttcgccatcgcccaccacaacaggaaccagggtgctgctttggagttgacacgggtgctgaaatcgaagcggcaggtggtgaccgggacactgcatgacctggtattggaggctgctgatgttggaaaaaagagtctgtacagagcaaaggtttgggtgaagccatgggaagatttcaagtcagttgttgagtttcgccttgttggagactctgaggttgaatccgagctttctgttgcttctgatggtagctctgttcaagccattgccaaggtctctcttgaagcagacatcgcacaagaagaggctcgcctgcacacagttgagaatgaaggactttccaacggcttcgcatcgtcctcctagacatacttggtgtgactagaattccaggaggggatggaaggtgtgaaggtagtaactgaagtcttaaggtatctatagatagtaagtcgctgtcaagctgaaatgcttcgactcttctaccggaatatgtatattttgtttggaacgtgggaacatagatctgtatatttcagttttcacactgtccatttccatgtctgtacataaggtggccagttcttctgt

SEQ ID NO: 15392 - protein, 174 aa, Panicum virgatum
  misc_feature: Ceres CLONE 1782540
  misc_feature (37)..(122): Pfam Name: Cystatin Pfam Description: Cystatin domain
MAPRRAALFAAALLLASAAAAVSGFHLGGDESGLVRGVLAALRERAEAEDAARFAIAHHNRNQGAALELTRVLKSKRQVVTGTLHDLVLEAADVGKKSLYRAKVWVKPWEDFKSVVEFRLVGDSEVESELSVASDGSSVQAIAKVSLEADIAQEEARLHTVENEGLSNGFASSS

SEQ ID NO: 15393 - DNA, 465 bp, Panicum virgatum
  misc_feature: Ceres CLONE 1782553
  misc_feature: Encodes the peptide sequence at SEQ ID NO. 15394
gcagcagcggccgcatcgtcacgttctcgtcgtccatcgtgggcacgctcctgccgggctacgcggcgtacacggcgaccaacgccgccgtggaggcgatgacgaagatcctggccaaggaggtggcggcgaagggggtcaccgcgaacgtggtggcgccgggacccgtgcgtacggagctgttctttgccgggaaagatgaggccttcgtgcggaaggtcgaggagcggtccatggggcgcatcgccgagaccacggacgtcgcatcggtcgtgacgttcctggtgagcgacggcgcggcgtgggtgaatggccaggttatccgggtcaacggtggcttcgcctaaaagccagataagcagagcttcttcagttgtagcatctactgtgtctgaaaagttgagattcagttgttgcacgggtgtagcgaagttattgccatgataataccacgcatgtagctcc

SEQ ID NO: 15394 - protein, 114 aa, Panicum virgatum
  misc_feature: Ceres CLONE 1782553
  misc_feature: SWISSPROT Homolog: EC 1.1.1.100 3-oxoacyl-[acyl-carrier-protein] reductase
SSGRIVTFSSSIVGTLLPGYAAYTATNAAVEAMTKILAKEVAAKGVTANVVAPGPVRTELFFAGKDEAFVRKVEERSMGRIAETTDVASVVTFLVSDGAAWVNGQVIRVNGGFA

SEQ ID NO: 15395 - DNA, 714 bp, Panicum virgatum
  misc_feature: Ceres CLONE 1782562
  misc_feature: Encodes the peptide sequence at SEQ ID NO. 15396
aaaacctgggccactgatcgccgagccacgcggttcactactacggcccaaacagcaagaggtgcgcagcgccgcaacaacttgttgagagagatggcgagcccgatggtggccgccccgctccagctccgcaccagcaccggctgcctcagcttctcctcctccccccccagcgcagcagccaggcggcgattcgcggcggtgcaggcgtcggcggaggcgatggccacggagaagctgggtatcagggtggagcgcaacccgcccgagtcccgcctctccgagctcggcgtccgccagtggcccaagtgggggtgcgagaagagcaagttcccgtggacctactcggccaaggagacgtgctacctgctgcaggggaaggtgaaggtgtacccggagggccacggggaggacttcgtggagatcgccgcgggggacctggtcgtcttccccaagggcatgagctgcacctgggacgtcgccgaggccgtcgacaagcactacaacttcgagtagccgcttgccgccgccgccgcccgccaatgtcggactagcctggtatggaatgcagtagcagtaattttgtgaccgcctggtggggatgtttgaattgctcctacttttccattcctacctgcctgtagaccttctgtgctctgaaccagtgatgctccagtccagtgttaaacatcataataaagctctggatyagag

SEQ ID NO: 15396 - protein, 140 aa, Panicum virgatum
  misc_feature: Ceres CLONE 1782562
  misc_feature (62)..(137): Pfam Name: Cupin_3 Pfam Description: Protein of unknown function (DUF861)
  misc_feature: Useful for making plants with modulated cold sensitivity
MASPMVAAPLQLRTSTGCLSFSSSPPSAAARRRFAAVQASAEAMATEKLGIRVERNPPESRLSELGVRQWPKWGCEKSKFPWTYSAKETCYLLQGKVKVYPEGHGEDFVEIAAGDLVVFPKGMSCTWDVAEAVDKHYNFE

SEQ ID NO: 15397 - DNA, 638 bp, Panicum virgatum
  misc_feature: Ceres CLONE 1782568
  misc_feature: Encodes the peptide sequence at SEQ ID NO. 15398
cgccttgcagaaaccctagagaccgctcgaggccgccgccgccgccgctccgctccgctccgctcttcttctccggctccctccctcccggatcaaggatgaagtttgttgctgcctatctgcttgctgtcctcgctggcaaccccagcccctctgcaaaggatctatcgtctattctggaatcagttggctgtgaaattgacaatgaaaagatggagctgctgctgtcccaactgagtggcaaggacattaccgagctcattgctgccggcagggagaagtttgcttcggttccatgcggtggtggtggtgtggctgtggcagcagctgcccctgctgctggtggagctgctcctgcagctgaggccaagaaagaagagaaggtcgaggagaaggaagagagtgatgatgacatgggcttcagcctcttcgactaagctgtgtggtcatcagaggtgtctttttggcaggaaaaccagagtcgccatgtttggacttttactttgttttatgttgcgaagcacctgaaaagattgctactgccttgatatgtagtatttcagccgtaggttgctagactggttggtgtttactggtgaaccagagtttatgcatcatatattgagaatcggttaccc

SEQ ID NO: 15398 - protein, 112 aa, Panicum virgatum
  misc_feature: Ceres CLONE 1782568
  misc_feature (17)..(111): Pfam Name: Ribosomal_60s Pfam Description: 60s Acidic ribosomal protein
  misc_feature: Useful for making plants with altered oil content
  misc_feature: Useful for making plants with modulated biomass
MKFVAAYLLAVLAGNPSPSAKDLSSILESVGCEIDNEKMELLLSQLSGKDITELIAAGREKFASVPCGGGGVAVAAAAPAAGGAAPAAEAKKEEKVEEKEESDDDMGFSLFD

SEQ ID NO: 15399 - DNA, 899 bp, Panicum virgatum
  misc_feature: Ceres CLONE 1782584
  misc_feature: Encodes the peptide sequence at SEQ ID NO. 15400
tctctaaaccctacccgcgccgccgcctcgcatcgccagccgccgccgccgcgccgtgcgagctcagaccagcttccaccatggcggacatcgatgtcgaacccgaggtcgccgccggcgcgcctaagaagaggacgttccgcaagtacagttaccgcggcgtcgacctcgacgcgctgctcgacatgtccaccgacgacctcgtccagctcttccccgcgcgcgcaaggagaaggttccagaggggtctgaagaggaagcccatggcgctcatcaagaagctgcgcaaggcgaaaaaggatgctcctgccggtgagaagccggagccagtgaggacccatctccgcaacatgatcattgtccctgagatgattggaagcatcatcggtgtttacaatggcaagacattcaaccaggttgagatcaagcctgagatgattggccactacctcgctgagttctccatctcctacaagccggtcaagcacggtaggcctggtattggtgccactcactcctcgcggttcattccactgaaatgagttattgcccagttgtcagccccagaatccagcacggaagacgcatggcatgtcatgtttccttccagctgtgctgcttgttttgaagaagttgcatattaccaatggtgttttgctctgtttcagctctagaatcctagctaagcaatgcacaatttatgctgttttgagttaatcttatctatactgcgatgtggttgcttgtcagcattgtgatcgcttcattgttcttatgcgctgtatgctggattgctgaaatttgaacaccgccctatccttggtatacttgcctgatcgtactgggttatgacgatcacatgttgtcatcatgttttttgatggcttgaaggccacctc

SEQ ID NO: 15400 - protein, 153 aa, Panicum virgatum
  misc_feature: Ceres CLONE 1782584
  misc_feature (55)..(136): Pfam Name: Ribosomal_S19 Pfam Description: Ribosomal protein S19
MADIDVEPEVAAGAPKKRTFRKYSYRGVDLDALLDMSTDDLVQLFPARARRRFQRGLKRKPMALIKKLRKAKKDAPAGEKPEPVRTHLRNMIIVPEMIGSIIGVYNGKTFNQVEIKPEMIGHYLAEFSISYKPVKHGRPGIGATHSSRFIPLK

SEQ ID NO: 15401 - DNA, 570 bp, Panicum virgatum
  misc_feature: Ceres CLONE 1782600
  misc_feature: Encodes the peptide sequence at SEQ ID NO. 15402
gcgcatttgtctaattcgtcctcttctccttttcccctcgtcccgacgccgggccggcacggcgaggccaccaaacccagtcgacgcctctccccttcttctcagtccgccggcctcaagccatcactgcaccatcgcccttccctcgaggatggattggcaggggcagaagctcgcggagatgctgatgcaggtgctgcttgtggcgtcggccgtggcggcgttcctggcgggctacgtgcgcggggacttccagctcatgctgctcgtctacgccgctggcgtcgtgctcacggcgctcgtcaccgtccccaactggcccttcttcaaccgcaacccgctcaagtggctcgacgccgccgaggccgagcgccacccgcgcccgcagatcagcgccaccggcgcgggggcagggggtaagaagaagtccgggaagaacaagtagttggtctttcagaggcaatatgtgttgtcggcccatatgactcgacttgttttggtactgttttcagagctatatatgacattgaaatattagacaattgcggtgctaagttaacagatcagcgg

SEQ ID NO: 15402 - protein, 97 aa, Panicum virgatum
  misc_feature: Ceres CLONE 1782600
  misc_feature (1)..(80): Pfam Name: SPC12 Pfam Description: Microsomal signal peptidase 12 kDa subunit (SPC12)
MDWQGQKLAEMLMQVLLVASAVAAFLAGYVRGDFQLMLLVYAAGVVLTALVTVPNWPFFNRNPLKWLDAAEAERHPRPQISATGAGAGGKKKSGKNK

SEQ ID NO: 15403 - DNA, 601 bp, Panicum virgatum
  misc_feature: Ceres CLONE 1782605
  misc_feature: Encodes the peptide sequence at SEQ ID NO. 15404
ctattgctcggatccacctcttcctctcccgcacgccgccgccgccgccgccgccgcgatgggcctcttcgacgtgctctactgcgcggtcatcctgtggctgtcggtggtgtcgtggctcatcttctcctgggtcggcggggaggacggcggcgggggccgcggcgggaggaggcgccgggggggcggcagccgcgggagccccgtgttcgtgggcgccgcggggatctgcgacggcaccgggcccggctgcagcggcggctacggcatctgcggaacctgcctcgactagccagcctctctccttcgcgccgagcgagcgtgtacatgtcgccaccgatcgacgctgtgctgtgtgtcgtggcgtcgatcgacttggcgtggctccggaggagagaaagggagggctcccctctgtcaaggcaataagagggagatccaccaccagtctgtttaatttccatcttgcttcggttgcagaagctgagttcttagcttgcttttttttttacgtttccttcctctatctgcttgatcctctgtgtaaatatctccatattccgtttgtctccagtttaattaagctgcaaaagtacctgtc

SEQ ID NO: 15404 - protein, 77 aa, Panicum virgatum
  misc_feature: Ceres CLONE 1782605
  misc_feature: Useful for making plants with altered alkaloid content
MGLFDVLYCAVILWLSVVSWLIFSWVGGEDGGGGRGGRRRRGGGSRGSPVFVGAAGICDGTGPGCSGGYGICGTCLD

SEQ ID NO: 15405 - DNA, 920 bp, Panicum virgatum
  misc_feature: Ceres CLONE 1782619
  misc_feature: Encodes the peptide sequence at SEQ ID NO. 15406
gctagatccgctaggagccggctgaagcggttccgttccgcccttgctctccgaaatccaactcctcctcccccgtccgggaagcgaaggccgcagtccctctcctccctcctcccctgctgtcctcggtgtccggcgcacaccacggccggcgcagggatgcagaaccccgccacgcccaccccggcggcggccccgtccaagggcaagtcggcggcgcagaatcctagcgagcaccacgccgcgacgaccgccccgtcggggacgccgtccaagggcaagtcggcggcggctcaggccgcggccgcgggccagggctcctcctcgcatcaccactccgctgccggcgccgacgcgtccgcccccaccctcaagcgcaagcgcggcgtcttccagaaagacctgcagcacatgatgtatggatttggggacgatcctaatccacttccagaaactgttgctcttgtggaggacattgttgtggaatatgtcactgacctggtgcacaaggcacagaatgttgcatcaaagagggggaagctcctgacagaggattttctttaccttatacgcaaggatttacggaaactgcaccgtgctactgaactactctccatgaatgaagagctcaagcaagcaaggaaagcttttgatgtggatgaagagacgctggctacaaatgccatatgatatcttcacagaagccttggaaaccttcatacaatatgcattagttttcctttcagctgtttctgctgaaagcgatttatataatgttggtttttgagggcttttaccttgtactgaccaaaccatcatatcgttcttgttgcctaaactaaacagttgatgcgtactgacgacaattcacctgcgcattcctggtttcaaacttcagaaagcactcctggtatggtatt

SEQ ID NO: 15406 - protein, 176 aa, Panicum virgatum
  misc_feature: Ceres CLONE 1782619
  misc_feature (76)..(166): Pfam Name: TFIID-18kDa Pfam Description: Transcription initiation factor IID, 18kD subunit
MQNPATPTPAAAPSKGKSAAQNPSEHHAATTAPSGTPSKGKSAAAQAAAAGQGSSSHHHSAAGADASAPTLKRKRGVFQKDLQHMMYGFGDDPNPLPETVALVEDIVVEYVTDLVHKAQNVASKRGKLLTEDFLYLIRKDLRKLHRATELLSMNEELKQARKAFDVDEETLATNAI

SEQ ID NO: 15407 - DNA, 773 bp, Panicum virgatum
  misc_feature: Ceres CLONE 1782647
  misc_feature: Encodes the peptide sequence at SEQ ID NO. 15408
atcttcctcctcttattagctccttcgatccattgctgggataacgcaagctaaggtgacccgggaggaatgtcgtcggcccagatcgcgccgccgccggagcatgtgtgctacgtgcactacaatttctgcaacacaattctcgcgttggtgcaggagaatttcaaggttcacaatattcacaatatcagctttactgaaaactactctgagtatgctccttcgtcttcaaaattccggatgccaatgatgttctcagcaaaaggagatcaggatcatatgctgcacgtgcgtgctctagagaagcggcaacgtgttccatcagcatacaatagatttattaaggaagagatacggaggattaaagcaagcaaccctgccataagtcatagagaagcattcagcactgcagcaaagaattgggcacattttccaaacatacattttggcctagggacccatgaaagcagcaagaagcttgatgaggccattggtgcggcaggtggtccccagaaagtccaagatctctactagagacctgcaacacccatcttgattccgtgttgtaagtaattttagaaaagaaaactatcttaattccaaatccatttgcaagtggtgtacatatataggtaagtgatatcatggataaataaagaataagacatatatatgtacgagaacataatgctactggctctttcaccaggactgcatagggacctcatcatgttgttatttaataccggattgaaataaattatcctttctgc

SEQ ID NO: 15408 - protein, 154 aa, Panicum virgatum
  misc_feature: Ceres CLONE 1782647
  misc_feature (4)..(128): Pfam Name: YABBY Pfam Description: YABBY protein
  misc_feature: The sequence is a functional homolog of SEQ ID NO 1506 in the 10/666,642 US patent application
  misc_feature: The sequence is a functional homolog of SEQ ID NO 420 in the 10/666,642 US patent application
MSSAQIAPPPEHVCYVHYNFCNTILALVQENFKVHNIHNISFTENYSEYAPSSSKFRMPMMFSAKGDQDHMLHVRALEKRQRVPSAYNRFIKEEIRRIKASNPAISHREAFSTAAKNWAHFPNIHFGLGTHESSKKLDEAIGAAGGPQKVQDLY

SEQ ID NO: 15409 - DNA, 593 bp, Panicum virgatum
  misc_feature: Ceres CLONE 1782846
  misc_feature: Encodes the peptide sequence at SEQ ID NO. 15410
agctccatttgactagtgtgtgatccttatcaccgctcatgtaaataacccctgtacttgtactgtgcctatattaaggcttggtgatatcaataaagatgaggcatcctgccgttctgcactcattccttcctagccaggccactgtagaataaaagcaacatgaagaagcagcggatcctgctccatgttctcttcttcctcttcctcttcatcctcatggctgcccttgctgttgatgctgatgatccacaggagctgcaggagcagcatcgatccctgctccaggctcccccaaagatagactgcccgtcaagctgcatggtgcgctgcggcagaaactggaagaacaagatgtgcaacaagatgtgcaacgtctgctgcaaccgctgcagctgcgtcccgccaggcaccggccaggagacacgccacctctgcccctgctatgacaccatggtcaacccaaaaaccggccagcccaagtgcccgtagcctggtgcctcaggccaatctggcaatttctgccgttcgtgttatctatgtatgctatcatcttcatgttaactatatcaactgatgataaataaacacct

SEQ ID NO: 15410 - protein, 109 aa, Panicum virgatum
  misc_feature: Ceres CLONE 1782846
  misc_feature (6)..(109): Pfam Name: GASA Pfam Description: Gibberellin regulated protein
MKKQRILLHVLFFLFLFILMAALAVDADDPQELQEQHRSLLQAPPKIDCPSSCMVRCGRNWKNKMCNKMCNVCCNRCSCVPPGTGQETRHLCPCYDTMVNPKTGQPKCP

SEQ ID NO: 15411 - DNA, 635 bp, Panicum virgatum
  misc_feature: Ceres CLONE 1782862
  misc_feature: Encodes the peptide sequence at SEQ ID NO. 15412
ggaacaagggagcaggaccagcgaatgtttacctgcttcgccgggcgcgcctcctccacgacatcgagcatcgtcgcggggggcctcgccgccgccgccgccgcgcccgcccccgcgccgtcgcccaagccccgcagccccgcctccgccgcccgccgcaagctcatcatgagcaagcccgtcttcgaccgccagagggccgtcgcgggaatggacgccgtcgagcgcgagaggagcgggttcgagcatgtcaagacccaggtatatgacaagaagccggagctgttgaagccgctcaaggccggccaatcacgaatggacatggttttcgcatgcgccgactcccgctgctgcccgacggtgaccctgggcctgcagcccggcgaggccttcagcatgcgcaacatcgccggcatggtcccgccctactacaagaacaagtacgccggcatcggggccgccatcgagtacgccgtctgcgcgctgaaggaggaggtcctcagcgtcagtgggcacagccgctggggtggcatcaaggcgctcctctccgtccaggacggcgcagccgacaccttccacttcatcgaggactgggtcatgatcggcttccaagacaagaagaaggagctgaaaga

SEQ ID NO: 15412 - protein, 203 aa, Panicum virgatum
  misc_feature: Ceres CLONE 1782862
  misc_feature (92)..(203): Pfam Name: Pro_CA Pfam Description: Carbonic anhydrase
  misc_feature: SWISSPROT Homolog: EC 4.2.1.1 Carbonate dehydratase
MFTCFAGRASSTTSSIVAGGLAAAAAAPAPAPSPKPRSPASAARRKLIMSKPVFDRQRAVAGMDAVERERSGFEHVKTQVYDKKPELLKPLKAGQSRMDMVFACADSRCCPTVTLGLQPGEAFSMRNIAGMVPPYYKNKYAGIGAAIEYAVCALKEEVLSVSGHSRWGGIKALLSVQDGAADTFHFIEDWVMIGFQDKKKELK

SEQ ID NO: 15413 - DNA, 687 bp, Panicum virgatum
  misc_feature: Ceres CLONE 1782909
  misc_feature: Encodes the peptide sequence at SEQ ID NO. 15414
gacaccttggcttatagttctcatgcattctcccatgtacaacagcaatgaggcacattatatggagggtgagagtatgagggctgcttttgagaaatggtttgtgaagtacaaggtcgacttggtatttgcaggtcatgttcatgcttatgagagatcataccgcatttcgaatgtcaactacaacataacatcggggaatcgatatccagtgccagacaaatctgctcctgtttacataactgttggtgatggaggcaaccaggaaggacttgcttcaaggtttaacgacccccagccggactactctgcattcagggaggccagttacggccattcaattttacaactggaaaacaggactcatgccgtctaccgatggaatagaaatgacgatgggaataacgttccagcagacaccgtggtgtttcataaccaatactggacaagcagcacgcgtcgcaggaggctgaagaaaaaccacttccatcttgagaaactcgaggatctgatctccttattctaggagagctggtctcgcagcctcgcaggacgttacgcagcacgacctttgttttgtggagcaatggcagaatagcaccgttgctagtgtccggtgctcttcggagcagcaggagaccagttatcagactggccattgcaagtccagctacccgatttcatccc

SEQ ID NO: 15414 - protein, 174 aa, Panicum virgatum
  misc_feature: Ceres CLONE 1782909
  misc_feature: SWISSPROT Homolog: EC 3.1.3.2 Acid phosphatase
TPWLIVLMHSPMYNSNEAHYMEGESMRAAFEKWFVKYKVDLVFAGHVHAYERSYRISNVNYNITSGNRYPVPDKSAPVYITVGDGGNQEGLASRFNDPQPDYSAFREASYGHSILQLENRTHAVYRWNRNDDGNNVPADTVVFHNQYWTSSTRRRRLKKNHFHLEKLEDLISLF

SEQ ID NO: 15415 - DNA, 829 bp, Panicum virgatum
  misc_feature: Ceres CLONE 1782919
  misc_feature: Encodes the peptide sequence at SEQ ID NO. 15416
acacgccgacgccgatcgagctacctcccaccgacatcttgcggagttgcagtcctatctcttccgatccgtcccgcccgccgccgcagcttgggattagttcttctccgcgcggagatccgtgagccatggctgctgagttgaccatgcagactgttgtcctcaaggtggctatgtcatgccagggttgcgccggggcggtcaggagagtgctctcaaagatggaaggagttgagacctttgacatagacctcaaggaacagaaggtgacagtcaaaggcaatgtcaagcctgaggatgtcttccagacggtttccaagtccgggaagaagacctcctactgggagggcgaagccacagcccaggctgctccggctccagcagcagaagcagctcccagcactgaggcagaagcgcctgccgcggaggctgcaccagagagcactccagccgaagctgctgcaccagagatcaccccagtcaaatctgacgcttgatcgtcacatgagatgatgtgaccccaaaaccttactctagaactagctgggaaaccgagtcttgtgtggtttgcatcatgttgttgccactctagcaagtgattgcgaattatagaataaatgataaaacccagtgtgtgcttgcgtgtgatttcaagatgaacacatcccttgcaggattgttgttcmctacattttacatttaccgtaccattgcttacgagatcccccaaaaaggatcttggacgagtacaacccatgttaaacctcatagcttgtgacttctagattctaatatgatctttcgatgataatacattatgttgacctgg

SEQ ID NO: 15416 - protein, 122 aa, Panicum virgatum
  misc_feature: Ceres CLONE 1782919
  misc_feature (10)..(71): Pfam Name: HMA Pfam Description: Heavy-metal-associated domain
  misc_feature: SWISSPROT Homolog: EC 3.6.3.4 Copper-exporting ATPase
MAAELTMQTVVLKVAMSCQGCAGAVRRVLSKMEGVETFDIDLKEQKVTVKGNVKPEDVFQTVSKSGKKTSYWEGEATAQAAPAPAAEAAPSTEAEAPAAEAAPESTPAEAAAPEITPVKSDA

SEQ ID NO: 15417 - DNA, 720 bp, Panicum virgatum
  misc_feature: Ceres CLONE 1782932
  misc_feature: Encodes the peptide sequence at SEQ ID NO. 15418
agtgcccgtctcacattgtcacacagcggagctgccagggtaggaagagaagagagaaggcaggcaggatgccccacagccgcttctcggggtcgctccgctcgcccaagatcgacgtcgtcatcgacatggggaaccccttcctcaaccggaccgtcgacggcttcctcaagatcggcgcggtcggcgcttgcaaggtggccgccgaggagaccttcgagtgcctccatagaggggatgtttcaaagcacaagcttgagcatgcactaaagaaaatgtgcaaggagggtgcttactggggtactgttgctggagtttatgtgggcatggtgtatggagtggaaagggtccgtggtcgtagtgactggaagaatgcaatgataggaggcgcattatctggtgccctaatctctggtgccagcaacaaccacaaagacaaaatcatcaaggacgccatcactgccggcgcagttgcaacagctgttgagttcatcaactaccttacctagttatgcaactgcatttgcagtgccattgtcgtacaataacaacaagaacttcttcagtgaagccatgtccggttcaataaaccagcatcttcagtcttggttgctcctcacccgcttttgctttgtgcggatgtccttatcacccgtttttcgttatcgttgaggcttgcagtcatcgctgtgattctgtgatgacttatttgatttaaag

SEQ ID NO: 15418 - protein, 146 aa, Panicum virgatum
  misc_feature: Ceres CLONE 1782932
  misc_feature (18)..(146): Pfam Name: Tim17 Pfam Description: Tim17/Tim22/Tim23 family
MPHSRFSGSLRSPKIDVVIDMGNPFLNRTVDGFLKIGAVGACKVAAEETFECLHRGDVSKHKLEHALKKMCKEGAYWGTVAGVYVGMVYGVERVRGRSDWKNAMIGGALSGALISGASNNHKDKIIKDAITAGAVATAVEFINYLT

SEQ ID NO: 15419 - DNA, 756 bp, Panicum virgatum
  misc_feature: Ceres CLONE 1782961
  misc_feature: Encodes the peptide sequence at SEQ ID NO. 15420
actcggcgcccgcacccgacaacgcacgcgcccgcaccaccatggccggcgctggcctcaccgtctccatccccatcgcctcccctccgctcgcccgcgcctccgcgcccgcctaccccgcgcgccgcgtctgcgcgatgccgtcctcctccagcagcggcagcagcttcagatcctcgccgctccgcgcgattgccggcttctctgggaacagacagcgcccccgccgcggcgcgtccgtagcatgcgccgtccagggccaggacacgtccatcgaagtcccagatgtgacaagggcaacatggcaatcgcttgtgatggaaagtgagcttcctgtccttgttgagttctgggcttcgtggtgcgggccatgcaaaatgatagatccagttgttggcaagctctcgaaggacaacgaggggaagctgaaatgctacaagctcaacacagatgagggcccagacatagcaagccagtccggggtccggagcatccccaccatgatgatattcaagaacggcgagaagaaggattcggtgatcgggactgtgcctgagagcacactgaccgcatgcatcgataaatttgtggagaggtgaaatgcccagcggatctcttgaaagcggctgcctttcaaaagcctgtgttcagatcagtggacccgtacgcagaaacagttctatatacctggttgtagatatcggaatcacattcgattattgtttgatgaaggcggcatgagttgctttccgcccc

SEQ ID NO: 15420 - protein, 185 aa, Panicum virgatum
  misc_feature: Ceres CLONE 1782961
  misc_feature (79)..(182): Pfam Name: Thioredoxin Pfam Description: Thioredoxin
  misc_feature: SWISSPROT Homolog: EC 1.8.1.8 Protein-disulfide reductase
MAGAGLTVSIPIASPPLARASAPAYPARRVCAMPSSSSSGSSFRSSPLRAIAGFSGNRQRPRRGASVACAVQGQDTSIEVPDVTRATWQSLVMESELPVLVEFWASWCGPCKMIDPVVGKLSKDNEGKLKCYKLNTDEGPDIASQSGVRSIPTMMIFKNGEKKDSVIGTVPESTLTACIDKFVER

SEQ ID NO: 15421 - DNA, 551 bp, Panicum virgatum
  misc_feature: Ceres CLONE 1782967
  misc_feature: Encodes the peptide sequence at SEQ ID NO. 15422
tagttgctgcaatcccatcatggccaccgcctgacgcatcaccgcgcagctcggcctcaccacgctgcaccgcggccacgcccccgccggcgtcatcgaggccatcgcccaatgcggctccaaggtcaacaaaggcgtcgccctcagggcgacgtccggcggccagggcatgacgaaagatgtgcccgaaatcgtcaaggctgcccaggacgcgtgggacaaaattgaggacaagtacgccgtggccgccatccgcgtcgccgccgtcgtcacgctaaggaccgaggcaggggccctcaaggccatcgacaagcttcctctcctgcctggtgtccttgagattgttggaatccgctataatgggtggctctcataccgccacctcctcttccagccagacagggaagctcttatcactaaggtcaagagcacttacaaagaactcaccggaagaagcagctgatcaagcatcattaactagatgggatctgtaaggagacgctataattgaatccatgagcactgacctgccatgcacgcgaaagtgctaa

SEQ ID NO: 15422 - protein, 97 aa, Panicum virgatum
  misc_feature: Ceres CLONE 1782967
  misc_feature: SWISSPROT Homolog: EC 6.1.1.9 Valine--tRNA ligase
MTKDVPEIVKAAQDAWDKIEDKYAVAAIRVAAVVTLRTEAGALKAIDKLPLLPGVLEIVGIRYNGWLSYRHLLFQPDREALITKVKSTYKELTGRSS

SEQ ID NO: 15423 - DNA, 516 bp, Panicum virgatum
  misc_feature: Ceres CLONE 1783026
  misc_feature: Encodes the peptide sequence at SEQ ID NO. 15424
atccgcaaacacaagcttcacgcacgcagaacctctctccgcagcttctcccccgcagccagcttcacttgcaaacccgcctccgtcgattagcgttccacgcggagcagcagccagatggccgccacgatgaagctcaggatcctcgccgccgccgccgccgccgcgtcgtgcctggtcgcgaccgcctccgcggccaaggggccggcgcccgccccgacgtccggcgcatcgtccatggccgcgccggccgttgccgcggcgtccctgaccgcgctcgtcttcggctacctcttctaagaagtgccgtggacggcgttgcatgtagtaccaaattgtttcctgctcagagatttcttcttcttgtcgttgtctttgcttgttggtgtgtatggtgagtattgtaattaagtgtccattttttttatatgaatcttgtaatctcagtgcatggacataaatagagagagctgcagtttggttcttttaacacgatgttggacaaaagctgaccgg

SEQ ID NO: 15424 - protein, 60 aa, Panicum virgatum
  misc_feature: Ceres CLONE 1783026
  misc_feature: Useful for making plants with altered carbohydrate content
MAATMKLRILAAAAAAASCLVATASAAKGPAPAPTSGASSMAAPAVAAASLTALVFGYLF

SEQ ID NO: 15425 - DNA, 656 bp, Panicum virgatum
  misc_feature: Ceres CLONE 1783030
  misc_feature: Encodes the peptide sequence at SEQ ID NO. 15426
ggaaagtgtcatcgtccttcacttcttccaacctctgaatctctctgcatctgtgtgatcgaggaagaaaggaggagccaacaaacatggtgcacgggaagctggaggttctccttgtctccgccaagggccttgaggacaccgatttcctcaataacatggacccctacgtgatccttacatgccgcacccaggagcagaaaagcagcgttgcaaatggagaaggaagtgaacctgaatggaacgaaaccttcatcttcacggtctctgacgataccccgcagcttaatctcaagatcatggacagcgacgtcaccaacgatgatttcgttggtgaagcaagcatccccctggaggctgtgtttcaggaaggcagccttcccccgacagttcacccagtcgtcaaggaggataaatactgcggagagatcaagcttgcactcaccttcactccagcagtggaaactcgccgccccgacaacgaggagggtacttacagcagctggaattgatctgcccgatgtgtgcactgagcaataacataatttactgaagaattactgctgttatacaacactattttgctttgtcatgaactgaatatttgcatgtaacttccagcattgtgataactattcagaattgttgctttgcgc

SEQ ID NO: 15426 - protein, 141 aa, Panicum virgatum
  misc_feature: Ceres CLONE 1783030
  misc_feature (6)..(86): Pfam Name: C2 Pfam Description: C2 domain
  misc_feature: SWISSPROT Homolog: EC 3.1.1.4 Phospholipase A(2)
  misc_feature: Useful for making plants with modulated nitrogen use efficiency
MVHGKLEVLLVSAKGLEDTDFLNNMDPYVILTCRTQEQKSSVANGEGSEPEWNETFIFTVSDDTPQLNLKIMDSDVTNDDFVGEASIPLEAVFQEGSLPPTVHPVVKEDKYCGEIKLALTFTPAVETRRPDNEEGTYSSWN

SEQ ID NO: 15427 - DNA, 653 bp, Panicum virgatum
  misc_feature: Ceres CLONE 1783045
  misc_feature: Encodes the peptide sequence at SEQ ID NO. 15428
ctcttccagccctagccctcctcctccccgccgccacctcgcgctcgtcctcccccgcccgctccctcccttcctcaatcgcaagagctctcaacgcggcgaccgcatctccaagatggtgctccagaacgacatcgacctgctcaacccgccggcggagctcgagaagctcaagcacaagaagaagcgcctcgtccagtcccccaactccttcttcatggatgtcaagtgccagggctgtttcagcataaccactgtgttcagccactcccagaccgtggtggtgtgtcctggttgccagacagtgctctgccaaccgactggtggaaaggccaggctcacggagggctgctctttccgccgcaagggcgactaggctactggtgttggcaacagggaaaaaaagatcgatgtcctgctgagcaactcatgtttaatcttccctggatatgtactcgtggaagatttgtttagttatgcctgttaagctcctgtgatgtaaacctgcactttgtttgagtgaaagctgcttagtgttttggtcaccactgtgattccccggtcaaatttctcttggccagcgtgttctgttgatgcacccgcgattgaaggtgtatcaacgttattggacatcttggtaagaaaaccaaaat

SEQ ID NO: 15428 - protein, 86 aa, Panicum virgatum; identical to SEQ ID NO: 9875
  misc_feature: Ceres CLONE 1783045
  misc_feature (30)..(84): Pfam Name: Ribosomal_S27e Pfam Description: Ribosomal protein S27

SEQ ID NO: 15429 - DNA, 723 bp, Panicum virgatum
  misc_feature: Ceres CLONE 1783058
  misc_feature: Encodes the peptide sequence at SEQ ID NO. 15430
ccgtctccgtcctccactccactccacgccaccggtggattggaagcattgccagtttgccacggggggcgccatgccggcggacgggagcaagaagaagggcgtgccgccgctgggctggtggctcatgctcgtcggctccctccgcctcgcctccgtctggttcggcttcttcgacatctgggcgctccgcgtcgccgtcttctcccaagcggagatgactgatgtacacggccgtacttttggtgtctggactcttctgacctgcacgttgtgcttcctttgtgcactcaacctggaaaataggcctctatatctggccaccttcctgtcattcatctatgctattggtcatttcctaacggaatacttgatataccacaccatggctgtggcaaatctcagcacggttggcttctttgcaggtacgtcaattgtatggatgcttcttcagtggaattctcatggcaacccccgtggatcccatgctgtgaagcagtcatgagaaatgctcgggttgtcagcttgatgtggtctgggggaggaaggatgcgtgaagaaaccttgccataaaggctccgttgccattcgtacttcatttgtcatcatgtatttcagttcatgaaatgtttgttccactgattagaatctggaaattcgaacgttgtaaactttgcgcgtctgagtcttgtagccaagagctgtaatttccgatttgatcac

SEQ ID NO: 15430 - protein, 143 aa, Panicum virgatum
  misc_feature: Ceres CLONE 1783058
  misc_feature (11)..(120): Pfam Name: Erg28 Pfam Description: Erg28 like protein
MPADGSKKKGVPPLGWWLMLVGSLRLASVWFGFFDIWALRVAVFSQAEMTDVHGRTFGVWTLLTCTLCFLCALNLENRPLYLATFLSFIYAIGHFLTEYLIYHTMAVANLSTVGFFAGTSIVWMLLQWNSHGNPRGSHAVKQS

SEQ ID NO: 15431 - DNA, 1036 bp, Panicum virgatum
  misc_feature: Ceres CLONE 1783063
  misc_feature: Encodes the peptide sequence at SEQ ID NO. 15432
gtgctctctcagaggtgggttggcttctcctccccctccggttcgcggttcggttcggtccgggttcgtgaggttcttgggggtgagaggaagagatggcggcgtcggatgttgagtaccgctgcttcgtcggcggccttgcatgggccaccgacgacaactcgctccacaacgccttcagccccttcggcgaggtcctcgagtccaaggtccgtcccgtaatctcatctcctcgatccgccgccctcgcttcttctgttcatgatttcctttcggtgggaagaaaaacgaaatttttcaaggaggagaaacgggggagctggccagatctgcggcggcggatggtatcgcgagctagatctggggggctttatttttctgacatgagctcgtgccgtcccttgcagatcatcctcgatcgtgagacccagaggtcccgcggcttcggcttcgtcaccttctcgagcgagcaggcgatgcgcgatgccatcgaggggatgaacggcaaggacctggacggccgcagcatcaccgtcaacgaggcccagtcccgcggcggcccgcgctccggcggcggcggcggcggcgggtacgggcgccgcgagggcggcggtggctacggcggcggcggctacgggcgccgcgagggcggcggtggctacggcagcggcggcggcggcggctacggtggccgtggaggctacggtggcggcggcggcggcggctacggcaactccgatgggaactggaggagctgagcggtggggcccgcgtggccaagttatcctgtccttgctactgttacctgagttatcctgtgccatgatctacctgtgtttggtgtctttcgtgttcgttgttgcccatctgtgtttttgatcgcaagctcgttcgtctagtggtcatgttgtctgtcagagctatcttgacctccatcccatgaaccggggtgttggaattggatgctgttatcttgtgtaacttgttaccgtttcagttaatcgaatggaaaaaaaagttgctacttggtgctgcc

SEQ ID NO: 15432 - protein, 220 aa, Panicum virgatum
  misc_feature: Ceres CLONE 1783063
  misc_feature (77)..(147): Pfam Name: RRM_1 Pfam Description: RNA recognition motif. (a.k.a. RRM, RBD, or RNP domain)
  misc_feature (114)..(215): Pfam Name: GRP Pfam Description: Glycine rich protein family
  misc_feature: SWISSPROT Homolog: EC 5.2.1.8 Peptidylprolyl isomerase
  misc_feature: Useful for making plants with altered alkaloid content
  misc_feature: Useful for making plants with modulated flowering time
  misc_feature: Useful for making plants with altered lignin content
  misc_feature: Useful for making plants with modulated nitrogen use efficiency
  misc_feature: Useful for making plants with modulated biomass
  misc_feature: Useful for making plants with altered terpenoid content
  misc_feature: Useful for making plants with modulated phosphate use efficiency
MAASDVEYRCFVGGLAWATDDNSLHNAFSPFGEVLESKVRPVISSPRSAALASSVHDFLSVGRKTKFFKEEKRGSWPDLRRRMVSRARSGGLYFSDMSSCRPLQIILDRETQRSRGFGFVTFSSEQAMRDAIEGMNGKDLDGRSITVNEAQSRGGPRSGGGGGGGYGRREGGGGYGGGGYGRREGGGGYGSGGGGGYGGRGGYGGGGGGGYGNSDGNWRS

SEQ ID NO: 15433 - DNA, 792 bp, Panicum virgatum
  misc_feature: Ceres CLONE 1783068
  misc_feature: Encodes the peptide sequence at SEQ ID NO. 15434
acccgccgcgtacgtgaccgagcgctaccaccagagagatcgaccgaccgaccgaccaccagcggaagcggcaggatgtcgtggcagacgtacgtcgacgagcacctcatgtgcgagatcaagggccaccacctcacctccgccgccatcatcggccacgacggcaccgtctgggctcagagcgccgccttcccgtcgttcaagcctgaggagatgtccaacatcatgaaggacttcgacgagcccgggttcctggccccgaccggcctcttcctcggccccaccaagtacatggtcatccaaggcgagcccggcgccgtcatccgcgggaagaagggatctggaggcatcaccgtgaagaagaccgggcaggccctcgtgatcggcatctacgacgagcccatgacccccgggcagtgcaacatggtggtcgagaggctcggcgactacctcgtagagcaaggcctgtaaaaacgggccccggcccgccgcccgcccacgggttgaagaagaagcccaagcaacaatacgaccgccagccagcacgtagtagtctgtgtctacgcacgcgttcttagtcccccccacgccgcctgggattgtgcgtggctcgatccgttaccttacctccggcatttcttcccatgcccccgtcgtcgccggtcaccagaggatctttcctttctttgatttttgttggtgtcgttttggcaaataattttgtgattttcctcccgaatttggttgtcgcctgatttgtgaaacaacgatatatatatgtgattgaactgg

SEQ ID NO: 15434 - protein, 131 aa, Panicum virgatum
  misc_feature: Ceres CLONE 1783068
  misc_feature (2)..(126): Pfam Name: Profilin Pfam Description: Profilin
  misc_feature: Useful for biocontainment applications
  misc_feature: Useful for making plants with modulated biomass
MSWQTYVDEHLMCEIKGHHLTSAAIIGHDGTVWAQSAAFPSFKPEEMSNIMKDFDEPGFLAPTGLFLGPTKYMVIQGEPGAVIRGKKGSGGITVKKTGQALVIGIYDEPMTPGQCNMVVERLGDYLVEQGL

SEQ ID NO: 15435 - DNA, 788 bp, Panicum virgatum
  misc_feature: Ceres CLONE 1783124
  misc_feature: Encodes the peptide sequence at SEQ ID NO. 15436
ggcgcaatcgcggaaaagtccaaccccyaaactccccagccggaggggaggcgaggcgatctgggggtgaggggaagcagccgcagtcatgtcggggggaatcgctcgcggccgcctcgccgaggagcgcaaggcctggcgcaagaaccacccgcatggtttcgtggcgaagccggagacgctgcccgacgggacggtgaacctgatgacctggcactgcaccatccccggcaagcaagggactgattgggaaggtggatacttccctcttacccttcatttcagtgaggattaccctagcaagcctccaaagtgcaagttcccacagggcttcttccaccccaatgtctatccttcgggaacagtctgcctttctattcttaacgaggacagcggttggaaaccagctattactgtcaagcagattcttgttgggattcaggacttgcttgatcagccaaatcccgctgatcctgcacagacagatggttatcacctttttatccaggatcaaacagaatataagaggcgtgttaagctgcaggctaagcagtatcccgcattggtctgagaacaattgcgcatctagggatccatgctgcacatccgcatagttgttgctagtgtcttgaaagaaagaccaaatgtaacatggtgctttaagamgtaaagctatcgcccattgtgaaccaattgtgtctgttaacggtgccattaactgttggagtgagtgttttgtgggataatgtcaaaacctttgcagtgtttggtttatattaagatttgcc

SEQ ID NO: 15436 - protein, 160 aa, Panicum virgatum
  misc_feature: Ceres CLONE 1783124
  misc_feature (9)..(153): Pfam Name: UQ_con Pfam Description: Ubiquitin-conjugating enzyme
  misc_feature: SWISSPROT Homolog: EC 6.3.2.19 Ubiquitin--protein ligase
MSGGIARGRLAEERKAWRKNHPHGFVAKPETLPDGTVNLMTWHCTIPGKQGTDWEGGYFPLTLHFSEDYPSKPPKCKFPQGFFHPNVYPSGTVCLSILNEDSGWKPAITVKQILVGIQDLLDQPNPADPAQTDGYHLFIQDQTEYKRRVKLQAKQYPALV

SEQ ID NO: 15437 - DNA, 958 bp, Panicum virgatum
  misc_feature: Ceres CLONE 1783127
  misc_feature: Encodes the peptide sequence at SEQ ID NO. 15438
gaccagcgcctccgtgatgcttgccgcggcgagaatggcgttcgcctcctgcgcccgcttgctcccatcctctccctcgacccacgccttagtgcgggcccgcgccggcgccgtctcgttcttggctcccgcaccgtcgccgtcggcggccgcaaggtcctcgcgtaacctcgcgctcttctgctcttcctcgacgccttcgccggcggacgccgccgtagcgccgccgtccccgcaggccgcggcggaggagacgaagccgtcggccccgggcggggagaaagcggagccgaccgtggaggagctggcggggctgctggacatccgtgtggggcgggtggggaaggcgtggaggcacccggaggcggacacgctctacgtcgaggaggtggacgtaggcgaggcggagccccgcaccatctgcagcggccttgtcaacttcataccaattgaagagctccaggacagcagtgtgattgttcttgctaacctcaaaccaaggaacatgcgtggcatcaagtcgaatggcatgctcatggctgcttctgatgcttcacatgagaatgttgagctgctcacacctccggaaggatctgttcctggtgaaagagtatggtttggtttggaagaagaaaaggatcgtcaatcagaccctgcatcaccaaatcaggtacaaaagaagaaaatttgggaatctgtccagccgcatcttaaaacaacggataagtgcatagcgattctcggtgagcatacaatgcgtacatctgcaggcccagttttctgcaaatcactaaagggtgctagagtgtcataaatctttgttgacgaacacctgtttgtttcaccaagtcttatgtcgtgtacccatccctgaaaatgattaaactacacaagtagagcaactgtctaagatttttgtttccaacttctggcaataatctcacagaattttgatgtc

SEQ ID NO: 15438 - protein, 259 aa, Panicum virgatum
  misc_feature: Ceres CLONE 1783127
  misc_feature (97)..(192): Pfam Name: tRNA_bind Pfam Description: Putative tRNA binding domain
  misc_feature: SWISSPROT Homolog: EC 6.1.1.1
MAFASCARLLPSSPSTHALVRARAGAVSFLAPAPSPSAAARSSRNLALFCSSSTPSPADAAVAPPSPQAAAEETKPSAPGGEKAEPTVEELAGLLDIRVGRVGKAWRHPEADTLYVEEVDVGEAEPRTICSGLVNFIPIEELQDSSVIVLANLKPRNMRGIKSNGMLMAASDASHENVELLTPPEGSVPGERVWFGLEEEKDRQSDPASPNQVQKKKIWESVQPHLKTTDKCIAILGEHTMRTSAGPVFCKSLKGARVS

SEQ ID NO: 15439 - DNA, 750 bp, Panicum virgatum
  misc_feature: Ceres CLONE 1783133
  misc_feature: Encodes the peptide sequence at SEQ ID NO. 15440
atcccaaccccggccgggccgcccgccgcgccgcctgcccgcagatcgaagagaagacagccagagccagcagcagatcgaagcatgtcgggcgtgtgggtgttccggaacggcgtggtgcggctggtggagaacccgacgtcgggggcggcggcgtcggcgtcggggaagcgcaaggcgctgctgcacacgccgtccggggaggtggtctcctcctacgcgtcgctcgagcgcaagctggcggcgctggggtgggagcgctactacgccggcggcggcggcgacgggatgctgcagtaccacaagcgcacctccgtggacctcatctcgctgcccaaggacttcgcccacttcggctccgtccacatgtacgacatcgtcgtcaagaaccgcgacgccttccgcgtcatcgacgcctagctagctagcttcttgctgctcgctcgctcgcttgcatcatcatcatcttcaattcctcatcgtcgtcaagctagccttcttgcatctatctaagctagtgtgtacgtgtgatcgagatcatcagtttgtacgttcgttcgtatgcaatctagctttcacgtatatgtacgtaccttttgtgtacgcggcttgtcgacgtatatttatttatacgcgcctgcatagggagtactctagtcagtattcatggatcgatttggttgccgtggtcgtggtgtgtgcgcgcgcgcgcgcgcatccagtatggtatgtagtactgagttttcgtgt

SEQ ID NO: 15440 - protein, 111 aa, Panicum virgatum
  misc_feature: Ceres CLONE 1783133
  misc_feature: Useful for making plants with modulated flowering time
MSGVWVFRNGVVRLVENPTSGAAASASGKRKALLHTPSGEVVSSYASLERKLAALGWERYYAGGGGDGMLQYHKRTSVDLISLPKDFAHFGSVHMYDIVVKNRDAFRVIDA

SEQ ID NO: 15441 - DNA, 732 bp, Panicum virgatum
  misc_feature: Ceres CLONE 1783153
  misc_feature: Encodes the peptide sequence at SEQ ID NO. 15442
atttatgaagcccccgatgcattaagccagggctcacgccgacgccgatcgagctacctcccacctacatcttgcggagttgcagtcctatctcttccgatccgtcccgcccgccgcctcagcttgggttagttcttctccgcccggagatccgtgagccatggctgctgagactgttgtcctcaaggtggctatgtcatgccagggttgcgtcggggcggtcaggagagtgctctcaaagatggaaggagttgagacctttgacatagacctcaaggagcagaaggtgacagtcaaaggcaatgtcaagcctgaggatgtcttccagaccgtttccaagtcggggaagaagacctcctactgggagggcgaagccacagcccaggctgcttcggctccagcaacagaagctgctgcaccagagatcaccccagtcaaatctgacgcttgatcgtcacataagatgctgtgaccccaaaaccttactctagaactagctgggaaaccgagtcttgtgtgatttgcatcatgttgttgccactctagcaagtgattgcaaattatagaataaatgataaaacccagtatgtccgtctgtgtgatttcaggatgaacacatcccttcactacattttactttattttaccattgctttcgagttccccctaaacacttgtctagaccctattgtcttacaaaaaagaacatgaaatgaatccatgttaaacctc

SEQ ID NO: 15442 - protein, 96 aa, Panicum virgatum
  misc_feature: Ceres CLONE 1783153
  misc_feature (6)..(67): Pfam Name: HMA Pfam Description: Heavy-metal-associated domain
  misc_feature: SWISSPROT Homolog: EC 3.6.3.4 Copper-exporting ATPase
MAAETVVLKVAMSCQGCVGAVRRVLSKMEGVETFDIDLKEQKVTVKGNVKPEDVFQTVSKSGKKTSYWEGEATAQAASAPATEAAAPEITPVKSDA

SEQ ID NO: 15443 - DNA, 728 bp, Panicum virgatum
  misc_feature: Ceres CLONE 1783163
  misc_feature: Encodes the peptide sequence at SEQ ID NO. 15444
ctcttcccttcgcgcaccgctccaccccacgccgccgcttcgccgccgcagccgccaccgtcgccatggcccggatcaaggtgcacgagctccgggggaagaacaaggcggagttgcaggcgcagctcaaggagttcaagtccgagctctccctcctccgcgtggccaaggtcaccggcggagcccccaacaagctctccaagatcaaggtggtgcgcacctcgatcgcgcgcgtgctgacggtgatctcgcagaagcagaaggcggcgctgcgggaggcgtacaagaagaagaagctgctccccctcgacctccgccccaagaagacccgtgccatccgccgccgcctcaccaagcaccagctttctctgaagacggagagggaaaagaagcgtgagaagtacttccccatgaggaagtatgctatcaaggcctaggtcagaactgtgagatgtttctagcatattgtgggctgtttctttgcctaggaagtgttttaagttttgggttttatggacctttgctatgggttgaaactacggtacaatccctctgttacctcaaatacctagatgggtttaaggggcaattcgtattggcaatgaaaccttgcatgcttgttgtgatatggtcctttctacagttgtatcgctagacgatgatttttgtgtaggcctgctggatgtattgtgacagacttagacaagttatagattccttttagtttc

SEQ ID NO: 15444 - protein, 123 aa, Panicum virgatum; identical to SEQ ID NO: 10653
  misc_feature: Ceres CLONE 1783163
  misc_feature (6)..(64): Pfam Name: Ribosomal_L29 Pfam Description: Ribosomal L29 protein

SEQ ID NO: 15445 - DNA, 742 bp, Panicum virgatum
  misc_feature: Ceres CLONE 1783185
  misc_feature: Encodes the peptide sequence at SEQ ID NO. 15446
ggctatagcctgctccctctccctctccctctctctctagtctagtccaccaccaaccattatggcctccctctcctctgccgccgtcaccgccccttccttcgcggcttcccggcccgcccgcgccgctgccaggcgctctgctgccttcaccgtgcgcgcctcgctcggcaaggccgccggcaccgccgccgtggccgtggccgccagcgccctgctcgccggcggcgccatggcccaggaagtgctgctcggcgccaacggaggcgtcctcgtcttcgagcccagcgagttcaccgtcaaggccggcgaggccatcaccttcaagaacaacgccgggtaccctcacaacgtggtcttcgacgaggacgaggtgcccagcggcgtcgacgccgccaagatctcgcaggaggagtacctcaacgcgccgggcgagacctactccgtcacgctcaccgtgccgggaacctacggattctactgcgagccgcaccaaggagccgggatggtcggcaaggtcaccgtcaactgatgcgatgccatgccatgccatgatcgagtatatatattcaagcgtatctgcgtatgtacgtaccaggctataggctagctagctagagagcttagcttgccactcagatcagtcatcatctccatcttgtaccaagtggcatgcatgcatgctattacttcatcatatttatatcatcggcattgccttgcttcttttactcttttcact

SEQ ID NO: 15446 - protein, 156 aa, Panicum virgatum; identical to SEQ ID NO: 13903
  misc_feature: Ceres CLONE 1783185
  misc_feature (60)..(156): Pfam Name: Copper-bind Pfam Description: Copper binding proteins, plastocyanin/azurin family
  misc_feature: Useful for making plants with modulated nitrogen use efficiency

SEQ ID NO: 15447 - DNA, 814 bp, Panicum virgatum
  misc_feature: Ceres CLONE 1783203
  misc_feature: Encodes the peptide sequence at SEQ ID NO. 15448
aaaaaatcctctcccagtccacttccgaggtcatcaaaaccctaccccttgcggcaacccatcctccccccaaccctagccgccgcgccgccgccgcttctcctcctcgcttgaaggagcttgtgaagggtccatcagactgagaagatggttcttaagactgaactttgccgttttagtggccagaagatatatccagggaagggtattaggttcattcatgctgattcccaggttttcctttttgctaactcaaaatgcaagcgttacttccacaaccgcctgaagcctgcgaagcttacctggacagctatgtacaggaagcagcacaagaaggacattcatgctgaagctgtgaaaaagaggcgtcggaccaccaagaagccatactcacgctcaattgttggtgccactttggaagttattcaaaagaagagaagtgagaagcctgaagttcgtgatgctgctagggaggctgctctacgtgagataaaggagcgcattaagaagaccaaggatgagaagaaggccaagaaagcggaggtggcgaaatctcagaagacacaaaccaagggtgcagcaccgaaggttcctaagggccccaagattggtggtggcggtgggaagcgctgaatgcccattgcatcatagagatatagttctgtcaactagccttctctcccatcctatcttagacattggtcaaattagtctgctgtcttgagttttcacctttctgatgagattggtgtcctgaatgttttggattgtttcttgagttgatttaaattggcacttatgtctattgttgttc

SEQ ID NO: 15448 - protein, 161 aa, Panicum virgatum
  misc_feature: Ceres CLONE 1783203
  misc_feature (3)..(73): Pfam Name: Ribosomal_L24e Pfam Description: Ribosomal protein L24e
  misc_feature: Useful for making plants with modulated nitrogen use efficiency
MVLKTELCRFSGQKIYPGKGIRFIHADSQVFLFANSKCKRYFHNRLKPAKLTWTAMYRKQHKKDIHAEAVKKRRRTTKKPYSRSIVGATLEVIQKKRSEKPEVRDAAREAALREIKERIKKTKDEKKAKKAEVAKSQKTQTKGAAPKVPKGPKIGGGGGKR

SEQ ID NO: 15449 - DNA, 724 bp, Panicum virgatum
  misc_feature: Ceres CLONE 1783212
  misc_feature: Encodes the peptide sequence at SEQ ID NO. 15450
acgtctccgccgcggcggtttggagttggccttgccgggggcaggcgggcagccgattgattgccttcgccttcccgcaagcccgcaactactcgacttccccacaaaactgaacaagctcccctacccctcctctcctcgcgcctccctcctgcaatctctctccaccagctccacgccgcgctgctaatcctattcctagctcgccggctaagatggacggcagcagcctcaagtccgcgcagctcctggatcagatgcgcctgcacttggccaccgacgccggcaaagagctcaccaagaaggtcggcctcgtctaccagctcaacatcgcccccaagaagctcggcgttgacgaggagatcttcgtggtcgacctcaagaagggcgaggtcaccaaagggccgtaccaggggaagccggatgctaccttctccttcactgacaacgatttccttggaatcgccaccggcaagactaacccgcagattgcgttcatccgaggggcgattaagatcaaggggagcataagcgccgcgcagaagttcacccctgacatcttccccaagccagcgaagctgtagaaggttagaatgcattatttgggtgcggatggataataaaatttccaagcttcaaccactatgtacctgataggatgaggggaatacatgaacacacgatgatctgtttttatcaatggaatatggataatgctttggtt

SEQ ID NO: 15450 - protein, 122 aa, Panicum virgatum; identical to SEQ ID NO: 10305
  misc_feature: Ceres CLONE 1783212
  misc_feature (9)..(117): Pfam Name: SCP2 Pfam Description: SCP-2 sterol transfer family
  misc_feature: SWISSPROT Homolog: EC 2.3.1.176 Propanoyl-CoA C-acyltransferase

SEQ ID NO: 15451 - DNA, 909 bp, Panicum virgatum
  misc_feature: Ceres CLONE 1783231
  misc_feature: Encodes the peptide sequence at SEQ ID NO. 15452
atagccccgcgacgagataccgatgtcactcgtctctccccgctgcggcccgccgctagcgctcgccggccgccgccgccgccgcccgcatcgggcccgagctgtcgcgcccaaatgcgagccctccccctcccatcctcccgtccttacccggagggccgtgtccgccgccgcgctgctcctccccctccccgcctcgtggccgcaactccccgtctcctccgcgtccgaggcagcggcggcggcggcggcggcggcggaagcacaaggagaaagtggagttccagaggggctagaactggagcggtacaccgaccaggagcatggcttcaccctcctcaagccggcctcctggcccaaggtggacaaggcgggcgcgacggcgctgtttcagcaggaggggaaagggagtaacaacattggggttgtcgtcaatcctgtccggctcaattcgctgacggagtttgggacgccgcagtttgttgccgacaagcttctgcaggcagagaagaagaaggaaagcacgaagtctgctgaggtgatttcagctggagagagatcaggtcatggtggcctgacagtgtatgaaattgagtacgcactggatagcaccaggggagggatgaagcggatcttctcagctgcatttgttgcttcaaggaagctctatcttctcaatattgcctattcagatgcccaggagaagcccttggacagccagactagaactgttctggaacaagttctccattcttttgattctgtatagtggtctttaacaattgaggtatgacacttttctctctttttttttcagaatttccttccgcttgaaaatacagtcccaaatatttgtttcttgctttgtaaaaagagttgtaatcaaatggttgctgtgttctgttgtcc

SEQ ID NO: 15452 - protein, 248 aa, Panicum virgatum
  misc_feature: Ceres CLONE 1783231
  misc_feature (64)..(248): Pfam Name: PsbP Pfam Description: PsbP
MSLVSPRCGPPLALAGRRRRRPHRARAVAPKCEPSPSHPPVLTRRAVSAAALLLPLPASWPQLPVSSASEAAAAAAAAAEAQGESGVPEGLELERYTDQEHGFTLLKPASWPKVDKAGATALFQQEGKGSNNIGVVVNPVRLNSLTEFGTPQFVADKLLQAEKKKESTKSAEVISAGERSGHGGLTVYEIEYALDSTRGGMKRIFSAAFVASRKLYLLNIAYSDAQEKPLDSQTRTVLEQVLHSFDSV

SEQ ID NO: 15453 - DNA, 997 bp, Panicum virgatum
  misc_feature: Ceres CLONE 1783238
  misc_feature: Encodes the peptide sequence at SEQ ID NO. 15454
accccgaatcttccccggtctcctgccaagaaccgcgcgcaacaagacccaccacgcttctcctctccaacgatgcaggcggcggcgggggcggcggcagctgtggcgtgggcgccgggcccatcgccgtccacctcctcctcctcgccttcccccttcagggtgggggttgcgtcgacggccgtgccggcttcttccgcgcccaggatggtcgccgtgtccgcgcccctgggtcgttgtcggcggcggcaagtggttcaagctgttgccaacccagaccctgcgattgagctgccgctgactgctgaaaatgttgagatggtgttggatgaagtaaggccatatcttatggcagatggaggaaatgttgcactgcatgagattgacgggaatgtcgtgaggttaaagctgcaaggagcatgtggctcatgcccggcttcagtaacaacgatgaagatgggtatcgagcgacgcttgatggagaaaataccagagattgtagcagttgaacccatcgctgatgaggagactgggcttgagttgacccaagagaacatcgaaaaggtacttgatgagattaggccgtaccttgctggcacaggaggtggtgagctcgagttttttgcaatcgaggaacctattgtcaaggttaggcttacaggaccagctgctggtgtgatgactgttcgagttgcccttactcagaagctccgagaaaagatccctaagattgcagcagtccagctattgtcataagcctataaagtttataatccagccagctccatctatctacagtgtaaatgggtttgcaataatcttcaaaaagaagttgtaacgtgtaggcacctgaagagtatgtggctccacttcagctattaacaatgaccatcaatacggaatgttgtaagcgtgtttttttttcgtacttacagccaagttttgcgctctgtatgtattcagttcagtttttactaaatggtaatgtcccctctcc

SEQ ID NO: 15454 - protein, 227 aa, Panicum virgatum
  misc_feature: Ceres CLONE 1783238
  misc_feature (81)..(148): Pfam Name: NifU Pfam Description: NifU-like domain
  misc_feature (162)..(226): Pfam Name: NifU Pfam Description: NifU-like domain
MQAAAGAAAAVAWAPGPSPSTSSSSPSPFRVGVASTAVPASSAPRMVAVSAPLGRCRRRQVVQAVANPDPAIELPLTAENVEMVLDEVRPYLMADGGNVALHEIDGNVVRLKLQGACGSCPASVTTMKMGIERRLMEKIPEIVAVEPIADEETGLELTQENIEKVLDEIRPYLAGTGGGELEFFAIEEPIVKVRLTGPAAGVMTVRVALTQKLREKIPKIAAVQLLS

SEQ ID NO: 15455 - DNA, 861 bp, Panicum virgatum
  misc_feature: Ceres CLONE 1783243
  misc_feature: Encodes the peptide sequence at SEQ ID NO. 15456
aaagactcccaagtcgcccccacccacacccaaaccagaacaaacccttgcgagggagcgaggagagctgctcgccgccgccgccactgccgcagccgccatgtcggcagggatcgcgcgcggccgcctcgccgaggagcgcaaggcctggcgcaagaaccacccccacgggttcgtggcgaggccggagacgctggccgacgggtcggcgaacctcatgacctggaactgcaccatccccggcaagcaggggactgattgggaaggtggttactaccctcttacccttcatttcagtgaggactaccctagcaaacctccaaagtgcaagtttccacagggttttttccacccaaatgtctatccttcagggacagtctgcctctcaattctcaacgaggatagcggttggagacctgctatcactgttaagcagattctagttggaatacaggacttgctcgatcagcctaatccagctgatcctgctcaaactgatggataccaccttttcatccaggatccaacagaatataagagacgtgttcgtctgcaggccaagcagtatcctgctctggtgtgaggatgttggatgcttgagatccatgacccatcctgcacatccgcatagtagctgcgacatcttcagttatgcatctgaatatggctttgacaagatataagttctctggagtattgccagtgcaatcttgaaacttttatgatctgtagatcgggcattggcttgaaacagaattgtttccttaactgctgcaattgctggagtgaatgacattttgatgacgatcaccattatctgtaatcccacttcaagataatttgaatctttgcgtgcttatt

SEQ ID NO: 15456 - protein, 160 aa, Panicum virgatum
  misc_feature: Ceres CLONE 1783243
  misc_feature (9)..(153): Pfam Name: UQ_con Pfam Description: Ubiquitin-conjugating enzyme
  misc_feature: SWISSPROT Homolog: EC 6.3.2.19 Ubiquitin--protein ligase
MSAGIARGRLAEERKAWRKNHPHGFVARPETLADGSANLMTWNCTIPGKQGTDWEGGYYPLTLHFSEDYPSKPPKCKFPQGFFHPNVYPSGTVCLSILNEDSGWRPAITVKQILVGIQDLLDQPNPADPAQTDGYHLFIQDPTEYKRRVRLQAKQYPALV

SEQ ID NO: 15457 - DNA, 607 bp, Panicum virgatum
  misc_feature: Ceres CLONE 1783253
  misc_feature: Encodes the peptide sequence at SEQ ID NO. 15458
aacgcctcgtacagttcatcaagtaaatccacatcaagatcacacacaagctagctgcaaaaatggcgtcgacggtggcgagcctctctaccccggcgacggccttcgcggccgcggacgtggtcccgaggaggaaggccgccgaaggccgcgtctggttccccgtggcgcgccgcggcagcttcgcggtgaggtcgagcgggccggggacgccgccggggatctccgacaaggtgtcggagagcatcaagaaggcggaggagacgtgcgcggacgagaaggtctccggggagtgcgcggcggcgtgggacgaggtggaggagctcagcgccgcggcgagccacgcccgggacaagctcaaggacagcagcgacccgctcgagaactactgcaaggagaaccccgagaccgacgagtgccgcatctacgacaactagagcaagcctgctgtatatatcgatctgtgtatcagcaatcaaagacgttaaatttgttatagatatagataattaataaaggaataaaggatacttggccgcgggtcatacataaacgtcactataagaaatcatttaatctgtgacaaatttatttgtcacagattgtt

SEQ ID NO: 15458 - protein, 124 aa, Panicum virgatum
  misc_feature: Ceres CLONE 1783253
  misc_feature (54)..(124): Pfam Name: CP12 Pfam Description: CP12 domain
MASTVASLSTPATAFAAADVVPRRKAAEGRVWFPVARRGSFAVRSSGPGTPPGISDKVSESIKKAEETCADEKVSGECAAAWDEVEELSAAASHARDKLKDSSDPLENYCKENPETDECRIYDN

SEQ ID NO: 15459 - DNA, 695 bp, Panicum virgatum
  misc_feature: Ceres CLONE 1783290
  misc_feature: Encodes the peptide sequence at SEQ ID NO. 15460
atccatccgccatggcgaccgccacgctgctgagctccgccttcgccatgcccgccgccgcccggagggcctcctcctcctcttcctccacctccctgggcttcgccacgtcgcagctcgccggcctctccctctccgccgccgcgcccgcttcaaccgcggcggcccccctcctcaagaggccgatccagcccatcgtcgcgcgccgggtgtgccccttcactgacaagaagacgaaccgggcgaacaaggtgtccttctccaaccacaagaccaagaagcagcagttcgtgaacctgcagtacaagaagctgtggtgggaggccggcaagcgcttcgtcaagctgcgcctctccaccaaggccctcaagaccatcgagaagcacggcctcgacgccgtcgcgcgcaaggccggcatcgacctcaacaagaagtgagccgagcttgagtagtcgagccggtggcggcggtatggtcaggccgagcaatctcgcgaacagatgccactagcttagtctcgtctgtctcaatttctgctgctgctgctgctgctcattcagtcatacagtatttttcctttcctccctaatttgatttgcatccaaccaatgtaggcacatcgaggttgcatatatttttattctgtggaaagagttgatgtttcttcctcttgatcaatcttctctccatttcgt

SEQ ID NO: 15460 - protein, 141 aa, Panicum virgatum
  misc_feature: Ceres CLONE 1783290
  misc_feature (66)..(126): Pfam Name: Ribosomal_L28 Pfam Description: Ribosomal L28 family
MATATLLSSAFAMPAAARRASSSSSSTSLGFATSQLAGLSLSAAAPASTAAAPLLKRPIQPIVARRVCPFTDKKTNRANKVSFSNHKTKKQQFVNLQYKKLWWEAGKRFVKLRLSTKALKTIEKHGLDAVARKAGIDLNKK

SEQ ID NO: 15461 - DNA, 830 bp, Panicum virgatum
  misc_feature: Ceres CLONE 1783306
  misc_feature: Encodes the peptide sequence at SEQ ID NO. 15462
caaccaactagccaagtgcccccaattcacaccgcatcctgccatcctcgtctcctctcctaccctccattaaccctagcgacagccgcgccctctcttgatccccgcggggagctccagatctgcaggccggctgcccggcgtccggatcggcaagcgaagatgacggaggcctgggtgcggaacaaaccggggatggccagcgtcaaggagatgccgctggtgcaggacggcccgccgccgggcgggttcgcgcccgtgcgctacgcgcgccggatccccacatcggggcccagcgccaccgccatcttcctcaccgccttcggcgccttcgcgtacggcatgtaccaggtcggccaggggaacaaggtccgccgtgcgctcaaagaagagaagattgctgcccgtagtgctatactgccgatgctccaagctgaagaggatgaaagatttgtcaaagagtggaagaagtatcttgaggaggaggccaggatcatgaaaaatgttccaggatggaaggttggcgagagcgtgtacaactctgggaaatggatgcctccggctactggtgaactccgccctgaggtttggtaagggcttgctgccggctctgataatttcatcatgtcatgaggacatgaatataaggcttctaaacctgggtaccttcattttctcctttaccaaggagtgactccttaaacacctctgtgtttgtcgtggtgtatgaaaattgactggttaataattggacatatcaagccgccttccttgtcttccgaattttgaactgtgcttgcacgttgatgtcgatgtaacgtcatttcatc

SEQ ID NO: 15462 - protein, 143 aa, Panicum virgatum
  misc_feature: Ceres CLONE 1783306
  misc_feature (16)..(141): Pfam Name: GRIM-19 Pfam Description: GRIM-19 protein
MTEAWVRNKPGMASVKEMPLVQDGPPPGGFAPVRYARRIPTSGPSATAIFLTAFGAFAYGMYQVGQGNKVRRALKEEKIAARSAILPMLQAEEDERFVKEWKKYLEEEARIMKNVPGWKVGESVYNSGKWMPPATGELRPEVW

SEQ ID NO: 15463 - DNA, 745 bp, Panicum virgatum
  misc_feature: Ceres CLONE 1783311
  misc_feature: Encodes the peptide sequence at SEQ ID NO. 15464
tcgcctccccgtctctctcgtcctccctcgccgccgccgagaaggaaggaataggaggaggaaggagcaagcggagatgggccactccaacgtctggaactcgcaccccaagaactacgggcccggctcccgcgtctgccgggtctgtgctaacccccatggattgatcaggaagtatggtctcatgtgctgcaggcagtgcttccgcagcaatgccaaggacattggcttcatcaagtaccgctaaagacattgccttgctggcgtcgagaacttcacatgggttgaaaagaaatggatccttcaatagaaggctcaacttatgtgcattagattttcgttcagacttgagactgctagtaaactacttgttaaagttttgatgggtactatatgcctgttaaactaattataattaagtgattggagtattttgtcatgtttgatatctggtgtactcaacctgcttgtattggtgccctcctaggctcccaagttattgtactgccaattctattccttgcttcatgtatgagcttagcacttttgaatgatgacaattagtctgtgatatcaaactgtaatgtgataataattacagtgtgtatttgctggtacaacgggtgttgcaccggttgcccgagtaggctgaggcactgcatccatgaggcaatatggctactgcagtacagtgttgctttctgcttcagtcatttcactgtctattcttgctctattgcagatt

SEQ ID NO: 15464 - protein, 56 aa, Panicum virgatum; identical to SEQ ID NO: 9888
  misc_feature: Ceres CLONE 1783311
  misc_feature (3)..(56): Pfam Name: Ribosomal_S14 Pfam Description: Ribosomal protein S14p/S29e

SEQ ID NO: 15465 - DNA, 867 bp, Panicum virgatum
  misc_feature: Ceres CLONE 1783327
  misc_feature: Encodes the peptide sequence at SEQ ID NO. 15466
aaaaaaaacgccgcttcctctcaccagtcaccaacgcgcctccattcccgttcctgtcttgcctagggttctagccctctcgtcgccgccctccggcgccgaccatgacggccgagaccacgacgccggaggagcagctccgcgccttgctcgaggagcagaagatccacgagggagatgacccgattgttgaggatgacgatgatgaggaagatgacgatgatgaggatgacaaggatgatgatgatgctgagggagttgatgctagtgggagatctaagcagagccgcagtgagaaaaagagcaggaaggccatgctgaagcttggcatgaaggcgatcactggtgtaagccgtgtaactgtcaagaagagcaagaatatgctctttgtcatctccaaaccagatgtcttcaagagccctgcatcagacacctacgtgatctttggggaggccaagattgaggacctgagctcacagctgcagacacaggctgcagagcagttcaaggcaccagacatgagcagcgtcctgtcaaagccagaggtctccacagcggcccaggatgacgatgaagctgtcgatgagactggtgtggaggagaaggacattgagttggtgatgacccaggctaccgtgtcgagggctagggcggtgaaggcgctgaaggcggccgatggggatatagttagtgcaatcatggagctgacaacttagctggtcatgcgccgacttgtgatatcatgtcagttttatcttgtttaatggatctattatctgagacacatgttgtcacgttgtgctgttttgcatgttgtgtgattggaaacaaatggaaaacacatgttttgaaggctctttttcgtgc

SEQ ID NO: 15466 - protein, 203 aa, Panicum virgatum
  misc_feature: Ceres CLONE 1783327
  misc_feature (62)..(121): Pfam Name: NAC Pfam Description: NAC domain
  misc_feature (164)..(201): Pfam Name: UBA Pfam Description: UBA/TS-N domain
MTAETTTPEEQLRALLEEQKIHEGDDPIVEDDDDEEDDDDEDDKDDDDAEGVDASGRSKQSRSEKKSRKAMLKLGMKAITGVSRVTVKKSKNMLFVISKPDVFKSPASDTYVIFGEAKIEDLSSQLQTQAAEQFKAPDMSSVLSKPEVSTAAQDDDEAVDETGVEEKDIELVMTQATVSRARAVKALKAADGDIVSAIMELTT

SEQ ID NO: 15467 - DNA, 737 bp, Panicum virgatum
  misc_feature: Ceres CLONE 1783334
  misc_feature: Encodes the peptide sequence at SEQ ID NO. 15468
tgccttgcctgatggctggctctcctgtcgccccaagggatggcgtgacacgccacaacgttcgaaccctctcctttcctctgctacagttgggagaggcgaaaaggaggctgcccgtgctcccgccggcgaggccgctgatctcccccgcctctagtggccttctaggcctcggatgtgagggggatctccggttctcagcccggtggtgtagattaggtactagcttgtctaggtttgtgtttcccgccgccgccgccgtcgcagcagtcaccgtgaccagcaaccggacaaagtatggatacccaggttaagcttgctgttgtggtgaaggtgatgggccgcactggctccaggggtcaggtgacccaggtcagggtgaagttcctggacgaccagaaccgtctcatcatgaggaacgtcaagggccctgtccgtgagggtgacatcctcaccctcctcgagtctgagagggaggccaggaggctgcgctgaagcagctggtggttgcgccagttgttggccattcctgttttaaacaagttaaatgatgaattgaatccccccttgcctagtgtactgctttcgtatcaagttattgaacaatgctactttgtcctttgagtaggctatggagaatgggcttaagcaatggaattgtaatttgagtactcgtcttgtttgcagttttggtctgttattgcctgaatgaatttaagtgcacttgatgatgtgtg

SEQ ID NO: 15468 - protein, 65 aa, Panicum virgatum; identical to SEQ ID NO: 9766
  misc_feature: Ceres CLONE 1783334
  misc_feature (1)..(65): Pfam Name: Ribosomal_S28e Pfam Description: Ribosomal protein S28e

SEQ ID NO: 15469 - DNA, 710 bp, Panicum virgatum
  misc_feature: Ceres CLONE 1783377
  misc_feature: Encodes the peptide sequence at SEQ ID NO. 15470
acaatacgccggcgctagctctagtcttgcgagccacgaaagaaagaagcaaacagatctgcctgcctgccgcttgttcttgctgccctccgggctccggcgatccgatccgaacgatggcgtccgccgccgcggggtcgtggtcgaagcggtggatccggccggaggtgtggccgctcttcttcgcgacgggcacggccgtcggcatctgcgggatgcagctcatccgcaacatcaccggcaacccggaagtcagggtgctcaaggagaagagggcggcgggcgtgctggagaaccacgacgaggggaagaggtactcgcagcacggcttcaggaagttcatcgacggcaggaagcccgagatcatggagaacctcaactcgtggatggccgacccgcccaagtagtagatcaatccgtacgtctccatatctaccgcggccgatggctcatttggtcggccgcacaattttaattatccttgacattcagcagctgttaccgtgattgtctgcggtacgtttatttttgtatcaccgtaaacatactcctcctatattcttaacaacaagaacaaacatgtgacagcatgcatgctgtcatggccctggctgtgaacgggcatattcaaagtttttttttcctcattttgggacgcgaatataattcttgttgctctcgttctgaataaccttaacagttgggtgcct

SEQ ID NO: 15470 - protein, 96 aa, Panicum virgatum
  misc_feature: Ceres CLONE 1783377
  misc_feature (10)..(96): Pfam Name: B12D Pfam Description: B12D protein
MASAAAGSWSKRWIRPEVWPLFFATGTAVGICGMQLIRNITGNPEVRVLKEKRAAGVLENHDEGKRYSQHGFRKFIDGRKPEIMENLNSWMADPPK

SEQ ID NO: 15471 - DNA, 728 bp, Panicum virgatum
  misc_feature: Ceres CLONE 1783378
  misc_feature: Encodes the peptide sequence at SEQ ID NO. 15472
atcacctgcaacgagcaatcaatcgccagatttttcacaggcggaaacacgcaaagccgtaactagcagctcatcgaccggctagcaatggcggcggcggcggcggcggcggagggggcagcgaagaagagcggcggcgagatgacggtggtgcgcgggctggacgtggcgcggtacatggggcggtggtacgagatcgcctcggtcccgtccttcttccagccccgggacggccggaacacgcgcgccacctacgcgctgctggaggacggcgcgacggtgcacgtgctcaacgagacgtggagcaagggcaagcgcgactacatcgaggggacggcgtacaaggccgaccccggcagcgacgaggccaagctcaaggtcaagttctacctcccgccgttcctccccatcatccccgtcgtcagcgactactgggtgctctacgtcgacgccgactaccagtacgcgctcgtcggcgagccgcgccgcaagaacctctggatcttgtgcagggagacgagcatcgacgaggaggtgtacagccagctggtggagcgggcgagggaggaaggctacgacgtgagcaagctgcacaggacgccgcaggacgacccgccgccggagagcgacgccgcgcccaccgacaccaagggggtctggtggttcaagtcgctcttcggcaaatgatcgtccatcgcgtgctgcgctttgctctgcttctcgcttgc

SEQ ID NO: 15472 - protein, 199 aa, Panicum virgatum
  misc_feature: Ceres CLONE 1783378
  misc_feature (25)..(173): Pfam Name: Lipocalin_2 Pfam Description: Lipocalin-like domain
MAAAAAAAEGAAKKSGGEMTVVRGLDVARYMGRWYEIASVPSFFQPRDGRNTRATYALLEDGATVHVLNETWSKGKRDYIEGTAYKADPGSDEAKLKVKFYLPPFLPIIPVVSDYWVLYVDADYQYALVGEPRRKNLWILCRETSIDEEVYSQLVERAREEGYDVSKLHRTPQDDPPPESDAAPTDTKGVWWFKSLFGK

SEQ ID NO: 15473 - DNA, 718 bp, Panicum virgatum
  misc_feature: Ceres CLONE 1783379
  misc_feature: Encodes the peptide sequence at SEQ ID NO. 15474
acatcctcttcctctccagcctccgccagaccgcagaagtccccaaaccctagtttgctccggcgccgccttcctccggtccgcgcatctgccgcggaccgccgtggatcccgcgccgccggcccgctttcacgtcccggctcccgccaccccacaggtgcgcttctgattccggagttccaagctcgcgcgtgaggtgccggatcaaagcaatcggccaccatgcaggctagcgataggttcaacataaactctcagcttgagcatcttcaagctaaatatgtcggtacaggacacgctgacttgaccagatttgaatgggctgtgaacatccagagggacagctatgcctcttatattgggcactatccaatgttggcgtactttgccattgctgagaacgaatcgattggaagagaacgttacaatttcatgcagaaaatgctgcttccttgtggcctccctcctgagagagatgaagactgaggagttggtgcataatttcagtcttattgcgaagggagcaaccgtgggactatgttagcatgctttggaaggagactaggtttgccaccgtggtaccatgtgcaactcattttagagcgtttggcgtatgctttacttgtctaaaattaatctattatgatgcacaaaaaattcgaatttgtatgaagtgttaagaaaatgttgctgttgtctgtagtatatttgtggcgtg

SEQ ID NO: 15474 - protein, 87 aa, Panicum virgatum
  misc_feature: Ceres CLONE 1783379
  misc_feature (5)..(87): Pfam Name: SF3b10 Pfam Description: Splicing factor 3B subunit 10 (SF3b10)
MQASDRFNINSQLEHLQAKYVGTGHADLTRFEWAVNIQRDSYASYIGHYPMLAYFAIAENESIGRERYNFMQKMLLPCGLPPERDED

SEQ ID NO: 15475 - DNA, 664 bp, Panicum virgatum
  misc_feature: Ceres CLONE 1783431
  misc_feature: Encodes the peptide sequence at SEQ ID NO. 15476
atttcattccgctttgagcttttgcttgcagctccagcaccaagcgcaggcccctcttgcattggtggctatctacgccatggccaccgtcctgagctgcagcctccgcgcgccggccagcttcatccccggcctccgcgccgccccggctcccgccgtcgtcgccatgcccgccgccaagcaggttgttgcccgcggcgccaggctgcgcgcgcaggccacctacaacgtgaagctgatcacgcccgacggcgaggtggagctgcaggtgcccgacgacgtgtacatcctggaccaggccgaggaggaggggatcgactcgtgccgcgcggggtcctgctcctcctgcgccggcaaggtcgtctccggcagcgtcgaccagtccgaccagagcttcctggaagacgaccagatcgccggcggctgggtgctcacctgcgccgcgtaccccacctccgacgtcgtcatcgagacccacaaggaggaggagctcacctcctcctcgtaatgcttgcattattgcttatcatcgatctccgctgattacatttaatttcttggttacgtaagtgtcgtgctactatgcttaattggtttgcagttgagctataatgcatgctgtggaaatttatatttattttgcaataatatagctattttattt

SEQ ID NO: 15476 - protein, 142 aa, Panicum virgatum
  misc_feature: Ceres CLONE 1783431
  misc_feature (54)..(126): Pfam Name: Fer2 Pfam Description: 2Fe-2S iron-sulfur cluster binding domain
MATVLSCSLRAPASFIPGLRAAPAPAVVAMPAAKQVVARGARLRAQATYNVKLITPDGEVELQVPDDVYILDQAEEEGIDSCRAGSCSSCAGKVVSGSVDQSDQSFLEDDQIAGGWVLTCAAYPTSDVVIETHKEEELTSSS

SEQ ID NO: 15477 - DNA, 845 bp, Panicum virgatum
  misc_feature: Ceres CLONE 1783442
  misc_feature: Encodes the peptide sequence at SEQ ID NO. 15478
attcctgacatactctggggatgctaagagagaacgagggagatatgtcaggaaaggggaaactccaacttctacgctccattacaaagtcggatgcggcaaacaagacgtcaatcctggtagatgcgtcgaaatacatcaaggaactcaaggacaagattgaagaagcaaccaccgttgcttcagcagctgacagtagcagctccggttctggcagcgccgtggcagcaacacaggtgagcgtctcgtcagtggatctggataacaacaacagcaacagcaacagtagtagcaggagaggcttccggatcaacgtgtcgatggcaacgagccgggcggggctgctggtgtccgtgctggaggccttggaggacctcggcatcgacgtcctggacgccgacgtctcctgcgccgacgacaccgccttccgcctcgaggcgctgggatcaggtcagggtcagggccagcagcaggctgcaagtggaagcgtggatgagcaaaaggttcgccaggcggtgttgcaggccatcaacaaatgcatcaacgatgacgatgagtaacaacagaagactatgaaagaaacctgaacattgccattggtccttggagctcatgcaagagcaagcttggccaaggaattcgatcgtcaagttaaagctagttttaatttctgtcgttcctcagcatggttaataatttcacaacgaaacacgcttcctgtgtgttgcagttgcaaattttctacccaatgcaaattaaaacgcttcctcagcattggccaaggaagcaagtctttgtaatagcattttctacccaatgcaaattaacactttcctgtgtgttgc

SEQ ID NO: 15478 - protein, 171 aa, Panicum virgatum
  misc_feature: Ceres CLONE 1783442
  misc_feature (87)..(167): Pfam Name: ACT Pfam Description: ACT domain
MSGKGKLQLLRSITKSDAANKTSILVDASKYIKELKDKIEEATTVASAADSSSSGSGSAVAATQVSVSSVDLDNNNSNSNSSSRRGFRINVSMATSRAGLLVSVLEALEDLGIDVLDADVSCADDTAFRLEALGSGQGQGQQQAASGSVDEQKVRQAVLQAINKCINDDDE

SEQ ID NO: 15479 - DNA, 858 bp, Panicum virgatum
  misc_feature: Ceres CLONE 1783468
  misc_feature: Encodes the peptide sequence at SEQ ID NO. 15480
tggagctggatcacgttggggcaaactactcccaagtcccaatgatgaagtccctcctcttctccgcccaccacacgccgccgctcctccccgccccgcgcctcctccgcctttgcgcctcctccgcctccgcctccgcctccgccacgccacgcgccgatcgcctcgtgcccctctcgagcgcggcgcggccgtgcagggggctcgcggcggtgtctctatcgcgcggcgcggcgggacggaggttgccgagcgtgtcggcgatgtcgtcgtcgaccccgccgccagggcccgtgcagaagtcggaggaggagtggcaggctatcctaacgccggagcagttcaacatcctccgcctcaagggcaccgagtaccctggaacaggtgaatacgacaagttttttgatgagggcatttataaatgtgctggatgtggaactcccttatacaaatcatctacaaagttcaactcagggtgtggctggcccgcattctatgagggacttcctggggccataagacagacgccggaccccgatgggaggcggacagagatcacatgtgctgcctgtggaggacatttggggcatatattcaaaggggaagggtttaaaacacctaccaatgagcgacattgtgttaacagcatttctctcaagttcattccagcctcagaggaagcctgacggcagatgaacaccaacgtgaaacccgacaacagaatgagaccttggcctttgttgggtgtttttacagtgtagacagatggtggttgttctgccgtttatcattatgtttactcatcctttaaacgacataccatcctgtttgtgaaagcttaatagattttgtgcagac

SEQ ID NO: 15480 - protein, 214 aa, Panicum virgatum
  misc_feature: Ceres CLONE 1783468
  misc_feature (89)..(210): Pfam Name: SelR Pfam Description: SelR domain
  misc_feature: SWISSPROT Homolog: EC 1.8.4.12 Peptide-methionine (R)-S-oxide reductase
  misc_feature: Useful for making plants with modulated heat sensitivity
MMKSLLFSAHHTPPLLPAPRLLRLCASSASASASATPRADRLVPLSSAARPCRGLAAVSLSRGAAGRRLPSVSAMSSSTPPPGPVQKSEEEWQAILTPEQFNILRLKGTEYPGTGEYDKFFDEGIYKCAGCGTPLYKSSTKFNSGCGWPAFYEGLPGAIRQTPDPDGRRTEITCAACGGHLGHIFKGEGFKTPTNERHCVNSISLKFIPASEEA

SEQ ID NO: 15481 - DNA, 597 bp, Panicum virgatum
  misc_feature: Ceres CLONE 1783534
  misc_feature: Encodes the peptide sequence at SEQ ID NO. 15482
atctccaccactctccatttctgcagcccaccccttcctctctccctggcggagatggcatctggggcggcggagaaggggaaggtcctggcggatagctcggagtcggcggcggagagcgcggcgcggcgggcgcgggagtggaccacgtgggcgatgaagaaggccaaggtggtggcccactacggcttcatccccttcgtcatcctcgtcggcatgaactccgagcccaagccccgcttcgcccagctcctctcccccatctaggcctcctcggtcgccccaatcccgttcgattcctgcaattcagtactgcatttcttgctacttgcgtacttttacaattttttctttacgtttgatataattctatcttaattaagttgtatcactgagtttatgataaaggagttccgagtccaaatcatggaaattgctgtggacaatctccatactcccatggtcagtttgtgactatattgatccattggagctttagatatctctacactaagaatgttgatggttaaactaaatgcacacgaaatgccggtgcccaggcattcgtattgttgcgagaatcagaaaattttcctc

SEQ ID NO: 15482 - protein, 70 aa, Panicum virgatum
  misc_feature: Ceres CLONE 1783534
  misc_feature (28)..(67): Pfam Name: Tom7 Pfam Description: TOM7 family
MASGAAEKGKVLADSSESAAESAARRAREWTTWAMKKAKVVAHYGFIPFVILVGMNSEPKPRFAQLLSPI

SEQ ID NO: 15483 - DNA, 704 bp, Panicum virgatum
  misc_feature: Ceres CLONE 1783541
  misc_feature: Encodes the peptide sequence at SEQ ID NO. 15484
agacttcccaaaggcagaacgcaagctcgcggcggcttccttcttccaaacccctcgcttccccgcgtgctcgccccgagatctcgcccggccgccatggacgcgatcgactcggtggtggatcccctccgcgacttcgccaaggacagcgtccgcctcgtcaagcgctgccacaagcccgaccgcaaggagttcaccaaggtcgcggcgcggacggcgatcgggttcgtcgtcatgggcttcgtcggcttcttcgtcaagctcatcttcatccccatcaacaacatcatcgtcggttccggctagacctcgagtcctggagaagtgcagaacgagtgactagcatgggtggattgcaatacttttgaggagagcaaaggctaacgatgatcttggtctttcacaaagtattgtaaaagacagtttctcatttgtgtttttggagtaatcctcatactgtttaagacttcaggatgcctgcataccagattctgagttgatcgatcggttatagaagggtacggtggactgctttctttttagataggctgaaagtaagaattcaggttggttcaatgtatcagttcgtggtaaatataaaaaacttaaaatatttttttgattgtggaacaaatttttttattactcggctggaacaatgtttcagcaacaaaaaaatttattccagcaaaagaaattattcc

SEQ ID NO: 15484 - protein, 69 aa, Panicum virgatum; identical to SEQ ID NO: 12598
  misc_feature: Ceres CLONE 1783541
  misc_feature (10)..(66): Pfam Name: SecE Pfam Description: SecE/Sec61-gamma subunits of protein translocation complex

SEQ ID NO: 15485 - DNA, 478 bp, Panicum virgatum
  misc_feature: Ceres CLONE 1783547
  misc_feature: Encodes the peptide sequence at SEQ ID NO. 15486
attccctcagctcgcttctggtaatttcggtgctcaagcaaggcacatctctcccctctcctcctcttcgtcgccgccgccaccgccaccatgggacactccaacgtgtggaactcgcacccgaagaactacggccccggatcccgggtttgccgtgtgtgcgccaacccccacggcttgatccgaaagtacgggctcatgtgctgcaggcagtgcttccgcagcaacgccaaggacatcggcttcatcaagtaccgctaaaaacttgagaggtctgaagcatcacgaaaatgggagcatggatgaggagcatctttgatccgtcttttgtttagtactgtgataatcataccatgtaatgaattatttgggtttgaaatggaccaagtcgtattctggctggcactctagtgcaccctagttgagcatgttgaaccgctatgatcagactaatacaatattgttactattgtggctc

SEQ ID NO: 15486 - protein, 56 aa, Panicum virgatum; identical to SEQ ID NO: 9888
  misc_feature: Ceres CLONE 1783547
  misc_feature (3)..(56): Pfam Name: Ribosomal_S14 Pfam Description: Ribosomal protein S14p/S29e
  misc_feature: Useful for making plants with modulated nitrogen use efficiency

SEQ ID NO: 15487 - DNA, 928 bp, Panicum virgatum
  misc_feature: Ceres CLONE 1783579
  misc_feature: Encodes the peptide sequence at SEQ ID NO. 15488
aggtgcacacgcgcgcgaacacgaacacgagcacggcactgcggcggccatggcgagcggcggtggcgacccgaggccggaggacgaccccttctccgacggcgaaaccagcgaatccgactccgccgaggagtcccgcccgcagcggatgggggcgccccggcccggcgccacaaacaacccgatcctgacgcgcctcgcggtgtcgcggaacccgagtccgctggccgcggccaccgccgcccccggggtctgcctcctccgcttcgcctgggagtccgccgcggggtccctcgtcggcgccgtcgtcggatacggtaaaggtttggttacgatgaagggttttaaaggatcatttcctgatgctgcatcatctgctaagatatttgctgttcttgctggtgttcaaagtttggtagcctgctctttgagaaaactacgtggaaaagatgatggtatcaatgcaggagttgcaggctgttgcactggccttgctctgagctttccaggtgcaccacaaactctgattcaaagctgcctgaccttcggaactttctcatacatcatagagaagctaaacaagcagcagcctgctctggcgctcccaccgggctcgaaggacctgaagggtggacagagcgttcttcctcccttcacgcttcctcttccccatgatgctatggagggattttctaagttccaaaacttgttgtcgtcaaagtttcggggaaattgagttacctttacggaataatgcctagttgcccactctggattgtgtcgttgtaaatccatcaagctgagccttctcctttcagtttatcttttctgcgagtatatgtttctaaggtagtgcgttgctagtgttgatgattctaccctattctgtgacaattttgcgaataatggaagcagccttgctgtgttc

SEQ ID NO: 15488 - protein, 228 aa, Panicum virgatum
  misc_feature: Ceres CLONE 1783579
  misc_feature (62)..(180): Pfam Name: Tim17 Pfam Description: Tim17/Tim22/Tim23 family
  misc_feature: Useful for making plants with modulated salt sensitivity
MASGGGDPRPEDDPFSDGETSESDSAEESRPQRMGAPRPGATNNPILTRLAVSRNPSPLAAATAAPGVCLLRFAWESAAGSLVGAVVGYGKGLVTMKGFKGSFPDAASSAKIFAVLAGVQSLVACSLRKLRGKDDGINAGVAGCCTGLALSFPGAPQTLIQSCLTFGTFSYIIEKLNKQQPALALPPGSKDLKGGQSVLPPFTLPLPHDAMEGFSKFQNLLSSKFRGN

SEQ ID NO: 15489 - DNA, 724 bp, Panicum virgatum
  misc_feature: Ceres CLONE 1783608
  misc_feature: Encodes the peptide sequence at SEQ ID NO. 15490
ctagtctccatccccccacccgccgcccctcaaccttacccagccgccgccgccgccgccgccgcgcggaggcgaccccctaccgccgccaagatgcagatcttcgtgaagaccctgacggggaagaccatcacgttggaggtggagtcctcggacaccatcgacaacgtgaaggccaagatccaggacaaggagggcatccccccggaccagcagcggctcatcttcgccggcaagcagctcgaggacggccgcaccctcgccgactacaacatccagaaggagtccaccctccacctggtgctccgcctccgcggtggcgccaagaagcgcaagaagaagacctacaccaagcccaagaagatcaagcacaagcataagaaggtgaagctcgccgtcctgcagttctacaaggtcgacgacgccactggtaaggtcacccgcctccgcaaggagtgccccaacgccgactgcggcgcgggtaccttcatggccaaccacttcgaccgccactactgcggcaagtgcggcctcacctacgtctacaaccagaaggcgtaatcgcttgcatcgctttgcttagcattacccgcctacctatcatgaaattgagctgttggtttctcgagttggatatcatttagatctgtctgaggttgaaacttaaatggagtagcagtatctattttctcggaccgcctgttactgagctgatatgatgcga

SEQ ID NO: 15490 - protein, 155 aa, Panicum virgatum; identical to SEQ ID NO: 14149
  misc_feature: Ceres CLONE 1783608
  misc_feature (6)..(74): Pfam Name: ubiquitin Pfam Description: Ubiquitin family
  misc_feature (101)..(148): Pfam Name: Ribosomal_S27 Pfam Description: Ribosomal protein S27a
  misc_feature: Useful for making plants with modulated cold sensitivity
  misc_feature: Useful for making plants with modulated flowering time
  misc_feature: Useful for making plants with modulated nitrogen use efficiency

SEQ ID NO: 15491 - DNA, 1019 bp, Panicum virgatum
  misc_feature: Ceres CLONE 1783644
  misc_feature: Encodes the peptide sequence at SEQ ID NO. 15492
gtcgccgccgcctcctctcccctaaacccttctcgccccctcctcctcctcctcagtttgtaactatggcactgactaataagcttggtggccttctcaagaaagccactagctcaaatccttctatctatcaagcaatcagatgcatgtcatcatctaagctctttgttggagggctttcttatggcactgatgatcagagtctcagagatgcctttgcgaattatagccaggttattgaagctagggttatcatggaccgtgagtctggaagatccagaggttttggctttgtaacttacacatcatctgaggaggcttcagctgccatcacagccatggatggacaggatctccatggaaggaacataagggttaaccatgctactgagaagacaagtggtttccgggctggtggcggcggcggttttggtggtggtggctatggcggcggtggttttggtggtggtggcagtggtggcggtggttacggtggcagcggagggtacggtgcgggctatggtagcggcggcggcggcgggggctatggtggtggcaactatggcaacagggatggcggcggctatgggggtggtggagttgcaggtggagctggcggcaattttgctgctggaggtggcgacagctttggcagcaacttcggtggtgaaagtgggtttggaaaccctgctggtggattcggtgctcccagtggcacctatggtggtgatgagttccctgctagtggcagcttcagcagcaacaagaatgacgaaatcatgcaagatatgttcaaggatgacgataagcctgacaactatgccgacaaaagggcctagtttttgtcctccaagctaccctagcgtaccagtaaaaatgcggtgaatgatcatccggatgagattccaggacaatctgcagtggctggtgtttttctgttaactttataggtctcgtctgtctaaataacggaacgagcactttgtgttgaacagactatcgaagtgtgctttattttg

SEQ ID NO: 15492 - protein, 257 aa, Panicum virgatum
  misc_feature: Ceres CLONE 1783644
  misc_feature (33)..(104): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with altered alkaloid content
  misc_feature: Useful for making plants with modulated biomass
  misc_feature: Useful for making plants with modulated flowering time
  misc_feature: Useful for making plants with altered lignin content
  misc_feature: Useful for making plants with modulated nitrogen use efficiency
  misc_feature: Useful for making plants with altered terpenoid content
  misc_feature: Useful for making plants with modulated phosphate use efficiency
MALTNKLGGLLKKATSSNPSIYQAIRCMSSSKLFVGGLSYGTDDQSLRDAFANYSQVIEARVIMDRESGRSRGFGFVTYTSSEEASAAITAMDGQDLHGRNIRVNHATEKTSGFRAGGGGGFGGGGYGGGGFGGGGSGGGGYGGSGGYGAGYGSGGGGGGYGGGNYGNRDGGGYGGGGVAGGAGGNFAAGGGDSFGSNFGGESGFGNPAGGFGAPSGTYGGDEFPASGSFSSNKNDEIMQDMFKDDDKPDNYADKRA

SEQ ID NO: 15493 - DNA, 780 bp, Panicum virgatum
  misc_feature: Ceres CLONE 1783741
  misc_feature: Encodes the peptide sequence at SEQ ID NO. 15494
atctcattccgctttgagcttgcttgcagctccagctcccctcgtctcttggtggctacgccatgaccaccgtagtcctgatgagctgcagcctccgcgcgccggccagcagcggcttatctggcgtccgcgccgccccggcaccggccatcgtcgccatgcccgccgccaagcagcaggttgttggccgcggcgccaggctgcgcgcgcaggccacctacaacgtgaagctcatcacgcccgacggcgaggtagagctgcaggtgcccgacgacgtgtacatcctggaccaggccgaggaggaagggatcgacctgccctactcgtgccgcgcggggtcctgctcctcctgcgccggcgaggtcgtcgacccgctctaccccggcggcagcttcgaccccctcggcctggctgacgaccccgaggccttcgccgagctcaaggttaaggagctcaagaacggccgcctcgccatgttctccatgttcggattcttcgtccaggccatcgtcaccggcaagggcccgctcgagaacctcgccgaccacctcgccgacccggtcaacaacaacgcctgggcctacgccaccaacttcgtccccggcaactaagctccgatccattggcaatgcaacttcattgtcttccggagggggcgtacgtggatccattgatgctgcaagctgccgcgtgtgcgtctcttgtttcacgttgcatttcaggggcaagtcgagatgatgagttgccgttgtacactaagatgaacgatgatgcttgtgc

SEQ ID NO: 15494 - protein, 182 aa, Panicum virgatum
  misc_feature: Ceres CLONE 1783741
  misc_feature (58)..(130): Pfam Name: Fer2 Pfam Description: 2Fe-2S iron-sulfur cluster binding domain
MTTVVLMSCSLRAPASSGLSGVRAAPAPAIVAMPAAKQQVVGRGARLRAQATYNVKLITPDGEVELQVPDDVYILDQAEEEGIDLPYSCRAGSCSSCAGEVVDPLYPGGSFDPLGLADDPEAFAELKVKELKNGRLAMFSMFGFFVQAIVTGKGPLENLADHLADPVNNNAWAYATNFVPGN

SEQ ID NO: 15495 - DNA, 659 bp, Panicum virgatum
  misc_feature: Ceres CLONE 1783759
  misc_feature: Encodes the peptide sequence at SEQ ID NO. 15496
gttcgttaggaggcacgtctccccctgtatcatgtatccagcggtaaaccattctgtgttattttggaggctgttcgaacttatttatgatacggagttcgagttaaaccatcgttgctttttgttcaatttatgcgattttgatgcaaaaaagcagcagacgcatccctacgccggtcgcagccatggtgaagtactcaagggagccgaacaaccccaccaagtccgccaaggccatgggccgggacctccgtgttcacttcaagaacacccgtgagacagcttttgccctcaggaagttgcctctcactaaggccaaaaggtaccttgaggatgtgattgcccacaagcaggccatccccttccgcaggtactgtggcggtgttgggcgtactgctcaggctaagtcacgccactcaaatggacagggacgctggcccgtcaagtctgctagattcattcttgatcttctaaagaatgctgagagcaatgctgaggtcaaaggtcttgatgtcgataccctgtatgtgtcgcacattcaagtaaaccaggctcagaagcagcgtcgcaggacctaccgtgctcatggacgcatcaacccttacatgtcctccccgtgccacattgagctgatcttgtcggagaaggaagagccagtg

SEQ ID NO: 15496 - protein, 157 aa, Panicum virgatum
  misc_feature: Ceres CLONE 1783759
  misc_feature (17)..(153): Pfam Name: Ribosomal_L22 Pfam Description: Ribosomal protein L22p/L17e
MVKYSREPNNPTKSAKAMGRDLRVHFKNTRETAFALRKLPLTKAKRYLEDVIAHKQAIPFRRYCGGVGRTAQAKSRHSNGQGRWPVKSARFILDLLKNAESNAEVKGLDVDTLYVSHIQVNQAQKQRRRTYRAHGRINPYMSSPCHIELILSEKEEP

SEQ ID NO: 15497 - DNA, 655 bp, Panicum virgatum
  misc_feature: Ceres CLONE 1783786
  misc_feature: Encodes the peptide sequence at SEQ ID NO. 15498
tccacctcgagggggggccccgcacccccttcttcctatattgagtcgaattacacccgctccctgttcgtccttttatcccgtcctgacagggaaaagcctggcgttacccaacttggtcttcttgcactgcatccccatttcgacgattggcataataaccaacaggccggcctcgatctgccttccgaacaatgacgcatcctgtatggctgatggaacccgccgtggttcctgttattcagcgtggagggtgtggtggttacccgccgcgtgaccgctaaacttgccgccatcctctcccccggtcctttcgctttcttcccttcctttctcgccacctgcgccggctttccccatcaagctctctgtcgggtcgctccctttatggttcctatttattgctttacggcacctcgacaccaaaaacttgatgacggtgatggttcacgtagtgggccatcgccctgatagactgtttttcggcctttgacggatgactcctcgttctgtagtagtggactcctgctccttactggaacaacactcaaccctatctctgtctattcttttgatttataaggcatattacccatttctgtcgattgcttacaccatgagttgattgaaccaaaatgctgcgccaagttccacg

SEQ ID NO: 15498 - protein, 65 aa, Panicum virgatum
  misc_feature: Ceres CLONE 1783786
  misc_feature: SWISSPROT Homolog: EC 3.2.1.23 Beta-galactosidase
STSRGGPAPPSSYIESNYTRSLFVLLSRPDREKPGVTQLGLLALHPHFDDWHNNQQAGLDLPSEQ

SEQ ID NO: 15499 - DNA, 958 bp, Panicum virgatum
  misc_feature: Ceres CLONE 1783790
  misc_feature: Encodes the peptide sequence at SEQ ID NO. 15500
catcgaccccgcatttacattacaccacgggcacagtgagccagacagccagcgacgagccacgagcaccaggtctccgagcgacacggcggcgagcgcgccgccgccacgaccagcagccgccacacacctcgagcgaagaagcagccatggcgacgcgtcgcctcccgtcgtcgtccctcccgctgctgctgctccttgcggcggcggcggcggcggcaggcgcgcttggcggcaactcccccgaggccgacacggacccggacatagtgccgcgctccggccggagcctgcagcagctgccgcagccggacccgaacccacagccgcagccaggggggaacccgccggtgccacagcccctgccgcaaccaaatccgaacccgccgcagccgcttccacagccacagccgcagcccatgccgcagccgcagccgctgcctcagccgcagccgcagcccgggccgcagccagacccaacagccccacagccgcagcccttgccgcagccggacccaggccagcagcagccacagcccgggactcagccggctcagaatccgcaggcgcagccggaccagctgctcccgagcggcggcgggtcgaggatgatgctggtgaacctgcaagactccatgtgcatacttctcccaagtcttggctatctgttagtgtaaccctgtgcaaatactttttttctttttcttccttccttcatttgttagttgttacccgccgcgtctgtatgtaattattaattaaatatatatagtcgcgagatatgtacagttgtatttttttttgcgtacgttgtgcgagtgtgtgtagtaattagattgcatagatttttgcgagtgtgtggtaacagggcttgcgctgtgggtatttggatgtagcttgcgtgtaccatgattgtgtgcctctctgtacatactatacaatacacttgatttacatg

SEQ ID NO: 15500 - protein, 175 aa, Panicum virgatum
  misc_feature: Ceres CLONE 1783790
  misc_feature: Useful for making plants with altered lignin content
MATRRLPSSSLPLLLLLAAAAAAAGALGGNSPEADTDPDIVPRSGRSLQQLPQPDPNPQPQPGGNPPVPQPLPQPNPNPPQPLPQPQPQPMPQPQPLPQPQPQPGPQPDPTAPQPQPLPQPDPGQQQPQPGTQPAQNPQAQPDQLLPSGGGSRMMLVNLQDSMCILLPSLGYLLV

SEQ ID NO: 15501 - DNA, 645 bp, Panicum virgatum
  misc_feature: Ceres CLONE 1783809
  misc_feature: Encodes the peptide sequence at SEQ ID NO. 15502
acgccgccactcctcccaaccccgcgcctccgcctcaaaccctagcccaccggagcaacgaccaaggaatggggaagggtacgggcagcttcggcaagcgccggaacaagacgcacacgctctgcatccgctgcggccgccggagcttccacctacagaagagcacctgctcctcctgcggttaccccgccgcccgcatccgcaagtataactggagtgtgaaggccatccgccgcaagaccactggaactgggaggatgagatacctccgacatgtgcctcgccgtttcaagagcaacttcagagaaggtactgaggctacccccaagaaggctgctgctgcttccaactaagtctggatgttgtcatcgagtaccgcagaagctagaaattggaacctttttggctgagttgtacagtctgaactatttagacgtgatactatggaagtattgttttgtcgtactttaaattcaatccagacgaacatctgaattcgttgctccatgctttcatgtatcgttttggtgagcagtgcgtgcgttatagaaatttcaatgttttgtggctctagttcacagctaaccctgcaaacagttgtgcctgtgcaggctgtgctcgttggctgtaactgtgagagcagtg

SEQ ID NO: 15502 - protein, 94 aa, Panicum virgatum
  misc_feature: Ceres CLONE 1783809
  misc_feature (2)..(55): Pfam Name: Ribosomal_L37e Pfam Description: Ribosomal protein L37e
MGKGTGSFGKRRNKTHTLCIRCGRRSFHLQKSTCSSCGYPAARIRKYNWSVKAIRRKTTGTGRMRYLRHVPRRFKSNFREGTEATPKKAAAASN

SEQ ID NO: 15503 - DNA, 786 bp, Panicum virgatum
  misc_feature: Ceres CLONE 1783812
  misc_feature: Encodes the peptide sequence at SEQ ID NO. 15504
atcgccgccccggatcggattcaactcgcctaccctcctcccacccctcaatcccgagctccgcctgcttcccacgctgccgcggcgggctccgacctccccgctcctcgggaaagctgtcatggcggccgccgcgctgagggagcagctcaacgccctcctctcctccatgttcgcctcgggtctggtggacgagcagttccagcagctgcagatgctgcaggatgacgggggcaccccgggcttcgtcgccgaggtcgtcaccctcttctgcgacgacgccgacaggatcatctccgagctcaccgccctgctggagcagcccgtcgtggacttcgataaggtggacgcctacgtgcatcagctaaaggggagcagcgccagtgttggtgctcagaaagtgaagtttacttgcacgcagttccgtcagttatgtcaggacaagaacagagacgggtgcatcgtggcattagccgttgtgagaaatgagttcaatgatctgcgcaccaagttccagactatgcttcagcttgagcagcaaatccaggctcaacaataaattgaaggagaaagaatgtagttgcatgtgatctcacatgataagtgtatctctggagatgtagaccatgttcattgttcgccggattcccgcaacgtgtgcgcaatcattgacattgaggttttcgtgcttacaaaactttggctcacaaagctgtactgttagcggcaccaatgactgtctagcgttgtgcctctgttgctgtagcttgtttgtgttggattgcc

SEQ ID NO: 15504 - protein, 145 aa, Panicum virgatum
  misc_feature: Ceres CLONE 1783812
  misc_feature (45)..(130): Pfam Name: Hpt Pfam Description: Hpt domain
MAAAALREQLNALLSSMFASGLVDEQFQQLQMLQDDGGTPGFVAEVVTLFCDDADRIISELTALLEQPVVDFDKVDAYVHQLKGSSASVGAQKVKFTCTQFRQLCQDKNRDGCIVALAVVRNEFNDLRTKFQTMLQLEQQIQAQQ

SEQ ID NO: 15505 - DNA, 660 bp, Panicum virgatum
  misc_feature: Ceres CLONE 1783814
  misc_feature: Encodes the peptide sequence at SEQ ID NO. 15506
gttggcaacatccgcggacggtcaatttcggcccggtgatgaggagtatatatatataaaaaaggtctttttaatttgtgcggcggccaccgacgcgacccaactgaatccggacccaaatccaaacaccatccaacacctgtcccttttccgcccaggcgagaatcacagcttcgacgccgccatcctcacgaggcggtgggctgggcttcttccgtcccaagtccccgtgcggccgtgccccttctccacccgatgcttccggcatcgcgtgccctttctcctctcgctggcgcaggcgcaacagatcccccccacccgttccttcggcggccagacgaatcgtggaggggagggaggatggcctccgacggccacccgccggagccggtgaagaaggaggaggtcgccgccaccgccgccgggcctggggccaacgatttggacgatccgcagttcatgtgctgcgtctgcctggatcttctgtacaagccagttgttatctcatgtggccatatgtcatgtttctggtgtgtccacaaagctatgcatatcttccgggaatcaaagtgtgctgtgtgtaggcagccctataaacattttccaagtatctgccagctcatgcatcacttgatcctaaagcttgaacctgcagactac

SEQ ID NO: 15506 - protein, 99 aa, Panicum virgatum
  misc_feature: Ceres CLONE 1783814
  misc_feature: The sequence is a functional homolog of SEQ ID NO 174 in the 10/225,068 US patent application
  misc_feature: The sequence is a functional homolog of SEQ ID NO 1838 in the 11/479,226 US patent application
  misc_feature: The sequence is a functional homolog of SEQ ID NO 2646 in the 10/374,780 US patent application
MASDGHPPEPVKKEEVAATAAGPGANDLDDPQFMCCVCLDLLYKPVVISCGHMSCFWCVHKAMHIFRESKCAVCRQPYKHFPSICQLMHHLILKLEPAD

SEQ ID NO: 15507 - DNA, 604 bp, Panicum virgatum
  misc_feature: Ceres CLONE 1783899
  misc_feature: Encodes the peptide sequence at SEQ ID NO. 15508
atcaatccaaagaatcccccccaaacgccaccgcctcccctagggttttcgctccgcgagccggatcaggtcgaggcgtcgagcccggggtcgggggatccgcgccatggcgtcgcgtccgtcgctgaaggcgaagcccaagggcaagggcgggaggaaggactccgccgcggccgcggccgacggggaggccaccagggcggcgaccgcggtgcggctcgtcaaggagtggaccacgtggacgatgaagacggccaaggtggcggcgcactacggcttcatcccgctcgtcatcgtcatcggcatgaactccgagccccagccctccatctcccagctcctctcccccgtctgatcgggctccccctgaggggcccccggatgcggtcggtcccgcctgctttcgtagtaattcatagctggttgcttgttttcacatgtgctggatcgagttggtgagggttggcgagtccgtgatgcttctgggagcaggttgagcgtaataatttcttgttggcggatgtgtcttctgtagaacggaccaaatccgttaagttggttatatgaatccgctatgctattaatgtgatggtatgaactagat

SEQ ID NO: 15508 - protein, 82 aa, Panicum virgatum
  misc_feature: Ceres CLONE 1783899
  misc_feature (40)..(79): Pfam Name: Tom7 Pfam Description: TOM7 family
MASRPSLKAKPKGKGGRKDSAAAAADGEATRAATAVRLVKEWTTWTMKTAKVAAHYGFIPLVIVIGMNSEPQPSISQLLSPV

SEQ ID NO: 15509 - DNA, 423 bp, Panicum virgatum
  misc_feature: Ceres CLONE 1783902
  misc_feature: Encodes the peptide sequence at SEQ ID NO. 15510
aagccatctgcaagtcaagtctcactagtcactcctaatcctaaaccacaagacaccttggtgttagaagtgcaatggcgaccagcaccatggccctctcctctacggccttcgccgagctcaaggtcaaggagctcaagaacggccgcctcgccatgttctccatgttcggcttcttcgtgcaggccatagtcaccggcaagggcccgcttgagaacctcgccgaccatctcgccgaccccgtcaacaacaacgcctgggcctacgccaccaacttcgtgcccggcaagtgaggggtcggttcccgaactgttcgatctgtaggaggtccggatgtgagcgcgcattggtttcagtttgtaccatgatataaattactgggttccaaccgagaaggaaattgcttgctgtgttcgttgtccg

SEQ ID NO: 15510 - protein, 72 aa, Panicum virgatum
  misc_feature: Ceres CLONE 1783902
  misc_feature: Useful for making plants with modulated nitrogen use efficiency
  misc_feature: Useful for making plants with modulated oxidative stress sensitivity
MATSTMALSSTAFAELKVKELKNGRLAMFSMFGFFVQAIVTGKGPLENLADHLADPVNNNAWAYATNFVPGK

SEQ ID NO: 15511 - DNA, 960 bp, Panicum virgatum
  misc_feature: Ceres CLONE 1783936
  misc_feature: Encodes the peptide sequence at SEQ ID NO. 15512
gtccttcctccgtcttcctcctctcgctctcatccactctcctcccccctcgccactgcggtgcggagcttcggcggctcggctcgagcagaagaaaatgcaacgggcagtgcaagccatcaggtcgcatggcagtgtgcttaaatatgctgttcaacaacacatcagcgctcccaaaccagcaatgcttcctgctgccttttctcgcttcatgtcagcttcatctgctcgcctagaggacagtggatttgaaactgccactgtagctgatatcttgaagtctaaagggaagagtgctgatggatcttggctctggtgcaccacagaggacagtgtctatgatgctgtcaaatcgatgacgcaacacaatgtgggggctttggtggtggtcaaaccgggacaggaaaaagcaattgctggcattgtcacggagagagattatctccggaaaatcatagtgcaaggacgatcttccaagtcaactaaggttggagacatcatgactgaagagaacaaactgatcaccgtgaagcctggcaccaaggtcctgcaagcaatgcagctgatgacagagaaccgcatcagacacatcccggtggtcgaaggcacggggatgctggggatggtctccatcggcgacgtcgtccgcgcggtggtcagcgagcacaaggaggagctgaacaggctcaacgcctacatccagggaggctactaggacgacgcccctacctcccagcgatgtccgccttcgatatccaataactcgaaccagtgatgatgacgaaataggccgtgtgtttgcggacaatgctgttgaattgcgcaaggtgtttttcccccgcttgttctgtgtgtatattgctgaaaggcgggcgtgacagtgcgcctggtgctggggcgcacagactatctgacggtggaaacaccggaaataaaaagcgtgccgccgccgtgtgcttc

SEQ ID NO: 15512 - protein, 205 aa, Panicum virgatum
  misc_feature: Ceres CLONE 1783936
  misc_feature (65)..(187): Pfam Name: CBS Pfam Description: CBS domain pair
  misc_feature: SWISSPROT Homolog: EC 1.1.1.205 IMP dehydrogenase
MQRAVQAIRSHGSVLKYAVQQHISAPKPAMLPAAFSRFMSASSARLEDSGFETATVADILKSKGKSADGSWLWCTTEDSVYDAVKSMTQHNVGALVVVKPGQEKAIAGIVTERDYLRKIIVQGRSSKSTKVGDIMTEENKLITVKPGTKVLQAMQLMTENRIRHIPVVEGTGMLGMVSIGDVVRAVVSEHKEELNRLNAYIQGGY

SEQ ID NO: 15513 - DNA, 929 bp, Panicum virgatum
  misc_feature: Ceres CLONE 1783969
  misc_feature: Encodes the peptide sequence at SEQ ID NO. 15514
ctcggcttcttccccctttccccctgacgacccgaccgcctccttccttccgccaaaccgaagcgcgcggcgtgcctgcttggctgcttcgcaggagttcgtcccttcttctcgacatccatatcctcgcctccagtggcccggtgtggagtgggatccatttggaatcggattgatttcccctttcgctgatttgtgttctctagacattccataaaccagcatgccaaagataaagacaagccgtgtttcgtatccggaaggatgggagcttattgaaccaacaatccgtgagttggatgccaaaatgagagaagctgaaaatgatccacatgatgggaagaggaagtgtgaagctctctggcccattttccgtatttctcatcaaaggagccgctacatatatgatctttactacagaaggaaggagatatcacagaagctttatgagttttgcctggaccagggttatgcagaccgcaatctgattgcgaagtggaaaaagccaggttatgagcgcctttgctgccttcggtgcatacagacacgtgaccacaactttgcaacgacttgcgtctgcagagtccccaagcacctcagggaggagcaagtgatcgaatgtgtccattgcggctgcaggggctgtgccagcggtgactaatcttgtcgttatgctgttgggttcatgactcatcatctcaaccttaacacttgtgatctctcgtgagcatgttccgataaagagcagcgggtgcctatagaggtgattcgcatgaatgtattggtgcaacttgtaagcctaggatgcttaatttcttgacgtttgtatgtctctgttatgctcagacttgttgacttcgtatgtatgtattatgacgatttcacctcatgcagcccatgctgatttactgttttgtttttttctgtac

SEQ ID NO: 15514 - protein, 145 aa, Panicum virgatum
  misc_feature: Ceres CLONE 1783969
  misc_feature (1)..(143): Pfam Name: G10 Pfam Description: G10 protein
MPKIKTSRVSYPEGWELIEPTIRELDAKMREAENDPHDGKRKCEALWPIFRISHQRSRYIYDLYYRRKEISQKLYEFCLDQGYADRNLIAKWKKPGYERLCCLRCIQTRDHNFATTCVCRVPKHLREEQVIECVHCGCRGCASGD

SEQ ID NO: 15515 - DNA, 751 bp, Panicum virgatum
  misc_feature: Ceres CLONE 1783973
  misc_feature: Encodes the peptide sequence at SEQ ID NO. 15516
aggtgcatccatcgtggcctccgactccatctatctatcctcttcctctccagcgccacgccgcgctagttcacacagcacacatccctctgcagactccggccctgcggggggcggcgccatggcggctgcgaatgggagcggcggcaaggggttcgaggtgcccaaggtggaggtcaggttcaccaagctcttcatcaacggccagttcgtcgacgccgtctccgcgggtggccacatcgaggaggtcaggaggaacaagacaagctgcctcgatggctcgatcgctagcttcggcctttggattattcaccgcctcaccggtgagatctcgggtggaggaggccaaactgggaccgttcatgtcctggcaaaagataggccgtcacagtaaccaagagctggcatgacactcctcttttttttttatgctttgatcttgtgcgatcgtatcgtgccatcgtgggaagcaagaggccacgacaaaagtgaggtgacctagccggcaacaaaggaaaaacccagtgttcatcccgagaggatttgctttatttgcctgccactttctaattaaatacaactgatcatttttaggcttaaccacggagtacttgatgttgagttgtactcgaaggttgcacacttgtacgcagcagtaccactattattagcacaatgccgtaacttaactagtaaggacactcatactacggatgtactctcatgaacaagtgctacctctttcaaggat

SEQ ID NO: 15516 - protein, 90 aa, Panicum virgatum
  misc_feature: Ceres CLONE 1783973
  misc_feature: Useful for making plants with altered carbohydrate content
MAAANGSGGKGFEVPKVEVRFTKLFINGQFVDAVSAGGHIEEVRRNKTSCLDGSIASFGLWIIHRLTGEISGGGGQTGTVHVLAKDRPSQ

SEQ ID NO: 15517 - DNA, 842 bp, Panicum virgatum
  misc_feature: Ceres CLONE 1783975
  misc_feature: Encodes the peptide sequence at SEQ ID NO. 15518
atctccactccacataatcctgagagcaaccaacgcgacaacataggcgtccagcgtctgctggggctgaggatggcatcgcactcgtgcccccgcaccgccgctgtggcgccgcgtgcctcgcgcccgctgtcctctctcctcctcgcctcctcgccggccgccgcgcgccctcggcccgcgcccctcccgtgcaggggccgcgcggcgggacggaggttgcccggcgtgtcggcgatgtcgtcgtcgaccccgccgccagggcccgtgcacaagtcggaggaggagtggcaggccatcctcacgccggagcagttcaacatcctccgcctcaagggcacagagtatcccggaacgggtgaatatgacaagttttttgatgacggcatttataaatgtgctggatatggaactcccttatacaaatcatctacaaagttcaactcagggtgtggctggcctgcattctatgagggacttcctggggccataagccagacgccggaccccgatgggaggcggacagagatcacatgtgctgcctgtggaggacatttggggcatatattcaaaggggaagggtttaaaacgcctaccaacgagcgacattgtgtcaacagcatttctctcaagttcattccagcctcagaggaagcttgacagcagatgaacaccaacgtgaaacccgacaacagaatgagagcttggcctttgttgggtgtttttacagtgtagacagatgaaggttgttgttctgccgtttatcattatgtttactcatcctttaaacgacataccatcttgtttatgaaagcttaatagattttgtgcagacaagcttg

SEQ ID NO: 15518 - protein, 219 aa, Panicum virgatum
  misc_feature: Ceres CLONE 1783975
  misc_feature (94)..(215): Pfam Name: SelR Pfam Description: SelR domain
  misc_feature: SWISSPROT Homolog: EC 1.8.4.12 Peptide-methionine (R)-S-oxide reductase
  misc_feature: Useful for making plants with modulated heat sensitivity
ISTPHNPESNQRDNIGVQRLLGLRMASHSCPRTAAVAPRASRPLSSLLLASSPAAARPRPAPLPCRGRAAGRRLPGVSAMSSSTPPPGPVHKSEEEWQAILTPEQFNILRLKGTEYPGTGEYDKFFDDGIYKCAGYGTPLYKSSTKFNSGCGWPAFYEGLPGAISQTPDPDGRRTEITCAACGGHLGHIFKGEGFKTPTNERHCVNSISLKFIPASEEA

SEQ ID NO: 15519 - DNA, 709 bp, Panicum virgatum
  misc_feature: Ceres CLONE 1783998
  misc_feature: Encodes the peptide sequence at SEQ ID NO. 15520
aacactccgataccatccatccgccatggcgacgggcacgctgctgagctcctccttcgccatgcccgccgccgcccggagggcctcctcctcttcctccacctccctgggcttcgccacgtcgcagctcgccggcctctccctctccgccgccgcgcccacttcaaccgccgcggcccccctccacaaaaggccactccagcccatcgtcgcgcgccgggagtgccccttcactgacaagaagacgaaccgggcgaacaaggtgtccttctccaaccacaagaagaagaagcagcagttcgtgaacctgcactacaagaaggtgtggtgggaggccggcaagcgctacgtcgagctgcgcctctccaccaaagacctcaagaccatcgagaagcacggcctcaacgccgtcgcgcgcaaggccggcatccacctcaacaagaagtgagccgagcttgagtagtcaagccggtgatggcggtatggtcaggccgagcaatctcgcgaacagatgccactagcttagtcttcatggtatgggtccgtctcgactgtctcaaagtctgctgctgctgctgctgctcattcagacatacagtatttttcctttcctcgctaagttgatttgcatacaatagacaatgtaaagcagatcgaggttgcgtatatttttattctatggaaagagttgaggtttcaaaaagaaaag

SEQ ID NO: 15520 - protein, 140 aa, Panicum virgatum
  misc_feature: Ceres CLONE 1783998
  misc_feature (64)..(125): Pfam Name: Ribosomal_L28 Pfam Description: Ribosomal L28 family
MATGTLLSSSFAMPAAARRASSSSSTSLGFATSQLAGLSLSAAAPTSTAAAPLHKRPLQPIVARRECPFTDKKTNRANKVSFSNHKKKKQQFVNLHYKKVWWEAGKRYVELRLSTKDLKTIEKHGLNAVARKAGIHLNKK

SEQ ID NO: 15521 - DNA, 790 bp, Panicum virgatum
  misc_feature: Ceres CLONE 1784013
  misc_feature: Encodes the peptide sequence at SEQ ID NO. 15522
attgctccttccagttcccacctccagcgctgccatgaacacagccatggccaccacttccttatccctccaaggccgcccttgccaggccgcggccaagaagctctcttccccgttcctcggagcccccgccttcttcctccggccgctggcgcccgcgcccaccgccgcctcctctcggcggacgctcgccgtcagggccatggctccgcccaagccgggaggcaagccgaagaaagtggtggccatgataaagctggccctggaggccggcaaggcgacgccggcgccgcccgtcggcccggcgcttagtgccaagggtgtgaacatcatggctttctgcaaggagtacaatgccaagacggccgagaaggccggctacatcatccccgtcgagatcaccgtcttcgatgacaagagctttactttcatcttgaagacaccaccagcctcagttctgctccttaaggctgcaggtgtcgaaaaaggttcaaaagagccacagcgagaaaaggttggcaaagtaacagcagatcaagtccgtgcgatagctcaagagaagttgccggacttgaactgcaagagcatcgactctgctatgaggatcatcgctggcactgccgctaacatgggcattgatgttgaccctccaatccttcagaagaaggaaaaagttctcttgtagtttgttttgctgggacccgcagatcaaattatcaatcaccttatgtagattctgccttcctttttgttcatcaattcgcagtgattaaagtttttctctggtgtc

SEQ ID NO: 15522 - protein, 212 aa, Panicum virgatum
  misc_feature: Ceres CLONE 1784013
  misc_feature (131)..(199): Pfam Name: Ribosomal_L11 Pfam Description: Ribosomal protein L11, RNA binding domain
  misc_feature (68)..(126): Pfam Name: Ribosomal_L11_N Pfam Description: Ribosomal protein L11, N-terminal domain
MATTSLSLQGRPCQAAAKKLSSPFLGAPAFFLRPLAPAPTAASSRRTLAVRAMAPPKPGGKPKKVVAMIKLALEAGKATPAPPVGPALSAKGVNIMAFCKEYNAKTAEKAGYIIPVEITVFDDKSFTFILKTPPASVLLLKAAGVEKGSKEPQREKVGKVTADQVRAIAQEKLPDLNCKSIDSAMRIIAGTAANMGIDVDPPILQKKEKVLL

SEQ ID NO: 15523 - DNA, 754 bp, Panicum virgatum
  misc_feature: Ceres CLONE 1784017
  misc_feature: Encodes the peptide sequence at SEQ ID NO. 15524
gtcccggccatatatatcctccgccgccgacgatcgagctagctacagcctagagctgccaccaccgttaattataattacgcaccgcagcaatggcctgcggccactccgcctccgcgctcctgctgctggtggcggtggtggtggccgcctccgccgcctgccgctgctgcctcgccgcgccggcgggggcgctggtgacgcgcgtgccggggttcgcccagcagcagctgccgtcgaagcactacgccgggtacgtgacggtggacgaggcgcacgggcggcgcctcttctactacctggtggagtcggaacgcgaccccgccggggaccccctcgtgctctggctcaacggcggcccgggctgctccagcttcgacggcttcgtctacgagcacggtgcgtcgcgtccgatcctccgccgtcgttgatcccagccccctactagctccgatccttttcttctccgcgaatttttcttctttattatttgcccaaggaattgaacgaaaccatcgtcgccgttgcttggtctctgttgcgttgctgtcgccggccggtcgccggaccacggagagagtggccgaggttgggctgggagagcggcggggcaagaagctaggcccgcctgtgggctgctgcgctgttgctttctacgcaccgcgtaaaggagcccccgtcgctgtctttccgcccattttgtcttgggaaagcgaactactaatctactataacaagacattattcctgctcc

SEQ ID NO: 15524 - protein, 112 aa, Panicum virgatum
  misc_feature: Ceres CLONE 1784017
  misc_feature: SWISSPROT Homolog: EC 3.4.16.5 Carboxypeptidase C
MACGHSASALLLLVAVVVAASAACRCCLAAPAGALVTRVPGFAQQQLPSKHYAGYVTVDEAHGRRLFYYLVESERDPAGDPLVLWLNGGPGCSSFDGFVYEHGASRPILRRR

SEQ ID NO: 15525 - DNA, 699 bp, Panicum virgatum
  misc_feature: Ceres CLONE 1784030
  misc_feature: Encodes the peptide sequence at SEQ ID NO. 15526
cttctgcctcctctctccacacgacttctcccgccgccgccgccgtcgcagcagtcgccgtgaccagcaaccggacaaagtatggatacccaggttaagcttgctgttgtggtgaaggtgatgggccgcactggctccaggggtcaggtgacccaggtcagggtgaagttcctggacgaccagaaccgtctcatcatgaggaacgtcaagggccctgtccgtgagggtgacatcctcaccctcctcgagtctgagagggaggccaggaggctgcgttgaagcagctggtggtcgcgccagttgttggccattcctgtactgctttcgtatcaagttattgaacaatgctaccttgtcctttgagtaggctatggagaatgggcttaagcaatcgaattgtaatttaagcactcgtcttattgcaagttttggtctgttattgcctgaatgaatttaagggcacttgatgcgtgacatgattttgttgctatcttgggtaacaacaatgaatggtttgtatgactaaaatctgaacttttactgtcaactacaaatccaaattgtttggtttggttgtccgggaactgtctaatttgcgtggtggttagtttgtcactagggtgtgtagtcagaggttgtgtcatggggtgcttgttggatttttgtcaaataatgtaagtttatgagttacgccatcag

SEQ ID NO: 15526 - protein, 65 aa, Panicum virgatum; identical to SEQ ID NO: 9766
  misc_feature: Ceres CLONE 1784030
  misc_feature (1)..(65): Pfam Name: Ribosomal_S28e Pfam Description: Ribosomal protein S28e

SEQ ID NO: 15527 - DNA, 839 bp, Panicum virgatum
  misc_feature: Ceres CLONE 1784035
  misc_feature: Encodes the peptide sequence at SEQ ID NO. 15528
accatttcacttcacagaactccttgtcctaggccccagaaacacaaacgaccgctctttgtttaggcaagatgaacaggaagcctggagactgggattgcagggcttgccaacacctcaacttcagtcggcgggacctatgccagcgctgtggtgagccacgtggagctgctgaccgtggcagcggcggtggaggtgactatgccaacttcggtggccgtggtggctcctccttcggcggtggctttggtgctggctctgatgtccgccctggtgactggttatgttcctgcggcgcgcacaacttcgccagccgctccaactgcttcaagtgctctgccttcaaggaggaggctgctgtcaacagtggtgctggtggctttgatggtgacatgtcacgctcgcgctacggcttcggtggcggtgctgcccgcaccaaccgccctggttggaagtctggagactggatctgcaccaggtccggatgcaacgagcacaactttgccagcaggatggagtgtttcaggtgcaacgcaccacgggactccggcactgaggtgtgggatcggagctggtgcttcgaacggaccccgacgagcagaagcagcaagaaacctgataagaagagtagtagatttgcaaaaggcatcccggtgttttgttccacccctaccgtttccttttagaatttggttctcgtctccttagtacccctcggacctatgtttgctgttttattcccgttgtttcccgcaatgtttgcgctttgcatcgagatcatgtgatgtaacccttaaaacgcttgcttcacgaagtattaactagtactgttgcttctt

SEQ ID NO: 15528 - protein, 204 aa, Panicum virgatum
  misc_feature: Ceres CLONE 1784035
  misc_feature (128)..(159): Pfam Name: zf-RanBP Pfam Description: Zn-finger in Ran binding protein and others
  misc_feature (66)..(94): Pfam Name: zf-RanBP Pfam Description: Zn-finger in Ran binding protein and others
  misc_feature: Useful for biocontainment applications
  misc_feature: Useful for making plants with modulated biomass
MNRKPGDWDCRACQHLNFSRRDLCQRCGEPRGAADRGSGGGGDYANFGGRGGSSFGGGFGAGSDVRPGDWLCSCGAHNFASRSNCFKCSAFKEEAAVNSGAGGFDGDMSRSRYGFGGGAARTNRPGWKSGDWICTRSGCNEHNFASRMECFRCNAPRDSGTEVWDRSWCFERTPTSRSSKKPDKKSSRFAKGIPVFCSTPTVSF

SEQ ID NO: 15529 - DNA, 1063 bp, Panicum virgatum
  misc_feature: Ceres CLONE 1784047
  misc_feature: Encodes the peptide sequence at SEQ ID NO. 15530
ccaattccttcttccttcgccgcgactcctccagactcgggccacaagacaagcctgatagcgccgcacaagagaggatttcgaggggttttgcccggtcggcgacccggatcgagatcgcgacgccatgagcgaggtcttcgagggctacgagcgacagtactgcgaggcatccgcctccctcacccgcaaatgcaccgccgccgcggccctccaaggagagaagctgaagcagaaggcggcggagatcaaatccggcatcgatggcgccgaggccctgataagaaagatggatcttgaagcaaggaacctccaaccaagcattagagctgggctcctagcaaagatcagggagtacaagtcagatcttaataacctcaagggagcgttgaagaggattactagtggctatgcacagcaaggggtgagggaggagttgctggagtcaggaatggctgatgcattaggggtttctgctgatcaaagatcaagattgctcagggcaactgaaagacagaatgaaacaactgataggctcggagatagccatagaactatgctggagaccgaagatcttggagtctccatcttgcatgatctgagtcaacagcgccaacctctcttgcatgctcatcgtgtattggatgatgtcgatgtcaacgttgacaagagtaggaggactattggaggcatggtgaggagaatggacagaaacaagtggatcatcggtctcgtcatagccgcccttgtcctggccatcctagtgatcctgtatttcaagttcgtgcactaggtgcattggggcagtagttttctactgcaaccatgatgaaggcagccagctgtgaatttttttgttctatctgcacttggcaacctgtgtgtttttcttttctattttccttttattttgttcagatcatatttttgtgggggtgtgcttgtatgctatcgaatgtgtttcgaggaaaagttgagaccatcagacagtctcttgtatatcagctgattgctttttgtttgaaagactaactgaacgggcaataatgaagcagatttaagc

SEQ ID NO: 15530 - protein, 221 aa, Panicum virgatum
  misc_feature: Ceres CLONE 1784047
  misc_feature (41)..(196): Pfam Name: V-SNARE Pfam Description: Vesicle transport v-SNARE protein
MSEVFEGYERQYCEASASLTRKCTAAAALQGEKLKQKAAEIKSGIDGAEALIRKMDLEARNLQPSIRAGLLAKIREYKSDLNNLKGALKRITSGYAQQGVREELLESGMADALGVSADQRSRLLRATERQNETTDRLGDSHRTMLETEDLGVSILHDLSQQRQPLLHAHRVLDDVDVNVDKSRRTIGGMVRRMDRNKWIIGLVIAALVLAILVILYFKFVH

SEQ ID NO: 15531 - DNA, 897 bp, Panicum virgatum
  misc_feature: Ceres CLONE 1784055
  misc_feature: Encodes the peptide sequence at SEQ ID NO. 15532
acctccattgccgcgcctcttcctccatctcctatagcagcagcagctacctacctagctttcagcagctctagcaataatggccaccgccctcagcagcctccgcgcgccggccagcagcttctccggcgtccgcgccgccccggcacccgcggcgcccgccatcgtcgccatgcccgccgccaagcagcaggttgcccgcggcgccaggctgcgcgcccaggcgacctacaacgtgaagctcgtcacgcccgacggcgaggtggagctgcaggtgcccgacgacgtgtacatcctggaccaggccgaggaggaggggatcgaccttccctactcgtgccgcgccgggtcctgctcctcctgcgccggcaaggtcgtctccggctccgtcgaccagtccgaccagagcttcctcgacgacgaccaggtcgccagcggctgggtgctcacctgccacgcctaccccacctccgacgtcgtcatcgagacccacaaggaggaggagctcaccgcttaatatacaattaattaagctcgctccatcgtgcgtcgatatatatcatcatcatctatagctagtatatctgaatctgcctgccttgcaagagatgttgtaatcgatcgagttgacgaagccggccgccggagaaatttcttcctagctttaatttgtatcatccatcatgcatgtcgatcaagcaagctaagcatcggcagcagggccatctgttaccgtcgcagtacctgcgtgcttggtctctgtatcattcaccatttttactgcatgcggatgcatcatctacttctcatcaaagttattaattaataatgttttttcctctttatgtttctactgtcatcaatacatatatattacggaaattaatacatatatcc

SEQ ID NO: 15532 - protein, 145 aa, Panicum virgatum; identical to SEQ ID NO: 14772
  misc_feature: Ceres CLONE 1784055
  misc_feature (56)..(131): Pfam Name: Fer2 Pfam Description: 2Fe-2S iron-sulfur cluster binding domain

SEQ ID NO: 15533 - DNA, 1797 bp, Panicum virgatum
  misc_feature: Ceres CLONE 1784056
  misc_feature: Encodes the peptide sequence at SEQ ID NO. 15534
gatatccaaaaaagaaaagtttcctctttttataccacgatgaaacctactactctctgcaaacttccaaagctaaagcttcggcccatcgtctccacaaatggagctcacgctagcaatggcactgatgatggtcaccaccgtcgtcttcctcgtgctgatcggctccctcgtcaggccgcgccgcagacagcggaaggcgctgaacctcccgccgggccccaggggttggccggtgttcggcagcctgagcttgctagcaggcacgctcccgccacaccgcgtgctggccaagctcgcggcgcgctacggcccgctcatgcacctccggctcggctccttccacgtcgtggtcgcctcctccgcggaggcggcgcggctcgtcctcaagacccacgacctcgccttcgctgaccgccagccggcggcctggggcgcgatcatcgcctacaactacaagggcatcgtgcagacgccctacggcccctactggcgcatggcgcgcaagctatgcgccacggagctcttctccgcgcaactcgtcgacaagttcgagcccgtgcgcgcggaggagacgcgcgccctgacgcgcgccctgttcgagcgcgccggcgccgccgtgcaggtgaaggagctcctgatgggcttcacgatgcggaacatcctccgcatggcgctcggggagaagtggtcgggcttctacggcagcgccgagggcgaagggttccggcggtcgctcgaggaggccttcgcggtgagcggcgcggtgagcaacgtgggggagtgggtgccgtggcccgcctggctcgacgtccagggtctggcccggcggatgaggcgggtgcacgcggtgttcgaccggttcaacgagcagatcctcgacgagcaccaggaggatcgtcggcgcgccggcgccggcgggttcgtggcgagggacctggtggacgtgctgctgcgactagccgaggacgggcgggaggagccagcggagaccaggctcacgcgtgccggcgtcaaggccatcgtccaggacatcatttctggcggcacggagaccgcggcggtgacgatggagtgggccatggtggagctcctccaccgcccggacgcaatggcggccgccaccggcgagctcgaccgcgtggtgggccgcggccgctgggtcaccgagcgcgacctgccggacctgccctacatcgatgccgtcgtgaaggagacgatgcggctgcaccccgtgggccccctcctgatcccacaccaagcccgcgatgacacggtggtcggcggctacgacgtccccgccggcacgcgcgtgctggtgaacgcgtgggtcgtggggcgcgacccggcgtcgtggcccgacgctcccggcgcgttccggccggagcggttcctcgccggaggcagcgccgagggcgtggacgcgcgcggggcgcacttccagctgctgccgttcgggtccgggcggcggatgtgcccggcgcacaacctcgcgatgagggagatggcagccacgctggcgaacctggtgcaggggttcgcatggcagctgccggacggggtggcacccgaggacatgagcatggaggaatccttggggctgtcggtgagtcccaaggagccgctcgttgccatcgccgagccaaggctgccggcacacctctacaccggagtccactagctagctagattgtcatccgggttctatgtttaccattcatcaggtcttttgatacatgcatgtgtggtatgtcatgttaaacatcagctagcagtgttcttgagttgttcagcact

SEQ ID NO: 15534 - protein, 526 aa, Panicum virgatum
  misc_feature: Ceres CLONE 1784056
  misc_feature (38)..(512): Pfam Name: p450 Pfam Description: Cytochrome P450
  misc_feature: SWISSPROT Homolog: EC 1.14.13.21 Flavonoid 3'-monooxygenase
  misc_feature: Useful for making plants with altered carbohydrate content
MELTLAMALMMVTTVVFLVLIGSLVRPRRRQRKALNLPPGPRGWPVFGSLSLLAGTLPPHRVLAKLAARYGPLMHLRLGSFHVVVASSAEAARLVLKTHDLAFADRQPAAWGAIIAYNYKGIVQTPYGPYWRMARKLCATELFSAQLVDKFEPVRAEETRALTRALFERAGAAVQVKELLMGFTMRNILRMALGEKWSGFYGSAEGEGFRRSLEEAFAVSGAVSNVGEWVPWPAWLDVQGLARRMRRVHAVFDRFNEQILDEHQEDRRRAGAGGFVARDLVDVLLRLAEDGREEPAETRLTRAGVKAIVQDIISGGTETAAVTMEWAMVELLHRPDAMAAATGELDRVVGRGRWVTERDLPDLPYIDAVVKETMRLHPVGPLLIPHQARDDTVVGGYDVPAGTRVLVNAWVVGRDPASWPDAPGAFRPERFLAGGSAEGVDARGAHFQLLPFGSGRRMCPAHNLAMREMAATLANLVQGFAWQLPDGVAPEDMSMEESLGLSVSPKEPLVAIAEPRLPAHLYTGVH

SEQ ID NO: 15535 - DNA, 708 bp, Panicum virgatum
  misc_feature: Ceres CLONE 1784058-R
  misc_feature: Encodes the peptide sequence at SEQ ID NO. 15536
ccatgtacaaccccgtgcggcggttcggcaaggtgcgctacgacacgctgcggctgccgcacaaggtcgtggcgcgggaggccgacggctccgtcaagttcggccagggcgagggctccgcctacctcttcgacccggacatctacaccgacggtaggatctcggtgcagggcattgacgccgtgctcttcccgccgggtgacaagaacgcgacgcagacggccgaccctcacaggaagcctcccgccatcaccacccacaagaagatcaagctccggcgaggcaagttgttagaagcatcgtgccaaatggctgccctcttcggtcagcgatcgcgattcgcaagctgccaagattgatctccatgataccgaaagacgaacgaactgaaacaaccaagtgatggccgatgggggctgtgctggagggagccgtccacattattatttgttttcttttttttgtttattgataagaataatgaatcaggtggggatgtaaactcggtggttgttggtgtgtccagagaaagagggggaaaaaagaaaaggcaagaaaaaaaattgtccatacatgaaggaagaccaggatcgtcgtctgtgtataggaagaattaaacgttttgttttctgtttttcgtcattctttgcttctgttcccgttttgacaatgagaatctcgggtaaacacacatcattcttatgattc

SEQ ID NO: 15536 - protein, 118 aa, Panicum virgatum
  misc_feature: Ceres CLONE 1784058-R
  misc_feature: Useful for making plants with altered carbohydrate content
  misc_feature: Useful for making plants with altered cell wall content and/or composition
MYNPVRRFGKVRYDTLRLPHKVVAREADGSVKFGQGEGSAYLFDPDIYTDGRISVQGIDAVLFPPGDKNATQTADPHRKPPAITTHKKIKLRRGKLLEASCQMAALFGQRSRFASCQD

SEQ ID NO: 15537 - DNA, 141 bp, Panicum virgatum
  misc_feature: Ceres CLONE 1784058
ggcgacgcggcagatgtcacttctgtcgtgatggatgaggaaggaggggagcgagaactaggcggcatacgtgctcgtcgaagtgatgatgactgctgcaagggccgagcaggagtgggataacttgcttctgggggagta

SEQ ID NO: 15538 - DNA, 646 bp, Panicum virgatum
  misc_feature: Ceres CLONE 1784063
  misc_feature: Encodes the peptide sequence at SEQ ID NO. 15539
atctacggcctctgctcgtgctccaaggccaatcgccgactctcaactcgcgttgtacgatccgcgtcgagtcatcgacggcgcgcgggatccgctgcgctcgggtgcgcgatggtggatcggttttggcagcaatttggcgatggtgtgcgatggcccccgcacccgcagcggtgccgctgctgcatctgcccgcggggtcgcacgagagctcaacccggcccggaacgcgatagcgactgagctcgcgagggcccctgttgcggcgccgcgcctaccaccgctcgccgccttcgctggtttgctctatttcgggctttgattttgtgttgtttggggatttccaggtggaggcgtccatgaacctaatggccagaaacaagatgcgcctctacgatctgccctccaagctgccctgtcgtgtgctcaacgtcgagctcaaggttcctcttcctattgcagagaggtgctggtgagctcttcccgcaaccactgactagacgttatgtcaggggaacaattgaacgaatgcaacacctctttttttcaatcaagtgtcatttttattttgtcaagtgtaaactgataatggcatttgtttgttagactctcttccttttcaagtgtcaactgaaagtttatttgc

SEQ ID NO: 15539 - protein, 38 aa, Panicum virgatum
  misc_feature: Ceres CLONE 1784063
  misc_feature: The sequence is a functional homolog of SEQ ID NO 108 in the 10/225,066 US patent application
  misc_feature: The sequence is a functional homolog of SEQ ID NO 296 in the 10/412,699 US patent application
  misc_feature: The sequence is a functional homolog of SEQ ID NO 692 in the 11/479,226 US patent application
  misc_feature: The sequence is a functional homolog of SEQ ID NO 84 in the 10/374,780 US patent application
  misc_feature: Useful for making plants with modulated seed size
  misc_feature: Useful for making plants with modulated biomass
MNLMARNKMRLYDLPSKLPCRVLNVELKVPLPIAERCW

SEQ ID NO: 15540 - DNA, 711 bp, Panicum virgatum
  misc_feature: Ceres CLONE 1784098
  misc_feature: Encodes the peptide sequence at SEQ ID NO. 15541
aagatcaaaggacagccagttcacgttggtggacttccaatcgccgccgcccccgccgattgtagcgcctgctctcgtcggagaatggctgacggctccacgatcattgttgctgctgctcctcccggtctccatcttgctcgcacgctactcgttcgctgccaagagggcgaggaagatgaggcagcagcaagacgaccagctaccgccatcgcctccggctctgcccatcctcgggcacctccacctcgtgggctcactcccgcacgtctccctccgtagcctcgccaggaagcacggccacgacctcatgctgctccgcctcggcgccatgccggtcgtcgtcgtgtcgtcgccgcccgccgcgtaggcggtgctgcgcacgcatgacgacgtgttcgcgtcccggccgcactctatggtagccgagatcctcctctacggcccgtccgacatcggcttcgctccgcatggggagtactggcggcaggcgaggaagctcgtcaccacgcacctgatcaccgtcaagaaggtgcagttgctacgccacgcccgcgaggaagaagtaagagataccttcgaaaagttgggaactcttattagttgacgctgtggatatctcaccagtgcatgggtaggtgagcacggtgatggccaagatcggcgaggcggccggcgccggcgccgcggtggacttgggcgatctgctcg

SEQ ID NO: 15541 - protein, 122 aa, Panicum virgatum
  misc_feature: Ceres CLONE 1784098
  misc_feature: SWISSPROT Homolog: EC 1.14.13.68 4-hydroxyphenylacetaldehyde oxime monooxygenase
RSKDSQFTLVDFQSPPPPPIVAPALVGEWLTAPRSLLLLLLPVSILLARYSFAAKRARKMRQQQDDQLPPSPPALPILGHLHLVGSLPHVSLRSLARKHGHDLMLLRLGAMPVVVVSSPPAA

SEQ ID NO: 15542 - DNA, 630 bp, Panicum virgatum
  misc_feature: Ceres CLONE 1784098-R
  misc_feature: Encodes the peptide sequence at SEQ ID NO. 15543
gaaccgcatggcctacctgagagccgtcataaaggagtcgctccggctgcgcaacgtgacgccgctccttgcgccgcacttctccatggcaagctgcagcgtcgacggtgtggtggtccccgccggggtgcgcgttctgatcaacgtctgggccatcgccagggacccgcgcttctgggaggacgcggaggagttcgtccccgagaggttcctcgacgggggcagcgcggcagacgtcggcttcaaggggaacaacttccagttcctgccgttcagcgccgggcgcaggcagtgccccgggatgaacttcgggatggccgccatcgaggtcatgctggcgaacctcgtgcaccgcttcgaatgggagatgctggcggggaaggaggcgcgcgacattgacatgtccgaggagttcgggctcgtgatgcaccggaaggagaagctcctcttggttcccaaactacttgtgtagctccataagttcatatgctgcatatttgtatgaagaatgccggattgctgatacaacatgatgattatttatttgtgtcgatgtaatcttagtgttggattcgaaccagcgaagtccaagcaggatcaaaggtctagttcacggagtgtagaaaaagt

SEQ ID NO: 15543 - protein, 156 aa, Panicum virgatum
  misc_feature: Ceres CLONE 1784098-R
  misc_feature: SWISSPROT Homolog: EC 1.14.13.21 Flavonoid 3'-monooxygenase
NRMAYLRAVIKESLRLRNVTPLLAPHFSMASCSVDGVVVPAGVRVLINVWAIARDPRFWEDAEEFVPERFLDGGSAADVGFKGNNFQFLPFSAGRRQCPGMNFGMAAIEVMLANLVHRFEWEMLAGKEARDIDMSEEFGLVMHRKEKLLLVPKLLV

SEQ ID NO: 15544 - DNA, 562 bp, Panicum virgatum
  misc_feature: Ceres CLONE 1784104-R
  misc_feature: Encodes the peptide sequence at SEQ ID NO. 15545
ttgggaggagatcggtgtgttcgtcgccgaggaggatgtcccaaagctggacagcatcctgacgtccattcccacagatgttatactgaggaagcagagactcctcgccaacccgtccatgaagcaggccatgctgttcccccagcctgctcagccgggagatgcattccaccagatcctgaacgggctggcgcgcaagctcccgcacggtgacaacgtcttcctcaagcccggggagagggtcctgaactggaccgccggaccaccgggcgacctgaagccttggtagcatctggcatactattactagaactttttggaaagaggagattggggacacatgatgatatacgtgcgcctttgaattaccatggctgcatagtgctgaccacaagccaaatgtacatttttgtatgatcgttacgtatagctgttatactatatatcttaatttcttttttctttttccctcttttattaggtgatgagaatgtcagccttgtcaatcatatgtggatagcataatcgaaatttactcatgctgaatgcttgatctcatttt

SEQ ID NO: 15545 - protein, 95 aa, Panicum virgatum
  misc_feature: Ceres CLONE 1784104-R
  misc_feature: Useful for making plants with altered carbohydrate content
  misc_feature: Useful for making plants with altered cell wall content and/or composition
WEEIGVFVAEEDVPKLDSILTSIPTDVILRKQRLLANPSMKQAMLFPQPAQPGDAFHQILNGLARKLPHGDNVFLKPGERVLNWTAGPPGDLKPW

SEQ ID NO: 15546 - DNA, 120 bp, Panicum virgatum
  misc_feature: Ceres CLONE 1784104
agttctccaacaccagcgtcgccagctgggacggcgcgaccgggttcgtgtgcaccacgaccctgccgttcggcctgaacaccgaggaggtgagcgagcacgggaaggacttcaaactgt

SEQ ID NO: 15547 - DNA, 596 bp, Panicum virgatum
  misc_feature: Ceres CLONE 1784111-R
  misc_feature: Encodes the peptide sequence at SEQ ID NO. 15548
gaaccaccagttatttcatcaagctatttctagacaagaaatatgcattgccatatcgggcgcttgatgcagtgcttgctcatttcatgcggtttcttgatgatgagagagtcatgcctgttatatggcatcaatcactgcttgcctttgtggaaagatacaagaatgaattggagaaaaaggataaggagaaacttgtacgcttgttggatcaccagaagcattatttggttactccagaaattcgaagggaacttcggggcagctgcaacaggggtgaaaaagataataatatgcagacttcctcacctatctccgtcatcacgaaacctattgaggaagacaagtgggacgtaccacaagtgccaatggaggaggattagtctgttcgaatatttcttcaccgctgagtgtcattccccattgtcaatttttgcgcaactttattgagtaacgttttatatagagaagtgctgtaatgaatatttacatgtttgaaatgaacctgccatgtaagatgtcctaacctctatatgttgttgtggggccgacctgaaacgcacatgaagttagctgtcaccattcatttatttttg

SEQ ID NO: 15548 - protein, 126 aa, Panicum virgatum
  misc_feature: Ceres CLONE 1784111-R
  misc_feature (1)..(101): Pfam Name: Bystin Pfam Description: Bystin
TTSYFIKLFLDKKYALPYRALDAVLAHFMRFLDDERVMPVIWHQSLLAFVERYKNELEKKDKEKLVRLLDHQKHYLVTPEIRRELRGSCNRGEKDNNMQTSSPISVITKPIEEDKWDVPQVPMEED

SEQ ID NO: 15549 - DNA, 733 bp, Panicum virgatum
  misc_feature: Ceres CLONE 1784111
aacgacgcccgattccactactagggttttaactctcccgccaccgccgccgccgccgccgccaatccagcggagccccgagtccacgaagctatggcggggaagaagcgcaagtccggctccgagaagcagccgaagcatcgcctcccgctcggcgcggatgccgacgcggtcgccgccgcttctaagcgccgccgctcgggcgccgccaagcagcaccaggcggatgaggaggcgtccatcccgtcctccctcagcgccaagatcctccgcgagacgcgcaagcagcagcaggaggagatgctcgctgactccggcgacgaggagcccccagccgccgcaagggcagccgcggggccgtccacgtcgtcctcgttcccagtccccgccgcggatgacgaggaggaggacgacgtcgacgagttcgacgggtttgacgcgctgagcgagtacgacggcggcgagggggagatcaacgaggaggacgagaaggcccttgctgccttcatgtcaaacgacaaagctgccgagcgcacacttggtgatatcattctgcagaagatcagagagaaggatgccgaggtctcagctgaaggacggcctcgtgtaaaattggacaacaacatcattgagctttataaagaggttgggaagttcttaagccgatacacaagtgggaagattccaaaagcattcaagcgcataccatcattggagtgctgggcagaggtgc

SEQ ID NO: 15550 - DNA, 279 bp, Panicum virgatum
  misc_feature: Ceres CLONE 1784119
  misc_feature: Encodes the peptide sequence at SEQ ID NO. 15551
atatccccccctcgcgtcccgagactatgcacatatctcaccacctaaaaaaaatcccaaaaccctgggcttcggatctctccgatctgcgatggcgaacccgccacgtgttcttcggcctgaccgcccgacgcgccccggccggccgcctcctcatggagctgttctccaacgacgtcccccgcaccgcctacaacttccacgccctctgggctggctagaagggggtgagcaagacgggcaagccgctccactaccatggatccaccttccaccgcg

SEQ ID NO: 15551 - protein, 64 aa, Panicum virgatum
  misc_feature: Ceres CLONE 1784119
  misc_feature: SWISSPROT Homolog: EC 5.2.1.8 Peptidylprolyl isomerase
MHISHHLKKIPKPWASDLSDLRWRTRHVFFGLTARRAPAGRLLMELFSNDVPRTAYNFHALWAG

SEQ ID NO: 15552 - DNA, 688 bp, Panicum virgatum
  misc_feature: Ceres CLONE 1784126-R
  misc_feature: Encodes the peptide sequence at SEQ ID NO. 15553
tgatcccgagtactacaccgaccactgtcatcaaaggcatcgtcttggtactactctctgcccggaccgacacgtctgcgcttactaccgaatgggcaatggcgctgctgctgacacacccggaagcgatgcggaaggtgagggctgagatagacaccaaggttggcaccgcacggatggtggaggagtcggacatcacaaaccttccgtatttgcaatgcgtggtgaaggagaccctccggctatgccccgtcgcaccgatcattccggcacatgaggccatggaggactgcaccgtcggtgggttcaacgttcgccgcggcacaatgatcctcgtgaacgcttgggcgatccaccgggatcccaatctctgggacgcagccggggagttcaggcctgagaggttcttgcacgccggtatggtgaccgcggtcaccgcacccatgctgccatttgggcttggacggaggcggtgccccggcgatgggttggcgatgcgtctagttagcttgacactggcagcgctcgtgcagtgctttgagtgggatgtcggtaaaggttgtgtgattgacatgtctgaaggtggtgggctgtccatgccaatggcgacgccattgtcagctgtctgccagccccggaagtttgtcgagcgcatgctctgtgcttcagcataaacatggtcagatgg

SEQ ID NO: 15553 - protein, 223 aa, Panicum virgatum
  misc_feature: Ceres CLONE 1784126-R
  misc_feature (1)..(208): Pfam Name: p450 Pfam Description: Cytochrome P450
  misc_feature: SWISSPROT Homolog: EC 1.14.13.89 Isoflavone 2'-hydroxylase
  misc_feature: Useful for making plants with modulated nitrogen use efficiency
IPSTTPTTVIKGIVLVLLSARTDTSALTTEWAMALLLTHPEAMRKVRAEIDTKVGTARMVEESDITNLPYLQCVVKETLRLCPVAPIIPAHEAMEDCTVGGFNVRRGTMILVNAWAIHRDPNLWDAAGEFRPERFLHAGMVTAVTAPMLPFGLGRRRCPGDGLAMRLVSLTLAALVQCFEWDVGKGCVIDMSEGGGLSMPMATPLSAVCQPRKFVERMLCASA

SEQ ID NO: 15554 - DNA, 205 bp, Panicum virgatum
  misc_feature: Ceres CLONE 1784126
accgaggttgtcttcggcccccgcccccggctccatgggcgtggaatacgtgtaggacgacaacctcggctccatgtctatcgaggatctcgtcaggccctagcgcgtcctgggcgacgagatcctattcgtacaggcccacctctagcgccctccgccggatctggagtgtgcctaccagaactttgctgagaatcatgagcat

SEQ ID NO: 15555 - DNA, 2244 bp, Panicum virgatum
  misc_feature: Ceres CLONE 1784136
  misc_feature: Encodes the peptide sequence at SEQ ID NO. 15556
gtggagctcccactcccgcccgcgctcccggctgcagccccctcgcctcctcctgcgtgccaacgatggtggcaacgagcttcgaccccctctcctccgacggaggcacgcgcgccggagactcgcgcacgcagcggggcctgcgcggctgcgctgctgcaggcggggaggggccacggtgacaggccgccggggacccgtgcgccatcgtcgtcgttctgttcgcaagggtggagggtgtcgcgagtgggagagaatggaaaacaagcgaatcggtacccataatcattggtagtggccaatttcgcgaacttaccgatcccaccgccagtcgcagcacatcctggcctgcttcgagctgctgcgagatttcaactagcgaaaaaaaaggttttggacggaatccgagatgggtgtaattagcacagtgcttggtttctctggatttggctttgggttttcagctggtattgttattgggtacttcctcttcatctacgtccagccaaatgatgtcaaggatgtcaaagttcgtccgcttgtggaatatgattcaaaatctttggaatccatccttcccgaaattcctttgtgggtcaagaatcctgactatgatagaattgattggctgaacaggtttttggagttgatgtggccctatcttaacaaggctatctgcaaaactgcacaggaaatcgctaagccaattattgccgagaatactgcaaaatataagatagactcggttgagttcgaaactcttactttgggtagcttaccgccaacctttcaagggatgaaagtatacgtcacagaggagcaagagctgataatggaaccatgtcttaaatgggctgcaaatccaaatgtcactgttgctgtaaaagcttatggtttgaaagcaactatccagattgtggatctacaagtctttgctttacctcgtattactctgaagccattggtgcctacatttccttgctttgctaaaatccttgtctctctcatggagaagccacatgttgactttgggctaaaacttcttggagcagatgtaatggctattcctggtctttacagatttgttcaggagaccatcaagaagcaagtagcgagcatgtatttgtggccgaagacattagaagtacctataatggatccctcaaaagcatcgaaaaaacctgttggaattctacttgtgaaggttgtaagagcccagaatctgcggaagaaggatctgctgggtaaatcagacccatatgtgaaacttaagatgtcagatgacaagcttccatccaaaaaaacaactgtaaagcgcagcaatcttaatccggagtggaatgaagatttcaaatttgttgtgacagatccagaaactcaggctcttgaagttaatgtctttgactgggaacaggttggaaaacatgaaaagatgggaatgaatagtgtcctattaaaagacctcccagcagatgagactaaagttactaccctcgacttgcttaagaccatggatccaaatgatgtacaaaatgagaagtctcgtggccagcttactctagagcttacatacaagcctttcaaggaagaagatatggagaaagaaggcacagagggtgccgatgtggtagagaaagctccagatggtactccagctggtggtggtctgcttcatgttattgttcatgaagctcaagatcttgaggggaagcaccatacaaacccatatgcgaaaataattttcaaaggcgaggagaagaaaacaaaggtcatcaagaagaatagggatccacgatgggaggatgaattcgagtttgtgtgtgaggaaccacctgtaaatgataagctacatgttgaagtcctaagtaaagccccgaagaaagggctgatacatggcaaggaaactttgggctacattgatatcagccttgcagacgtgatcagcaacaagcggattaatgagaagtaccatctcatagactcaaaaaatggccagatacagattgagatgcaatggagaacttcctagacagcagaaagaacttgaatgcctgaatgtagtacaggaatgagatatggatgtcgatgttcctattactcagtttgcggaattctgtaattgagctctagtcgatatttgctccgtttctagacatctgttgttgagatttttttttttctttggtcttatggaacttattctgtgagtaatacagatcatacaagtatactcagcattctgtc

SEQ ID NO: 15556 - protein, 539 aa, Panicum virgatum
  misc_feature: Ceres CLONE 1784136
  misc_feature (262)..(346): Pfam Name: C2 Pfam Description: C2 domain
  misc_feature (421)..(504): Pfam Name: C2 Pfam Description: C2 domain
  misc_feature: SWISSPROT Homolog: EC 2.7.11.13 Protein kinase C
MGVISTVLGFSGFGFGFSAGIVIGYFLFIYVQPNDVKDVKVRPLVEYDSKSLESILPEIPLWVKNPDYDRIDWLNRFLELMWPYLNKAICKTAQEIAKPIIAENTAKYKIDSVEFETLTLGSLPPTFQGMKVYVTEEQELIMEPCLKWAANPNVTVAVKAYGLKATIQIVDLQVFALPRITLKPLVPTFPCFAKILVSLMEKPHVDFGLKLLGADVMAIPGLYRFVQETIKKQVASMYLWPKTLEVPIMDPSKASKKPVGILLVKVVRAQNLRKKDLLGKSDPYVKLKMSDDKLPSKKTTVKRSNLNPEWNEDFKFVVTDPETQALEVNVFDWEQVGKHEKMGMNSVLLKDLPADETKVTTLDLLKTMDPNDVQNEKSRGQLTLELTYKPFKEEDMEKEGTEGADVVEKAPDGTPAGGGLLHVIVHEAQDLEGKHHTNPYAKIIFKGEEKKTKVIKKNRDPRWEDEFEFVCEEPPVNDKLHVEVLSKAPKKGLIHGKETLGYIDISLADVISNKRINEKYHLIDSKNGQIQIEMQWRTS

SEQ ID NO: 15557 - DNA, 659 bp, Panicum virgatum
  misc_feature: Ceres CLONE 1784140
  misc_feature: Encodes the peptide sequence at SEQ ID NO. 15558
attccacgcgttcttagcttcgctccccgtcgcgctgttcaacgttcaaagccttccaccttcccctccttccctggtcttgcagtctccattgaccaccccctacaaccttccactccgttaaatctggcctcaccccgcgacccgcggcgccctccctcaacatccactcctcgtagctccaggcttaccgcatcaacagacagccgggagatctccagagaaggcatcttggaatccaaaaaaccaaaaaacgcaatcaaacacagctaagattcgaattgagagagacgagctgtccggataaaatccaacaattctctcggacgaagagtgcgtggaggcgtcacgaggaccaaacgacgacagcccggggggattaatgagggagcaagatggtgaggctgccgtacacaacggcgctgaccacgctgtttagctactggctgctcttcgtgttcagccggctcagggatttattccgcaagctgatcaactggttcaaggccaacaacgtcaaggggtactcatcgatctggctgaacctggaggatttctatgtgcgccgcctgtaccttcggatccagaattgcattagtaggccgattgcaagcacaacaaatacatggtttgatgctggtcagtgaaccacaaatgac

SEQ ID NO: 15558 - protein, 83 aa, Panicum virgatum
  misc_feature: Ceres CLONE 1784140
  misc_feature: SWISSPROT Homolog: EC 2.3.1.50 Serine C-palmitoyltransferase
MVRLPYTTALTTLFSYWLLFVFSRLRDLFRKLINWFKANNVKGYSSIWLNLEDFYVRRLYLRIQNCISRPIASTTNTWFDAGQ

SEQ ID NO: 15559 - DNA, 565 bp, Panicum virgatum
  misc_feature: Ceres CLONE 1784143
  misc_feature: Encodes the peptide sequence at SEQ ID NO. 15560
agtcaccacagtctctccgcgcgccgcgtgagccgccaacgatggccctggagacgtgcttcgaagcgtgggcgactgcaccccgccccctccggcggagaggaggcgctccccgccggccccagcttcgcgccggccaagctggccgccggcgccccgttgtccgcctgccgcggcgccgcgcggcggccgctgcacgtctgccagtccgagaacgccgtccaccaggtgctgggggcgtacgagaacaactgggacgggatggtgatggcgggcgagacgccggtgctggggaagttgagggcgccgtggagccggccgtgcctgatgatctcggcggcgagttgcgagctgggcaaggactacgccggccagatcaagtgctgggaggagaacacggacgactgcatcaacgtgtgctccgcctacagcatccacagcatccccaccgtgctcatcttcaacgtcggcgagaacaacgagagggtcatctgcgacgtgcccaagaccaaggtcaccaccatcgtcgacatgtacatcagcagctcgtgaaccagactactat

SEQ ID NO: 15560 - protein, 183 aa, Panicum virgatum
  misc_feature: Ceres CLONE 1784143
  misc_feature (76)..(179): Pfam Name: Thioredoxin Pfam Description: Thioredoxin
  misc_feature: SWISSPROT Homolog: EC 1.8.1.8 Protein-disulfide reductase
SHHSLSARRVSRQRWPWRRASKRGRLHPAPSGGEEALPAGPSFAPAKLAAGAPLSACRGAARRPLHVCQSENAVHQVLGAYENNWDGMVMAGETPVLGKLRAPWSRPCLMISAASCELGKDYAGQIKCWEENTDDCINVCSAYSIHSIPTVLIFNVGENNERVICDVPKTKVTTIVDMYISSS

SEQ ID NO: 15561 - DNA, 561 bp, Panicum virgatum
  misc_feature: Ceres CLONE 1784144
  misc_feature: Encodes the peptide sequence at SEQ ID NO. 15562
acctcctaccttgacaaggtcgctcatacagcggcgcctcccccctttgctcctctcttctttctccgttcgccgcatcccgcgctaccctatggccccgactgggcggctcctcgcggtagccgccctctccatcctctgtttgcccggggctggagctcgattctagcgctggatttgctcacaccctcctggcccctcaccagatcattcacgacgaggaaaaggaccgcggcctcttgctcgacctccccttcaccttcctcatgcccttgcaggacctctcccccttctcctcccccaagctatttgttcactacctggcgcctgctcggctcgcccccttcttcagcaacaccacgcctaagatctcaagtaaatgggcattgaacttctccgttgtccatgacctgatgaccaccaaagctgtcctctgcttctgctctgttgcacctttcttggacaatgatatttgctgcccccatcttgacgtgacactgaccatccacgttgttgatgctaccaagcttacagactctctcgtgatgaatcccaccgtcg

SEQ ID NO: 15562 - protein, 98 aa, Panicum virgatum
  misc_feature: Ceres CLONE 1784144
  misc_feature: Useful for making plants with altered carbohydrate content
MPLQDLSPFSSPKLFVHYLAPARLAPFFSNTTPKISSKWALNFSVVHDLMTTKAVLCFCSVAPFLDNDICCPHLDVTLTIHVVDATKLTDSLVMNPTV

SEQ ID NO: 15563 - DNA, 1152 bp, Panicum virgatum
  misc_feature: Ceres CLONE 1784166
  misc_feature: Encodes the peptide sequence at SEQ ID NO. 15564
gagctttccgccttcgttctccgcagtgtcagatcggccgtcgcgcgccgagcccgagccctagcgccgccgctcgccccgcctcccagtcctgacctctgaggaacagcgagggccttgcggttgcggatcggggatcgcgccgcggcggcgggacgacccgatgggcgaggaagccaagtacctggagacggcgcgggccgaccgctctgtgtggctcatgaagtgccccccggtcgtctcccgcgcctggcaggccgcctccgcctcgtcctcctccgacgccgccaaccccaaccccgtcgtcgccaaggtcgtcctctccctcgacctgcccagcggcgaagagcagcaagagccttccctccagttcaagatggagttggctcaaactaacactggcaatacacctaaaagctactctttgaacatgttccaagatttcgtgcccatgtgtgttttctcggaatctaaccaagggaaactttcatgtgaaggaaaagttgagcataaatttgacatggaaccacacagtgataatttggtgaactatggaaagttatgccgtgaaagaacacagaaatatatggttaaatccagacaagtgcaggtacttgacaatgaccacggcatgagcatgagaccaatgcccggcatggtcggtctaataccttctggttcaaaggagaagaagaagcaaacaccagccaaaccatctgatgtcaaaagaactcgtagggatcgcacggaaatggaaaatattatattcaagctttttgaaaggcagcctaattgggcactaaaggcgctagtgcaagaaactgaccagccggagcaattcctgaaggagatactgaatgatctctgtgtatacaacaaacgaggaccgaaccaggggacgcacgagctcaagcctgaatacaagaaatccacaggcgatactgatgctgcttgaagatgcaagtccatttatctgtagttttatgagtgagagatactgacaacctgttggcctgacatgcgaaaacattagctctctgttggtagctcaggcttcatgtttgtaaacatgagatgattcagtttcctttgcatgctttgagaggcatggtttgtaaggatatgtataagctggatacacattgtttacag

SEQ ID NO: 15564 - protein, 263 aa, Panicum virgatum
  misc_feature: Ceres CLONE 1784166
  misc_feature (5)..(263): Pfam Name: TFIIF_beta Pfam Description: Transcription initiation factor IIF, beta subunit
  misc_feature: Useful for making plants with altered lignin content
MGEEAKYLETARADRSVWLMKCPPVVSRAWQAASASSSSDAANPNPVVAKVVLSLDLPSGEEQQEPSLQFKMELAQTNTGNTPKSYSLNMFQDFVPMCVFSESNQGKLSCEGKVEHKFDMEPHSDNLVNYGKLCRERTQKYMVKSRQVQVLDNDHGMSMRPMPGMVGLIPSGSKEKKKQTPAKPSDVKRTRRDRTEMENIIFKLFERQPNWALKALVQETDQPEQFLKEILNDLCVYNKRGPNQGTHELKPEYKKSTGDTDAA

SEQ ID NO: 15565 - DNA, 736 bp, Panicum virgatum
  misc_feature: Ceres CLONE 1784167
  misc_feature: Encodes the peptide sequence at SEQ ID NO. 15566
aaaacccttgctccagtcctcgtcccgccgccgccgccgccgccgccccctgcactagcaccagccgccgcctagcagcagccgtcgccggagaagaaggggagggagccatgggtcgcgtccgcaccaagaccgtgaagaagacctccaggcaggtgatcgagaagtactactcccgcatgaccctcgacttccacaccaacaagaaggtgctggaggaggtctcgatcctgccctcgaagcgcctccgcaacaaggtggccggcttcaccacccacctgatgcgccgcatccagcgcggccccgtccgcggcatctcgctcaagctccaggaggaggagcgcgagcgccgcatggacttcgtcccggagaagtcggcgctcgaggtggaggagatccgcgtcgacaaggagaccatggagatgctcgcgtccctcggcatggccgatctccccggcgtcgagcgccaggctgaggtgtccagcgcccccacctacggccgcccgcagtacggtggcccccgccgcgaccgcgtctaggcttctagtcggttgcagtggttggatcttgatcgcttcacttatagtcgttattatgctactatgtcaaacttgttttaggtcattggttgctttgtggcgattaagtcttgaacctatctgttttgctctgaattctgcactgttttgatctgcgtgtgatggacaagatctatattctagcgccaatgaaatct

SEQ ID NO: 15566 - protein, 142 aa, Panicum virgatum; identical to SEQ ID NO: 10208
  misc_feature: Ceres CLONE 1784167
  misc_feature (1)..(122): Pfam Name: Ribosomal_S17e Pfam Description: Ribosomal S17

SEQ ID NO: 15567 - DNA, 1768 bp, Panicum virgatum
  misc_feature: Ceres CLONE 1784194
  misc_feature: Encodes the peptide sequence at SEQ ID NO. 15568
ccctcctaccttggcgagctcgcgcagacagcggcgccgccccccttccctcctctcttctccgtccgttcgccgccgcccgcggcaccctatggccccgactgggcggctcctcgcggtagccgccctctccatcctctgtttgcaggggctggtgcgcgattcaggcgctgcatttgctcagacccacctgccgcctcaccggatcgttcacgcaggggaaaatgacggcggcctcatgccggagctcccgcccagcggcctcatgcccatgccggagctctcccccagcggttccccgaagccatttgttcccttcctggcgcctgctccgctcgcgcccttcttcaacaacagcacgccaaagctctcagggaaatgcacattgaacttcaccgctgtcgataacctgatgaccaccacagctgtcgactgcttcacctcgtttgcacctttcttggccaatgttatttgctgcccccagcttcaggcaacactgaccatcctcattgggcagtctagcaagcagacagggtctctcgcgttggatcccaccgtcgccaactattgcctgtcagatgtccaggagctgctgctgagccagggtgccagcgataatctccacagcccttactcggtccacctctcgaatgtcaccgagggatcatgccctgtcagcaccgtggattcgtttgagagtgttattgactcatccaagctccttgaggcctgtcagaagatcgaccctgttaacgaatgctgcagccagacatgtcagaatgctataaacgaggctgcccagaaaatctcatccaaggatggaggcttgacgagctactctgggagccccaaaattgatagttgcaggaacgttgttctcagatggttgtcgagcaggcttgatccaccgtctgcaaagcaaatgctgaggcagatatctaactgcaatgtcaatggagtttgccccctaagctttcctgacacaagtaaggtggcaaaagagtgtggtggaacaatcaagaacagcactacatgttgcaaggttatgttaagctatgtagctcatttgcaaaagcaaagcttcataacaaacttgcaagctttaaattgtgcttcgtttcttggtgcaaagttgcaaaagatgaacgtcagcacgaatgtatatagctcttgtcaaataacactaaaggatttttcacttcaagttggatctcaagaatctggatgcctccttccaagtatgccttcggatgcatcctttgaccacatttctgggattagtttcacatgtgatctaaatgataacattgcggccccatggccatcgtccatgcaagcaccatcctcatcatgcaataaatctgtcaatattccagagcgacctgctgcgacatcggcacagaatggtgtgaaccacaagaatctgaggctaaggcagcttgtttctttggcctcccttcttctggtgctcttggtacaaggttagcgtggtccagtttggcagatggaaattattgagatccattcaggagagctaactagaggtgtcagtgaagtttttgcttgcatcaaagtgctgtaggtttcacatgtgttttctgtttttgtaatctcctggtagctatatattagtgtaatttgttgcaaggcatatatatatatatatatatatatatatatatatatatatatatatatatatatatatatatatatatatatatatatatatatatatatatatatatatatatatatatatatatat

SEQ ID NO: 15568 - protein, 464 aa, Panicum virgatum
  misc_feature: Ceres CLONE 1784194
  misc_feature: Useful for making plants with altered carbohydrate content
MAPTGRLLAVAALSILCLQGLVRDSGAAFAQTHLPPHRIVHAGENDGGLMPELPPSGLMPMPELSPSGSPKPFVPFLAPAPLAPFFNNSTPKLSGKCTLNFTAVDNLMTTTAVDCFTSFAPFLANVICCPQLQATLTILIGQSSKQTGSLALDPTVANYCLSDVQELLLSQGASDNLHSPYSVHLSNVTEGSCPVSTVDSFESVIDSSKLLEACQKIDPVNECCSQTCQNAINEAAQKISSKDGGLTSYSGSPKIDSCRNVVLRWLSSRLDPPSAKQMLRQISNCNVNGVCPLSFPDTSKVAKECGGTIKNSTTCCKVMLSYVAHLQKQSFITNLQALNCASFLGAKLQKMNVSTNVYSSCQITLKDFSLQVGSQESGCLLPSMPSDASFDHISGISFTCDLNDNIAAPWPSSMQAPSSSCNKSVNIPERPAATSAQNGVNHKNLRLRQLVSLASLLLVLLVQG

SEQ ID NO: 15569 - DNA, 583 bp, Panicum virgatum
  misc_feature: Ceres CLONE 1784194-R
ctctctttctctctctctctctctcacacacaccgcgcgcgcgcgcgcgcgcgcgcgcgcgcgcgcgcgcgcgcgcgcgcgcgcgcgcgcgcgcgcgcgctctctctcttttttttttttttttttttctctctctctctctctctctctctctctctctctctctctctctctctctctatatatatatatatatatatatatatacacacacacacacacacacccacacacccccccccccccccccccccccccccctctccctctctctctctctctcacacacacacacacacacatacatatatatatatatatatatatatatatatatatatatatatatatatatatatatatatatatatatatatatatatatatatataatataatggtagcaataatttgtattcattttgtatagcgagaaagtggggtggtgagatgccaaatgcgcatggtgatttggctggagttagggaacggatgtcagcattggttaacactcatattgttgaattgatatttttggtgcctcaggaagtctgatactgatagatggatcatgtttcatgtc

SEQ ID NO: 15570 - DNA, 795 bp, Panicum virgatum
  misc_feature: Ceres CLONE 1784201
  misc_feature: Encodes the peptide sequence at SEQ ID NO. 15571
aagggagaggggaaaagtgcagggaagaagcgaagggaaagatggcggctcggcgtgggcgggagtgggacggggacgagctgggcggtccgccgcagacaccgctcgccgcacccgtcgtctgcctcctgcgctccgctggggacctcgccgccggtgccttcgtcggctcgctcgtcggatacggcaaaggtttgatcacaaaccaaggtatgaaggcttcacttagcaatgctggatcatctgccaagacttttgcagctcttgctggtgtccaaagtttcataatgtgcttattgagaagactgcgtgggaaagatgacatgatcaatgctggtatggctggttgttgcacaggccttgctttgagttttccaggtgcaccacaagcaatgctccacagctgcgtcaccttcgcagcattctcatgcataatggatgggctcaacaagcagcaggccgccatggcactcacacatgacgggaaatcctcatttgccaagagtcaggaggctggtgttctcccaccttttacacttcctccacttctggatgctttggacgctttagcttcatcgtgccagacccatgttaagcctaaacactagactttgttgaagtctgattccccaaagagagcgatccataggttctccatatgtgcttatttagtattctgaatttgtgaccagtgatgtagatccatttcggtgctgaactcgggtcagatttggtaattgtagtgccatagcgtgtatgcccaatttttatatctagtatccatgatgcagtttg

SEQ ID NO: 15571 - protein, 188 aa, Panicum virgatum
  misc_feature: Ceres CLONE 1784201
  misc_feature (21)..(139): Pfam Name: Tim17 Pfam Description: Tim17/Tim22/Tim23 family
  misc_feature: Useful for making plants with modulated salt sensitivity
MAARRGREWDGDELGGPPQTPLAAPVVCLLRSAGDLAAGAFVGSLVGYGKGLITNQGMKASLSNAGSSAKTFAALAGVQSFIMCLLRRLRGKDDMINAGMAGCCTGLALSFPGAPQAMLHSCVTFAAFSCIMDGLNKQQAAMALTHDGKSSFAKSQEAGVLPPFTLPPLLDALDALASSCQTHVKPKH

SEQ ID NO: 15572 - DNA, 695 bp, Panicum virgatum
  misc_feature: Ceres CLONE 1784213
  misc_feature: Encodes the peptide sequence at SEQ ID NO. 15573
aaaaacccattcgagaggtcgccgaggagacgggggaggaggagcatcggagagggagaagaagaggggtagccatgctggaccatctcgtcgggctggtgagggtgcgcgtggtcaggggggtgaacctcgccatccgcgacctccgatccagcgacccctacgtcgtcgtccgcatcggcatgcagaagctgaggacgaaggtgatcaagaagaataccaatccggaatggaatgaagaactcaccctctcgattgaagaccctgcacatcctgtcaaactggaagtgtttgacaaggacacattcgtggatgattcgatgggtaacgcggagctggacattcgaccgttggttgaggtcgtgaagatgaagcttcaggatgttgccgatggaactgtggtaaagaaactggtgcccaacagacagaactgcctagccgaggagagctcgatttacatctccgaggggaaggtgaagcaggacctggttatcaggctgaagaacgtggagtgcggggagatagagctccagcttcagtgggtcgaccttcctggttcagagggtgtatgagctcagcgctgccctgctgttttcaggggttctcgagtaaaagtaaagttcatgtgacgaatgtaagctaaggatggttatggtacagcaagtgctaaactgctgattaggattttgatgttc

SEQ ID NO: 15573 - protein, 165 aa, Panicum virgatum
  misc_feature: Ceres CLONE 1784213
  misc_feature (9)..(87): Pfam Name: C2 Pfam Description: C2 domain
  misc_feature: SWISSPROT Homolog: EC 2.7.11.13 Protein kinase C
MLDHLVGLVRVRVVRGVNLAIRDLRSSDPYVVVRIGMQKLRTKVIKKNTNPEWNEELTLSIEDPAHPVKLEVFDKDTFVDDSMGNAELDIRPLVEVVKMKLQDVADGTVVKKLVPNRQNCLAEESSIYISEGKVKQDLVIRLKNVECGEIELQLQWVDLPGSEGV

SEQ ID NO: 15574 - DNA, 544 bp, Panicum virgatum
  misc_feature: Ceres CLONE 1784215
  misc_feature: Encodes the peptide sequence at SEQ ID NO. 15575
acccaaaaaacattgtcgaatcccgtttccctcgcttccccccaaacccaaaaccgatttccctccaaatccacccacaccctccgaaatgggcgcctaccaggcggccatcaacaacagcgacgtcccggaccatcgaggagtgcgaggccgacgctgtcgctgggaaattccctgctcccccgcccttggttagaccaaaggctcctaaaggaacaccggagatcaggccccttgacatgacaaagcgcccacgccgccaaatcccccaagaagtaggctgctcctggtcatgcgcgcgctgatctctcatcgcatccgatcctagcagtcttgcttcccctgtgttcgttgcttttgtgtgtatgtagtgccgcatctctatgtaccgtgccctccgtgcttcggatcctaagtcgtaggtctaggtctagctgtagttgttggtgatggggttatctatgttcccaaaatttaatgagatgagggatcggtagatgtagattcagattggtgaatcctaatgatttcagtgaaattcctt

SEQ ID NO: 15575 - protein, 100 aa, Panicum virgatum
  misc_feature: Ceres CLONE 1784215
  misc_feature: SWISSPROT Homolog: EC 4.2.1.24 Porphobilinogen synthase
PKNIVESRFPRFPPNPKPISLQIHPHPPKWAPTRRPSTTATSRTIEECEADAVAGKFPAPPPLVRPKAPKGTPEIRPLDMTKRPRRQIPQEVGCSWSCAR

SEQ ID NO: 15576 - DNA, 1585 bp, Panicum virgatum
  misc_feature: Ceres CLONE 1784216
  misc_feature: Encodes the peptide sequence at SEQ ID NO. 15577
aaaccccgccccttcatattcgcctccgcctccgcctccgcggctccgccgcctcgtcaaacccacgcgaccgcgagagctctcacagagcaccaccacgagagagacgaatcttccgaatctctcagcggcgatggcgctctccgaccgctcccgcgagtcgctcctcccgagcttcctctacgcctcctcctcggcgcgctccttcgccgccaccccctcgcgcctctccgtccccgtccccgccccggccccggccgcggctggagctggtggcggtgcgcccatctcgatccaggcgcccaaggagaagatcgagctctactcgccggcgttctacgccgcctgcacggccggagggatcgccagctgcgggctcacccacatggccgtcaccccgctcgacctcgtcaagtgcaacatgcagatcgatccagcgaaatacaagagcatctcatctggatttggtgtcctgttaaaggagcaaggggctaggggcttcttcaggggatgggtgcctaccttgcttggttacagtgctcagggggcttgcaagtttggcttctatgagttcttcaagaagtactactcggacattgcagggcctgagtatgcccagaagtacaagactctgatctacctggcaggttctgcttctgctgaggtaattgctgatgtggctctctgcccctttgaagctgtgaaggtacgtgtgcagacgcagcctggatttgctcgtgggttgagcgatgggctccccaaatttgtccgatctgaaggtgctctcgggctttacaagggacttgttcctctctggggtcgtcagattccttataccatgatgaagtttgcttcctttgagaccattgttgagcttatctacaagcatgctgtgcctgttcccaagtctgagtgcagcaagttgacccagctgggtatcagctttgctggtggctatattgctggtgtcttctgtgctattgtttctcacccggctgacaaccttgtgtctttcctgaacaatgccaagggtgctacagtgggtgatgctgttaagaagtttggtctctggggtcttttcaccagaggacttcctattcgtattgtcatgattggtacccttactggtgctcagtggggaatttatgatgctttcaaagtcatggttggactcccaacaaccggtggtgttacacctgccccagcagaggctgaatcgaaagccagcgcttgatttttctgtaaccccttgatggtatttggtggatggaattgtatcaatcattcaagagcttagttcccaatcttttgttttttttcttaattgtccagtcacctttttgatgagaggaactcattaaacagttgaaataggtccgtttttgcccccaggaaaagtttatgctcgatgcataataatttgtaggacagcaagactgttagagcgaagattttgtttgccacctatactgaggcatactcacaagccacatcatggagtttgtggaagcacgtacctaatttgacgctcttcattttgcccttgttctgaactacaactcatttgctccggttttttgtaacc

SEQ ID NO: 15577 - protein, 366 aa, Panicum virgatum
  misc_feature: Ceres CLONE 1784216
  misc_feature (68)..(156): Pfam Name: Mito_carr Pfam Description: Mitochondrial carrier protein
  misc_feature (165)..(253): Pfam Name: Mito_carr Pfam Description: Mitochondrial carrier protein
MALSDRSRESLLPSFLYASSSARSFAATPSRLSVPVPAPAPAAAGAGGGAPISIQAPKEKIELYSPAFYAACTAGGIASCGLTHMAVTPLDLVKCNMQIDPAKYKSISSGFGVLLKEQGARGFFRGWVPTLLGYSAQGACKFGFYEFFKKYYSDIAGPEYAQKYKTLIYLAGSASAEVIADVALCPFEAVKVRVQTQPGFARGLSDGLPKFVRSEGALGLYKGLVPLWGRQIPYTMMKFASFETIVELIYKHAVPVPKSECSKLTQLGISFAGGYIAGVFCAIVSHPADNLVSFLNNAKGATVGDAVKKFGLWGLFTRGLPIRIVMIGTLTGAQWGIYDAFKVMVGLPTTGGVTPAPAEAESKASA

SEQ ID NO: 15578 - DNA, 662 bp, Panicum virgatum
  misc_feature: Ceres CLONE 1784235-R
  misc_feature: Encodes the peptide sequence at SEQ ID NO. 15579
acaacgtcatgttcgagggcatcctgctcaagccctccatggtgacccccggcgccgagtccaaggacaaggccactcccgagcaggtggccgagtacaccctcaagctcctccaccgccggatccctccgtcggtgcccggcatcatgttcctctccggcggccagtcggaggtggaggccacgcagaacctcaacgccatgaaccaggggcccaacccgtggcacgtctccttctcctacgcgcgggcgctgcagaacacctgcctcaagacctggggcggcgcgccggagaacgtcaaggcggcgcaggacgcgctgctgctgcgcgccaaggccaactccctggcgcagctcggcaagtacacctccgacggcgagaccgccgaggccaaggaggggatgttcgtcaagaactacagctactaataaataaattgatcggttataatccgatccgacgacgatccctatatacacacactactaccgattaagcaagatatatgagcacgtattctcggtcgccatgttcgagatgcatgctgcgtcactacttattagctatgtatatatatgcatggctatcggagagagattgtattaagacgttggtcgaggtggttacttattaatcaattaccgtttctcgtttacatcgtc

SEQ ID NO: 15579 - protein, 141 aa, Panicum virgatum
  misc_feature: Ceres CLONE 1784235-R
  misc_feature (1)..(141): Pfam Name: Glycolytic Pfam Description: Fructose-bisphosphate aldolase class-I
  misc_feature: SWISSPROT Homolog: EC 4.1.2.13 Fructose-bisphosphate aldolase
  misc_feature: Useful for making plants with modulated biomass
  misc_feature: Useful for making plants with modulated phosphate use efficiency
NVMFEGILLKPSMVTPGAESKDKATPEQVAEYTLKLLHRRIPPSVPGIMFLSGGQSEVEATQNLNAMNQGPNPWHVSFSYARALQNTCLKTWGGAPENVKAAQDALLLRAKANSLAQLGKYTSDGETAEAKEGMFVKNYSY

SEQ ID NO: 15580 - DNA, 412 bp, Panicum virgatum
  misc_feature: Ceres CLONE 1784235
cttaagcttttacatacgactgaaacacccgatccatgccactcttgaatgtgatcccatcgtcaccgttctatctagcacgagcatccatttgctagcgtcgtccagcttcctcacaggacgcatgacactcccaatatcccgacgtgctctgcttgcacgccgctaaggtcgacctccctgccatgatgctcccacggggccccagtaagctggtcgcatcgcccacgacggtgaacttgatctgcgtggtcgtacgcacctgcccctctgcccatgacctaggacaaatcgatcaacctgcgctattctcgccgcgggtcgtccatgtcctcgtggaccgtgaagtcgttctccggcaacgacctggagtccaacaagatggacaacaacgacgtcatcacgcaggcgt

SEQ ID NO: 15581 - DNA, 1932 bp, Panicum virgatum
  misc_feature: Ceres CLONE 1784243
  misc_feature: Encodes the peptide sequence at SEQ ID NO. 15582
aaaaaagcccggccgcgccccccctcccccccgcgcgctctcatcccctccacacgtttccgcctccccgatccacaagccgccgcggccgccgccgccgacacagcaccgtcccccttcccctcgcagccctcgccgcggacgaggccgaccgaccaagcagccagccagccagccccgctccttcatcaccaggcggcgcgggcgaggcggcgccgggagtgaacgagcgagcgggggtgccgcgcggcgcggctattgttgtcctctgcgggggaggcggtttcggggggttgcgcggcgcggaggatggcgtcgagcgcggcggaggcggcggggggagtggcggactaccacgacggttgggcgtcggacgacgaggtggacatggagatggaggcgggcggcgaggaccacgggcgcgatgccgaccagagggatggcggcgcggacgaggcagacgacgcgtactcgctggtcactagggtaagtgacacatcagcagctgaagcaaggacaggaaaggatagacaaggtattccatgggaggggctaaacataaccaggcaggactacagaaaagctaggttggaacagtataagaactatgaaaacttccctcaatctggagagctcatggataagttgtgcaagcaagtggagccgagcagcaggtattacgagtttcagcacaacactagatcagtgaagccatcaattctccattttcagcttaggaatttgttatgggcaacctcaaagcatgatgtctattttatgtcggagtccacagtaggccactggtcatcactgtctcacaaattgtcaacggttctcgacttctcagggcacgttgctccaacagagaagcatcctggcagtttactagaagggttctctgggattcaagtcagcacacttgctgtgaatgagggtttattggtagctggtggttttcaaggagaactaatttgcaagggtttagcagaccgcaatgtgaaattctgtacaaggacaactttgagcgacaatgctataacgaattccatagatatacacagatctacaagtggaagcttgtgcattacagtatccaataatgattgtggtgtccgtgaatatgacatggaaagatttcagctcttgaatcacttccattataactggccggtgaatcacacatctgtgagtccggataggaaacttctggcggtggttggagatgatcgggacgcacttcttgtggattcacgaaacgggaaggtaacctctaccctagtcggccatctggactactcattcgcaacggcatggcacccagatgggcgcaccttcgcaacagggaaccaggataaaacctgccgcgtctgggacatgcgcaacctgtcgacctcccttgcagtccttcggggcaacattggtgcgatccggtgcatccgctactcctccgatgggaggttcctggtgttctcggagcctgccgacttcgtgcacgtgtatagcgctgccgcggactacaagaagcggcaggagatcgacttctttggtgaggtgtctgggatcacgctcagccccgacgatgagtctctgttcgttggggtgtgcgaccgcgtctacgccagcttgatgcagtacaggatggcccatgcgttcaactatcttgactcgtacgtgtgaagaactgaatatctggagttgtctgtctggtgctggctatccgtcactgctctcagtgccggttctggtgtgcggttcagggaatgtatctgcctgttctcgtgcgcaggcccatggtgtacggcgagttgaggctcgggcgagtccgccgtgtaaatagttttgtagttgaagcacaatgtcaaggaccggtactgtctgaacatatgactatggctgtgttcacttccctcccattcctacaaactttccatc

SEQ ID NO: 15582 - protein, 455 aa, Panicum virgatum
  misc_feature: Ceres CLONE 1784243
  misc_feature (317)..(355): Pfam Name: WD40 Pfam Description: WD domain, G-beta repeat
  misc_feature: SWISSPROT Homolog: EC 2.3.1.48 Histone acetyltransferase
MASSAAEAAGGVADYHDGWASDDEVDMEMEAGGEDHGRDADQRDGGADEADDAYSLVTRVSDTSAAEARTGKDRQGIPWEGLNITRQDYRKARLEQYKNYENFPQSGELMDKLCKQVEPSSRYYEFQHNTRSVKPSILHFQLRNLLWATSKHDVYFMSESTVGHWSSLSHKLSTVLDFSGHVAPTEKHPGSLLEGFSGIQVSTLAVNEGLLVAGGFQGELICKGLADRNVKFCTRTTLSDNAITNSIDIHRSTSGSLCITVSNNDCGVREYDMERFQLLNHFHYNWPVNHTSVSPDRKLLAVVGDDRDALLVDSRNGKVTSTLVGHLDYSFATAWHPDGRTFATGNQDKTCRVWDMRNLSTSLAVLRGNIGAIRCIRYSSDGRFLVFSEPADFVHVYSAAADYKKRQEIDFFGEVSGITLSPDDESLFVGVCDRVYASLMQYRMAHAFNYLDSYV

SEQ ID NO: 15583 - DNA, 654 bp, Panicum virgatum
  misc_feature: Ceres CLONE 1784298-R
  misc_feature: Encodes the peptide sequence at SEQ ID NO. 15584
cctccagcagaaggagcatcccaagttcaagagaaagggcgatgacctcttttatgagcacactctgaccctgactgaatctctctgcggcttccagtttgttctgacccacttggataacaggcagctgctaatcaaatcaaagcccggtgaagttgtcaagcctgactcgttcaaggcgatcaacgatgagggcatgcccatgtaccagaggcccttcatgaagggcaaactgtacatccacttctcggtggagttccccgactctttgaacccggagcagtgcaaggccctggaggctgtcctcccggccaagccagcatcgcagtacacggacatggagctagatgagtgtgaggagacgatgccgtacgatgtgaacatcgaggaggagctgcggaggcggcagcaacagcaccaggaggcctacgacgaggacgaggacatgccggacggcgcgcagagggtgcagtgcgcccagcagtaggcgctgtaggcagatttgtttgacggtggcggcaaatttgttgtttcgctctatgcgagtactgttgggtcccaaagttttctcgcgtattatgtgatgatactttcggttctaaaaatactacaatattcgctcagtggagcagaaggttttgcgtgttttccgtt

SEQ ID NO: 15584 - protein, 161 aa, Panicum virgatum
  misc_feature: Ceres CLONE 1784298-R
  misc_feature (1)..(102): Pfam Name: DnaJ_C Pfam Description: DnaJ C terminal region
LQQKEHPKFKRKGDDLFYEHTLTLTESLCGFQFVLTHLDNRQLLIKSKPGEVVKPDSFKAINDEGMPMYQRPFMKGKLYIHFSVEFPDSLNPEQCKALEAVLPAKPASQYTDMELDECEETMPYDVNIEEELRRRQQQHQEAYDEDEDMPDGAQRVQCAQQ

SEQ ID NO: 15585 - DNA, 363 bp, Panicum virgatum
  misc_feature: Ceres CLONE 1784298
gacggcatggtcaagatgctcgtctctgaggaggcgggcagagaggtcgcctccctcggtcgcgccttctaggacgttcaccaccggctctataccaagctctcccaccgacaccgcgaccgattgattgagagtactcctgattaacgaattggatctcccatggtcattatggacacagaagcttatgacggcatccaaatccccaaatgcgtcgaccccgtctctcccgagtacgaatcgcagtttgacgctctgtttgtcgacctgaaggacgtcgagatggcatctctcaaggagtcataacggtgaaagaactaaattgctgaagtcaggaaaatgaagagtaacatctccaccctg

SEQ ID NO: 15586 - DNA, 734 bp, Panicum virgatum
  misc_feature: Ceres CLONE 1784300
  misc_feature: Encodes the peptide sequence at SEQ ID NO. 15587
atcatcacagaggaagagcgagcggcaatcgaagcagcagcaatggcggcctccatgatctcgtcgtcagctctggtggcgccggccagggcccagggcctgccgtccctcggccgccgcgcctcctccttcgccgtcgtctgcggcaccggcaagaagatcaagaccgacaagcccttcgggattggcggtggcctcaccgtcgacgtcgatgcctccgggaggaaggtcaagggcaagggcgtgtaccagttcgtcgacaagtacggcgccaacgtcgacggatacagcccaatctacaaagaggaggactggtctcccaccggtgacgtctacgtcggtggaaccactggacttctgatctgggccgtcaccctcgccgggctccttggaggcggtgccctccttgtttacaacaccagcgctctcgccagctaagaacactattcatgcacagtccatgcaagcacttgcggttcatgtaagatcagcttgggggtgtctgtctgtaatctagcctgcagctttgatgtccaatataatgcttggttcatgtaacaatgctactacggctctccatacttttgggacagttattatattaattacttgatgctacatatttagattaatatataactggtaactttatttctctgtgccttgtgagcctttgtgaagaagatgatgatgatgacgctaagttaatatatgtatgtactaagtcatgatcg

SEQ ID NO: 15587 - protein, 131 aa, Panicum virgatum
  misc_feature: Ceres CLONE 1784300
  misc_feature (35)..(131): Pfam Name: PsbR Pfam Description: Photosystem II 10 kDa polypeptide PsbR
MAASMISSSALVAPARAQGLPSLGRRASSFAVVCGTGKKIKTDKPFGIGGGLTVDVDASGRKVKGKGVYQFVDKYGANVDGYSPIYKEEDWSPTGDVYVGGTTGLLIWAVTLAGLLGGGALLVYNTSALAS

SEQ ID NO: 15588 - DNA, 783 bp, Panicum virgatum
  misc_feature: Ceres CLONE 1784321
  misc_feature: Encodes the peptide sequence at SEQ ID NO. 15589
gcctccgagtcctccatttagccctcggttctcgagtcttccagactcgcgctcgcgctcgctgctcgccttcgcttccgacttctccactcgcgtcgcacgcaggggtcgcctgagatcacatagacaatggtgaaggctgtcgctgtcctcgctggcagtgatgtcaagggtaccattttcttttctcaagagggagatggtccaaccaccgtgaccggaagtatctctgggctcaagccggggctccatgggttccatgtgcatgcgcttggtgacaccaccaatggctgcatgtccactgggccacacttcaatcctgctgctaaggagcatggtgcaccagaagatgagaatcgccatgccggtgatcttgggaatgtgacagctggagaagatggtgttgctaatgtcaatattactgactgccagattcccctcactgggccacactcaatcattggccgagctgtagttgtccatgccgatccagatgaccttggcaagggtggacatgagcttagcaagagcacgggaaatgctggtggccgtgttgcttgtggtatcattgggctccagggctagatgctgtggcttcattggtgaacattcacatctgagcacctccggtcttgctgcttcatttcccttatattggatacataattggctactcttaataatcgcctgatcaatagtcagagcgctattcctatcattccgtgtatgaacattgcacaaccatcatttttctttagtgcgatgcgaagtggctgttttggc

SEQ ID NO: 15589 - protein, 151 aa, Panicum virgatum; identical to SEQ ID NO: 9809
  misc_feature: Ceres CLONE 1784321
  misc_feature (1)..(151): Pfam Name: Sod_Cu Pfam Description: Copper/zinc superoxide dismutase (SODC)
  misc_feature: SWISSPROT Homolog: EC 1.15.1.1 Superoxide dismutase

SEQ ID NO: 15590 - DNA, 597 bp, Panicum virgatum
  misc_feature: Ceres CLONE 1784332
  misc_feature: Encodes the peptide sequence at SEQ ID NO. 15591
ccctcctaccttggcgagctcgcgcagacagcggcgccgccccccttccctcctctcttctccgtccgttcgccgccgcccgcggcaccgtatggccccgactgggcggctcctcacggtagccgccctctccatcctcggtgtgcaggggctggtgcgcgattcaggcgctgcatttgctcagacccacctgccgcctcgacggatcgttcacgcaggggaaaatgacggcggcctcatgccggagctccagcccagcggactcctgcccatgccggaactctcccccatcggttccacgaagccatttgttcccttcctggcgcctgctccgctcgcgcccttcttcaacaacagcccgacaaagctctcacggaaaggctgattgaacttcaccgcggtcaataacctgatgaccacaacagctgtcgactgcttcatctcggttgcacctttcttggcctatgtgatttgctgcccccatgttcatgcaacgctgagcttcctcattgggaagacgagcacggatacttggtctgtcgcgatgaatcccaccgtctacaactattgcctgtcagatgtctggcagctgctgct

SEQ ID NO: 15591 - protein, 97 aa, Panicum virgatum
  misc_feature: Ceres CLONE 1784332
  misc_feature: Useful for making plants with altered carbohydrate content
MAPTGRLLTVAALSILGVQGLVRDSGAAFAQTHLPPRRIVHAGENDGGLMPELQPSGLLPMPELSPIGSTKPFVPFLAPAPLAPFFNNSPTKLSRKG

SEQ ID NO: 15592 - DNA, 744 bp, Panicum virgatum
  misc_feature: Ceres CLONE 1784337
  misc_feature: Encodes the peptide sequence at SEQ ID NO. 15593
ctcgctaaccctagcccccgcctcccacctgctccccgccgccgccgccgccgccgcaagtaggaccagccaggatgccggccggccacgggctgcgctcgcggacgcgcgacctcttcgcgcgtcccttccgcaagaaggggtacatcccgctcaccacctacctccgcaccttcaagatcggcgactacgtcgacgtcaaggtgaacggcgccgtccacaaggggatgccgcacaagttctaccacggccgcaccggtcgcgtgtggaacgtcactaagcgcgccatcggcgttgagatcaacaagcaggttaatggccgcatcatcaggaagcgtatccatgtccgtgtggagcatgtgcagcagtcccgctgcactgaggagttccgccagaggaaggcaaagaatgaccagctgaaagcagatgccaaggcacgcggtgaggtcatcagcaccaagaggcagccgttgggtcccaagcctggcttcatggttgaagatgctaccatcgagaccgtcacccccatcccatatgatgttgtcaacgatctcaagggcggttactaggttgctcggtctatctagccgcactaccagttctatatctgtattactctagtgggtacaattttgctctgtccgagcagtagtctggacctattctgtgtgtttctgttgaaagattttccattctaggtgcaaacctgagttcggcagaacgctcgatactgttatgtttgct

SEQ ID NO: 15593 - protein, 164 aa, Panicum virgatum
  misc_feature: Ceres CLONE 1784337
  misc_feature (2)..(100): Pfam Name: Ribosomal_L21e Pfam Description: Ribosomal protein L21e
  misc_feature: Useful for making plants with modulated flowering time
MPAGHGLRSRTRDLFARPFRKKGYIPLTTYLRTFKIGDYVDVKVNGAVHKGMPHKFYHGRTGRVWNVTKRAIGVEINKQVNGRIIRKRIHVRVEHVQQSRCTEEFRQRKAKNDQLKADAKARGEVISTKRQPLGPKPGFMVEDATIETVTPIPYDVVNDLKGGY

SEQ ID NO: 15594 - DNA, 2333 bp, Panicum virgatum
  misc_feature: Ceres CLONE 1784351
  misc_feature: Encodes the peptide sequence at SEQ ID NO. 15595
ctcccggtctcccccctcagatcttccccatatctctgtgctgcactgctgcctcgctcgccgccgcagtccactcccaatccaaaacctaaaggctcccggctccgccgccctgttcgctcgccccgccttttgactcccccccggcctagctagctgctgcggaggagcaacccgaaaatcctagaaaagcaagcggtcaagaaagagcggaagaaaggagcgcggtgatgatgaggacgataagtcgccccatgattctccccatcattccgtcgcctccggggcctgtgcgctgctaaaagggcgtcgccgtccgtcgctacggtgctggtggtggtggtggtggtgtgcttggccgggggactcgtcgctgcgccgccgccaggccgcaacaatgccgcagtaccaggagctgccatgcggcgggcaggtgctcgacatcgacacggctctcaaggacggcatcctcgggggcgcgccggagcccggggatgcggcggcgggggacgccgggaagcagccggtcgagctgaggaggatgatggacgagctcgacgcggccggggacggcggcggggacgaggcggtgccggcggtcttcatctgcccgatctcgctcgagcccatggtggatccggtcacgctctgcacggggcagacgtacgagcgggccaacatctcgcggtggctcgcgctgggccaccggacctgcccgaccacgatgcaggagctctgggacgacgcgctcacccccaacgccacgctccgccagctcatcgccgcctggttctcgcgccgctacaccaggttcaagaagcgctccgccgacttccacggccgcgccgccgacctcgtccacggcctccggggcacggcggtgcccaggaggcagccgctcaagggccaggcccgcgtcgccgcgctccgggagctgcgcaccctcgccgccacccaccagtccgtcaccaaggccatcgtcgaggccggcggcgtggccctgttgacctcgctgctcggccccttcacgtcccacaccgtggggaccgaggccgtcgccattctcgtcagcggcgtgacgctcgacgccgacgcgaagaccgcgctcatgcagcccgcgaaggtgtcgctcgtggtggatatgctcaacgagggggcggcggacaccaagatcaactgtgtccgcctcatccgcattctcatggatgagaggggtttccggcctgagacggttgcgagcctgagcctcttggtcggtgtcatgcgcctcatccgggacaagcggcatccagacggcgtggttgcggggcttgagctgctgaattcgatttgtgcagtgcataggccggcgaggagtatgattgttagcattggtgcggttccgcagctggtggaattgttgccggagctggcaacagagtgtgtcgagccggccttggacatcttggatgccctgtctgcagttccagagggtagggcggctctcaaggattgcccgcggacaatacccaatgcggtccgcttgctgatgagagtttcagaggcttgcacacgacgggcgctgtcaatgctgtggacggtgtgtcggatggcgcctgaagagtgtgcacctgctgccgttgaggctgggttggctgccaagcttctacttgtcatccagagtggttgtgcgccggagctgaagcagaaagcctcggagctgctcaagctgtgccggcttaactacactgacaccctcttcatctccaagtgcaaactcacaaggacaattcagtgaggggatggaaatgatgctgttctgatgtgatttgattcgatgatgcgtggtttgtcaattgaccttgctgagttcagagttcgaaggagatgggattgccgaattgataaatggtaatgagcatacatagataaacttgcagatctagctcaatgagcatacatagataaacttgcagatctagctcatctagctctatcatcttatctgaagagatgctggtggttgagcagatggcagattgggtggctaccatatcaatttgtggagagacagatggcagtattggagcaatgcggcataatcagtggcatgttagatggcaagcaggcggatgtacatgcaaattgatgtggatttgatcagctcaataagcacttgaggctgggtggtaagtacagccagttttgccattaggagtagagaacattaagcaaaaccagcaaatttagatttttggcaatgtgggtaagtcagggctgtagatgttgctcccttccctgtaattatacagtactgttgcttcaacactggaatatacattgccattgctcgg

SEQ ID NO: 15595 - protein, 459 aa, Panicum virgatum
  misc_feature: Ceres CLONE 1784351
  misc_feature (64)..(138): Pfam Name: U-box Pfam Description: U-box domain
MPQYQELPCGGQVLDIDTALKDGILGGAPEPGDAAAGDAGKQPVELRRMMDELDAAGDGGGDEAVPAVFICPISLEPMVDPVTLCTGQTYERANISRWLALGHRTCPTTMQELWDDALTPNATLRQLIAAWFSRRYTRFKKRSADFHGRAADLVHGLRGTAVPRRQPLKGQARVAALRELRTLAATHQSVTKAIVEAGGVALLTSLLGPFTSHTVGTEAVAILVSGVTLDADAKTALMQPAKVSLVVDMLNEGAADTKINCVRLIRILMDERGFRPETVASLSLLVGVMRLIRDKRHPDGVVAGLELLNSICAVHRPARSMIVSIGAVPQLVELLPELATECVEPALDILDALSAVPEGRAALKDCPRTIPNAVRLLMRVSEACTRRALSMLWTVCRMAPEECAPAAVEAGLAAKLLLVIQSGCAPELKQKASELLKLCRLNYTDTLFISKCKLTRTIQ

SEQ ID NO: 15596 - DNA, 421 bp, Panicum virgatum
  misc_feature: Ceres CLONE 1784352
  misc_feature: Encodes the peptide sequence at SEQ ID NO. 15597
tactcggacatcgaagagctgaagaatgctaaaaacttgctgaccgtggttgagtcatggctccgatcagagaccaaactccccaagaaggatcctccaccacgttcagagacccagcccaggcgctcctcgccgtttgataattctcctttccgctcatctcgccacatggcatactaccgttgatgatttggcgtcttcccttttctttttttgaacaaacatatttgtcatcttatctgcttcgcttccttgcatacggcaatatatgtgtagaataaagttagcttgttcctgtgtcgacgaggagccataggtgctcaccacgttcatcgccgttctgcttctcacactcttatcttacaccagaaattcagtcccagtcgatgaggcttgatatattcagaaaagtttccccgtt

SEQ ID NO: 15597 - protein, 61 aa, Panicum virgatum
  misc_feature: Ceres CLONE 1784352
  misc_feature: Useful for biocontainment applications
YSDIEELKNAKNLLTVVESWLRSETKLPKKDPPPRSETQPRRSSPFDNSPFRSSRHMAYYR

SEQ ID NO: 15598 - DNA, 558 bp, Panicum virgatum
  misc_feature: Ceres CLONE 1784354
  misc_feature: Encodes the peptide sequence at SEQ ID NO. 15599
agaaaaccaactctagcaataatggccaacgccctcagcagcctccgcgcgccggccaacagcttctccggcgtccgcgctgccccggcacccgcggcgcccgccatcgtcgccatgcccgccgccaagaatcaggttgcccgcggcgccatgctgcgcgcccaagcgacctacaacgcgaagctcgacacgcccgacggccaggtggagctgcaggtgcccaacgacatgtacatcctggaccaggccgaggaggaggggatcaaccttccctactcgtgccgcgccgggtcctgctcctcctgcgccggcaaggtcgtctccggctccgtcgaccagtccgaccatagcttcctcgacgaccaccatgtcgcctgcagctggatgctcacctgccacgcctaccccacctccgacgtcatcatcaagacccacaaggaggaagagctcaccacttaatatacaattaattcagctcgctccatcgtgactcgatatatatcatcatcatctaatatatctcaatctgcctgccatgcaatagatgttgtaatcgat

SEQ ID NO: 15599 - protein, 145 aa, Panicum virgatum
  misc_feature: Ceres CLONE 1784354
  misc_feature (56)..(131): Pfam Name: Fer2 Pfam Description: 2Fe-2S iron-sulfur cluster binding domain
MANALSSLRAPANSFSGVRAAPAPAAPAIVAMPAAKNQVARGAMLRAQATYNAKLDTPDGQVELQVPNDMYILDQAEEEGINLPYSCRAGSCSSCAGKVVSGSVDQSDHSFLDDHHVACSWMLTCHAYPTSDVIIKTHKEEELTT

SEQ ID NO: 15600 - DNA, 585 bp, Panicum virgatum
  misc_feature: Ceres CLONE 1784362
  misc_feature: Encodes the peptide sequence at SEQ ID NO. 15601
accaacgaatccccagtcccccacatccccagtcccccacatccccttcctcgatttcaatctcaccacctccgagggagccatgtcgggccgcggcaagggaggcaaggggctgggcaagggcggcgcgaagcgccaccgcaaggtcctccgcgacaacatccagggcatcaccaagccggcgatccggaggctggcgcgcaggggcggcgtgaagcgcatctccgggctgatctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggccgcaccctctacggcttcggcggctgagctctgcctctccgttccggcggcgctcctgcttttggtcagacggtgctaggtttagcagtggtggtaggcgttctcgttccatcagatgtcgggaagagtccgtgtctgttttgtgcaaagtcatctgttctgtgatgagaaatggatcccgaaggttatgaatgaaatcgatccatgtttacttttct

SEQ ID NO: 15601 - protein, 103 aa, Panicum virgatum; identical to SEQ ID NO: 12044
  misc_feature: Ceres CLONE 1784362
  misc_feature (25)..(94): Pfam Name: Histone Pfam Description: Core histone H2A/H2B/H3/H4

SEQ ID NO: 15602 - DNA, 2057 bp, Panicum virgatum
  misc_feature: Ceres CLONE 1784365
  misc_feature: Encodes the peptide sequence at SEQ ID NO. 15603
atcgtcgtcgtctccctcccccgtcgtccaatcttataatcgcattcccaatccccaaatcgagacctcgccactctccacagcttccactccaaggaacagtcaccgtcgttaagaagaggatgatgcgctgcgctctcaagggtggcgggtgcgtcacctcgtggagcggcgatcggaggttgccggcggcggccgtcaacccctgcggcgtgcggatgccgacgggcggcggcgggtgctgctccggcctgcggtcgcgggccgcggatctcgcggggctcgagatggccaccatgcgcggcggcgtcgggggcctcttccgctccagcccgcgctacgggcgcttgcaagccacggcgtcagttgatcctgaagacattccgttggagaaggttcaagttaaatcctcgggacatgttctgccatatgttggtgttgcttgcttgggcgctattttgtttggttaccatcttggtgtggtcaatggtgcgcttgaacatcttgccaaggatcttgggatcgctgaaaatgctgtcctacaaggatgggtagtcagcacatccctggctggtgcaacaataggttctttcaccggagggtctttggctgataaatttggtcgaacgagaacatttatcctggatgcagtcccgcttgctctaggtgcattcttgagtgcaacagctcaagacatccgggcaatgattattggtcgattgcttgctggaatcggcattgggatctcatctgctcttgttcccctgtacatatctgagatatcaccaactgaaatccgtggaacacttggcactgttaatcaactatttatctgcattggaattctcgcagctttgttggctggattgcctttggctggaaatcctgcctggtggaggacaatgtttggagttgctgtagttccatccattttactagctgtaggaatggccttttcacctgaaagtcctcgttggctgttccagcaaggaaaggttacccaagcagaatcagctgtaaaaagactgtatggaaaagaaaaggttacggaagttatgtatgatctgagagctagtggccaaagttcttcggagccagaagctggctggtttgatctcttcagcaaccgctattggaaagttgtgagcgtgggggcagcactgtttttgttccaacagcttgctggtataaatgctgttgtatattactctacatcggtgttccgcagtgcaggaattgcatctgatgttgctgctagtgctcttgttggggctgccaatgtttttggcaccatgattgcatcttctcttatggacaagcaaggcaggaaaagccttctgataacaagcttttctggaatgggtgcttctatgttacttctagctctgtccttcacctggaaagctctggcgccttattctgggactcttgctgttgttggcactgttctgtatgtgctgtcttttgctctcggagctggtcctgttccagctttacttcttcctgaaatatttgcctccagaataagggctaaggctgtcgcattatctctaggcatgcactgggtatccaacttctttatcggcctgtacttcttaagtgtcgtcaacaagtttggcatcagcaccgtttacctggggttcgcatcagtgtgtgctcttgcagttctttacatagctgggaacgtggtggaaaccaaggggcgatcgctggaggagattgaacgggaactaagcgtagtagattgatatgctgtccattttggtgatcgagaatgctaccaagcacacaaccgagcatccttggacgtggagaccctgtttctagttccattttgcataagaaataagcgagtggcaagagcgccaatcgtcgctgacttggtgtgcgcagtgagggctttgtgttcgagcagtaagtttagctgcccgccgtgtcatctgtcagaatcaatgaacccgtcgatgttcctggagataagttttgtgttcttagatttttcgtttttctggtgtatagatgaaccctgtctcccgaaaataaagtcgattattgtc

SEQ ID NO: 15603 - protein, 541 aa, Panicum virgatum
  misc_feature: Ceres CLONE 1784365
  misc_feature (103)..(537): Pfam Name: Sugar_tr Pfam Description: Sugar (and other) transporter
MMRCALKGGGCVTSWSGDRRLPAAAVNPCGVRMPTGGGGCCSGLRSRAADLAGLEMATMRGGVGGLFRSSPRYGRLQATASVDPEDIPLEKVQVKSSGHVLPYVGVACLGAILFGYHLGVVNGALEHLAKDLGIAENAVLQGWVVSTSLAGATIGSFTGGSLADKFGRTRTFILDAVPLALGAFLSATAQDIRAMIIGRLLAGIGIGISSALVPLYISEISPTEIRGTLGTVNQLFICIGILAALLAGLPLAGNPAWWRTMFGVAVVPSILLAVGMAFSPESPRWLFQQGKVTQAESAVKRLYGKEKVTEVMYDLRASGQSSSEPEAGWFDLFSNRYWKVVSVGAALFLFQQLAGINAVVYYSTSVFRSAGIASDVAASALVGAANVFGTMIASSLMDKQGRKSLLITSFSGMGASMLLLALSFTWKALAPYSGTLAVVGTVLYVLSFALGAGPVPALLLPEIFASRIRAKAVALSLGMHWVSNFFIGLYFLSVVNKFGISTVYLGFASVCALAVLYIAGNVVETKGRSLEEIERELSVVD

SEQ ID NO: 15604 - DNA, 660 bp, Panicum virgatum
  misc_feature: Ceres CLONE 1784367
  misc_feature: Encodes the peptide sequence at SEQ ID NO. 15605
cgctgacacgctcgcacccgtcattaattccagaggggaaacccacgcagtatccagtggctggctgggcagcgggggcgcaggcgcaggcgggcgagcgagctcagccatggcgagcgcgatgaacggcggcggcggcggcggggcgctgaagcggatgggcccgctgcggctgcagtactacatcgtgatgggcgcggtggcggcagccgtggtgctggccacgctgcgctacatgccgggccccgccgccgcggccagcagcgtggaccggccgggcgcctccgccgcggcggcggcccccggcgccgaggcggaggcggaggatgcggagggggagagtgagaagaggaagaggaagggggacggcgtggtgctgttcaacttctgcgactccaacagcgactcgggcggcgtggcggcggtgatggggatccgcatcgcgccgccggaggggcgggcctacttccaccaccccacggggcggctctccgacggccgcgtcatcctcgagttcatctgagacagcctgggcacgcaacatctgagcccgttcatgaagccgctggactccaacttcaccaacggcgtgaacttcgccatcgcaaggaccacagccatgacaggagtcaccacattctcgctggatgtgcaggtgga

SEQ ID NO: 15605 - protein, 137 aa, Panicum virgatum
  misc_feature: Ceres CLONE 1784367
  misc_feature: SWISSPROT Homolog: EC 3.2.1.51 Alpha-L-fucosidase
MASAMNGGGGGGALKRMGPLRLQYYIVMGAVAAAVVLATLRYMPGPAAAASSVDRPGASAAAAAPGAEAEAEDAEGESEKRKRKGDGVVLFNFCDSNSDSGGVAAVMGIRIAPPEGRAYFHHPTGRLSDGRVILEFI

SEQ ID NO: 15606 - DNA, 594 bp, Panicum virgatum
  misc_feature: Ceres CLONE 1784378
  misc_feature: Encodes the peptide sequence at SEQ ID NO. 15607
accaatctcaccttgaatccccacccccgctcaaatccactccgaggaatccacaacccgtctggtcgtcggcaagcatgtctgggcgcggcaagggcggcaaggggctgggcaagggcggcgcaaagcgccaccggaaggtgctgcgcgacaacatccagggcatcaccaagccggcgatccggcggctggcgaggaggggcggcgtgaagcgcatctccgggctcatctacgaggagacccgcggcgtgctcaagatcttcctcgagaacgtcatccgcgacgccgtcacctacaccgagcacgcccgccgcaagaccgtcactgccatggacgtagtctacgcgctcaagcgccagagccgtaccctctacggcttcggcggctaggctgatgcactcgccccctcgctgtctcccttctgcagctacgacgttatctgggtattgctcacaggtcttgctgtcaagaaagtctcagattcgcttgattagctcatctctggctgtagtaggtttatcggaaccatgagacattaatgaattgaagttaccttgtgaaattgggagccaagcttgtcgcggttgacttgcg

SEQ ID NO: 15607 - protein, 103 aa, Panicum virgatum
  misc_feature: Ceres CLONE 1784378
  misc_feature (25)..(94): Pfam Name: Histone Pfam Description: Core histone H2A/H2B/H3/H4
MSGRGKGGKGLGKGGAKRHRKVLRDNIQGITKPAIRRLARRGGVKRISGLIYEETRGVLKIFLENVIRDAVTYTEHARRKTVTAMDVVYALKRQSRTLYGFGG

SEQ ID NO: 15608 - DNA, 881 bp, Panicum virgatum
  misc_feature: Ceres CLONE 1784397
  misc_feature: Encodes the peptide sequence at SEQ ID NO. 15609
acgcggagagagaggcagcaggcagggaggggagcatggcgagcgtcaagcagggcggggacgcggcgaaggcggcgggaggcggaggggggcttgggatgccggcggcggaggtggagcaggtgttccggcgctacgacgccaacggcgacggcaagatctcggcggaggagctggcgtccgtgctgcgggcgctgggcgcgccgccggggcccggggaggtgcgccgcatgatggacgagatggacgccgaccgcgacggcttcgtcgacctcgccgagttcgtcgccttccactgcggcgcccagccggcggaggggcaggacgacggcgccgcggaggccgagctgcgggaggccttccgcatgtacgacgccgaccgcaacggcctcatctccgcgcgggagctccaccgcgtcctgcgccagctcggggacaagtgctccgtcgccgactgctcccggatgatccgctccgtcgacgccgacggcgacggcagcgtcaacttcgacgagttcaagaagatgatgggcgccggcgccggagccaggcgctagcaaccagccaaggcccaaggaggaggaacctccctgcatgactccgatccacacccccaaaggtttatttaacctgtcctcccttgatgtatgtgtggtttatctgcttattagcttgattaattaagcctgattattagcttctactactaaggtgaagtgagtagcctgcatccatccagctgaatgcccttcgattttactttaggcctccttttactgtagtactacataccaagcaagcacggttttggaggcactctgatctgatttcatggtgaacagcggaggtgatgttgtcgtgtaaaggtgtgatgacctgct

SEQ ID NO: 15609 - protein, 173 aa, Panicum virgatum
  misc_feature: Ceres CLONE 1784397
  misc_feature (26)..(54): Pfam Name: efhand Pfam Description: EF hand
  misc_feature (104)..(132): Pfam Name: efhand Pfam Description: EF hand
  misc_feature (140)..(168): Pfam Name: efhand Pfam Description: EF hand
  misc_feature (62)..(88): Pfam Name: efhand Pfam Description: EF hand
  misc_feature: SWISSPROT Homolog: EC 2.7.11.1 Non-specific serine/threonine protein kinase
MASVKQGGDAAKAAGGGGGLGMPAAEVEQVFRRYDANGDGKISAEELASVLRALGAPPGPGEVRRMMDEMDADRDGFVDLAEFVAFHCGAQPAEGQDDGAAEAELREAFRMYDADRNGLISARELHRVLRQLGDKCSVADCSRMIRSVDADGDGSVNFDEFKKMMGAGAGARR

SEQ ID NO: 15610 - DNA, 675 bp, Panicum virgatum
  misc_feature: Ceres CLONE 1784433
  misc_feature: Encodes the peptide sequence at SEQ ID NO. 15611
gagccacgatccaccaccacacactctccagcacccggcggagcaagcggccagcgagagatccagaggcagcagcaatggccaccgtcagcgccgccgcggcgaccaccgtcgttgcccgcgccgccctaggtacggtttggttggtcggtcgtcggtcatctttgtcctctcacgcttgcatccgcgcatcgtgcaagctagctcatcacggtcgctgtccgcagggctgccgcagctgagggcgaggagcgagagggtgcggtgcggctactcgagggacgccaggagcgcggcggccgccgtgagcgcgaggggcgccggcgcgtcgctgctggccgcggcgggcgcggtgaccgcgtcggcggggccggcgctggcgctcgtggacgagaggatgtcgacggagggcaccgggctgagcctggggctcagcaacaacctgctggggtggatcctcctgggggtcttcggcctcatctggtcgctctacaccgtctacacctccgacctcgacgaggacgaggagtccggcggcctctcgctctagataatatcatgtccgtcctctgctcctgttactaccgatccggatgtaaacatggcggtggtcatcggtgtaatgtcagacttggctatttaatttgtatctaagcttcgcttttgcgttggatc

SEQ ID NO: 15611 - protein, 182 aa, Panicum virgatum
  misc_feature: Ceres CLONE 1784433
  misc_feature (46)..(182): Pfam Name: PsbW Pfam Description: Photosystem II reaction centre W protein, PsbW
SHDPPPHTLQHPAEQAASERSRGSSNGHRQRRRGDHRRCPRRPRYGLVGRSSVIFVLSRLHPRIVQASSSRSLSAGLPQLRARSERVRCGYSRDARSAAAAVSARGAGASLLAAAGAVTASAGPALALVDERMSTEGTGLSLGLSNNLLGWILLGVFGLIWSLYTVYTSDLDEDEESGGLSL

SEQ ID NO: 15612 - DNA, 845 bp, Panicum virgatum
  misc_feature: Ceres CLONE 1784439
  misc_feature: Encodes the peptide sequence at SEQ ID NO. 15613
ccgggggacggtgatatataaagggcaatagggctcagcaagttgcttcacatagctagcttggcaacacatacaggtacagctcgaaggcccgcaggcatagaagtgaacgcccgtcgtaggtagttgcgcggcttgtgctgatcgaggaggtgccgagcgagcgagcgcgtcgatggcgatccggaacatgcaggtggcgacgcgctcgctggacgcggacatgacggtggacgagttcaaggagtggctgcggcggttcgacacggaccgcgacgggcgcatcagccgcgaggagctgcggcgcgccatgcgcgccatccgcgcccggttcacggggtagcggagcaggcagggcatcagctacgccgacgccgacggcgacggctacatcgacgacagcgaggtggacggcctcatcgagttcgcgcagaagaacctcgggctcaagatcgtcgcctactgatgatcgagctggtccactcaggggcggacccgggcggcggcgagctatagctcgatccatcaccatgggctagcagcgagcacgccatctggcgcctggccccccggcccgctaaaaataagaacaactgcttgatcgaccgcttgcttgcttccttaaagctttgctttcttgtacgtactctatcaattcatggctctgtatcccctctctctctctctctgtgatctatctatgtaaggtgtgtatatgggtacccgtgcgcgctctcggtctcggctacctcctctgcaaggtccagccctgccatggtgccgccgcggattttaattaacagatttgctctagtgaaattgacagtatattatccttgaccatc

SEQ ID NO: 15613 - protein, 55 aa, Panicum virgatum
  misc_feature: Ceres CLONE 1784439
  misc_feature (21)..(49): Pfam Name: efhand Pfam Description: EF hand
MAIRNMQVATRSLDADMTVDEFKEWLRRFDTDRDGRISREELRRAMRAIRARFTG

SEQ ID NO: 15614 - DNA, 707 bp, Panicum virgatum
  misc_feature: Ceres CLONE 1784443
  misc_feature: Encodes the peptide sequence at SEQ ID NO. 15615
actcccaccacagtccgcagcagcagctagcgaccggtctcagcaaccctccttcgcctcacgcaatggccgcctccaccatggcgatctcctccccggcgatggccggcacccccgtcaaggtgggctccttcggcgagggccgcatcaccatgcgcaagaccgcggccaagcccaaggtggcggcgtccggcagcccgtggtacggccccgaccgcgtcaagtacctcggccccttctccggcgagcccccgagctacctgaccggcgagttccccggcgactacagctgggacaccgcggggctgtccgccgaccccgagaccttcgccaagaaccgcgagctggaggtcatccactcccggtgggccatgctcggcgcgctcggctgcgtcttccccgagctgctcgcccgcaacggcgtcaagttcggcgaggccgtctggttcaaggccggctcccagatcttcagcgagggcggcctcgactacctcggcaaccccagcctgatccacgcccagagcatcctcgccatgttctccatgttcggattcttcgtccaggccatcgtcaccggcaagggcccgctcgagaacctcgccgaccacctcaccgatccggtcaacaacaacgcctgggcctacgccaccaacttcgtccccggcaaataagctccgatccattggctctgcaacttcattgtcttc

SEQ ID NO: 15615 - protein, 201 aa, Panicum virgatum
  misc_feature: Ceres CLONE 1784443
  misc_feature (61)..(168): Pfam Name: Chloroa_b-bind Pfam Description: Chlorophyll A-B binding protein
MAASTMAISSPAMAGTPVKVGSFGEGRITMRKTAAKPKVAASGSPWYGPDRVKYLGPFSGEPPSYLTGEFPGDYSWDTAGLSADPETFAKNRELEVIHSRWAMLGALGCVFPELLARNGVKFGEAVWFKAGSQIFSEGGLDYLGNPSLIHAQSILAMFSMFGFFVQAIVTGKGPLENLADHLTDPVNNNAWAYATNFVPGK

SEQ ID NO: 15616 - DNA, 646 bp, Panicum virgatum
  misc_feature: Ceres CLONE 1784443-R
  misc_feature: Encodes the peptide sequence at SEQ ID NO. 15617
gtctggttcaaggccggctcccagatcttcagcgagggcggcctcgactacctcggcaaccccagcctgatccacgcccagagcatcctcgccatctgggcttgccaggtcgtgctcatgggcgccgtcgagggctaccgcattgccggcggcccgctcggcgaggtcgtcgacccgctctaccccggcggcagcttcgaccccctcggcctggctgacgaccccgaggccttcgccgagctcaaggtcaaggagctcaagaacggccgcctcgccatgttctccatgttcggattcttcgtccaggccatcgtcaccggcaagggcccgctcgagaacctcgccgaccacctcgccgatccggtcaacaacaacgcctgggcctacgccaccaacttcgtccccggcaaataagctccgatccattggctctgcaacttcattgtcttctggaaggggcgtacgtggatccattgatgctgcaagctgctgcatgtgtgtctcttgtttcacgttattgcatttcaggggcaagtcgagatgatgagttggcgttgtacactaagatgaaagatgatgtttgtgcaatagtagtgattttgttccctggggttaatcattgatttgtcaggttattattaagggc

SEQ ID NO: 15617 - protein, 137 aa, Panicum virgatum
  misc_feature: Ceres CLONE 1784443-R
  misc_feature (1)..(104): Pfam Name: Chloroa_b-bind Pfam Description: Chlorophyll A-B binding protein
VWFKAGSQIFSEGGLDYLGNPSLIHAQSILAIWACQVVLMGAVEGYRIAGGPLGEVVDPLYPGGSFDPLGLADDPEAFAELKVKELKNGRLAMFSMFGFFVQAIVTGKGPLENLADHLADPVNNNAWAYATNFVPGK

SEQ ID NO: 15618 - DNA, 291 bp, Panicum virgatum
  misc_feature: Ceres CLONE 1784462
  misc_feature: Encodes the peptide sequence at SEQ ID NO. 15619
cacttctattgctctactgtcccccgccctcagccatggcgacgaccctgatggctgctgccaccagcctcctgcttcccgcgccgcccgcggcgagatccacccgccccttgaccgcatgaaaaaggagagctgcccgcagctgcaggccgagctggacgagggcctccgccgcgacgatgccgacctcgtagagggagtcgcagatgtcggatcccaaaaagaggaagacgctgaagcactccaaggacaaatcgactcactttccctcgacatggcccacaaggtgct

SEQ ID NO: 15619 - protein, 96 aa, Panicum virgatum
  misc_feature: Ceres CLONE 1784462
  misc_feature: SWISSPROT Homolog: EC 3.6.3.14 H(+)-transporting two-sector ATPase
TSIALLSPALSHGDDPDGCCHQPPASRAARGEIHPPLDRMKKESCPQLQAELDEGLRRDDADLVEGVADVGSQKEEDAEALQGQIDSLSLDMAHKV

SEQ ID NO: 15620 - DNA, 1793 bp, Panicum virgatum
  misc_feature: Ceres CLONE 1784476
  misc_feature: Encodes the peptide sequence at SEQ ID NO. 15621
accgaatcctcgaatcgaatcgcgaccaaatcccccgccccacgctcccctcccctagtcccctgccctcctcaccccccccccccccgcgcccaccaaccccaccctccgccgccccaaccgatccccctcgagcgagcgccctcgtcgcgcgtgacggccgcaatgacggccgccacggcgccgccgccgccgcggcagctgagcctggaggacctgaaggcggtgtccgtgctggggcgcggcgccaagggcgtcgtgttccacgtcgtgcccgccccgggggagccggagggcggcgccgcggcggaggcggccatggcgctcaaggcggtctcgcgggaggcggcgcggcacaggaaggcggcgagcggggacggggacggccaccgccggatctggttcgagcgggacgtgctcctcgcgctgcgccacccgctgctcccgtcgctccggggcgtcctcgccaccgacgccgtcgtgggattcgccatcgaccgctgcggcggcggcgacctcaactcgctccggcgtcgccagaccgagaagatgttctccgactccgtcatccggttctacgcggcggagctggtgctggcgctcgagtacctgcacagcctcgggatcgtgtaccgggacctcaagccggagaacgtcctcatccaggacagcggccacatcatgctcgtcgacttcgacctctccacgcggctcccggcgccgccgcaggagccggacgcgccggccgagagcactaaaccggcgcctccggtcgccgcgccgtcgccgggccgtgggaagcccaggagaccagcgggcatcgccctgtgcttcccattccgcaccggcggcgccgcgaagcctgccgcggcggccgcggactcgccatcgccgccgtcgacctcgcggacggtctcctcgtcgtcctcatcctccacggcgaccacggcctcatccggggcctcggccggcgcgcggacgcccgcgaagtcgaactcgttcgtggggacggaggactacgtggcgccggagatcatcgccgggcgcggccacgacttcgccgtggactggtggggcctgggcgtggtgctctacgagatgctctacgggcgcacgccgttccgggggcagaaccgcaaggagaccttctaccgcgtcctcgccaagcagccggagctcgtcggcgagcagacgccgctgcgcgacctcatcgcccgcctcctcgagaaggaccccgagaagcgcatcggcgcgcgcggcgtcaaggcccaccccttcttccggggcgtcgactgggaccgcatcctccatgtggcgcgcccgccgttcatcccgtccccgccgcaggaagaggacggcgacgacgcgctcgacgtcgagaaggtcgtgcgcgaggtgttcgcctccaatgacgccgaggctgcaaaggcgggcgagaacgcttcgccggaggcggatgggggccgcggcggcgacggtgaagggcggaggagagacccatcaaaagatggtgacttctccgtgtttttctgagcttattttttttattttcttttttcttttttgagaaaaagttaactactactccctccttccctgtttataaggcatacacgtatatcaagattcaaatcttgtcatctttgaccaataatttgactattaaatttttatttttataatgcaaatttcatatgattggattcataatcaaatatattttacaatgattataagtttataatcaaaagtgatataatatatgataaataaatggtcaaagtgttgtttag

SEQ ID NO: 15621 - protein, 455 aa, Panicum virgatum
  misc_feature: Ceres CLONE 1784476
  misc_feature (18)..(372): Pfam Name: Pkinase Pfam Description: Protein kinase domain
  misc_feature: SWISSPROT Homolog: EC 2.7.11.1 Non-specific serine/threonine protein kinase
MTAATAPPPPRQLSLEDLKAVSVLGRGAKGVVFHVVPAPGEPEGGAAAEAAMALKAVSREAARHRKAASGDGDGHRRIWFERDVLLALRHPLLPSLRGVLATDAVVGFAIDRCGGGDLNSLRRRQTEKMFSDSVIRFYAAELVLALEYLHSLGIVYRDLKPENVLIQDSGHIMLVDFDLSTRLPAPPQEPDAPAESTKPAPPVAAPSPGRGKPRRPAGIALCFPFRTGGAAKPAAAAADSPSPPSTSRTVSSSSSSSTATTASSGASAGARTPAKSNSFVGTEDYVAPEIIAGRGHDFAVDWWGLGVVLYEMLYGRTPFRGQNRKETFYRVLAKQPELVGEQTPLRDLIARLLEKDPEKRIGARGVKAHPFFRGVDWDRILHVARPPFIPSPPQEEDGDDALDVEKVVREVFASNDAEAAKAGENASPEADGGRGGDGEGRRRDPSKDGDFSVFF

SEQ ID NO: 15622 - DNA, 741 bp, Panicum virgatum
  misc_feature: Ceres CLONE 1784536
  misc_feature: Encodes the peptide sequence at SEQ ID NO. 15623
ttatagaaaagagcaatctcagtcgccagttcctcttccgtgactggaacattgggcagcccaagtccacagttgctgctactgctgctatggcaattaatcctaagcttcatgttgaggcccttcagaacagggcaagtcctgagactgaaaatgtgtttaatgatgccttttgggagagcttggatgctgttgtcaatgccttggacaatgtgactgcaagaatgtacattgactccaggtgtgtgtatttccagaagccacttcttgaatctgggactctgggtgctaagtgcaacacgcagatggtcattcctcacctaacagaaaactatggggcatccagagatccacctgaaaagcaggcgcctatgtgcactgtacattcatttcctcataatattgatcactgcctaacgtgggcaaggtctgagtttgagggtctactagagaagactcccactgaagtaaacgcgttcctgtcaaatcctagtggatatgccactgctgcgagaactgctggtgatgcacaggctagggatcaacttgagcgagttattgaatgccttgacagagacaagtgtgagacattccaagattgtattacctgggctcggcttaagtttgaggactatttcgccaaccgtgtgaagcagctgacgtttaccttccctgaagacgcaatgacaagctctggtgctcctttctggtctgctccctagcggttcccgcgacctctgg

SEQ ID NO: 15623 - protein, 239 aa, Panicum virgatum
  misc_feature: Ceres CLONE 1784536
  misc_feature (1)..(104): Pfam Name: ThiF Pfam Description: ThiF family
IEKSNLSRQFLFRDWNIGQPKSTVAATAAMAINPKLHVEALQNRASPETENVFNDAFWESLDAVVNALDNVTARMYIDSRCVYFQKPLLESGTLGAKCNTQMVIPHLTENYGASRDPPEKQAPMCTVHSFPHNIDHCLTWARSEFEGLLEKTPTEVNAFLSNPSGYATAARTAGDAQARDQLERVIECLDRDKCETFQDCITWARLKFEDYFANRVKQLTFTFPEDAMTSSGAPFWSAP

SEQ ID NO: 15624 - DNA, 1640 bp, Panicum virgatum
  misc_feature: Ceres CLONE 1784542
  misc_feature: Encodes the peptide sequence at SEQ ID NO. 15625
acacaagcctccgaccgcatctcttcttcctcgtctcctcccccggagagcagagtctctcaccggcgcgttcagtagaaaccctaaaaaaccccgtctcctcctttcgctcgtggagccatcccctcgccggggggtagggctaagtggtttccgcccgccatggacgccatgcggaagcagctggacgtgctcatgggcgccaaccgcaacggcgacgtggaggaggtcaaccggaactactacgaccgcgacgtctgccgcctcttcctcgcgggtctatgcccgcacgacctcttccagctcacgaaaatggatctcggaccttgttccaagattcactcgcttcagctacggaaagactatgaagaagcgaaatcaaagggatcagagaattttgatagagagcttgaggatatgatagaaaggctcatcgtagagtgtgataggaaaattcaaagggccctgaaacggcttgcggatgacgatgccaaggctgctattgcaatatctgtgtctgaggttactctgacagacgagatactgcagctgtcaaaacaaatcaaggagaaaatgaaagaagttgatacttttgattttgaggggagaactgatgataaaataaaggcccaggaagttgtggaagaactgagagctaaaagggctgatatgcaggctaccctcttgcttgatgcttttaacaaggacagagcttcattacctacacctgctccacctcctcaagtagcagcgccacctcctcctcctcctgatgcccgtactcaggaaatgattaatgaaaagcttaagaaagctgaagagcttggtgaacaaggcatggtagacgaagctcagaaagctttggaagaggcagaagctctgaaaaagctggcaccacggacagagtcaccttcagatccttctaaatatacagctgctgatgttagaattacggatcaaaaattacgcctctgtgacatatgtggtgcatttctgagtgtatatgacaatgatcgacgtcttgctgaccattttggagggaagctacacttgggctacatgctgattcgtgaaaaactgaaagaacttcaggagcagataaataaaagaaggaaggacaaatctgaagacgatagacgatcaagagagcacagcaaggaccgcaacagtcgggcatcaagggatagagatacagaaagaaaagacaggattgactctcgagatggtagaagaggagattatgatagggatcgtgatagacgtcatgacagggatcggcaccatgaccgtgatcgggatagagattatgaccgctcccgcggctacgattcaaggagaagagaacgttcacgatccagggagcgcaggcgccatgagaggtactaaatgctgatccctggctgaaagattttcaagtgctctgggaagatagagttgtgatttgtatttcagaaagttcccactagttactgggttgatgctggcaatctggtgcattctgcatcctttagtactgtttttatataccactgttgtgccaagaacgttcgcattaaagcaaactttggggaaccgacttgacagctaaatgatccgagaatgttttgtgtttaaagtataataaactcgtcagaagttgg

SEQ ID NO: 15625 - protein, 407 aa, Panicum virgatum
  misc_feature: Ceres CLONE 1784542
  misc_feature (1)..(342): Pfam Name: LUC7 Pfam Description: LUC7 N_terminus
MDAMRKQLDVLMGANRNGDVEEVNRNYYDRDVCRLFLAGLCPHDLFQLTKMDLGPCSKIHSLQLRKDYEEAKSKGSENFDRELEDMIERLIVECDRKIQRALKRLADDDAKAAIAISVSEVTLTDEILQLSKQIKEKMKEVDTFDFEGRTDDKIKAQEVVEELRAKRADMQATLLLDAFNKDRASLPTPAPPPQVAAPPPPPPDARTQEMINEKLKKAEELGEQGMVDEAQKALEEAEALKKLAPRTESPSDPSKYTAADVRITDQKLRLCDICGAFLSVYDNDRRLADHFGGKLHLGYMLIREKLKELQEQINKRRKDKSEDDRRSREHSKDRNSRASRDRDTERKDRIDSRDGRRGDYDRDRDRRHDRDRHHDRDRDRDYDRSRGYDSRRRERSRSRERRRHERY

SEQ ID NO: 15626 - DNA, 612 bp, Panicum virgatum
  misc_feature: Ceres CLONE 1784543
  misc_feature: Encodes the peptide sequence at SEQ ID NO. 15627
aaacacaaatccgcagccaagaaagtgcaaattataaagaaaacatcagaattcaaagcagccggaaagcaagctgctagaagagcgaaaagagagagagaaatatatctcagcagcactaagtggcctcctccatggtgttcccttcagtaccggcctacctagatccacctaattggaataaccagcagcaaggccagcagccgagagcgagcgggggtggcgatgcaccagcaccgcttctgcccgtgggtcctccggctccggcggcggctcccgatgcctctggcttgccgagcagctcatcggcggccagtgccgccatggccgcgcacgcgcggcccaactcgatggcggagcgcgcgcggctggcgcggatgccgcagccggagccggcgctcaagtgcccgcgctgcgactccaccaacaccaagttctgctactacaacaactactccctctcccagccccgccacttctgcaaggcgtgccgccgctactgggacgcgcggcggcacgctttgcagcggtggcggggctgggagagggagtagttgttgtcgtagcagaacttggtgttggtggagtcgcagcgcgggctcttgagcgcgg

SEQ ID NO: 15627 - protein, 139 aa, Panicum virgatum
  misc_feature: Ceres CLONE 1784543
  misc_feature (84)..(134): Pfam Name: zf-Dof Pfam Description: Dof domain, zinc finger
  misc_feature: The sequence is a functional homolog of SEQ ID NO 2748 in the 10/374,780 US patent application
  misc_feature: The sequence is a functional homolog of SEQ ID NO 394 in the 10/225,066 US patent application
MVFPSVPAYLDPPNWNNQQQGQQPRASGGGDAPAPLLPVGPPAPAAAPDASGLPSSSSAASAAMAAHARPNSMAERARLARMPQPEPALKCPRCDSTNTKFCYYNNYSLSQPRHFCKACRRYWDARRHALQRWRGWERE

SEQ ID NO: 15628 - DNA, 675 bp, Panicum virgatum
  misc_feature: Ceres CLONE 1784543-R
gttggatgctaaccgaggaggcagcggttcagctgcagcggcggcgtttacgttagggcagaccagtgctgcaacggctaggcaggaaggatcaatgaaggtggaggagagtaacaaaggacaggacatgagcttattacaaaggcagtacatggcggctctacgccacggatcactctgggatggaaatgctggtagcagtggtggcgacggtgctggcaatggcggttctagttggccgatgaacattcctggattcaattcttcatcgacaggtggcggcaatggtagtggcatgttgtagtactccttgtggccaatgtcctaagcaagatggcaatggcattgtccagaggcatgctggttaagtttaagcaaatgctacctaggaaggaggaacaggagatggtcaacccaccggtctgttcatcagctgttattcttcatcaacgactgtagaagcactgctagctcatgatggtcacaggtacagtctaagttaaagttgctcttggttaactccttttctgtcatttggttttgaactcaaaggtgtgcctgcattgtgtccatagcgccacttttctacttttcacactattgctcacagggattaattaatcaaacttggtgcatggggtatactatttgataaggtatatatatttgacacgg

SEQ ID NO: 15629 - DNA, 1753 bp, Panicum virgatum
  misc_feature: Ceres CLONE 1784556
  misc_feature: Encodes the peptide sequence at SEQ ID NO. 15630
actgctctttgttttccttgttccctccttgctcttgttctttgatgattggttggcaactgcatcttaggatttgtttttttttccttttttttatttgccctgctccggtcttgttggtgattcttacctgttttctatgtgggatggcaagctttcctttgttcttttgggccactggattagttgtgacttctttaaccccttgccttatcctgaacttggtctgctcattttctatcaggccggcaatggcaaacggttttcatgaatgttgtggttgctcatggacatcccaaataggagatttaatctcttcaaactatcaggatttcctcaagtttggttgccttttcaaaatagcctttggccgagctggtggattgtggggatgttcttttttcctgctattttgttcatataactgaaaattttctgttctccaaagaaattctatagtttcttgttgctagtaaagcacttttagtgtataatttgtttgcaacttttactgatttcagagttcaccgctgaagactttcttgccctctcatctgcgcttcctgcacttttcccagggtttcatgcagggcaaagcagccggtttccgacgcctgatagccgccggaatctgcgagatctccacgagcagcgtcctcggataaggcagccggcacggcaatgccggttccccttgccccgtatccaactcctccggtgccattcacaccccccaatggggcccaaagccagcttgtctgcaccgggtgccggaatcttctcatgtatccagctggtgcgacgtctgtctgctgtgcagtttgcagcaccgtcaccgccgtgccggctccaggtacgcgcttgaacattttggtttgatgaatctgcgagtaacgcggcatctgaacattgagctacatttgtgctgaattattgtcatactgcccattctttctgttctttttatcaggataagaagtgccatttgctgtatcaataaaattttgcagcttgcaaactgtataggcataggggatgaaagttttattcagtacagagatctagttccaggtttcatgatagtttaaggagatcaaatgggaaacctttgcccattgaagctttacagttttctgaaaatttgctgatgcagtaatactgtaatagcatttggctgctggcctcaaatacatcttttgtggagtaaatttgccacctgaattttgcgcaggaactgagattgcacagttagtttgcggaggataccacactctcctgatgtacatacgtggggcaacaagtgtacaatgttcttgctgccacactgttaatctggctatggaagcgaatcaagtcgcgcatgtaaattgcgggaactgccgtatgctgcttatgtaccagtatggcgctaggtctgtgaaatgtgcagtctgcaattttgtgacatcagttggggcctcacctggtgcagagcagaagcccagcagctgatgttcctgaaaatactgagatcacatatgaaggcagcttctgaaaaggatgctttgagtgcacatgtatagagttcttcgctgaagcaatttttccccctcctttatctccactcttcccatccattctgcgttccttcgatggacctggcgagcccgcggaataatgagagttttgggaaataattagtgctcaacttcgtcgacttgtctgtaaaactgaatgagacatacataaacatatggcgttttgtgcgtttctg

SEQ ID NO: 15630 - protein, 65 aa, Panicum virgatum
  misc_feature: Ceres CLONE 1784556
  misc_feature (27)..(51): Pfam Name: zf-LSD1 Pfam Description: LSD1 zinc finger
  misc_feature: Useful for making plants with modulated oxidative stress sensitivity
MPVPLAPYPTPPVPFTPPNGAQSQLVCTGCRNLLMYPAGATSVCCAVCSTVTAVPAPGTRLNILV

SEQ ID NO: 15631 - DNA, 1552 bp, Panicum virgatum
  misc_feature: Ceres CLONE 1784565
  misc_feature: Encodes the peptide sequence at SEQ ID NO. 15632
aacccacccactggaacggaccgtgcctgctgcgtccagccctggctcccgcgatccactcctctcgagctcgacggaatcccggggggagagagggagaacagcagccggccggccgcagagggcaacagctgcaacccgcgggccgccacccgcaggcaggcaggaagcggcggggggatggggcaggctattcgcaagctcttcgattccttcttctccaccagggagatgagggttgtgatgcttggtttggatgcagctggtaaaacaacaatattgtataggctgcacatgggagaggttctttcaacagtccctacagtgggttttaatgtggagaaagttcagtacaagaatgtagtattcactgtgtgggatgttgggggccaagaaaaactcaggtcgctgtggaagatgtacctcagtaattctgatgcactggtaataactattacatggaagtctatatatacatgcctagcttctcattattctatctggtttttttgtagttctaatctttctcagttcttgctttggactttgcacattgtttatcttcaattgtagctaatatccaaatcacggcatatatgtacatatggtcttaaatctaagaacatttttgaaaaaaaactgcatcggtgaacttattaagctggtgtacagaacagaagtgaagagcatatagttgtcttgcacattgtttattcttcaattgtagctaatatccatatcaaggcatatatgtacatatggtcttaaatctaagaagatttttgaaaaaagaattgcataggtgaacttattaaactggtgtacagaacagaagtgaagagcatatagtcgtcttgctaagtttgtgtttcagctttcgacttgttgcagatatatgtcgttgattctttggacaaagaaaggattggagatgcgagacaggaatttcagacaattatcaaggaccctttgatggcaaacagcataatcttagtattcgcaaacaagcaagacctgagaggtgcgatgagcacagatgaggttagcgaaggactgggattacatgatctcaggaacagaatatggcacatacaggggacctgtgcactccgtggtgagggcctatatgatggccttgactggcttgcatccaccctgaagcagctgcaagaatcaggccatgcaacttcagttgctggcccttccatctaattcaacaaaagtgaactcggtgcctcaaccaattgacacctcatgccgtggctgcctgttgatctgctataagtgctaaaagcccacaggagctccagggcatggtgggggctgccaagtgcccgcagatggaattcgtttgctgcatatgagccaatccacgctgcagtcgcatacctttcttcctagtctcctagatgtttgtaaagccttagatgaaaggacgtttgtgtgtatcgacattgatcttgtcttgtgtgtatacttggagggcaggtgcacgtggtttgtttcggttattgattgtttgtcaataaagatttgctctgtgattcagcat

SEQ ID NO: 15632 - protein, 130 aa, Panicum virgatum
  misc_feature: Ceres CLONE 1784565
  misc_feature (1)..(126): Pfam Name: Arf Pfam Description: ADP-ribosylation factor family
  misc_feature: Useful for making plants with altered terpenoid content
  misc_feature: Useful for making plants with altered alkaloid content
  misc_feature: Useful for making plants with altered lignin content
  misc_feature: Useful for making plants with modulated nitrogen use efficiency
MGQAIRKLFDSFFSTREMRVVMLGLDAAGKTTILYRLHMGEVLSTVPTVGFNVEKVQYKNVVFTVWDVGGQEKLRSLWKMYLSNSDALVITITWKSIYTCLASHYSIWFFCSSNLSQFLLWTLHIVYLQL

SEQ ID NO: 15633 - DNA, 1533 bp, Panicum virgatum
  misc_feature: Ceres CLONE 1784592
  misc_feature: Encodes the peptide sequence at SEQ ID NO. 15634
acagtactagtacaccccttctctctctctcctctcggcttgtgggcagcagcatctgcatctcttgccagccagccagagccagagccagcccagcccagcccaggcttgtactgccgccactcccaatcctagctctagctcgagctctcccttcttctccatcctcaccctcctcctcccttttctttccccttttcctcacaccccctctttccagtttgtgctgtctgctgtgcctccagctaccttttaatttctcccaccgatccaccactcgcctcatgcgcgctcatggccgcagtcttccccacctcaattccgctgtagcacaagcctactactgccgctgctgctactagcgccaaggacaccaagccggccgcgcggcatgcagcagccgggcatgcctccattcttcgggacgccggtgggggtggcccagaacgccgccacgcccgcaccagctccagagggacagcagcagcagcagcagcaggtggacgccagcggcacggcctctgcagcagcagcaggcgaccatgaagcggcagcagggatgtccatgtccgcgggcggcgacgagggcgaccgcggcgggccgtcgggtaaccggtggccgcggcaggagacgctggcgctgctcaagatccggtcggagatggacgccgcgttccgggaggccgccctcaagggacccctctgggaccaaatctccaggtgaggtgcatgcatgaaatctcgctgtccaattcgagctcatctattccttcctcttcattttcattcatcttgcgcccgcggccggtgcccatgttgcacagatcacgaccaacacagtgaatttatttcccaattaaaaatcatacacacatcgctctcctccttcactttccacatcttttttctttcttttaatcctctcccccgttgtgttacctcatcatccgtatatcaaaataaagcacactactagagtaaagtaatagttcagatctgagatggcatcccaattcccaattcctcatatatccaagcaattttcttccaaattgagtagtaacttttttaagaaaaatctcctgttctcaaatggagtggagtggagcggtaaaaggaaaggggaaaagatggagcccgagctagctagctacaagtagtagatgaatgaatgatgcctcctttttctttgagagctacatgtgcgtgtgcatggtgatggatgcaatcccatcctagctgatggcaacgtgcatgcacgagcatgcattgacgaggttaagttagtttgtgcgtggtggccaccaagaattccatatgctgctgctgctgctgcaggaggctggaggccatgggctacaagcgcagcgccaagaagtgccgcgagaagttcgagaacgtcgacaagtactacaagcgcaccaaggacggccgcgccggccgcggcgacggcaaggcttaccgcttcttctccgagctcgaggccctccacggcgcttcttcctcgccggcgtcctctctcgcgccgacacc

SEQ ID NO: 15634 - protein, 105 aa, Panicum virgatum
  misc_feature: Ceres CLONE 1784592
  misc_feature: The sequence is a functional homolog of SEQ ID NO 988 in the 10/374,780 US patent application
  misc_feature: Useful for making plants with modulated nitrogen use efficiency
MPPFFGTPVGVAQNAATPAPAPEGQQQQQQQVDASGTASAAAAGDHEAAAGMSMSAGGDEGDRGGPSGNRWPRQETLALLKIRSEMDAAFREAALKGPLWDQISR

SEQ ID NO: 15635 - DNA, 660 bp, Panicum virgatum
  misc_feature: Ceres CLONE 1784592-R
acgttgttggcggcaacagcaagatgcagtacgagatccagttccagcggccgcagcagggccagaacgcgagcggcggcggcgccgggtcatctggccccggtccggcagcggcaacaagtgggtcattcctgaccatggtccatcactagctgctagctaggacacacacaccaaagcgtacaatacgcgcgtgtgctccttggttgcacaggtacggtaaaagtgggcatgcatgaacatctaccggcgacatcgatcgagagctctccaaagtaaattccggctacatatagctgttcatcatcgttttcatcacctgctcattcccctgcacatacacatacaccgtacatatacagatggtactggggtgtacactacactgtcgcgtagatactatactactgcgtgttaattttaccctgctatatatacagttaccttgtatggtacaaaagcacaaggacattgcttgtctagagctgagggagaataatgtgctcttgcgggaatttctttattttttttgggtatacttttgggcctttcttttttctttccccttttcagaagagttactgaactgtccattatgtaatttataaattcgttattacatatactactgtggttatattaatgactgttaaactatat

SEQ ID NO: 15636 - DNA, 981 bp, Panicum virgatum
  misc_feature: Ceres CLONE 1784621
  misc_feature: Encodes the peptide sequence at SEQ ID NO. 15637
gcgctcgctcgctcgctcacactcggcttccccgcccttatcctgaggccagccagcacccggtcgttccgtgcgccaccaccgcaggtcgccgcaaaccccgtgctcgatcagccgcggcgcaggcaggatggtcagcgagcaagcgccggcggcggaggtggagaagaccgaggcagcggcgcccgcggagagcgaggagcccaaggcagagcagcaggcggcggacgaggcgccggtcgtcgaggacgtcaaggaggacgaggacgaggacgatgacgatgaagacgacgacgacgacgctgatgaaggtgagctcggtgcaggggcaaccgagggctccaggcagagccggagcgagaagaagagccgcaaggccatgatgaagctcggaatgaaacccgtcaccggcgtcagcaggataaccatcaaaagagccaagaacatactgttcgtggtgtccaagcctgacgttttcaagagcccgacgtcggagacgtacgtgatattcggcgaggccaagatagaagacctgagctcgcagctgcaggcccaggccgcgcagcagttcaggatgcaggacctcagcaaggcgatggccaagcaggacgcggcggcagcggcgccggccgacgaggaagaggaggtggacgagaccgggatagagccccgcgacatcgacctcgtcatgacgcaggccagcgtgtcgcgggcaaaggccgtcaaggctctcaaggcgcacgacggcgacatcgtcagcgccatcatggagctcacggcctagacccccgacccgagatgttttcattttggggattcgcaataagatgttttcattgttcaccttcattatggacgttgcatcatgtcagtttccagattagtgtcatcttcatcaagttgttattcgaattatcatttcagtatctttctagaagagtgtcgggtaccatgattagaggcacccaaatcagaggactg

SEQ ID NO: 15637 - protein, 217 aa, Panicum virgatum
  misc_feature: Ceres CLONE 1784621
  misc_feature (75)..(134): Pfam Name: NAC Pfam Description: NAC domain
  misc_feature (178)..(215): Pfam Name: UBA Pfam Description: UBA/TS-N domain
MVSEQAPAAEVEKTEAAAPAESEEPKAEQQAADEAPVVEDVKEDEDEDDDDEDDDDDADEGELGAGATEGSRQSRSEKKSRKAMMKLGMKPVTGVSRITIKRAKNILFVVSKPDVFKSPTSETYVIFGEAKIEDLSSQLQAQAAQQFRMQDLSKAMAKQDAAAAAPADEEEEVDETGIEPRDIDLVMTQASVSRAKAVKALKAHDGDIVSAIMELTA

SEQ ID NO: 15638 - DNA, 1820 bp, Panicum virgatum
  misc_feature: Ceres CLONE 1784622
  misc_feature: Encodes the peptide sequence at SEQ ID NO. 15639
agaaaatcgaacaaaaatcaaacaaacaaataaagaagggaagggaagccaccgtccccccaccgttcccttcccttcccgatcctcctcgcagatctccggcaccggccgccatgaactcctactccggcgaccgctcctcctcctcccgccccaccaccacctccttcgactcctaccagttcgacttcggcatcaaagcttcccgctcctccggctcccgccccctccgcgaccagcgcccgggcgcggccgccaacccctccaccaggccggccaccggcgcctcgtggacgcaccagcccgccaccagcgccaagccgtcgtggacccatcagccgtcccccgccgcggcgtcggcggcggggcccgccggatccggtccgacctccatggtcggcgacatcttcggccggagctggtcctccgccgcgccctcatcgggtctcggcatcccgcaggccaataaccctgccctcttcagcgacctcctcggctccgcgctcggcggctccggctcctcccgcgcccagtccaacgcgccgctcagatccgccgcggcgccgcaggcctccaggcccaccggcgcgaatcccaatgccagcgccagcagctctaccttctcgatgggcggcatggcgagcgcgctcccgaagacgaccggagcgccgatgggctccggtggatacggcgttggtggccggccgatgaagcccgcgggcatggcggcgacggccgccgcgcagccgacggggcagaagaaggatccgtttggctcgatagatccatttgcggcgaagccggggtccatgaatgcggctaagcaggctagttcggtcaagccggatcagggatttggggcgttccagggcgtgagttccagcgccaacgctggatttgggagcttccagagcgctgacgcaggattcggggctttccagagctctggtgccacgaaaccttccagctttacgcctccaccccaatcagctccagcgcctgcccctgcggccgcagcagcgaactctagtgtggatcctttggacaatctgttcgcttcgaccacagctgcaccgactgcaaccgcggcgagcaatggtggtggtgggggtgacatatttggtgagatggatggttgggtcgatgtggaggcagagtttggtggtggtgacagtggtggtgcaaccacagagctggacggcctgccaccgccaccatccggattgacaatatcggctgctaaggccaaagggatggatagttacaagggagagcagtatgctgatgccatcaagtggttgtcttgggctgttgtgctcattgagaaatcagggaaagatgcagacattgtcgaggtgttgtcttcaagggcttcctcatataaggaggttggtgagtacaagaaggccatcgctgactgctctaaggtgctggaccaagataaggagaatgtctcagtgctagtgcagcgtgctctcctttatgaaagcacggagaaatataggcttggggcagaggacctgcgtttggttctgaagattgaccctgcaaataggcttgccaggagtacaattcaccgcttgaacaagttggcagactagggatgtctttctagcgccctgatgtaatattgtactaccactgtactcaatccttggcacgagatttgtgagttgtttttaacactttgctatacctgtggcttttggggaatagttcgcagctatgctgttatcaagtatgaactacaaatttacatacagtatattctttgatttgtataatctatgtattgtatcttatattaatcttgaaaagct

SEQ ID NO: 15639 - protein, 495 aa, Panicum virgatum
  misc_feature: Ceres CLONE 1784622
  misc_feature (413)..(446): Pfam Name: TPR_1 Pfam Description: Tetratricopeptide repeat
  misc_feature: SWISSPROT Homolog: EC 5.2.1.8 Peptidylprolyl isomerase
MNSYSGDRSSSSRPTTTSFDSYQFDFGIKASRSSGSRPLRDQRPGAAANPSTRPATGASWTHQPATSAKPSWTHQPSPAAASAAGPAGSGPTSMVGDIFGRSWSSAAPSSGLGIPQANNPALFSDLLGSALGGSGSSRAQSNAPLRSAAAPQASRPTGANPNASASSSTFSMGGMASALPKTTGAPMGSGGYGVGGRPMKPAGMAATAAAQPTGQKKDPFGSIDPFAAKPGSMNAAKQASSVKPDQGFGAFQGVSSSANAGFGSFQSADAGFGAFQSSGATKPSSFTPPPQSAPAPAPAAAAANSSVDPLDNLFASTTAAPTATAASNGGGGGDIFGEMDGWVDVEAEFGGGDSGGATTELDGLPPPPSGLTISAAKAKGMDSYKGEQYADAIKWLSWAVVLIEKSGKDADIVEVLSSRASSYKEVGEYKKAIADCSKVLDQDKENVSVLVQRALLYESTEKYRLGAEDLRLVLKIDPANRLARSTIHRLNKLAD

SEQ ID NO: 15640 - DNA, 610 bp, Panicum virgatum
  misc_feature: Ceres CLONE 1784646-R
  misc_feature: Encodes the peptide sequence at SEQ ID NO. 15641
actgggcatggcaattttggagcagagaacagccatgaggtcgccgcgaccatgcctactcctggctttgagaatggcagttggaacaccaatgattatcatgtcctaaatgatgcctgcaaggtcgagctcgcatatgatccagctccagtcagctcatctgaagcttgcttgtcatcatttgttccattgtgggaaatctgccccaacatgagcaatagtagcagtatggaggagaaccaccagactaatcctggccttggcacacttacgcaagctttccccaaaagaaccggctttgatgttgtgccctgccctgataggggctcggtcatctcgggctataaggagaagaggaagacaagaagattcgacaggcaggtttggtatgaatcacgcaaagttcgtgctgatggcaggctcaggatcaaggggcgttttgcaaaggcaaaccagacttaaaatttaaggagcaaactgattagcagtgaagataatacaaaatctgccatagttttgtttgccttcagttccatagctgatagctcatagcctcatacacagtttgaatgttgtatgtatattgccgtcatgtggatacacttattgg

SEQ ID NO: 15641 - protein, 153 aa, Panicum virgatum
  misc_feature: Ceres CLONE 1784646-R
  misc_feature (108)..(152): Pfam Name: CCT Pfam Description: CCT motif
TGHGNFGAENSHEVAATMPTPGFENGSWNTNDYHVLNDACKVELAYDPAPVSSSEACLSSFVPLWEICPNMSNSSSMEENHQTNPGLGTLTQAFPKRTGFDVVPCPDRGSVISGYKEKRKTRRFDRQVWYESRKVRADGRLRIKGRFAKANQT

SEQ ID NO: 15642 - DNA, 418 bp, Panicum virgatum
  misc_feature: Ceres CLONE 1784646
aagcgcggcgcggcagcttccggggaggcctgcgcgtctagatttttctgccactgaagcgatgatgattggctccgggtcttctggcgcggcgccggcgccggcggccggaggagagcgtcggcgccaccagccgaacgtcagcgtggcgtgcggtgggctgccgcggcccttcaggccggtgccgggcgcgacaggccctcggcccgggacgccgaggccggggtgtcccgcgggcggcggggcggcgccgtcggggcgagcggagtacaactgatggggcgccggcacgcgggacgcgggcgccgcgggaccccggcgggttaggaactgcaagagcgccagggccgctgctcttgccgcccccggtgaatgtgatggcggcgcaggtgcgggggtggcacgcaccgccagcctc

SEQ ID NO: 15643 - DNA, 743 bp, Panicum virgatum
  misc_feature: Ceres CLONE 1784681
  misc_feature: Encodes the peptide sequence at SEQ ID NO. 15644
aacacctcgtacagttcatcaagtaaagccacatcagatcacacacaatctagctgcagaaatggcgtcgacggtggcgagcctctctaccccggcggcggccttcgcggccgcagacgtagtcccgaggaggaagatcgccggccgcgtctggttccccgtggcgcgtcgcgtcggcttcacggtgaggtcgagcaggccggggacgccgccggggatctcagacaaggtgtcggagagcatcaagaaggcggaggagacgtgcgcggacgagaaggtctccggagagtgcgcggcggcgtgggacgaggtggaggagctcagcgccgcggcgagccacgcccgggacaggctcaaggagaacagcgacccgctggagaactactgcaaggagaaccccgagaccgacgagtgccgcatctatgacaactagaccatgcctgtatccagtggcggagctaggggggctggcaggggccatggccccccctaagcttggtgtaagtctactataatacatatataatgatgattgtataagtataaaattaaagaatacactaatctactgtagacatagaaaactgatttttagttattacctgtgtcaatatattttaactgtatatttcacaaagtaggatctttgagtaatcatgatcatttttatgtttttagctgatataatttgtttgtatctaactttttagatgtcatggatagtataataaacatattcttat

SEQ ID NO: 15644 - protein, 123 aa, Panicum virgatum
  misc_feature: Ceres CLONE 1784681
  misc_feature (53)..(123): Pfam Name: CP12 Pfam Description: CP12 domain
MASTVASLSTPAAAFAAADVVPRRKIAGRVWFPVARRVGFTVRSSRPGTPPGISDKVSESIKKAEETCADEKVSGECAAAWDEVEELSAAASHARDRLKENSDPLENYCKENPETDECRIYDN

SEQ ID NO: 15645 - DNA, 736 bp, Panicum virgatum
  misc_feature: Ceres CLONE 1784682
  misc_feature: Encodes the peptide sequence at SEQ ID NO. 15646
actgctccttccagttcccacctccagcgctgccatgataaagctggccctggaggccggcaaggcgacgccggcgccgcccgtcggcccggcgcttggtgccaagggtgtgaacatcatggctttctgcaaggagtacaatgccaagacggccgagaaggccggctacatcatccccgtcgagatcaccgtcttcgatgacaagagctttactttcatcttgaagacaccaccagcctcagttctgctccttaaggctgcaggtgtcgaaaaaggttcaaaagagccacagcgagaaaaggttggcaaagtaacagcagatcaagtccgtgcgatagctcaagagaagttgccggacttgaactgcaagagcatcgactctgctatgaggatcatcgctggcactgccgctaacatgggcattgatgttgaccctccaatccttcagaagaaggaaaaagttctcttgtagtttgttttgctgggacccgcagatcaaattatcaatcaccttatgtagattctgccttcctttttgttcatcaattcgcagtgattaaagtttttctctggtgtcagtaacctcgttccctaatctagtcatttggtgtagaactgtaatttttatttgccaagtccttcgatataccacatccgagaggaaagggttattccaagcctttgcgcaccaacatttttggagccagtcaagccttgtgcacagcaacatttatcc

SEQ ID NO: 15646 - protein, 145 aa, Panicum virgatum
  misc_feature: Ceres CLONE 1784682
  misc_feature (64)..(132): Pfam Name: Ribosomal_L11 Pfam Description: Ribosomal protein L11, RNA binding domain
  misc_feature (1)..(59): Pfam Name: Ribosomal_L11_N Pfam Description: Ribosomal protein L11, N-terminal domain
MIKLALEAGKATPAPPVGPALGAKGVNIMAFCKEYNAKTAEKAGYIIPVEITVFDDKSFTFILKTPPASVLLLKAAGVEKGSKEPQREKVGKVTADQVRAIAQEKLPDLNCKSIDSAMRIIAGTAANMGIDVDPPILQKKEKVLL

SEQ ID NO: 15647 - DNA, 716 bp, Panicum virgatum
  misc_feature: Ceres CLONE 1784695
  misc_feature: Encodes the peptide sequence at SEQ ID NO. 15648
ccaccactcctccccttccaaccccagcacccggcggcggcggcgagcggcggagatgacgacgagcctgaagaagaaccggaagaagcgcggccacgtgtccgcggggcacggccgcatcggcaagcaccggaagcacccgggaggccgcgggaacgccggtggcatgcaccaccaccgcatcctcttcgacaagtaccacccgggctacttcggcaaggtgggcatgcgctacttccacaagctccgcaacaggttctcctgcccgtcgatcaacgtcgagcggctctggtcgatggtgcccgccgacaaggccgcggaggcggcggccggcgcggacaaggccccgctggtggacgtgacgcagttcggctacttcaaggtgctcggcaaggggatgctgccgcccaagcccatcgtcgtcaaggccaagctcatctccaaggtcgcggagaagaagatcaaggccgccggcggcgccgtcgtgctcaccgcataggtctttttacatcttgtttcgtctatctgtgctaagagaacttatgaatttgttgcggattctgagttttgagaacccccccccctttttttttgtgcacttggtaacgaatgccagttcatttacctgaaatgtttcagattgcctgagatctgttgctgcaagttatgatccgtataattgattcccgatatatcatccagtgctgtttataatt

SEQ ID NO: 15648 - protein, 147 aa, Panicum virgatum
  misc_feature: Ceres CLONE 1784695
  misc_feature (109)..(141): Pfam Name: L15 Pfam Description: Ribosomal protein L15
MTTSLKKNRKKRGHVSAGHGRIGKHRKHPGGRGNAGGMHHHRILFDKYHPGYFGKVGMRYFHKLRNRFSCPSINVERLWSMVPADKAAEAAAGADKAPLVDVTQFGYFKVLGKGMLPPKPIVVKAKLISKVAEKKIKAAGGAVVLTA

SEQ ID NO: 15649 - DNA, 815 bp, Panicum virgatum
  misc_feature: Ceres CLONE 1784738
  misc_feature: Encodes the peptide sequence at SEQ ID NO. 15650
ggaatccagtcacgcgaattccctgaccggtcgtcgtcgtcccatccggctccggcgacctcctgccccttgctcctccaccgccgccgcccgcgggtccagccgagatggggagcacctcctcgatgctcacccagtacgacatcgaggaggtccaggaccactgcaaccacgccttctcgcagcaggagatcgtgtccctgtaccagcgcttctgccagctcgaccgcaacggcggcggcttcgtctcggccgacgagttcatgtccgtccccgagttcgcggtcaatctcctctcccagaggctcctgaggatgctggatgggctcaacttcaaggagtttgtggcgtttttatctgcgtttagcccccgcacaagcctgcagcaaaagattgaatttattttcaaggtttatgacactgactgcaatgggaaggttgcatttgatgacatcttgagcatcttgcgagatctgacgggttcgtttatgacagagcaacagagacagaaagtcttgactcatgtgttagaagaagctggctacacaaaagattcacatttcactgtcccagacttcatgaagattcttggcaattctgagctcaagatggaggtcgaagttcccattgactaataacttaataagtatctgtatagtattgtcatgctgttgctcagagtgtgttcatttatgttagatttggttgatggtttatttatatccttgtaactcaaatcatgatcagagttgtaattaagcatacatctgtacttgctatttggaggtttagttgactctgacatatgctccttt

SEQ ID NO: 15650 - protein, 175 aa, Panicum virgatum
  misc_feature: Ceres CLONE 1784738
  misc_feature (95)..(123): Pfam Name: efhand Pfam Description: EF hand
  misc_feature: SWISSPROT Homolog: EC 1.6.3.1 NAD(P)H oxidase
MGSTSSMLTQYDIEEVQDHCNHAFSQQEIVSLYQRFCQLDRNGGGFVSADEFMSVPEFAVNLLSQRLLRMLDGLNFKEFVAFLSAFSPRTSLQQKIEFIFKVYDTDCNGKVAFDDILSILRDLTGSFMTEQQRQKVLTHVLEEAGYTKDSHFTVPDFMKILGNSELKMEVEVPID

SEQ ID NO: 15651 - DNA, 689 bp, Panicum virgatum
  misc_feature: Ceres CLONE 1784739
  misc_feature: Encodes the peptide sequence at SEQ ID NO. 15652
atctcattccgctttgagcttgcttgcagctccagctcccctcgtctcttggtggctacgccatggccaccgtagtcctgatgagctgcagcctccgcgcgccggcctgcagcggcttatctggcgtccgcgccgccccggcaccggccatcgtcgccatgcccgccgccaagcagcaggttgttggccgcggcgccaggctgcgcgcgcaggccacctacaacgtgaagctcatcacgcccgacggcgaggtagagctgcaggtgcccgacgacgtgtacatcctggaccaggccgaggaggaagggatcgacctgccctactcgtgccgcgcggggtcctgctcctcctgcgccggcaaggtcgtctccggcagcgtcgaccagtccgaccagagcttcctcgaagacgaccaggtcgccggcggctgggtgctcacctgcgccgcctaccccacctccgacgtcgtcatcgagacgcacaaggaggaggagctcacctcctcttcgtaatccgatccagtatatgcggctttcattgcttattaattatctcagctcccttgattatatatatatatatatatatatatatatatatatagtagcatatatctatagctcgagcgatatatatctatatatatatgtatttcatatatatgtataatgcgagctatctgtgtctat

SEQ ID NO: 15652 - protein, 149 aa, Panicum virgatum; identical to SEQ ID NO: 10105
  misc_feature: Ceres CLONE 1784739
  misc_feature (58)..(133): Pfam Name: Fer2 Pfam Description: 2Fe-2S iron-sulfur cluster binding domain

SEQ ID NO: 15653 - DNA, 637 bp, Panicum virgatum
  misc_feature: Ceres CLONE 1784744
  misc_feature: Encodes the peptide sequence at SEQ ID NO. 15654
acttgctgccctgctcatcatacctctgctcaccttccttctgatcgccatcgccggcaagaggccttattctcacctgcaacgcggccatgggcggcggagactgcctccatccccgcccggtggcctgccgctcctcggccacctccacctactgggcagcctgccgcaccgggggctcaggtcgatggccgcgtcgtgcggcctggtcatgctccttcgcctcggccaggtgccaaccgtcgtggcgtcctccgcggccgccgcggaggaggccgtcaagacccgcgacccggccttcgccagccgccccatcctgcgcatggccgaccgcctctactacggccgccgcgacatggtgttcgcgccgtacggcgagcgctggcgcccgctgcgccgcgtctgcgtgacccagcgccgcgtcctccgcttccgcgccgtccgcgagcaggaggccgccgcgctgctcgaccgcgtccgcgtccgcggcgccgtcgtgaacctgagcgacctcctcaacagtgattgtacagtattagtacagtacaagcatatgccatgtacggttcttcatggaggaattcgggatttttatcactaccaatataacatacttttaaacatatcattgtcagtt

SEQ ID NO: 15654 - protein, 211 aa, Panicum virgatum
  misc_feature: Ceres CLONE 1784744
  misc_feature: SWISSPROT Homolog: EC 1.14.13.21 Flavonoid 3'-monooxygenase
LAALLIIPLLTFLLIAIAGKRPYSHLQRGHGRRRLPPSPPGGLPLLGHLHLLGSLPHRGLRSMAASCGLVMLLRLGQVPTVVASSAAAAEEAVKTRDPAFASRPILRMADRLYYGRRDMVFAPYGERWRPLRRVCVTQRRVLRFRAVREQEAAALLDRVRVRGAVVNLSDLLNSDCTVLVQYKHMPCTVLHGGIRDFYHYQYNILLNISLS

SEQ ID NO: 15655 - DNA, 900 bp, Panicum virgatum
  misc_feature: Ceres CLONE 1784762
  misc_feature: Encodes the peptide sequence at SEQ ID NO. 15656
gtctcccgttccccgcagctcagttcaccacacccagtcgctccatacctcgatcggattcggatccatggccaagctcgccgtcctcctcctcgccgtggcggcctccgccaccacactggcgcacgccctcgagcccccgactcggatcaagctgatccggggcgcggacgccggcggcgtgtccggcgacagcatggagtgcgtgtacacggtgttcatccggacggggtcgatctggaaggcggggacggactcgaacatcacgctggagctggtggcggcggacggcaacggcgtggggatctcggacctgccctcctggggcgggctcatggggcccggccactcctacttcgagcgcggcaacctggacatcttcagtggccgcgggccctgcatggcgaagacgccgtgctggatgcgcgtggcctccgacggcacggggccgcaccacggctggtactgcaactacgtcgaggtcaccgtcaccggcccgcaccaggggtgcgcgcagcagctgttcaccgtcgagcagtggctcgccaccgacgccccgccgtacaagctcgaggccgtcgtcgacaactgctccgccgcggctggcgccgccgcggcgtgagcccgtccgtccgggtccggccggccgaggagggagccgccgtttggtgacgcgtcgtaataagctgcgtggggccgttgtgtcacctcgtgattagcgtgcgccacgacacgatgtaatggccggcgatagatgtgcttgctggggtcgtgcagcgagtcgaataatcgggagccgtctcgcgagggacgatcgatgtgtagtgagtaggcttggtgttcttgttgatgcccctttttttttgtggtaaaaagcggatcttgatccgtgttttgatc

SEQ ID NO: 15656 - protein, 184 aa, Panicum virgatum
  misc_feature: Ceres CLONE 1784762
  misc_feature (46)..(170): Pfam Name: PLAT Pfam Description: PLAT/LH2 domain
MAKLAVLLLAVAASATTLAHALEPPTRIKLIRGADAGGVSGDSMECVYTVFIRTGSIWKAGTDSNITLELVAADGNGVGISDLPSWGGLMGPGHSYFERGNLDIFSGRGPCMAKTPCWMRVASDGTGPHHGWYCNYVEVTVTGPHQGCAQQLFTVEQWLATDAPPYKLEAVVDNCSAAAGAAAA

SEQ ID NO: 15657 - DNA, 526 bp, Panicum virgatum
  misc_feature: Ceres CLONE 1784768
  misc_feature: Encodes the peptide sequence at SEQ ID NO. 15658
aaagcactccgcggcagagagggttcgagaaagccaaaaggaaggggcgagcagatttggggagggcgaggcgaaggaagccagccagcgagccggggcaggcatccatggcggactggggccccgtgatcgtggcgacggcgctgttcgtggtgctgacgccgggcctgctctgcacgctgccggggcgcggccgggtggcggagttcggcagcatgcacaccagccccgtcgccatcatcgtccacgccgtcctctacttcgcgctcatcaccatcttcctcatcgccatcgggatccacatctacgccggctagccggcaccagcagccgccggccgatcgatcgagccggggggcgtcgggcggcgtgtgattcgaaactagatctggcttttcctcctgtccctctctctcctgctgatcagttgttcctccccccgctgcgggagtaggactcgatgatttattactactgtgctctgtgctggttgttatggatcaagactttgaatgtgatcttgttt

SEQ ID NO: 15658 - protein, 69 aa, Panicum virgatum
  misc_feature: Ceres CLONE 1784768
  misc_feature: Useful for making plants with altered cell wall content and/or composition
MADWGPVIVATALFVVLTPGLLCTLPGRGRVAEFGSMHTSPVAIIVHAVLYFALITIFLIAIGIHIYAG

SEQ ID NO: 15659 - DNA, 820 bp, Panicum virgatum
  misc_feature: Ceres CLONE 1784770
  misc_feature: Encodes the peptide sequence at SEQ ID NO. 15660
cctttccccttcccgcattcccacccccgagccgcatcgctcgccgcgccgccgctcctcaaccccagacgcaaaccctgctaatctccctcgcgccagcaacgccgcctcctcccgcgccgccacgaggggcagcagcagcgcgcacgcgtgcgacagggagctgggatgggaggcgggcggaagcgcgggcggacgcagcgccgccacttcaagcagggccgcgagaacgtctggaagcacaacccccagcgccctcccgccggcgaagcgggcgaggggcgcgaggggaatccctcgtggcagccctttgccaccgagaacccggccttcgaggagtactacaaggagcagcaaattattcctgaggaagagtgggatgatttcatgagtatgctccgaaagccattacctgccacttttaggattaatgcgagctgtcagttttttcaagatatctgctcacaattggaaaacgacttcagaaaatcattagagactgaggtaagcgatgagcatggagaagatgctatccggcctttgccttggtaccctggtaatcttgcatggcatttgaacttttcccgaatgcaactgaggagaaaccaggcacttgagaggtaaacagaataacagatgctgcatgatatttattttgagagaatcttctgaaatggtagaatgtagtagtcacttagaacttgttatgttttcatgttgatgtttcttgtaagagtttggatttgcagatgtattagctgtgtattcatgtgcaaataaataagagcatctccaagagtttgtcatattttactcggcg

SEQ ID NO: 15660 - protein, 151 aa, Panicum virgatum
  misc_feature: Ceres CLONE 1784770
  misc_feature: SWISSPROT Homolog: EC 2.1.1.29 tRNA (cytosine-5-)-methyltransferase
MGGGRKRGRTQRRHFKQGRENVWKHNPQRPPAGEAGEGREGNPSWQPFATENPAFEEYYKEQQIIPEEEWDDFMSMLRKPLPATFRINASCQFFQDICSQLENDFRKSLETEVSDEHGEDAIRPLPWYPGNLAWHLNFSRMQLRRNQALER

SEQ ID NO: 15661 - DNA, 834 bp, Panicum virgatum
  misc_feature: Ceres CLONE 1784824
  misc_feature: Encodes the peptide sequence at SEQ ID NO. 15662
aactctccactcgcgcataaacaaccgatcctactcccaagcaatgtatccctcggtcccgccggacgcttatcataagttcagcgccggagctccgccaacggcgccgccgccggcagcgtaccagcagcacggggccgtgaacatcatgaacccctcacgccccggcgccgggctgcggacatggtccaccggcctcttccactgcatggacgacccggggaactgtctcatcacatgcctgtgcccctgcatcacgttcgggcagatcgctgacatcgtggacaaaggcacctgctcttgtattgcgagtggactgatctatgggctcatctgcgcctcgacggggatgggctgcctctactcgtgcttctaccggtccaagctgagggccgagtacgacctgggggagggggagtgccccgacttcctggtccactgctgctgcgagcacctggcgctatgccaggagtaccgcgagctcaagaaccacggcttcgacctggggatcggttgggatgccaacatggaccggcagaagcgaggcgttgccggcggcacggtgatgggggcgccggccacgccgctcggcatgatgagataggcgataatggttgtgaaatggcgatatgctttgctcccgtggtcattcgtgttgctacgctgttagcagtttttttctcgtcttgcgacaggagatcagaatgcatgtatttctctctcttttttcccctatcctagagtgcctgtatttaagattttaagctggttgtgtattgcgctacttagtagtatctgtacggtaatctgaagtgtggacagtgtccgggcctg

SEQ ID NO: 15662 - protein, 186 aa, Panicum virgatum
  misc_feature: Ceres CLONE 1784824
  misc_feature (48)..(147): Pfam Name: PLAC8 Pfam Description: PLAC8 family
MYPSVPPDAYHKFSAGAPPTAPPPAAYQQHGAVNIMNPSRPGAGLRTWSTGLFHCMDDPGNCLITCLCPCITFGQIADIVDKGTCSCIASGLIYGLICASTGMGCLYSCFYRSKLRAEYDLGEGECPDFLVHCCCEHLALCQEYRELKNHGFDLGIGWDANMDRQKRGVAGGTVMGAPATPLGMMR

SEQ ID NO: 15663 - DNA, 722 bp, Panicum virgatum
  misc_feature: Ceres CLONE 1784827
  misc_feature: Encodes the peptide sequence at SEQ ID NO. 15664
aggaccaacgtctcgtctcagtcggcagccgagagagttttctccctcggtctcccccgcccccctccacagatcccgattcgatcagccgccatggcccgctcctcttcgcagtcccagtcctccgtcggcggcgccggcgccggcgccggagcccgcccggccaccgttggcccgcgcggcacggccgcagctgccgccggcatgcgccgccgccgcgccgccgccagcgccgggggagggggcttctccggcggcggagggagcaacatgcttcgattctacaccgacgaggccccgggtctgcgcctctcgccaaccatggtgctcgtcatgtcgctgtgcttcatcggattcgtcaccgccctccacgtcttcggcaagctctaccgctcccgcaccgcagcagcctccgcgtgatccatcccatcccatcccatcgcatccctccggcgcgagtatcatcagatcacaaggttttcaatatatcatcatcagtctacttactcttgtcttgcctagctttccttcctgtgctagatctggagggagatgaatggaaccctacaacttaaatgatgccctttcttttgccttgttcatcccctttccttttttagtgcctttttatttactcccagatgcaaagagttgtgcctagtcactgtaatcatggggttgctacaattaattttgcatctcagtaacttagcgtgtgctcc

SEQ ID NO: 15664 - protein, 108 aa, Panicum virgatum
  misc_feature: Ceres CLONE 1784827
  misc_feature (54)..(99): Pfam Name: Sec61_beta Pfam Description: Sec61beta family
MARSSSQSQSSVGGAGAGAGARPATVGPRGTAAAAAGMRRRRAAASAGGGGFSGGGGSNMLRFYTDEAPGLRLSPTMVLVMSLCFIGFVTALHVFGKLYRSRTAAASA

SEQ ID NO: 15665 - DNA, 635 bp, Panicum virgatum
  misc_feature: Ceres CLONE 1784834
  misc_feature: Encodes the peptide sequence at SEQ ID NO. 15666
atctcattccgctttgagcttgcttgcagctccagctcccctcgtctcttggtggctacgccatggccaccgtagtcctgatgagctgcagcctccgcgcgccggcctgcagcggcttatctggcgtccgcgccgccccggcaccggccatcgtcgccatgcccgccgccaagcagcaggttgttggccgcggcgccaggctgcgcgcgcaggccacctacaacgtgaagctcatcacgcccgacggcgaggtagagctgcaggtgcccgacgacgtgtacatcctggaccaggccgaggaggaagggatcgacctgccctactcgtgccgcgcggggtcctgctcctcctgcgccggcaaggtcgtctccggcagcgtcgaccagtccgaccagagcttcctcgaagacgaccaggtcgccggcggctgggtgctcacctgcgccgcctaccccacctccgacgtcgtcatcgagacgcacaaggaggaggagctcacctcctcttcgtaatccgatccagtatatgcggcttccattgcttattaattatctcagctcccttgattatatatatatatatatatatatatatatacatgcgatagcgcgagcgatagatatatatatatatat

SEQ ID NO: 15666 - protein, 149 aa, Panicum virgatum; identical to SEQ ID NO: 10105
  misc_feature: Ceres CLONE 1784834
  misc_feature (58)..(133): Pfam Name: Fer2 Pfam Description: 2Fe-2S iron-sulfur cluster binding domain

SEQ ID NO: 15667 - DNA, 908 bp, Panicum virgatum
  misc_feature: Ceres CLONE 1784851
  misc_feature: Encodes the peptide sequence at SEQ ID NO. 15668
gagagatcggagtcagcaatggagtctaccgcgctaatcgcaccattaccgcttctaacctctcgctcccgttccaaacccctctcccctgcctccatcagagctcgccgccccgcctccattcccttctacggcagcggccgcgtcgtcctattttcccgccgcggccgcgagtacgccggcgttggatccttggtctccgccgccgcagcgactggggaggcagcagatggcggctctgaggtcatcctgctcagtgtccagggtatgatgtgcgacgggtgcgcggcgagcgtgaagcggattctggagagccaaccagaggttacatctgctaccgttgattttaaggaagcaaatgcagttgtgtggacaacagctgaagctagggcatcggataattggcagaagcaatgtggagagaaacttgctaaacacctcggcacttgtggatttgagtctcggctgcaagagtaaggtgaagtcaaacaaagctgatactgaatataagtgatgttatcccatgggttcagcgtcagacgttatcctatgagttcagcgtcagttcaatttccaccatcatctgtgttgcagacttgccgggagccctggagagttttgcaacccaaattccagtgttccatctcatggagctcgggcttagtgccggtgtactagtgcttcctttcacctttctcatgggctttagctagtttgtttggagaggcttttgctgatatactaggctaagatctcaggtcactgttgcaaggcaaaaagtctgcatgtctccattcttcactcctctttattccttattaccgcacagatcatctactttgtccatatttgtatgggtttattggcttcctgtattccaaggccttattcatagtttttattagagt

SEQ ID NO: 15668 - protein, 152 aa, Panicum virgatum
  misc_feature: Ceres CLONE 1784851
  misc_feature (78)..(150): Pfam Name: HMA Pfam Description: Heavy-metal-associated domain
  misc_feature: SWISSPROT Homolog: EC 1.16.1.1 Mercury(II) reductase
MESTALIAPLPLLTSRSRSKPLSPASIRARRPASIPFYGSGRVVLFSRRGREYAGVGSLVSAAAATGEAADGGSEVILLSVQGMMCDGCAASVKRILESQPEVTSATVDFKEANAVVWTTAEARASDNWQKQCGEKLAKHLGTCGFESRLQE

SEQ ID NO: 15669 - DNA, 804 bp, Panicum virgatum
  misc_feature: Ceres CLONE 1784853
  misc_feature: Encodes the peptide sequence at SEQ ID NO. 15670
acccccacaacccgctccggccgccaccgcccgatcgatcgcccggagatcgccggaccccgccgcgaatctaacccctgctgcgttcgtagccttcgacgacgatgtcgggagccggagaggaggacaagaagccggcggagggcggcgcccacatcaatctcaaggtcaagggacaggatggcaatgaggtgttcttccgtatcaagaggtccacccagctgaagaagctgatgaacgcctattgtgaccgccagtctgtggacatgaatgccattgcattcctttttgatggccgcaggcttcgcggtgagcagaccccagatgagctggagatggaggacggcgatgagattgatgccatgcttcaccagaccggaggctacatgcctagtgtttagaaagcccttgtcgcagccttgttttgctgcgctgtgtgctctgccttcagtagtaaactaaagaagtcatgaaggaacttgtgaggctctggccctctgtgtgccattgctgaaggacatcggtagtcttgtgtttagtaagatttggtactttggcgtgtcatgactcgtttatctatcccctaatatatcctcccctgtgtgtactcccaatgatcgcccatggtttgtttatcctgacctggagctgggggtcatggttagttttgtgttgctgaggtgcaggaaaacgtgcgctgcacgtgtcaccactatcatttcgatgtaataagcctgtgatcaccatgagcaggccatggggatatcatggcttttatatctttatatatatattgtttgcatc

SEQ ID NO: 15670 - protein, 98 aa, Panicum virgatum; identical to SEQ ID NO: 12258
  misc_feature: Ceres CLONE 1784853
  misc_feature (21)..(91): Pfam Name: ubiquitin Pfam Description: Ubiquitin family

SEQ ID NO: 15671 - DNA, 809 bp, Panicum virgatum
  misc_feature: Ceres CLONE 1784855
  misc_feature: Encodes the peptide sequence at SEQ ID NO. 15672
gccatctggcattacctctaccagcagctgattgcccatctcaacaaacctcaaggatttcaccagcgctgctagcgatgacgaggtcagcaccggcggcggcggcggcggcggcctccgtcccggcgccgacgaagaagcagcagcacgcggcgctgcggggcagccagctgaagcagctccgcgagatcttcatgcggttcgacatggacggcgacggcagcctgacgcagctggagctggcggcgctgctgcggtcgctgggcctgcgccccacgggggaggaggtgcgcgcgctgctggcggggatggacgccgacggcaacggcgccgtggagttcgacgagctggcggccgccatcgcgcccctgctcaccacgcagacgcacctcgtcgaccaggcccagctgctggaggtgttccgcgccttcgaccgcgacggcaacggcttcatctccgccgccgagctcgcgcgctccatggcgcgcctcggccagccgctcaccttcgaggagctcacgcggatgatgcgcgacgccgacgcagacggcgacggggtcatcagcttccaggagttcgccgccgtcatggccaagtccgcgctcgacttccttggcgtcgcctgatctttctgtcctttccaaccgcgcacgccgtcgcccgcccgcccgccattgattagtagctctccccctccctccattcttaataggatgctcagctagatctagctagtatgacaaagatcatgtaactcatggatcatggctgctaacatgaacgctcaaaatgtgtacatatttttgatc

SEQ ID NO: 15672 - protein, 182 aa, Panicum virgatum
  misc_feature: Ceres CLONE 1784855
  misc_feature (146)..(174): Pfam Name: efhand Pfam Description: EF hand
  misc_feature (110)..(138): Pfam Name: efhand Pfam Description: EF hand
  misc_feature (34)..(62): Pfam Name: efhand Pfam Description: EF hand
  misc_feature: SWISSPROT Homolog: EC 2.7.11.1 Non-specific serine/threonine protein kinase
  misc_feature: Useful for making plants with modulated salt sensitivity
MTRSAPAAAAAAASVPAPTKKQQHAALRGSQLKQLREIFMRFDMDGDGSLTQLELAALLRSLGLRPTGEEVRALLAGMDADGNGAVEFDELAAAIAPLLTTQTHLVDQAQLLEVFRAFDRDGNGFISAAELARSMARLGQPLTFEELTRMMRDADADGDGVISFQEFAAVMAKSALDFLGVA

SEQ ID NO: 15673 - DNA, 621 bp, Panicum virgatum
  misc_feature: Ceres CLONE 1784889
  misc_feature: Encodes the peptide sequence at SEQ ID NO. 15674
acctcgtctatcccatctaaaccaaccgccgccccgccccgccccgcgcccccgcccacccaaacccctccgcctccgccgccgcgatgagctactacggccagcagcagccgcccgtcggcgtgcctcccccgcaagggtaccccgggaaggacgcgtacccaccggccggctacccgcccgcggggtacccgccgccggcgcaggggtacccgccgcaggggtaccctcccgcggggtaccctccgcagcaggggtacccgcagcagggctacccgccgccgtacgcgcagccgccgccgccgccgccgcagcgcccgcagagcagcggagggccctccttcatggagggatgcttggccgccctttgctgctgctgcctgttggaagcctgcttctgagttctaaggatacagcaacatgctcagcaattctgttgcgcgcactttcatataatcgggattgggttgtgaagctgcttcctagctacggagaatacagctactcttatgcaaatcacatctctccgtcctcttatcgatctgtttcttcgttgagatgattgggtgtacttagtggtcccatgaagtttatgtcaccagtggaatccttggtctagcg

SEQ ID NO: 15674 - protein, 104 aa, Panicum virgatum
  misc_feature: Ceres CLONE 1784889
  misc_feature: Useful for making plants with altered cell wall content and/or composition
  misc_feature: Useful for making plants with altered carbohydrate content
MSYYGQQQPPVGVPPPQGYPGKDAYPPAGYPPAGYPPPAQGYPPQGYPPAGYPPQQGYPQQGYPPPYAQPPPPPPQRPQSSGGPSFMEGCLAALCCCCLLEACF

SEQ ID NO: 15675 - DNA, 863 bp, Panicum virgatum
  misc_feature: Ceres CLONE 1784920
  misc_feature: Encodes the peptide sequence at SEQ ID NO. 15676
aaatcaaatcccccacccaaaaccaagagatccaatcgaccaagaccaccacaatgggctccgccagccgcgccgtctcctgcctctgctgcccctgcaagtgcctcgcctgcggcctcttcagctgcctctgcagcatcctcatctccctcctcgtcaccctcggcgtcctcgccctcatcttctacctcatcttccgcccccacatgatcgccgccaccgtcgactccgcctccctcgccacattcaccctctccccgacctcctcgctcgcatacaacctcaccgtcgccatgaccgtgcgcaaccccaacaagcgcgtcggcctctactacgacaacgtcgaggccctcgccttctacaaggaccagcgcttcggctacgacccgctcgacgccttctaccagggcaccgaggcctccacccagctcaagcccgagttccacggacagcagctgctgcagggggacgtcaccgccgcgcagttcaggcaggaccagaccgacggcagcttcgccatcaacgtcggcctcaacgccaagctcagggtcaaggtctgggccttcaaggtccgggggcccaaggccaggatcacctgcaagctcctcgtcccggcgccgggagccaccaacggagccaccttccagcccacagactgcaaagtctggttctgagatctgcttgcatttgcctgcctgctaacaactgctagctagtagttgattctttctgttcttgggtcccgtacccttaattaggcaggcatattcatttcatccatcgatatttactatactagtagtctagtactgtatatacattttgctatacttgttcagacttgagatattcagattctgttc

SEQ ID NO: 15676 - protein, 206 aa, Panicum virgatum; identical to SEQ ID NO: 12956
  misc_feature: Ceres CLONE 1784920
  misc_feature (45)..(182): Pfam Name: Hin1 Pfam Description: Harpin-induced protein 1 (Hin1)

SEQ ID NO: 15677 - DNA, 318 bp, Panicum virgatum
  misc_feature: Ceres CLONE 1784922
  misc_feature: Encodes the peptide sequence at SEQ ID NO. 15678
tgagtttaaagacttggttttgtgttcatgttcaggtgggcacgagctgagcaagagcactggaaacgctggtggccgtgtcgcctgcgggatcatcggactccagggctgagagtgatcaccagactcgagtgccgaaagcgtcgtcgtcgtcgccccccgccgtcaccactggaccagcctaagcatcctttggatacgtgaaataagagcgcctgatctatgatcggcgtgtttgtgttcgctcctgtagcacctaccgatgaactgaatgaaacctgtgttggtctaacgctgtttcacctggacctgtgtttc

SEQ ID NO: 15678 - protein, 36 aa, Panicum virgatum
  misc_feature: Ceres CLONE 1784922
  misc_feature: SWISSPROT Homolog: EC 1.15.1.1 Superoxide dismutase
EFKDLVLCSCSGGHELSKSTGNAGGRVACGIIGLQG

SEQ ID NO: 15679 - DNA, 827 bp, Panicum virgatum
  misc_feature: Ceres CLONE 1784930
  misc_feature: Encodes the peptide sequence at SEQ ID NO. 15680
acacagagcaccaccaccggagcacagagagagctcgggagagagcagagcgccacaggccgtccgatcctccgcgcgaagcagatcagatggctctcgctctctccggctcctccgcgctccgcgccgcgctggcctcgctggcccccgccaggggctacgcggcgtcggcggcgtccggggccatgcggcgcgcggcggccgcggcggaggccgccgccgcgggggaggccaaggaggccgggcgcggcgccgcctccgagatctcctgggtccccgaccccgtcacgggccactaccgccccgccaactgggccgccgccgccgaccccgccgacctccgcgccgcgcacctcgcccgggcgtgagccccgcgcccgcccgcccccacccgtctgacataacataccaacaaaggggaaggtggggtggaggttcgtctggcgtcgtcgtcggccgcgcgcgcgagcgctcgctccgtcacggcggcgggccggcatggccgggaagtcgtctcggttggtcgctgtgggacgctcgacgccgctgcatcatctcggcctcggccaatcgggagatacggtacagggaggagcggaggagcggccgctggtcgccgtggcgtgcgtgcgtgcgtggtgtgggctggacgccctgttctagcttctcgcttgtgctctcctmccagattsggatatatactactacgctgcggagagcgagcagggtttcgctgctgttctacgttttgttaggtgtttttggctccaggacttttttcaaaagtccctattacattaaaaagaatcttactattttataatatc

SEQ ID NO: 15680 - protein, 92 aa, Panicum virgatum; identical to SEQ ID NO: 14861
  misc_feature: Ceres CLONE 1784930
  misc_feature (1)..(90): Pfam Name: LEA_3 Pfam Description: Late embryogenesis abundant protein

SEQ ID NO: 15681 - DNA, 685 bp, Panicum virgatum
  misc_feature: Ceres CLONE 1784941
  misc_feature: Encodes the peptide sequence at SEQ ID NO. 15682
agagcactccactcccacgcaaaccctagcagcggcgccctcctcccctgaggatctccgcgaagcgggctttggtccaagccgtcggagcaactctgatcccagcggcggcgggttggggccgccagcgcagcaggtctgtggcgccggatttgggatcggcgcgatgtcgtgggccgggcccgacgagatcctcctctccacctccctcgccggcttcttggacaagaagcttattgtgctgctaagagatggacggaaactgcttggcaccctgtgctcatttgatcagtttgcaaatgttgttcttcagggtgcttgtgaacgagtaattgttggggagcaatattgtgatgttcctcttggtctatatgtgatacggggagagaatgttgttttgattggagaattggaccgcgaaaaggaggaactccctgctcacatgacatgtgtctcagaagcagaaattagaaaggctgagaaggcggaaagggaagcaagagacctgaaaggcacgatgaggaaacggatggagttcctagacttcgactagattcctcgtatgccatggtagttgctgccccctattgtggccgcgttgtttaaccaggacgcttcgggttgatggaaaacagattctttcgtggcagcgccgcttgatattcccgtctctttgcactttgtc

SEQ ID NO: 15682 - protein, 128 aa, Panicum virgatum
  misc_feature: Ceres CLONE 1784941
  misc_feature (13)..(81): Pfam Name: LSM Pfam Description: LSM domain
MSWAGPDEILLSTSLAGFLDKKLIVLLRDGRKLLGTLCSFDQFANVVLQGACERVIVGEQYCDVPLGLYVIRGENVVLIGELDREKEELPAHMTCVSEAEIRKAEKAEREARDLKGTMRKRMEFLDFD

SEQ ID NO: 15683 - DNA, 968 bp, Panicum virgatum
  misc_feature: Ceres CLONE 1784955
  misc_feature: Encodes the peptide sequence at SEQ ID NO. 15684
gatcggcggcggcggcgggccggcggcgacgatgctgagggcgcggggggcggcgggtgcgctgctccgcctcgccggcgccgcagccggtttccagagtggcggtgcccctcagctcgcgcgcgcggcattcactcgcggcttcctggatctccacaagctggcgaacaaggaggccatcgagaaggagaaggccaggcttaaggatgagatgagtaggggatacttcgcggacatctccgagatccgcaagaaccatggcaagattgcaactgcaagtaaggttatcatcccggaggttgatgctgtgaagtttcctgatctggctgtggagtcccctgatggtggggcattgcacctgcctcttgttgtgcctgctctgcaagatgatgatgttgaggctggtgatggtgtcattcctgatgcttcattggtctgcctttccttccgtgcaagctctcagaaaatgacagagtcatggagttcacctttcctggatgcattcggtgctgacaagaacattcatgtttatgaggtctcatttatagattcttggttattatcattgggtcctgtgagacgagtattcctcaaggtgatgaggaaatctaacaatcctcacagacatgtcgtatatgcttttggggaccattatgacttccggaagaagcttcagattataaaccttcttactggatacatataccttgtcgaccgcgaaggaagaataagatggcgaggctttggatccgcaacagaagaagaggtgtcgtcgctaacggcatctgcctccattttgttagatgaaaaatgagatggggttgctacttcttttttccttgtaacttttggtggatgaaattttgtttcgttgcaacttcaaagtgatttctatcttctcatttggcaaacggaggcattcttttgctgttgttaataagcatgggatggctggttttttggtttcc

SEQ ID NO: 15684 - protein, 260 aa, Panicum virgatum
  misc_feature: Ceres CLONE 1784955
  misc_feature (15)..(256): Pfam Name: ATP-synt_10 Pfam Description: ATP10 protein
MLRARGAAGALLRLAGAAAGFQSGGAPQLARAAFTRGFLDLHKLANKEAIEKEKARLKDEMSRGYFADISEIRKNHGKIATASKVIIPEVDAVKFPDLAVESPDGGALHLPLVVPALQDDDVEAGDGVIPDASLVCLSFRASSQKMTESWSSPFLDAFGADKNIHVYEVSFIDSWLLSLGPVRRVFLKVMRKSNNPHRHVVYAFGDHYDFRKKLQIINLLTGYIYLVDREGRIRWRGFGSATEEEVSSLTASASILLDEK

SEQ ID NO: 15685 - DNA, 722 bp, Panicum virgatum
  misc_feature: Ceres CLONE 1784957
  misc_feature: Encodes the peptide sequence at SEQ ID NO. 15686
agatagccatacccattctgttcccctcccaaacaaaacttgctttgaaatctcgcttcactgcgaacgctgcagcggaggaagaaagaagaagaaaaaaacaattcgtagcggaaatcagcaagcaaaagaaaataatttccataagaaatcgcccaatcccccttcctccttttctcttgaggcttcggaacgtgcggggaacttagccaggatggtggcgatcgagaaccagagccaggtcgcgcgggcggcggcggcggaggcggtgccggcagcggggccgcggatccccaaggaggcgcgacggctgctgcacgacctggcggcggcgtgggcggacgtgtcggactgccgcgcgctccaggtcgtgccgctcaagggcgccatgaccaacgaggtgtaccaggtgcgctggctcaccggcgtcccctccgctggcggcgaggcggaggagccccggggggagagggaggtgaggaaggtgctcgtgcggatatacggcgacggcgtcgacctcttcttcgaccgcgaggacgaggtgcgcaccttcgagtgcatgtcccgccacggccagggtccccgcctcctcggccgcttccccaacggccgcgtcgaggagttcatccacgcaagggtacctactacctactcgataccgcctccttatcaaactacctgctgttgttatatgactagtaaaaagaaattcaagcttggtt

SEQ ID NO: 15686 - protein, 169 aa, Panicum virgatum
  misc_feature: Ceres CLONE 1784957
  misc_feature (1)..(50): Pfam Name: Choline_kin_N Pfam Description: Choline kinase N terminus
  misc_feature: SWISSPROT Homolog: EC 2.7.1.82 Ethanolamine kinase
MVAIENQSQVARAAAAEAVPAAGPRIPKEARRLLHDLAAAWADVSDCRALQVVPLKGAMTNEVYQVRWLTGVPSAGGEAEEPRGEREVRKVLVRIYGDGVDLFFDREDEVRTFECMSRHGQGPRLLGRFPNGRVEEFIHARVPTTYSIPPPYQTTCCCYMTSKKKFKLG

SEQ ID NO: 15687 - DNA, 625 bp, Panicum virgatum
  misc_feature: Ceres CLONE 1785010
  misc_feature: Encodes the peptide sequence at SEQ ID NO. 15688
attcttctgagtgtgctcgatcatcaagcaagcaacaaagcctcccaattattctttcatcatatcatcttccttcatccaagatgtcttgcaactgcggatcatgctgcaactgcagctccaactgcaagtgcagcaagatgtaccctgaccttaacgacaacagcaccggcggcgctcacgccaccatcgtcctcggcgtggcccaggacaagaacactggccacttcgaggcggtagcgtactccggcgagaccgcccacgcctgctggtgccgcaacaactgacactactacccctgcaactgctgatttcgatgggggaacctcaaaacacacctgcatgcatgcatgctagctactacctactactctgcttgtgtgtgacttgatgattgaacaacaataattgatgaacctcgatccatcatgtctcatgtatcggtttggctcccgcctcatcaagcatgcatgcgtcgcctgcccctctgtgtgctttgcgtccgtcctgtgtctgtatgtgttgatcattgcaaagaaaccatgcaagcatacatctctgcatgtgtctctgtaatgatcggtccagagtgatgaatatataaaactggtttgctttatctgcc

SEQ ID NO: 15688 - protein, 67 aa, Panicum virgatum
  misc_feature: Ceres CLONE 1785010
  misc_feature (1)..(64): Pfam Name: Metallothio_2 Pfam Description: Metallothionein
MSCNCGSCCNCSSNCKCSKMYPDLNDNSTGGAHATIVLGVAQDKNTGHFEAVAYSGETAHACWCRNN

SEQ ID NO: 15689 - DNA, 393 bp, Panicum virgatum
  misc_feature: Ceres CLONE 1785028
  misc_feature: Encodes the peptide sequence at SEQ ID NO. 15690
acagctgctaccgcggtctcctctcccatagcaggagtggccggcctgtccttttccctccacacagccgccgccgccgccgcggcggcgcttccctcgtcgcgtccaagatcgagaggagcgtggacgtgcggaggagggcacggccacaggcgaaccgccgtccgcgccatgggctccgcaccgtcgtcgtcgtcgtcgtcgtccccgtcgccgcaaacgccgccaggacaagcccaagagaaagctaactataagtccctgagtgaagatgagtggaagaagcggctgactgaagagcagtattacgtgactcggcagaagggcactttattggtttcttctcctgctttttcctctttattttttaaaaaaatcttaattttttctccg

SEQ ID NO: 15690 - protein, 130 aa, Panicum virgatum
  misc_feature: Ceres CLONE 1785028
  misc_feature: SWISSPROT Homolog: EC 1.8.4.12 Peptide-methionine (R)-S-oxide reductase
TAATAVSSPIAGVAGLSFSLHTAAAAAAAALPSSRPRSRGAWTCGGGHGHRRTAVRAMGSAPSSSSSSSPSPQTPPGQAQEKANYKSLSEDEWKKRLTEEQYYVTRQKGTLLVSSPAFSSLFFKKILIFS

SEQ ID NO: 15691 - DNA, 1022 bp, Panicum virgatum
  misc_feature: Ceres CLONE 1785045
  misc_feature: Encodes the peptide sequence at SEQ ID NO. 15692
atcctcccagtctcccacgacgcgattcccccatttccaccccgaaacctccagccgggccgcccctgaatccccatccttctgcgccgccgccggcagacgcgccgcgaagtctccagaggtaagcccctcgcctctccgctcgactccgctcccaagtcccaagcacgcgggggtgcacccgcgacccccacctcgcaccggacgcgcgctgtcactggatcccgatctcgtccggcccgggccttgggggctcgccggatcgagcgtcgcgcgcgcgcgtggggccctgatccgccgcgccttccctgcaggaatcggaggggggggggggcgaggagcgatggaggaggactcgccgctgacgaagacggtgaagggcgccgtgacggggctcgccgctgggaccatctggggcaccgtcgtcgccacctggtacgacgtgccccgggtggagcgccacgtcgcgctcccgggcctcatccggacgctcaagatgtgcgggacctacggggccaccttcgccaccatcggcggactctacatcggcgtcgagcagctcgtgcagagtcagcgcaagaagcgcgacttcgtcaacggggccgtcggtgcgttcgtcgccggagcctccgtctgcggctacagaggaaagagcattcagtctgccctcatcggaggctcctgcctggcgttcacatctgctgtgctggacattggtggcaatacaacgagagtggacaatggcaaagagtactatccctacacaaccgagaagaagcccgctcattgatttaagcttgtgtacttgtagcacaaatctttcaagccatcagctcggtgaattttaaagctgatgcgcgctgttatgtctgttttgctggtgcacttagttcctctgcaaatccatggcaacttgtttgccgctgatcgagagggatgaacataatgttcaaaataaatctttgatttcctttcttgtgatcattgatgacaataaacgcacgtggcacagtatactgtgt

SEQ ID NO: 15692 - protein, 148 aa, Panicum virgatum; identical to SEQ ID NO: 13035
  misc_feature: Ceres CLONE 1785045
  misc_feature (2)..(129): Pfam Name: Tim17 Pfam Description: Tim17/Tim22/Tim23 family

SEQ ID NO: 15693 - DNA, 721 bp, Panicum virgatum
  misc_feature: Ceres CLONE 1785073
  misc_feature: Encodes the peptide sequence at SEQ ID NO. 15694
taacagctctatgtttatcttttttatcttcaggaagcaatgtgtgaaaaggtacagttcttttgatttcctgactgaagttgtcaacaaggtaccagaccttggtggtgcagactcttgtggggatgaaagaggattacctagaagaagaaagtcaaatggcagtgaccctgagaatgatgaatcaagatccagcaaaatggccataagaagtgcgaacatcagccctagaggccgtgggagaggtcgaggcagggggagagggcggccaccaaccaagagaaaggaagttggttatgtacagtttgaggatgagagcagcatgtttgctgaacaaggggaacccttaccaggagacgagacagttccagagagcaaccatggcaatgaaaacataaaccaaagtgcacaacctccagtagaggctcccccaccagcagctgcgccaggtgcatctaaggtggaagaagcgaataccgaccatcagtcagattggccaatgccagatgctgccactggaaacattggtgtcggtccatctggttttggccatctgacggtgcaggttgatgaggatgaggactacgacaacgaggattagtcatggtcgtcctcattgtatggactaacaggactgttctggtgttgtaaaatgtaaatatagtttgaagtagttgccacagcttagctgtgatggactgctgatgtgatgcagttatgt

SEQ ID NO: 15694 - protein, 199 aa, Panicum virgatum
  misc_feature: Ceres CLONE 1785073
  misc_feature: The sequence is a functional homolog of SEQ ID NO 32 in US patent 7288695
NSSMFIFFIFRKQCVKRYSSFDFLTEVVNKVPDLGGADSCGDERGLPRRRKSNGSDPENDESRSSKMAIRSANISPRGRGRGRGRGRGRPPTKRKEVGYVQFEDESSMFAEQGEPLPGDETVPESNHGNENINQSAQPPVEAPPPAAAPGASKVEEANTDHQSDWPMPDAATGNIGVGPSGFGHLTVQVDEDEDYDNED

SEQ ID NO: 15695 - DNA, 634 bp, Panicum virgatum
  misc_feature: Ceres CLONE 1785080
  misc_feature: Encodes the peptide sequence at SEQ ID NO. 15696
accaccgcatctcacaccccctgagctcagctccaagcagagtcttctccacctcctgtggttagagcgagaggccaggccgtgaaaatgccgatcagcaggatcgccgtcgggagccaccaggaggtgtaccacccgggcgccctcaaggcggcgttcgccgagttcatctccacccttatcttcgtcttcgccggccagggctccggcatggccttcagcaagctgtccgccggcggcgctacgacccccgctggcctgatctcggcggcggtggcgcacgccttcgccctgttcgtggccgtgtcagtcggcgccaacatctccggcggccacgtgaacccggccgttaccttcggcgccaccgaagacgttcgcgcgcagccgccggttcctccgtccgtttgatcagttccgcctcgccgccgtttgagttagtttttttccctcgcaccgcgtgctgcttgcatcgaccaccgccatgtaccatgaacccgtcgaactctccgccgccgctgcgccgctcgccatggtttgcttcgatcagtcgcatcaagttggaactgtaaccgccaccgtgaattccggaccccgtttgcatgcttctgtaaaatttgtgaatttgccggcgagt

SEQ ID NO: 15696 - protein, 106 aa, Panicum virgatum
  misc_feature: Ceres CLONE 1785080
  misc_feature (13)..(106): Pfam Name: MIP Pfam Description: Major intrinsic protein
MPISRIAVGSHQEVYHPGALKAAFAEFISTLIFVFAGQGSGMAFSKLSAGGATTPAGLISAAVAHAFALFVAVSVGANISGGHVNPAVTFGATEDVRAQPPVPPSV

SEQ ID NO: 15697 - DNA, 869 bp, Panicum virgatum
  misc_feature: Ceres CLONE 1785130
  misc_feature: Encodes the peptide sequence at SEQ ID NO. 15698
actctttctcctacctccgccgtccgtctttgcgcccaaaccaacccgccgttcctccggcgcccgccctccacaatggagacctcgttcctccccaccacgcttcccaccgcgaagcccctccctgcgttccgaaccctttccaccgccgcctcgctccgcccacacccgcgcccccgcacctcgaccatccgcgcggccatcacccggggccgcaaggaggagactgtggccaccgtccgcgagcagctggaggggtgctacctcctggcgggcatcaagtacgagggcctaacggtgaagcagctgcagggcatccgcgacgcgctccccgagacctgcagcctgctggtggcgaagaacacgctggtggggaaggccatcgagggcaccccctgggaggcgctcaagccgtgcatgaagggcatgaacgcctggctcttcgtccacaccgaggaggtccccaccgcgctgaagccctaccgcgccttccagaaggaggagcgcgtcgaggagaccaacgacttcgtcggtgccgtcttcgagggcaagttctacgggccgggcgacttcaaggcgctcgagaccatgcccagtcgtgccgaggtgtacgccaagctgctcggcgcgctgcagggccccgctacgtccctcgtcaccacactgcaggcgcccgccagggacgtcgtcgccgtgctctccgcctacgtgcgtaagctcgaggaggaggctggctcagcatagtgcaggtcgcgaaatggttggcatcccatcactctcccttccgtttgtagatttccttgtacctttactggatctcaatcatatttgaattgaatcacattttctatttcacaatttgttgcctg

SEQ ID NO: 15698 - protein, 222 aa, Panicum virgatum
  misc_feature: Ceres CLONE 1785130
  misc_feature (43)..(141): Pfam Name: Ribosomal_L10 Pfam Description: Ribosomal protein L10
METSFLPTTLPTAKPLPAFRTLSTAASLRPHPRPRTSTIRAAITRGRKEETVATVREQLEGCYLLAGIKYEGLTVKQLQGIRDALPETCSLLVAKNTLVGKAIEGTPWEALKPCMKGMNAWLFVHTEEVPTALKPYRAFQKEERVEETNDFVGAVFEGKFYGPGDFKALETMPSRAEVYAKLLGALQGPATSLVTTLQAPARDVVAVLSAYVRKLEEEAGSA

SEQ ID NO: 15699 - DNA, 841 bp, Panicum virgatum
  misc_feature: Ceres CLONE 1785131
  misc_feature: Encodes the peptide sequence at SEQ ID NO. 15700
actacagagctcaactcacactcaccactcgccttcgagcgagctagcacctccccgccctgagccttttgctagtagcgagcgaggtgtcgtgttgggttagggccgggagagacaaagcgggaacatggcggctcagggaaggggcagtgctgctcgtggcagcggcgccgccgtggtggcgctggtcctcctctgcgtgctcctccacggcgaggtcgccgagtcggcggtgtacaccgtcggcgaccgcggcggctggggcttcaactccgccagctggcccaggggcaagcgcttccgcgccggcgacgtgctggtgttcaggtacagcccgaaggcgcacaacgtggtgccggtgagcgcggccgggtacaattcgtgcgccgcgcccaggggcgtccgggcgctcacctccggcaacgaccgcgtcacgctgaagcgcggcgtcaactacttcatctgcagcttcccgggccactgccaggccggcatgaaggtcgccgtcaccgccgcctgagtccgccaggccggccggccgccgccaccgccgctggggctcgacgaccgctctcgcttgatttctcatcctgcccaaacttaagtgctgcaactaattattagacggtttcctgttgttgttcaataataaataccgtgcccgtcgcgtacggcgtgcgtgcgtgttagctgttaggtgttgacagattggctggcgtctgtagagaaggagcaatgtacgtagtacgtactgatgtgtgcgcgcgttcatgtgatgaggaggagcaataaaagcatatgtatacggctgcgtttgtttaatttgggctttgactttgcc

SEQ ID NO: 15700 - protein, 130 aa, Panicum virgatum
  misc_feature: Ceres CLONE 1785131
  misc_feature (45)..(123): Pfam Name: Cu_bind_like Pfam Description: Plastocyanin-like domain
MAAQGRGSAARGSGAAVVALVLLCVLLHGEVAESAVYTVGDRGGWGFNSASWPRGKRFRAGDVLVFRYSPKAHNVVPVSAAGYNSCAAPRGVRALTSGNDRVTLKRGVNYFICSFPGHCQAGMKVAVTAA

SEQ ID NO: 15701 - DNA, 661 bp, Panicum virgatum
  misc_feature: Ceres CLONE 1785143-R
  misc_feature: Encodes the peptide sequence at SEQ ID NO. 15702
gatcaaaaaagcaagtaacaagagaagatgaccgacgttgtgatgaccatcagtactaccacggatttggaaagagaactgaataaatccgacaagctgattgtgctggagttcatggcgccgtggagtgagccatgcaaggtcatgaaggaaccttataggcgaatcgccagagcaagaaaagacagagtcaacttctacacgctcaacgtcgacaagttcaaagatttggcggaggaagctgacgtggaggcgctaccgatgtacgttctactgaagaatgacgatgtgatcgacatggtcgttggcgtcaggaggcacgagctcgagaacgccataaaaaacaatatctaacgactgatccgatcagatcatccatgcgtcgagaacaaacgggaaatgaatgattcatagttaaataagcccactactgtacgtcccatgtgttgtatcacggatactgaaactcgtgtgtgcatgtacacatcctagctagctcagccgccgtagatccccatgttatacattgtacgtatggatctcgattatcgattgtcccatgtttgatttcctaaacttctgtggaagtagatccccatgttatgtatactctggtttgaaacaatttgcaataaatcaatgtctggctagtatatttctt

SEQ ID NO: 15702 - protein, 108 aa, Panicum virgatum
  misc_feature: Ceres CLONE 1785143-R
  misc_feature (4)..(107): Pfam Name: Thioredoxin Pfam Description: Thioredoxin
  misc_feature: SWISSPROT Homolog: EC 1.8.1.8 Protein-disulfide reductase
MTDVVMTISTTTDLERELNKSDKLIVLEFMAPWSEPCKVMKEPYRRIARARKDRVNFYTLNVDKFKDLAEEADVEALPMYVLLKNDDVIDMVVGVRRHELENAIKNNI

SEQ ID NO: 15703 - DNA, 114 bp, Panicum virgatum
  misc_feature: Ceres CLONE 1785143
tcgagatctaactcaggaagcatcccattaaggctcctatttcatgctttacggcaactcgaccccaaatttcttgaataaggcgaaggttcacgcactgccccttcaccctca

SEQ ID NO: 15704 - DNA, 890 bp, Panicum virgatum
  misc_feature: Ceres CLONE 1785150
  misc_feature: Encodes the peptide sequence at SEQ ID NO. 15705
atcacctatgcgcgcgtttgccccgagctccgacgccaaactccagacggacagcatctagctagcccgtccaccaccgcacgccatgagcgccggcgacacgctcgacaagctcgtggtgttcctcgcgaagcgcgatggcatcgacaagctggtcaagacgttccagtacgtgtccaagctggcgcactggggcgccgagtcgtcccgcccggagttcgccaggcgcgccaagagctgggagacggcgtccgggctgagccgcaaggcgttccggtcgggccgcttcctgaccggcttcaacaatctgcgccgcgccccgccgggggagttcggcgcgctcgccgtgctcgccaacgccggcgagatggtctacttcttcttcgaccacttcacgtggctgtcccgcgtgggcgtcctcgagccctggctggcgcggcattccagcttcatctcggcgttcggcgagtccgtcggctacgtgttcttcatcgccatggacctcatcatgatcaggcgggggctgaggcaggagcgcaggatgctgagggaaggcggcggcggcggcaaagacgcggacagggagaaggagctgggcaacatacggatggacagggtgatgcggctcatggcgacggccgccaacgccgccgacctcatcatcggcatcgcggaggtcgagcccaacccgttctgcaaccacgccgtcacgctggggatcagcgggctcgtctccgcgtgggccggctggtacagaaactggccgtcgtagaatgggccggttcggaccacggtcgtattcgtccctcctcctccctttgtacccgcatgatgattttgccaggatttgcgttgtccatttggctaagcaggcataactcatgattcgg

SEQ ID NO: 15705 - protein, 228 aa, Panicum virgatum
  misc_feature: Ceres CLONE 1785150
  misc_feature (7)..(226): Pfam Name: PEX11 Pfam Description: Peroxisomal biogenesis factor 11 (PEX11)
MSAGDTLDKLVVFLAKRDGIDKLVKTFQYVSKLAHWGAESSRPEFARRAKSWETASGLSRKAFRSGRFLTGFNNLRRAPPGEFGALAVLANAGEMVYFFFDHFTWLSRVGVLEPWLARHSSFISAFGESVGYVFFIAMDLIMIRRGLRQERRMLREGGGGGKDADREKELGNIRMDRVMRLMATAANAADLIIGIAEVEPNPFCNHAVTLGISGLVSAWAGWYRNWPS

SEQ ID NO: 15706 - DNA, 762 bp, Panicum virgatum
  misc_feature: Ceres CLONE 1785165
  misc_feature: Encodes the peptide sequence at SEQ ID NO. 15707
ctttttttcgccgccgccgccgccgccgccgctagctccagcgccccgtcggccgcccttctcccgctacaagcttggcgtcaccttcgcctatccaacatgggtaagacacgtggtatgggagctgggcgcaagctcaagacccacagaaggaaccagaggtgggctgacaaagcctacaagaagagccatctcggcaatgagtggaagaaaccttttgctggctcatctcacgcaaagggaatcgtccttgaaaagattggcattgaggctaagcagccaaactctgctatccgtaagtgtgcccgtgtccagcttgtgaagaatgggaagaagattgctgcctttgtgcctaacgacggttgcttgaactacatcgaggaaaatgatgaggtgctgattgctgggttcggtcgtaagggtcatgctgtgggagatattcccggtgtccgtttcaaggtcgtgaaggtctctggagtttccctgctcgccctcttcaaggagaagaaggagaagccgagatcttaaacatctgttcccccttgccttaatgaaatttgtaatgaatgtttttggttctgtggcgcatctgaagggctctctctcatatcggaactcatgttatgcctagatgagccttaccatcagtacgacagttcctgtatggccatagttttgttgagaagcaccagaatttgaattctaaactgcttgtctgtgtgatatatatgatcatgtcttgccatcgtggtgtgtttccgg

SEQ ID NO: 15707 - protein, 142 aa, Panicum virgatum; identical to SEQ ID NO: 12276
  misc_feature: Ceres CLONE 1785165
  misc_feature (8)..(141): Pfam Name: Ribosomal_S12 Pfam Description: Ribosomal protein S12

SEQ ID NO: 15708 - DNA, 866 bp, Panicum virgatum
  misc_feature: Ceres CLONE 1785169
  misc_feature: Encodes the peptide sequence at SEQ ID NO. 15709
ctcttgtcctcgccttgccgtcctcaattccctcggcctcgtttcaaaaaaaaaaaaaaaaatccctcggcctccttccggccttccctgtgctgtgctgtgctgtgcggtgacttgtccgctaccggggggctgccgggctgctgttgactggaggagagatccattcgtccgcacccctcttcttttgccgcatcatgtcggagacgaaggactctaacactgctgctcttgatggaaatcctgaacctatggatcaaagtgaagacaattctatgccatcagctcagcagcaggaagaagcaatcaagaagaagtttggtggactaatgcccaaaaagccaccactcatctcaaaggatcatgagcgggcctactttgattctgctgattgggctctaggaaagcaaggtgttgccaaacccaaaggacccctggaggcacttaggccaaagctgcagccaacacgccaacagcgacaacaacgtgcaaggcgctctatttacacttcgtcagaaaacgaggacggtgatagcgctggtgctgaggatatgaacatcaactgaagtggccctggaatctgcaggacgtgctgcgttgttggagaattcagttccttcgagcaggcagcccgctttcggtcgtcgtgtgggttgatggatataagaaaatcctcgttatcgagtgttgtgttgcgtttcccccattgatggacataggtgacccttgcattagttgcatctccgcatgagatgatggtgtacaaggttaattagtccagcatttggcatgagatagcctatgaaattattatactgcatatttatttgtggataaatatatgctgcgtgttttgttgagcatgt

SEQ ID NO: 15709 - protein, 122 aa, Panicum virgatum
  misc_feature: Ceres CLONE 1785169
  misc_feature (38)..(121): Pfam Name: Lg106 Pfam Description: Lg106-like protein
  misc_feature: Useful for biocontainment applications
MSETKDSNTAALDGNPEPMDQSEDNSMPSAQQQEEAIKKKFGGLMPKKPPLISKDHERAYFDSADWALGKQGVAKPKGPLEALRPKLQPTRQQRQQRARRSIYTSSENEDGDSAGAEDMNIN

SEQ ID NO: 15710 - DNA, 641 bp, Panicum virgatum
  misc_feature: Ceres CLONE 1785174
  misc_feature: Encodes the peptide sequence at SEQ ID NO. 15711
aaagcaaagcgcagcgcagcgaaggctttggttccgcgaccgcgacctcgattcggaacgaagctagggtttaggctttcgcagcgaatcgaggaggggggagggagtaggagcggcggcggcgatggcggcggaggaggacatggcggtgaaggagccgctggatctgatacggctcagccttgacgagcgcatctacgtcaagctccgctccgagcgcgagctccgcggcaagctccatgcatatgatcagcatctcaatatgatacttggagatgtcgaagagacagtgactagtgtagaaattgatgatgagacttatgaggagatcgttcgcacgagcaaacgcactgtcccctttctttttgtccgaggagatggtgtaatactggtttccccacccttgcggacggtgtgaacgttggggcggtgcattctgcagtcctacggggaagttttattgggagaagcaaacggctggtttctgagatggacaggttaagacaggagcattgtgcttcaactatggctgtgtatttgaatccacctcccagtttggtcagcttaatcttatcctgttatcggctcggtaaagtacggcgaacgagaatcacatgatccatcgttccattactttgtgg

SEQ ID NO: 15711 - protein, 97 aa, Panicum virgatum
  misc_feature: Ceres CLONE 1785174
  misc_feature (14)..(92): Pfam Name: LSM Pfam Description: LSM domain
MAAEEDMAVKEPLDLIRLSLDERIYVKLRSERELRGKLHAYDQHLNMILGDVEETVTSVEIDDETYEEIVRTSKRTVPFLFVRGDGVILVSPPLRTV

SEQ ID NO: 15712 - DNA, 657 bp, Panicum virgatum
  misc_feature: Ceres CLONE 1785176
  misc_feature: Encodes the peptide sequence at SEQ ID NO. 15713
aaaccccaactccaaaccaccggcctcccataactccaaccagcacttaaccaccctctcccactgccccccaagaacccaccggcggcaagagccagccacatggcgccgtcgccaccgccgccacggcgagccgcgctgctgctgctgcttctgctgtcgtctcttctgctgctctccgccgtcgcccacgcggcccgggagtcggcggcggcggcgaagtcgagaggccacgcgaagctccgaagccagcacggcgaggtggacggcgaggaggcggcgggcttcacggcggcggacgacgacggcggcccgtgctgcggcggcggaggaggaggcgaagcagaggaggagtgcctggtgaggcggacgctggtggcgcacaccgactacatctacacccagggaagaggccacaactagctactccgagctctcgcagctgcctctgcagatcgagatatctcgatgcaaccttccattccatccagtgtcgatcctgttcatatgatccaatgggaaaaggctgtgttagtgaagatgatcagatgagttttgcgaggctctgttgttgtgcatgaatgtaaccttttctctgaactggtcgatgaattgattgtacggcagttggtgaacgaaaaccgctgcttcgttgtt

SEQ ID NO: 15713 - protein, 106 aa, Panicum virgatum
  misc_feature: Ceres CLONE 1785176
  misc_feature (13)..(105): Pfam Name: PSK Pfam Description: Phytosulfokine precursor protein (PSK)
MAPSPPPPRRAALLLLLLLSSLLLLSAVAHAARESAAAAKSRGHAKLRSQHGEVDGEEAAGFTAADDDGGPCCGGGGGGEAEEECLVRRTLVAHTDYIYTQGRGHN

SEQ ID NO: 15714 - DNA, 874 bp, Panicum virgatum
  misc_feature: Ceres CLONE 1785185
  misc_feature: Encodes the peptide sequence at SEQ ID NO. 15715
acgaggattagttacatacttaccaccaagctcccgcagttaaggaggtcgtagcagagcagcaatggagcctgcggtaggtacgagggcgcccctccctctccccgccgcggggaggcccgtactgctggcggtgcgacctcgcggctggttcgcctccatctccgctccatcctcctcgtccagtggcggcggtggcgggggccgcttctccgcgggcggcggcggcggcgggaggggaggcggggacgactccggcgccggcgctgcagcggccgccgcggctgtggcggctctgggtgagcccgactcgtcggacgccgacgccgacgccatcgtgctccatgtcggggggatgtcgtgcggcggatgcgctgccaaggtcaagcggatcctcgagaaccagcctgaggttgcttcagccacggttgatgttgagaaggctaccgccgttgtgtggacgacacctgaagcgaaggcaaccaaagattggcagaagcagctgggcgagaaactggcgaatcacctcaccacctgcggattccactctcatctgcaaggtgaaggcgaagctgaacagactgatgcttgacctacgcacttgccaatgagtgcccatgaagttcttaccatcgaggcagagtccttgcaggaagacagttcctcctagttgagaagcagtgcaggcataatatggcaatatgcggctccacgaagtagtacatttttactgagagttatacggtttttaataacattattattatgcttgtactctactcgcagtagcagctaccagagcattgttccatcctgaaccacagacatttcattatttgaattgtcaactgtcaatccaagagtttatttgtag

SEQ ID NO: 15715 - protein, 175 aa, Panicum virgatum
  misc_feature: Ceres CLONE 1785185
  misc_feature (92)..(164): Pfam Name: HMA Pfam Description: Heavy-metal-associated domain
  misc_feature: SWISSPROT Homolog: EC 1.16.1.1 Mercury(II) reductase
MEPAVGTRAPLPLPAAGRPVLLAVRPRGWFASISAPSSSSSGGGGGGRFSAGGGGGGRGGGDDSGAGAAAAAAAVAALGEPDSSDADADAIVLHVGGMSCGGCAAKVKRILENQPEVASATVDVEKATAVVWTTPEAKATKDWQKQLGEKLANHLTTCGFHSHLQGEGEAEQTDA

SEQ ID NO: 15716 - DNA, 913 bp, Panicum virgatum
  misc_feature: Ceres CLONE 1785200
  misc_feature: Encodes the peptide sequence at SEQ ID NO. 15717
aagggaagacggcgacctaaaaacgccgccgccgccatggccgatgagaccgacaccaggcccacgtccgccggctcccgggtccgctccgtgccggacgacaacgacagggaggagggcgagatcaccgacgactcctccgcgcccgccccgccgctccaccccgccacgcacccgcttgagcactcctggaccttctggttcgacaacccgttcggaaaatccaagcaggccgcatgggggagctccatccgacccatccacaccttctccaccgtcgaggacttttggggcctttacaataatattcaccaccctagcaagttggctgtgggagcggacttccattgcttcaagaacaagattgaacctaaatgggaagaccctatttgtgctaatggcggtaaatggaccatcatctgtggcaaaggaaaatctgacacactgtggctgcacactctgttggcaatgattggtgaacaattcgattatggtgatgaaatttgtggagcagtcattagcgtgcgtggtaagcaggaaagaataggtatctggaccaaaaatgctgctaatgaagctgcccaggtaagcatcgggaagcagtggaaggaatttctggactacaaggattccattggattcatcgtccatgacgatgcaaagaagatggacaagggtccgaagaaccgttacacggtatgatcctggagctggaattcccagaggagcaggatcggatgatcccgatgcactagaatcttgctgtgagatgtttaggcatgcataatctaacatgtcgcatctatattcctgtactgtactcgataagtaagccacttcttagtgttgttttgtctcactgctgtgcttttactatgtacgcgtgaaactgagctgtgggaataatgtactg

SEQ ID NO: 15717 - protein, 221 aa, Panicum virgatum
  misc_feature: Ceres CLONE 1785200
  misc_feature (1)..(221): Pfam Name: IF4E Pfam Description: Eukaryotic initiation factor 4E
MADETDTRPTSAGSRVRSVPDDNDREEGEITDDSSAPAPPLHPATHPLEHSWTFWFDNPFGKSKQAAWGSSIRPIHTFSTVEDFWGLYNNIHHPSKLAVGADFHCFKNKIEPKWEDPICANGGKWTIICGKGKSDTLWLHTLLAMIGEQFDYGDEICGAVISVRGKQERIGIWTKNAANEAAQVSIGKQWKEFLDYKDSIGFIVHDDAKKMDKGPKNRYTV

SEQ ID NO: 15718 - DNA, 968 bp, Panicum virgatum
  misc_feature: Ceres CLONE 1785247
  misc_feature: Encodes the peptide sequence at SEQ ID NO. 15719
ctcccatttcaatttcaaatcaaccctccctctcgcgcacaccaccggccccgctccccagctcctcgccaccccgcggaaccctaaccctaccctagccgccgcagtcgccgccaccgccgccgctccctccggatgtcgggccccgaagcttccccggcggagcaacccgcttcccccggcgcgtcgcccgaggtgtcggccgagcgcgccccgtccccggcggattcgcagagaaaggaggagctgctgccagtgggggaaaagatctcggaattgaatgaatcacaatcagagcttttagggagactccgagggcttaaggaggatctggagaattggaggagcaatttagacacccaagtgacgaagtacaaagttgaaatctctgatatcaaaagtgcactcaataatgaaatagaacaacttcgttcagatttccaagagctgaggacaaccctcaagaaacagcaggaagatgtgtcacttagcttaatgaatttggggcttcaagatgctactgaaaatgatgtgagcaatggaagtggagaggagaatacaaatgaggacttgtcagctaacttagggagcttgaaattgaatgatgcttccgaaaatcatgatgaaagcagagacgctaaggatgataagactgaaacccctgctgaagatggtgctgccgacaagggcatcgtgggtacatcaagtgatgaatagatcaacgcgggtaaagtgaaacagaagtggagctgcttctcgcatggctcagacgtaggaactttaagaacagtgatagtgtaagttcttgtataagaaaacgagccaatgctccgtgatggctcgcctggtcgtgtagcctgatgttgtggaacgctgttgtgacctactgaggctcaactaaaattgcagtgacagttgtgtaaccaatcgcaagtaatcatctggtatcaccgtattattatcgttcc

SEQ ID NO: 15719 - protein, 193 aa, Panicum virgatum
  misc_feature: Ceres CLONE 1785247
  misc_feature: SWISSPROT Homolog: EC 6.1.1.11 Serine--tRNA ligase
MSGPEASPAEQPASPGASPEVSAERAPSPADSQRKEELLPVGEKISELNESQSELLGRLRGLKEDLENWRSNLDTQVTKYKVEISDIKSALNNEIEQLRSDFQELRTTLKKQQEDVSLSLMNLGLQDATENDVSNGSGEENTNEDLSANLGSLKLNDASENHDESRDAKDDKTETPAEDGAADKGIVGTSSDE

SEQ ID NO: 15720 - DNA, 802 bp, Panicum virgatum
  misc_feature: Ceres CLONE 1785250
  misc_feature: Encodes the peptide sequence at SEQ ID NO. 15721
ggcggcgaatccctagttccccgtccagtccttcggcacccgaattccggcagcggcggcgatggcggcggctgctgcgaggtccggtttccggcgcatgttctccatctcggccttcgcgccgccgaagccgcccgccccgcgaccccaggccgacccctccccgaacctcttcgtctccggattaagcaagcgtaccacaacagatggacttagaaatgcttttgcaaagttcggggaagttgtgcatgctcgagttgtgacagaccgtgtcactggttattcgaaggggtttggctttgtaaggtatgctacaactgaagaggcagggaaaggaatagaaggaatggatggaaagttccttgatggatgggttatttttgcggaatacgctaaacccaaaccagcaccccaggaagcagagatgaactcgcagccacaacaatcatggggtcctccatcaacttcctggggttcacagtagatgaagagctaccagccctctatccagccttggggctcacagtggatcaagaggccatcaattcagcatctaatttatagatattgtgtgtgctgtgcgaggtgtgaatgccctagacgttccgatattcttgccgtgttggattgccgtgttggagtggtcgttggattgccgtgttggagtggccgtttactcgcgtccatgatttccacatgaagaggtagttgtcaatcccaacacggaccaaaacaaatattactatgtgcaacagatgagaaacagttgaaaacctttgcgaataatgtctgccgttgttct

SEQ ID NO: 15721 - protein, 140 aa, Panicum virgatum
  misc_feature: Ceres CLONE 1785250
  misc_feature (37)..(108): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAAAAARSGFRRMFSISAFAPPKPPAPRPQADPSPNLFVSGLSKRTTTDGLRNAFAKFGEVVHARVVTDRVTGYSKGFGFVRYATTEEAGKGIEGMDGKFLDGWVIFAEYAKPKPAPQEAEMNSQPQQSWGPPSTSWGSQ

SEQ ID NO: 15722 - DNA, 484 bp, Panicum virgatum
  misc_feature: Ceres CLONE 1785264
  misc_feature: Encodes the peptide sequence at SEQ ID NO. 15723
acaacaagcagagcagagcctagcttcttcctgaacccaactccatcaaccaacgcaggctcgtcctcgtcctagctagttccaccagcaacatgtcggacaagtgcggcaactgcgactgtgctgacaggagcaagtgcacgaagggcaacagctatggcgtcgtcgtagtcgacaccgagagccgcgtcgagcgccgcgaggaggaggaggtcgccgccggcgagaacgacggcaagtgcaagtgcggcaccagctgcggctgcggcgccagctgcaactgcggccactgaagaagcccgccgcgtcgtccatggcctgcgtgcacactccccatccagtacccatcctgtacctgtatgtacgtcgtcgtgcatgtgaccagcaaccacctgtagctacctacctgtctttgtgacgacgcatgcatgtacgtatctctgttatgtgcaatgaaatctactgtgtgctttgactactaggt

SEQ ID NO: 15723 - protein, 66 aa, Panicum virgatum
  misc_feature: Ceres CLONE 1785264
  misc_feature (2)..(64): Pfam Name: Metallothio_2 Pfam Description: Metallothionein
MSDKCGNCDCADRSKCTKGNSYGVVVVDTESRVERREEEEVAAGENDGKCKCGTSCGCGASCNCGH

SEQ ID NO: 15724 - DNA, 747 bp, Panicum virgatum
  misc_feature: Ceres CLONE 1785274
  misc_feature: Encodes the peptide sequence at SEQ ID NO. 15725
atcaagctcctaaaaacctcgcgagaagcggcgagagcacacttttagtttgttcgctgtttccgccccaaatctgctggggggctcgagccgaattcgagtcgatcgaagcggcggcggcaatggcggggctgtcgctgcggtgcggcgactgtggcgcgcagctgcggagcgtggaggaggcgcaggcgcacgccgaggtcaccaaccacgccaacttcgtcgagtccaccgaggccgtcctcaacctcgtctgctccgactgcggcaagccatgccgctcccagaccgaggtggacctgcacaccaagcgcacgggccacaaggatttcgcggacaagaccgccgaggcggccaagcccatcgatctcgaggcgccgctcaagccggcctcctcctcggaggccatggatgtcgacgccccggcctcggcaagcgaggagcctcaagagatggtggtgccggaggtgaacaaggagatgctcgccgacctcgaggccatggggtttgcctctgcgcgtgccactagggcacttcatttctccggtaatagcaccatcgaaggtgccatcaactggctttctgagcaccaggaagatgcagatattgatgaaatgcctctggtaccagctaattcaaaaacggaggctaacaaacccaacctgactcctgaggaaatgaagattaaagcgcaggagctaagggaacgtgctcgtaagaagaaagaggaagaagagagaagaatgg

SEQ ID NO: 15725 - protein, 208 aa, Panicum virgatum
  misc_feature: Ceres CLONE 1785274
  misc_feature (116)..(153): Pfam Name: UBA Pfam Description: UBA/TS-N domain
  misc_feature: SWISSPROT Homolog: EC 3.1.2.15 Ubiquitin thiolesterase
MAGLSLRCGDCGAQLRSVEEAQAHAEVTNHANFVESTEAVLNLVCSDCGKPCRSQTEVDLHTKRTGHKDFADKTAEAAKPIDLEAPLKPASSSEAMDVDAPASASEEPQEMVVPEVNKEMLADLEAMGFASARATRALHFSGNSTIEGAINWLSEHQEDADIDEMPLVPANSKTEANKPNLTPEEMKIKAQELRERARKKKEEEERRM

SEQ ID NO: 15726 - DNA, 825 bp, Panicum virgatum
  misc_feature: Ceres CLONE 1785287
  misc_feature: Encodes the peptide sequence at SEQ ID NO. 15727
ctgccaccgccgctaggcgttagctcgattctcacatccatggtgctcggcctgtaccccttcgccgatatcgccgccgacggcgctccccgcctcgatgctgccgccggggaggagctcgtccgcgtccagctcgccgctgcgctcgccctcggctcccgcgcgccggagccacccgggaccctattcctaacaaccaggagagtgatttgggtcgttgagggtggcatggcctacgccgtggacttcatcgccgtctcgctccacgccgtgtcgcgcgaccccgaggcgtacccatccccctgcatctacacgcagattgaaacagaagctggttccgatgatgagtctgatgaatcagattctgaagtaaatggagaaatagagctctcaaaagtaactgagatgcgcatcataccatcggatcctggtcaactggacggactctttgaagcattctcccattgtgctgagttgaaccctgatcctaatgctgagagtgacgaggagaatggctgggttcatggtgatgaaggtgatgaagatatgacagatggaagtgatgcagagttttcagatgtcaacccaataggtcaaactaatgaccacgacattactcatgctgtagttgaggtgcagctccagatacaagaccaacgttttcaggatgcagaggaagcagacgaggagagcaacagaaacgggcactagaaatcatcttatttcctctcaagggaatcatgtaattggttcattgtacatcacctttttccctgatgcagcatggcatgcaacatatttgtgaaagggaacatttttatgtgc

SEQ ID NO: 15727 - protein, 223 aa, Panicum virgatum
  misc_feature: Ceres CLONE 1785287
  misc_feature (44)..(119): Pfam Name: ICln_channel Pfam Description: Nucleotide-sensitive chloride conductance regulator (ICln)
MVLGLYPFADIAADGAPRLDAAAGEELVRVQLAAALALGSRAPEPPGTLFLTTRRVIWVVEGGMAYAVDFIAVSLHAVSRDPEAYPSPCIYTQIETEAGSDDESDESDSEVNGEIELSKVTEMRIIPSDPGQLDGLFEAFSHCAELNPDPNAESDEENGWVHGDEGDEDMTDGSDAEFSDVNPIGQTNDHDITHAVVEVQLQIQDQRFQDAEEADEESNRNGH

SEQ ID NO: 15728 - DNA, 570 bp, Panicum virgatum
  misc_feature: Ceres CLONE 1785303
  misc_feature: Encodes the peptide sequence at SEQ ID NO. 15729
aagcaaggcaacatgtcgtcgttgaccaaccgagtgtttggggagccccggccagggtggtactgggcttattacatcattaataatattcaagagttagtaactgctctgacccaagtccatccagtggtgctgatgttctgggcggactggaaccaagcaagcaatgtcatggagcgaccgtactttaatatgggcgttgctaaaaaggatgaggccgtattctgccggctggacttcgacaagtttaaagatgttgtagagaagttcagagtgaaggatctgccaacgttcgtgctgatcaaggagggcgaggagcagcgcagagtcgttggcgccaaggtggaggagctcaacacgactatcaagaacaacatttgatgcgatccatgcatccagaacaaaggcatacacatacccaggatgtacaactacctcattcaccgcagtaaggggggtgcatgtgcgaaacgatcgaccgtgtcttatactccgtccgtcctaaattaagtctgttatggatctgtctacctgtaactcgtgcaatttaagactcaccatcacttgggc

SEQ ID NO: 15729 - protein, 122 aa, Panicum virgatum
  misc_feature: Ceres CLONE 1785303
  misc_feature: SWISSPROT Homolog: EC 1.8.1.9 Thioredoxin-disulfide reductase
MSSLTNRVFGEPRPGWYWAYYIINNIQELVTALTQVHPVVLMFWADWNQASNVMERPYFNMGVAKKDEAVFCRLDFDKFKDVVEKFRVKDLPTFVLIKEGEEQRRVVGAKVEELNTTIKNNI

SEQ ID NO: 15730 - DNA, 473 bp, Panicum virgatum
  misc_feature: Ceres CLONE 1785310
  misc_feature: Encodes the peptide sequence at SEQ ID NO. 15731
atgtcttgcagctgcggatcaagctgcaactgcggctccaactgctggtgcagcaagatgaaccctgaccttgaggagaagaggagcggcggcgctcaggccaccatcgtcctcggcgtgacccctgagaagaaagccggacagttcgaggcggcggcggaatccggcgagaccgcccacgcctgcaagtgcggtaacagctgcagctgcgacccctgctactgctgatttcgatggggaacatccgaacacacgtgcatgcatgctagctactacctactactctgcttgtgtgtgacgatgattgaacaaaaacaaggatgagcctgaaccatcatgtctcatggatcggtttagctccggactcatcgagcatgcatgcgactgcccctgtgtgtgctttgctaccttcccataccctgtgctgcttggcgtccggcctgtgtctgattgtgttgatcattgcaaataaa

SEQ ID NO: 15731 - protein, 75 aa, Panicum virgatum
  misc_feature: Ceres CLONE 1785310
  misc_feature (1)..(75): Pfam Name: Metallothio_2 Pfam Description: Metallothionein
MSCSCGSSCNCGSNCWCSKMNPDLEEKRSGGAQATIVLGVTPEKKAGQFEAAAESGETAHACKCGNSCSCDPCYC

SEQ ID NO: 15732 - DNA, 541 bp, Panicum virgatum
  misc_feature: Ceres CLONE 1785317-R
  misc_feature: Encodes the peptide sequence at SEQ ID NO. 15733
gctggaggtaaaggaggccagaacgtgaacaaggtggaaacggctgttcgcatggtccatattcctactggcattgcagttcgttgctcagaggagaggagtcagctggccaacaaaataaaggctctcagtcggctcaaagcgaagctgctggtgatcgcagaggaacaacgtgcatcggagatcaagcagatccgtggcgacatggtgaaggcggaatgggggcagcaaatacgcaactacgtcttccacccctacaagctcgtcaaggacgtccggacggggtgcgaaacttcagacatcaccggtgtcatggatggtgaactcgacccctttgtcaaagcgtacctccggtacaagctcaccgcagcaacttccagctgatgttgaggagcaaattaaagcgacaagtgactgcccccctatccagtagtatccatttttggtacaaagttcatcgtttttttttcttttcctgatgtagtacactttcattcatagtagtagcatcttatttcctgatttatgaatcgtaacggat

SEQ ID NO: 15733 - protein, 127 aa, Panicum virgatum
  misc_feature: Ceres CLONE 1785317-R
  misc_feature (1)..(93): Pfam Name: RF-1 Pfam Description: Peptidyl-tRNA hydrolase domain
AGGKGGQNVNKVETAVRMVHIPTGIAVRCSEERSQLANKIKALSRLKAKLLVIAEEQRASEIKQIRGDMVKAEWGQQIRNYVFHPYKLVKDVRTGCETSDITGVMDGELDPFVKAYLRYKLTAATSS

SEQ ID NO: 15734 - DNA, 694 bp, Panicum virgatum
  misc_feature: Ceres CLONE 1785317
ctggcgctgctgcgagctcgacgcgaagcgccgcctccatcctcccccggcgtccctatccgtggctctgcgccggcgtcgacgcgtctcgcagcagcatggttgactgcctgcggctgcttctaccggccgcgcggttcaccgccgccgttcactacccctgcggcaccgctcgcagtagcttcaacccggggcgttccaccttctccgtttgtttcaaccgccgccgccgccggagctctgttcctgtgcaatctgcatccgctgggaccggaagcgaatcgagtgttgcagaggaaccggaggctgtcgaatgggctatgcaggatttttacgctttgcggaaggaggttgagttggctgtagagcgtgtcagtgaagtcaggcagtctgcaggtttggaacagcttatggaggagatcgcttcgcttgagaagaagtcagcagatagttctttgtgggatgatccttccaaggcacaggggatactagtttctctgactgaggtcaaagacagagtcaagcttctcaacgattttaagtcacaggttgaagatgcagagaccattgtgaagcttactgaagaattagattccatagatactggtcttcttgaggaggcctcaaagattataaagtcattaaataaggcaatagataactttgagatgacacagcttctttctggacatat

SEQ ID NO: 15735 - DNA, 719 bp, Panicum virgatum
  misc_feature: Ceres CLONE 1785340
  misc_feature: Encodes the peptide sequence at SEQ ID NO. 15736
actacaacacctatgcgttcttcatcgatttggcacagccatcatctagctaggagctcacaattaagttcaaccccgggcagctatatggcggccatcaccggtggaagggcggcgctcgcggtggccgcgctcctctgcgccatggcggcgatggccgctgcgcagcaggcctccaacgtgcgcgcgacgtaccacctgtacaacccggcgcagaacggctgggacctcaaccgcgtcagcgcctactgcgccacgtgggacgccaacaagccgctgtcgtggcggcagaagtacggctggaccgccttctgcgggccctcgggccctaggggccaggcctcctgcggcaagtgcatcaaggtgacgaaccgtgcgacgggcgcatcgaccgtggcgaggatcgtggaccagtgcagcaatggcggcctggacctggacttcgagacggtgttcaagaagattgacaccaacgggcaaggctaccagatgggccacctcaacgtcgactaccagttcgtctcctgctgagtgagctttgcacacgcacgatcgaccgggcaggaacctggaggatgtaataataattaagcatttaagcgcctcgcctagatgtgtggtgtgatggaataaaagggaacacagacccgaatgatggtagctagtaatacacaataaacgacacagaattggactaaataaagcgagatttcgatatt

SEQ ID NO: 15736 - protein, 147 aa, Panicum virgatum; identical to SEQ ID NO: 13885
  misc_feature: Ceres CLONE 1785340
  misc_feature (28)..(147): Pfam Name: Barwin Pfam Description: Barwin family

SEQ ID NO: 15737 - DNA, 418 bp, Panicum virgatum
  misc_feature: Ceres CLONE 1785358
  misc_feature: Encodes the peptide sequence at SEQ ID NO. 15738
gtttctgattctgctctttgtgcttgatcatgacccagcgcaacaaagcctccctattatcttgtcggcaaataatggtccatcggcggcgatgtcttgcagctgctcatcaagctgcttctgcggcaccaactgcctgtgcaacagggtaaaccctgtcctagagaaggatagcgaccgcggcgctcatgccaccatcgtcctctgcgtgacaccagaaaagaaagccggccagtgcgagggctgaggggagtggggccagaccgcccactgctgcaaatgcgctaacgcctgcgtctgcgaccccggcgactggtgagaacgatgggcaacatctcaacgggcctgcccgctggctcgctactaccgacaactctgcttgtgtgtaagcatgatagtaccagaatgacggtgagcc

SEQ ID NO: 15738 - protein, 51 aa, Panicum virgatum
  misc_feature: Ceres CLONE 1785358
  misc_feature (1)..(49): Pfam Name: Metallothio_2 Pfam Description: Metallothionein
MSCSCSSSCFCGTNCLCNRVNPVLEKDSDRGAHATIVLCVTPEKKAGQCEG

SEQ ID NO: 15739 - DNA, 657 bp, Panicum virgatum
  misc_feature: Ceres CLONE 1785376
  misc_feature: Encodes the peptide sequence at SEQ ID NO. 15740
gatcccgagactgctcgaccggagaagtgcacacacaagccagccaaggcccccgagctgctgagatggcacaagccatggcgtccatgaccggcctctcgcagggcgtgctgcccagcaggcgcgccgccagcagggccagggcggccgtcgtcagggcatcggccgagggcgaggccgcggcgcaggctggccgccgcgccgtgctcgggctggtggccaccggcatcgtcggcggcgtcttcacccaggcggtgcgcgccgatgaggccgtcaagaccatcaagatcgggcccccgccgccgccctctgggggacttcccgggaccttgaactctgaccaggccagggacttcgacctcgccttgaaggagcggttctacctgcagccgttgccaccggcggaggccgcagccagggccaagtcgtcggcgcaggacatcctcaacctcaagccactcatcgacaagaaggcttggccgtatgtcatgaacgacctccgcctccgggcctcctacctgcgctacgacctcaacaccgtcatcgcctccaagcccagggaggagaagaagagcctcaaggagctcaccggcaagctcttcagcaccatcgacgatgtaagccatgtcatgccatcgaactgagaacaattggcct

SEQ ID NO: 15740 - protein, 192 aa, Panicum virgatum
  misc_feature: Ceres CLONE 1785376
  misc_feature (12)..(189): Pfam Name: PsbQ Pfam Description: Oxygen evolving enhancer protein 3 (PsbQ)
MAQAMASMTGLSQGVLPSRRAASRARAAVVRASAEGEAAAQAGRRAVLGLVATGIVGGVFTQAVRADEAVKTIKIGPPPPPSGGLPGTLNSDQARDFDLALKERFYLQPLPPAEAAARAKSSAQDILNLKPLIDKKAWPYVMNDLRLRASYLRYDLNTVIASKPREEKKSLKELTGKLFSTIDDVSHVMPSN

SEQ ID NO: 15741 - DNA, 729 bp, Panicum virgatum
  misc_feature: Ceres CLONE 1785395
  misc_feature: Encodes the peptide sequence at SEQ ID NO. 15742
atctcattccgctttgagcttgcttgcagctccagctcccctcgtctcttggtggctacgccatggccaccgtagtcctgatgagctgcagcctccgcgcgccggcctgcagcggcttatctggcgtccgcgccgccccggcaccggccatcgtcgccatgcccgccgccaagcagcaggttgttggccgcggcgccaggctgcgcgcgcaggccacctacaacgtgaagctcatcacgcccgacggcgaggtagagctgcaggtgcccgacgacgtgtacatcctggaccaggccgaggaggaagggatcgacctgccctactcgtgccgcgcggggtcctgctcctcctgcgccggcaaggtcgtctccggcagcgtcgaccagtccgaccagagcttcctcgaagacgaccaggtcgccggcggctgggtgctcacctgcgccgcctaccccacctccgacgtcgtcatcgagacgcacaaggaggaggagctcacctcctcttcgtaatccgatccagtatatgcggctttcattgcttattaattatctcagctcccttgattatatatatatatatatatatatatatatatatatatatagtcgtagcgtgtgatatatatatatatatatatatatatatatatatgtatttgttctatatagatagctctcgctctctctctctctctatatctatctctatatctagagatagatctat

SEQ ID NO: 15742 - protein, 149 aa, Panicum virgatum; identical to SEQ ID NO: 10105
  misc_feature: Ceres CLONE 1785395
  misc_feature (58)..(133): Pfam Name: Fer2 Pfam Description: 2Fe-2S iron-sulfur cluster binding domain

SEQ ID NO: 15743 - DNA, 719 bp, Panicum virgatum
  misc_feature: Ceres CLONE 1785399
  misc_feature: Encodes the peptide sequence at SEQ ID NO. 15744
atagcctgctccctctccctctccctctctctctctagtctagtccaccaccaaccattatggcctccctctcctctgccgccgtcaccgccccttccttcgcggcttcccggcccgcccgcgccgctgccaggcgctctgctgccttcaccgtgcgcgcctcgctcggcaaggccgccggcaccgccgccgtggccgtggccgccagcgccctgctcgccggcggcgccatggcccaggaagtgctgctcggcgccaacggaggcgtcctcgtcttcgagcccagcgagttcaccgtcaaggccggcgaggccatcaccttcaagaacaacgccgggtaccctcacaacgtggtcttcgacgaggacgaggtgcccagcggcgtcgacgccgccaagatctcgcaggaggagtacctcaacgcgccgggcgagacctactccgtcacgctcaccgtgccgggaacctacggattctactgcgagccgcaccaaggagccgggatggtcggcaaggtcaccgtcaactgatgcgatgccatgccatgccatgatcgagtatatatattcaagcgtatctgcgtatgtacgtaccaggctataggctagctagctagagagcttagcttgccactcagatcagtcatcatctccatcttgtaccaagtggcatgcatgcatgcatgcatgcttatacttcatcatatttatatcatcggc

SEQ ID NO: 15744 - protein, 156 aa, Panicum virgatum; identical to SEQ ID NO: 13903
  misc_feature: Ceres CLONE 1785399
  misc_feature (60)..(156): Pfam Name: Copper-bind Pfam Description: Copper binding proteins, plastocyanin/azurin family
  misc_feature: Useful for making plants with modulated nitrogen use efficiency

SEQ ID NO: 15745 - DNA, 670 bp, Panicum virgatum
  misc_feature: Ceres CLONE 1785450
  misc_feature: Encodes the peptide sequence at SEQ ID NO. 15746
atatctccgtgtcttgagcaattaccagcagatcgaatcattctctgctttcaacagtgtctataacaattcaggtctttttggaatttatgcagtcactagcccagacttctcgtcaaaggctgtggatttggcagcaggtgaactccttgagattgcaactcctggaaaagtttcacaagaacagcttgatcgtgctaaagaggcaaccaaatccgccattctgatgaacttggaatcaaggtccatagcatctgaagatattggaagacaggttctgacttatggggaaaggaaacccattgaatatttcctgaaaacagttgaggagatcaccttgaatgacatttcgtcaactgcaaagaagatcatgtcttcaccgcttacaatggcatcatggggcgatgttattcatgttcctagctatgagtctgtcagccgcaagtttcactcaaagtgagagcactcagcattgggcttgcgtgacctgttccaacaattgaaggtgaagcctgcagcggccctcagctggaataactttcctatgcttaatggatagttactgagatagaataatcatgcagtttccagtgccccttccctgcactcattcgctaaacatgatgaaaatctgcaagttccttcgccgctctttcccgagcctggcctt

SEQ ID NO: 15746 - protein, 152 aa, Panicum virgatum
  misc_feature: Ceres CLONE 1785450
  misc_feature: SWISSPROT Homolog: EC 3.4.24.64 Mitochondrial processing peptidase
YLRVLSNYQQIESFSAFNSVYNNSGLFGIYAVTSPDFSSKAVDLAAGELLEIATPGKVSQEQLDRAKEATKSAILMNLESRSIASEDIGRQVLTYGERKPIEYFLKTVEEITLNDISSTAKKIMSSPLTMASWGDVIHVPSYESVSRKFHSK

SEQ ID NO: 15747 - DNA, 501 bp, Panicum virgatum
  misc_feature: Ceres CLONE 1785460
  misc_feature: Encodes the peptide sequence at SEQ ID NO. 15748
agtcagccggatcgctgcgtcgctccgcctcggccttccaccctcgcgcggcgccttcctcggttcgtcggtccagcttgggagatgtcggactctgaggagcaccatttcgagtcgaaggccgacgccggagcctccaagacttacccgcagcaggccggcaccatccgcaagaacggatacatcgtcatcaagggccgcccgtgcaaggttgttgaggtctccacttcaaagacagggaagcacggtcatgcgaaatgccacttcgtggccattgacattttcaatggaaagaagcttgaggatattgtgccatcttcccataactgtgatgtgccccatgtcaaccgtactgactatcagctgattgacatatctgaagatggatttgtaagccttctgactgaaaatggaggcaccaaggatgatctgaggctccctactgatgaaactctgctttcccagattaaagctggattcgatgatgggaaggcttttgtt

SEQ ID NO: 15748 - protein, 138 aa, Panicum virgatum
  misc_feature: Ceres CLONE 1785460
  misc_feature (86)..(136): Pfam Name: eIF-5a Pfam Description: Eukaryotic initiation factor 5A hypusine, DNA-binding OB fold
  misc_feature (30)..(64): Pfam Name: KOW Pfam Description: KOW motif
MSDSEEHHFESKADAGASKTYPQQAGTIRKNGYIVIKGRPCKVVEVSTSKTGKHGHAKCHFVAIDIFNGKKLEDIVPSSHNCDVPHVNRTDYQLIDISEDGFVSLLTENGGTKDDLRLPTDETLLSQIKAGFDDGKAF

SEQ ID NO: 15749 - DNA, 559 bp, Panicum virgatum
  misc_feature: Ceres CLONE 1785491
  misc_feature: Encodes the peptide sequence at SEQ ID NO. 15750
cccgtccaggaactgctgagcctgaggatggtatcgaactcgtgccccccccgcgccgacacggcgcctcgcgcctcacgcccgctctcctccctcctcatcgccccctcgccggccgccgcgcccttcgcatgcgcggcccgcccgtgccggggcctcgcggcggcgtccccgtcgcgcggaccggcggcacagaggtatgaccggcgtgtcggcgacgacgtcatccaccccgacgccagggaccatgaagaaatcggacgacgagtggcatgccatcctcactccagatcagctcaccatccttcgcctcaagggcaccgagtacactggaacaagtgaatatgacaagttttatgatgagggcatttataaatgtgctggatgtggaactcccttatacaaatcatatacaaacttcgactcagggtgtggctggaccgcattctatgagggacttcttggggccatcacaccgacgccggaccacaatgggaagcggacacaaatcacatgtgctgcctgtggaggacatctagggcatatattcaaaggggaa

SEQ ID NO: 15750 - protein, 119 aa, Panicum virgatum
  misc_feature: Ceres CLONE 1785491
  misc_feature (21)..(119): Pfam Name: SelR Pfam Description: SelR domain
  misc_feature: SWISSPROT Homolog: EC 1.8.4.12 Peptide-methionine (R)-S-oxide reductase
  misc_feature: Useful for making plants with modulated heat sensitivity
MTGVSATTSSTPTPGTMKKSDDEWHAILTPDQLTILRLKGTEYTGTSEYDKFYDEGIYKCAGCGTPLYKSYTNFDSGCGWTAFYEGLLGAITPTPDHNGKRTQITCAACGGHLGHIFKG

SEQ ID NO: 15751 - DNA, 714 bp, Panicum virgatum
  misc_feature: Ceres CLONE 1785495
  misc_feature: Encodes the peptide sequence at SEQ ID NO. 15752
acagagctgcacgggcacccctcccctcgtgattgaactcgctggctcgcaaggaacgctccagcttccatctaggatccgaaaggaactggccaccagctcgtccttcgctcctcttcttcccccagtgaggagcaagcttgcgacatctgagctcgtttctttcttgctctgttcttcttcttcatctccggtgggctgcgcgatggcgacggcgttggcgctggcggccgccgtgctcctcttgtcctccacgctcgctgcttcagagttctgcgtgtgccggccggaccagccgacgacggcgcagcagaaggtgatcgacttctcgtacggggacggcgcggactgctcgtcgatcctacagggcggcggctgctacaaccccaacaccgtcgccgcgcactgctcctgggccgccaacagctactaccagaacaacaaggccaagggcgccacctgcgacttcggcggcgccgccgccatctccaccaccgaccccagtttctccgggtgcactttcccttcgactgccaggcaatgtggtcaatttcagattctcagagacaacctagtcaatcagtgtgcccagcacctaacacatttcagccgccctgttaatcatgcatggttcaccgacactagcatgtaatctactactgattaataataggagcaagatgcagcaatcttaaactgaatggtttgcgccgc

SEQ ID NO: 15752 - protein, 148 aa, Panicum virgatum
  misc_feature: Ceres CLONE 1785495
  misc_feature (22)..(106): Pfam Name: X8 Pfam Description: X8 domain
  misc_feature: SWISSPROT Homolog: EC 3.2.1.39 Glucan endo-1,3-beta-D-glucosidase
  misc_feature: Useful for making plants with altered carbohydrate content
  misc_feature: Useful for making plants with altered alkaloid content
MATALALAAAVLLLSSTLAASEFCVCRPDQPTTAQQKVIDFSYGDGADCSSILQGGGCYNPNTVAAHCSWAANSYYQNNKAKGATCDFGGAAAISTTDPSFSGCTFPSTARQCGQFQILRDNLVNQCAQHLTHFSRPVNHAWFTDTSM

SEQ ID NO: 15753 - DNA, 825 bp, Panicum virgatum
  misc_feature: Ceres CLONE 1785538
  misc_feature: Encodes the peptide sequence at SEQ ID NO. 15754
agggtttccccgaccgccgccgcctgcgcctcgttgctttctcagccttcgtgcgaaggcgacccctccctcctccgccggcgcactccgacagccgacgccatggtgaagtactcgcaggagccgggcaacccgaccaagtcggctaaggccatgggcagggatctcagggtccacttcaagaacacaagggagacagcttttgcacttcgcaagctgcctttggccaaggctaagcggtaccttgaggatgttatggctcacaagcaggcaattcccttccggagatactgcaggggtgttggtcgcactgctcaggctaagtctcgccactcaaatgggcagggtcgctggcctgtgaaatcagccaagttcatattggatttgctgaagaatgctgaaagtaacgctgatgtgaaaggcttggatgtcgacaacctttatgtttcacacatccaagtgaaccaagctcagaagcagaggcgtcgcacgtaccgtgctcatgggcgcatcaatccttacatgtcctcaccttgccacattgagttgatcctgtcagagaaggaagagcctgttaagaaagaggctgacaatattgtcgcatcaaggaagcagtgaagtatgttagcttgagcaaggctattttgtcgatgaattatagctgtagctcttatgttgtttttctggcagccttgcctcttgagatgttcctggttacaacgcttgaatcaggatttgctgagcttgatgctgtgcttcagattgtacgagcaattcgtaatactccctccgttcacttttgatagctatatttcatcttgacac

SEQ ID NO: 15754 - protein, 171 aa, Panicum virgatum
  misc_feature: Ceres CLONE 1785538
  misc_feature (17)..(153): Pfam Name: Ribosomal_L22 Pfam Description: Ribosomal protein L22p/L17e
MVKYSQEPGNPTKSAKAMGRDLRVHFKNTRETAFALRKLPLAKAKRYLEDVMAHKQAIPFRRYCRGVGRTAQAKSRHSNGQGRWPVKSAKFILDLLKNAESNADVKGLDVDNLYVSHIQVNQAQKQRRRTYRAHGRINPYMSSPCHIELILSEKEEPVKKEADNIVASRKQ

SEQ ID NO: 15755 - DNA, 665 bp, Panicum virgatum
  misc_feature: Ceres CLONE 1785552
  misc_feature: Encodes the peptide sequence at SEQ ID NO. 15756
attactggtccccatttccacatcggacgtggcctacgcacgaagagcaggagcagccccccgctccgccgccatgaaccccgagtatgactacctcttcaagctgctgctcatcggggactcgggcgtcgggaagtcttgcctgctgctgaggtttgcggatgattcgtatctggaaagctatatcagtaccattggtgttgattttaaaatccgcactgttgagcaagatgggaagacaataaagctgcagatttgggacactgctggccgagagcgctttacgaccatcacaagcagctactaccgtggagctcatggcatcattgtcgtgtatgatgtgactgaccaggagaacttcaacaatgtcaagcagtggctgaatgaaattgacaggtacgccagtgaaaatgtgaacaagcttttggtggggaacaagtgcgacttggctgagagcagagtagtttcttataaggctggcaaggcccttgctgatgagatagggataccgttcctggagactagtgccaaggatgcaacgaatgtggagaaggcattcatgaccatggcaggagagataaagaacaggatggcaagtcaaccagctgctagtggtgctagcaggcctgcaacagtacaaatgcggggtcagcctgttgctcagc

SEQ ID NO: 15756 - protein, 197 aa, Panicum virgatum
  misc_feature: Ceres CLONE 1785552
  misc_feature (10)..(171): Pfam Name: Ras Pfam Description: Ras family
  misc_feature (10)..(124): Pfam Name: Miro Pfam Description: Miro-like protein
  misc_feature: SWISSPROT Homolog: EC 2.7.11.1 Non-specific serine/threonine protein kinase
  misc_feature: Useful for making plants with altered lignin content
  misc_feature: Useful for making plants with modulated oxidative stress sensitivity
  misc_feature: Useful for making plants with altered alkaloid content
MNPEYDYLFKLLLIGDSGVGKSCLLLRFADDSYLESYISTIGVDFKIRTVEQDGKTIKLQIWDTAGRERFTTITSSYYRGAHGIIVVYDVTDQENFNNVKQWLNEIDRYASENVNKLLVGNKCDLAESRVVSYKAGKALADEIGIPFLETSAKDATNVEKAFMTMAGEIKNRMASQPAASGASRPATVQMRGQPVAQ

SEQ ID NO: 15757 - DNA, 802 bp, Panicum virgatum
  misc_feature: Ceres CLONE 1785576
  misc_feature: Encodes the peptide sequence at SEQ ID NO. 15758
accgcgtgccgtgcgcatcgatctagtgcctcttctccaaatccaaccccaccgtccttgctcacgaaggctactagaagagccctccctcctctccggcgccttctcctcggatccccaaccgactccgccgaccagccaggatcgatggaggcgaagatggggcgcttctttgagtccgtgggcagcttcttcaccggcggcgacaacatcccctggtgcgaccgcgacatcatcgccggatgtgaaagagagcttgccgatgctgcaactgaagagcagaggaatgctagccttatgaggctttcttgggcccttgtgcactccaggcagacggacaatgtaaatcgtggaattagcatgcttgaagcttctttgggtaattctggcagccctctggagactagggaaaagctgtacttgttggctgttgggcattacaggaatggtgactactcaaaaagccggcaacttgtggaacgctgtttgcagattcaacctgattggaggcaggctatttctctgaagaaagcaatagaagataaaattgccaaagatggtcttattggaataggaattgcgacaactgctgtgggacttctggttggtggaattgcagctgctgttgccagaaagaagtaagatgaatagatggtgtctctgctcaccaatgaacaaggagacgctttcagctgttctggcctgggtgttaaactggtgatacttgagtcgaattgaaatggattttatgtgtacaaagtgagtagatgataatactatcgaggcaatgtatcctctgttc

SEQ ID NO: 15758 - protein, 164 aa, Panicum virgatum
  misc_feature: Ceres CLONE 1785576
  misc_feature (87)..(120): Pfam Name: TPR_2 Pfam Description: Tetratricopeptide repeat
MEAKMGRFFESVGSFFTGGDNIPWCDRDIIAGCERELADAATEEQRNASLMRLSWALVHSRQTDNVNRGISMLEASLGNSGSPLETREKLYLLAVGHYRNGDYSKSRQLVERCLQIQPDWRQAISLKKAIEDKIAKDGLIGIGIATTAVGLLVGGIAAAVARKK

SEQ ID NO: 15759 - DNA, 1007 bp, Panicum virgatum
  misc_feature: Ceres CLONE 1785676
  misc_feature: Encodes the peptide sequence at SEQ ID NO. 15760
ctcctctgtcgtctgtccagcccttccccagcagcgcgaaaagacgagactaccccgctgccccgaagtcagagtggggactcggggagagggggatagggtagcgcatcgtcgtcgctccggtcgccggcgagcaagcaggcagcgatggcggtggcggagctgtgggagacgctgaagcaggcgatcttcgcgtacacggggctgtccccggtggccttcttcacggccatcgcggtggcggccgcgctgtaccacgtcgtgtcggggctcttcgcgcccccgcccccgccgccgctgcgcccgcgggaggtgcccgaggcggagccgctcccgccgcccgtgcagatgggggaggtctccgaggaggagctccgccagtacgacgggtccgaccccaagaaaccgctcctcatggccatcaagggccagatctacgacgtcacccagagcagaatgttctatggacctggtggaccgtacgctctattcgctggtaaagatgccagcagggccctagccaagatgtccttcgagccagaggacttaaccagcgacatctctggccttggtccctttgagctagacgccctgcaggactgggaatacaagttcatgagcaagtacgtgaaagttggtaccgtcaagaagactgtccccgttgaagatggcaacaccgcaagcacagctgctgctgaaaccagtgagaccgcacccaaggcaccagcaactgaggagaagccgagggaggtagctgcggaggaactgaaggagaaggaagctgccgctgacgaaggcgccaaggagagctagagtgactcagagctccagcggatgcagcaaataaatggacatggtcccgctgggttcgtgtcagggcactgccatcctctcctattagcgacataggctgtgtaatttggatatgtaaacttgaccagcgccatggccctactttgctttatattattattattatcagacgtcattgttggtttggagtacag

SEQ ID NO: 15760 - protein, 221 aa, Panicum virgatum
  misc_feature: Ceres CLONE 1785676
  misc_feature (70)..(167): Pfam Name: Cyt-b5 Pfam Description: Cytochrome b5-like Heme/Steroid binding domain
  misc_feature: Useful for making plants with modulated nitrogen use efficiency
MAVAELWETLKQAIFAYTGLSPVAFFTAIAVAAALYHVVSGLFAPPPPPPLRPREVPEAEPLPPPVQMGEVSEEELRQYDGSDPKKPLLMAIKGQIYDVTQSRMFYGPGGPYALFAGKDASRALAKMSFEPEDLTSDISGLGPFELDALQDWEYKFMSKYVKVGTVKKTVPVEDGNTASTAAAETSETAPKAPATEEKPREVAAEELKEKEAAADEGAKES

SEQ ID NO: 15761 - DNA, 711 bp, Panicum virgatum
  misc_feature: Ceres CLONE 1785710
  misc_feature: Encodes the peptide sequence at SEQ ID NO. 15762
acctaatcccatcgttatctcctcccacccacgccccaaccggacccgtaacaccaaacagtctcaggccccaaccacaggaggagaggtcatccgtcctcgtggagtgaacatcacgagggcgaacaaggaaaaagtatggccgccgccgctgccacggtgacggcggtgtcgagctgcggcaagcgcgagcgcgacattgtggacgccggcatgcccaagaaggggaagagagggacgccgccgccgccggaggaggtggaggcgttcctcgtcgccgcggagagcagcttggcgcggcgcttcgcggccaagtacaactatgacgtcgtcaaggacgctcccagggacgaccggtgcgagtgggtccgcgtgggcccgtgacacgatcgcgcgcacggccgctcggccagtcaaccgtcagatcgaagagaagaggcccacgcccgtgtccgcttcggtgttgatttcccttgtaccgtactagctacttaccgtctgtgtaacacttctcttagctgtaattatgctcacgagagggctaatcatgtgaagcctcaacctcactacgtcagtggatgttccccttgtaacttagcgtttggttaacatgtcgttatgtgtagcccaggaaaaagaagctgtaacttgtcgctatgttcgatttgtcggttccccgttcatatgatcatatcaatgaaacagagtgtt

SEQ ID NO: 15762 - protein, 81 aa, Panicum virgatum
  misc_feature: Ceres CLONE 1785710
  misc_feature (34)..(80): Pfam Name: CDI Pfam Description: Cyclin-dependent kinase inhibitor
MAAAAATVTAVSSCGKRERDIVDAGMPKKGKRGTPPPPEEVEAFLVAAESSLARRFAAKYNYDVVKDAPRDDRCEWVRVGP

SEQ ID NO: 15763 - DNA, 762 bp, Panicum virgatum
  misc_feature: Ceres CLONE 1785722
  misc_feature: Encodes the peptide sequence at SEQ ID NO. 15764
gggttagccaccgcctgtcgtctagccgccgctgcagccccaatccgtcgcgtggttcctcccaggccgcgctgctcggcgcgcacctccgcgacgtccgcactcgcgccgagcacgaccttgctctcgtcgacgtcgacagcaccgagggcagtgaccccgccgcccccgcggacctccgcctcctccccacggcgttcctcgccactcgcgacggccgcgccgacgccgccctgctgatctacaaggaggaggcccgcgatgcgccgttcgacccctgctcccgcaccctctcctaccacctgtgccacttcgacgggcgagaggaggagtcggtgtggtggagcgcggcctaccgccgcctcgtctgcgagctctccgcatgtaggcgcgggacgtggctgacggtgttgcagaggcatctcctgtttcatgattactatccattcatccatgcttgatgcttctactttggaggactggcctacttgaaattaagttaaagcatggggctaatgctggtagtgctttgaagctgatccagccgatcaaggataagttttcaggtgtcgcatatgcagatctatttcagctagctagctccacagccattcaggaagcaggtggccccaaaattcccatgatctatggaagggttgactgaataactggtctgaatataagctggatgaactggatccacttgttgtttgttcactggtctttgaactttacctaatcaagctatgcatatcgcaatgg

SEQ ID NO: 15764 - protein, 67 aa, Panicum virgatum
  misc_feature: Ceres CLONE 1785722
  misc_feature: SWISSPROT Homolog: EC 1.11.1.11 L-ascorbate peroxidase
MLLLWRTGLLEIKLKHGANAGSALKLIQPIKDKFSGVAYADLFQLASSTAIQEAGGPKIPMIYGRVD

SEQ ID NO: 15765 - DNA, 650 bp, Panicum virgatum
  misc_feature: Ceres CLONE 1785724
  misc_feature: Encodes the peptide sequence at SEQ ID NO. 15766
attcagctgagtgtgctcgatcatcaagcaatcaacaaagcctcccaattatcctttcatcagatcatcttccttcttccaaaatgtcttgcagctgcggatcaagctgcaactgcggctccaactgcaagtgcggcaagatgtaccctgaccttgaggagaagagcagcggcggcgctcaggccaccatcgtcctcggcgtggccccggagaagaaggccggccagttcgaggcggcggcggagtccggcgagaccgcccacgcctgcaagtgcggtaacagctgcagctgcgacccctgcaactgctgatttcgatggggaacgtcagaacacacctgcatgcatgctagctactacctactactctgcttgtgtgtgacttgatgattgaacaagaataaggatgagcctgagccatcatgtctcatgtatcggtttggctccggcctcatccagcatgcatgcgtcgtctgcccttatgtgtgctttgctacctccttattaccttgtgcttggcgtccgtcatgtatctgtatgtgtctgtatgtgttgatcatagcaaataaaccatgcaggcatgatgcatctctgcatgtgtctctgtaatgatcggtccagagtgatgaatatataaaactggtttgcttt

SEQ ID NO: 15766 - protein, 75 aa, Panicum virgatum; identical to SEQ ID NO: 12809
  misc_feature: Ceres CLONE 1785724
  misc_feature (1)..(75): Pfam Name: Metallothio_2 Pfam Description: Metallothionein

SEQ ID NO: 15767 - DNA, 830 bp, Panicum virgatum
  misc_feature: Ceres CLONE 1785730
  misc_feature: Encodes the peptide sequence at SEQ ID NO. 15768
gccacgaggattagttaattaattaccaacgacgctcccgtagttaaggaggtcgtagcagctgcttgtagttgtagcagagcagcaatggagcctgcggttggtacgagggcgcccctccttctccccgccgcggggaggcccgtcctgctggcgcgccctcgcggctggttcgcctccatctccgctccgtcctcgtccagcggcggcggcggcggctgcgggggccgtttctctgcgggcggcggcggcggcgggaggggaggcggggacgactccggcgccggcgctgccgcggccgccgcggctgtggcggctctgggtgaggccgactcgtcggacgccgacgccgacgccatcgtactccatgtcggggggatgtcgtgcggcggatgcgctgccaaggtcaagcggatcctcgagaaccagcctgaggttgcttcagccacggttgatgttgagaaggcgaccgcccttgtgtggacgacacctgaagcgaaggctaccaaagattggcagaagcaactgggcgagaaactcgcgaatcacctcaccacctgcggattccagtctcatctgcaaggtgaaggcgaagctgaacagactgattcttgacctacgcacttgccaacgagtgcccgaagtccttaccatcggggcagggtccttctgtattcgagtatgcggcattgcggctctacgaaatactagtacattttgacggagagttatacggtccttctaaataacattattatgcttgtactctactcgcagtagcaactatcagagcattcctccatcctgaaccacagacatttcattatttg

SEQ ID NO: 15768 - protein, 175 aa, Panicum virgatum
  misc_feature: Ceres CLONE 1785730
  misc_feature (92)..(164): Pfam Name: HMA Pfam Description: Heavy-metal-associated domain
MEPAVGTRAPLLLPAAGRPVLLARPRGWFASISAPSSSSGGGGGCGGRFSAGGGGGGRGGGDDSGAGAAAAAAAVAALGEADSSDADADAIVLHVGGMSCGGCAAKVKRILENQPEVASATVDVEKATALVWTTPEAKATKDWQKQLGEKLANHLTTCGFQSHLQGEGEAEQTDS

SEQ ID NO: 15769 - DNA, 926 bp, Panicum virgatum
  misc_feature: Ceres CLONE 1785783
  misc_feature: Encodes the peptide sequence at SEQ ID NO. 15770
aaattgccgttcaaggcctacgcttcttccccttcctctccccctcgaaccctagccaccctgctcacttcccagctcgaacccaccgaggcgcgagtcctcggcatttgggaattggggcagctgatcctgcggtcaaggcggcggagaagagatggtggtggtgtccggcggcggggggaacgcgtgggcaaaggagatgaccatccgccgcaggatagccagcatattcaacaagacgcgggatcatttccctactctgaaggactacaacgattatctggaagaagttgaggatatgactttcaacctgatcgaagggatagatgtcgaagcgattgaagctaaaattgcaagataccagaaggaaaatgcagagcagatattcttgtcccgagcgaaaagggctgaagatcttgcagctgcactaaaagcaagcagaatgaaccctgtaaagaccgacgctgatgatacggctgctgggagttcccagggtattagtggtgggactggagttcagggcgagtatgcgcctgctgctgtccctggcgggctggctcagcctcgtcccatgggtatggctccccaaccaatcggaggtcggtcagatcctcttcaaggagacgatgaggagaccaggagactacgtgcggagagagcagcacgagcaggcggatggactattgaattgagtaagaggagagcaatggaggaggcgtttagtgccatattcctctagatctgatccaaaggcagcaccaggcctggtcgaaagccagtatatttaagatggcctttgaacagtacacgacattggatgatctataattttatcatcttttgtttatcgagttctcgctgtgggtagtgaagttcatatatcagtatcaagcaaacttgcggttgcaaaagcttactttctttgc

SEQ ID NO: 15770 - protein, 194 aa, Panicum virgatum
  misc_feature: Ceres CLONE 1785783
  misc_feature (14)..(193): Pfam Name: MAT1 Pfam Description: CDK-activating kinase assembly factor MAT1
MVVVSGGGGNAWAKEMTIRRRIASIFNKTRDHFPTLKDYNDYLEEVEDMTFNLIEGIDVEAIEAKIARYQKENAEQIFLSRAKRAEDLAAALKASRMNPVKTDADDTAAGSSQGISGGTGVQGEYAPAAVPGGLAQPRPMGMAPQPIGGRSDPLQGDDEETRRLRAERAARAGGWTIELSKRRAMEEAFSAIFL

SEQ ID NO: 15771 - DNA, 882 bp, Panicum virgatum
  misc_feature: Ceres CLONE 1785816
  misc_feature: Encodes the peptide sequence at SEQ ID NO. 15772
agcgtgtcaactaagcgagccatggccttctccgctttctcatggccgtttcgccgccgggggagcggcggcggggctggcggcggggcaagcaagtcatccgccgcggccgcggaggacgaggagcttggcgtgaccgcggagctcctggacttcctccggacgctctcccccgacgccttcaaggccgccgccctccagctccaagggggctctgcggaggcggccgccggcgacctcacaagctggcaggagcggcatgccgtgctcgtgctatccaaagccaaggaactcgccaagattcggtatgatctgtgccctcgtcacatgaaggataagcagttctggaagatatacttcctgctttccaagagttatatctcaccgtacgagctacgtgccatacagaaagaaaagctaagaaggatggagacagaaaatggcaagtcaaaagaagtgattactgttgaggtggagatgcaagaatcaaaaggcagtagagtctcccaaccatcagaaattgatttagaatcccaagcttagtttcacatttatagcttctaacaggatttagcctaggtaatgcaagtagtagtccttttatgattccttcacagatcaatagctcatatgtccagttgcaacggctgttgcactaaacaaattacacatgttcatcagatgatgcatgtcctgttttttgcaactactgccgctgtattggaagtctgctgagtatgctttttgtacactgaaagtagttctttttgtcatcatgtagcatatgctcgttgggtgtgctctgaaccactgacatgtaacttcatggtatcttgagtgtaatcttgatgcgaagaacataaatattgtacctttcatatt

SEQ ID NO: 15772 - protein, 173 aa, Panicum virgatum
  misc_feature: Ceres CLONE 1785816
  misc_feature (64)..(126): Pfam Name: BSD Pfam Description: BSD domain
MAFSAFSWPFRRRGSGGGAGGGASKSSAAAAEDEELGVTAELLDFLRTLSPDAFKAAALQLQGGSAEAAAGDLTSWQERHAVLVLSKAKELAKIRYDLCPRHMKDKQFWKIYFLLSKSYISPYELRAIQKEKLRRMETENGKSKEVITVEVEMQESKGSRVSQPSEIDLESQA

SEQ ID NO: 15773 - DNA, 880 bp, Panicum virgatum
  misc_feature: Ceres CLONE 1785849
  misc_feature: Encodes the peptide sequence at SEQ ID NO. 15774
acacaaaccctcctcgcctccgccgccgctgccccgccgtcgccgaggaggaagaagaagaagaagcgccggccaagatgaagaccattctggcgtcggagaccatggacatcccggaggaggtcacggtgaaggtggccgccaaggtggtgacggtggagggcccccgcgggaagctcacccgcaacttcaagcacctcaacctcgacttccagctgcaggagggcggccgcaagctcaaggtcgacgcctggttcggcacccgccgcaccatggccgccatccgcaccgccatctcccacgtccagaacctcatcaccagcgtcaccaagggataccgctacaagatgaggttcgtctacgcccacttccccatcaacgcctccatcaccaacgccaacaccgccatcgagatcaggaacttcctgggcgagaagaaggtcaggaaggtggacatgcttgagggtgtgaccatcttgcggtccgagaaggtcaaggatgagctcatcctcgacggcaacgacatcgagctcgtctctcgctctgccgccctcatcaaccagaaatgccatgtgaagaacaaggatatcagaaagttcttggatggcatctacgtcagtgacaagggtgccattaacgaggagcagtgagcttgcctagtcattagctaaaaatgcctggagacggtcctgaagtgctgtttctgtatgctgtgtttctatcatcctttgggttgaaattttctgagactgaattttgtactgggttaggatgtgttatggagcatgctatcttatcctacatatcttcgtctctgtttaagagtctgaaccgtatttatcatcccctaaagatagttgactgcaaggattcgtggttg

SEQ ID NO: 15774 - protein, 190 aa, Panicum virgatum
  misc_feature: Ceres CLONE 1785849
  misc_feature (98)..(177): Pfam Name: Ribosomal_L6 Pfam Description: Ribosomal protein L6
  misc_feature (12)..(86): Pfam Name: Ribosomal_L6 Pfam Description: Ribosomal protein L6
MKTILASETMDIPEEVTVKVAAKVVTVEGPRGKLTRNFKHLNLDFQLQEGGRKLKVDAWFGTRRTMAAIRTAISHVQNLITSVTKGYRYKMRFVYAHFPINASITNANTAIEIRNFLGEKKVRKVDMLEGVTILRSEKVKDELILDGNDIELVSRSAALINQKCHVKNKDIRKFLDGIYVSDKGAINEEQ

SEQ ID NO: 15775 - DNA, 455 bp, Panicum virgatum
  misc_feature: Ceres CLONE 1785864
  misc_feature: Encodes the peptide sequence at SEQ ID NO. 15776
atctatcgagccagccagccctccttccatccttcctgccgcctctcctcgcctgctgcgcgcgtctctctgctctcctaaggagatctcgcgcaccccggaaaccagtcgacccgtctcgtcttcgtcgcagatgggcggcctccggatgaatttcgtcaccgccgccgccgtggacgccgcgctcgtggcgtccgccgccgccgccatcgaggcgcccggcccggggcccgcctccgacgccggcgcaggggaggccctcccggctgcgtccctcgccaacgtctgcttctgatacctcttctgatatcatgctcggccgttccccgtggttcctggagatataatgattcgatttggtctgatgctagtgcttgtctctgtgttgtcgagaggatgttggtgggcgtgtgtatggacaagttctgcggcggtgggagagtgcgtcatccctc

SEQ ID NO: 15776 - protein, 53 aa, Panicum virgatum
  misc_feature: Ceres CLONE 1785864
  misc_feature: Useful for making plants with altered carbohydrate content
MGGLRMNFVTAAAVDAALVASAAAAIEAPGPGPASDAGAGEALPAASLANVCF

SEQ ID NO: 15777 - DNA, 694 bp, Panicum virgatum
  misc_feature: Ceres CLONE 1785881
  misc_feature: Encodes the peptide sequence at SEQ ID NO. 15778
gaggcctcgaccacccacccaccgtgcgccaccattttcccctccccatctcgcccgccgtcctctcctcctcgatctcctcgcacctcgcatccgcagctctccccggcgcttaaccaagggtttaggagcggcggcgatggcggcgaggctggcgcagctgcgcgcgcaggcggcgcgtgcggcggagctcgcctcgaagcacggctgcgcctactacaaggaggtcatggagaagaacaagcagtacgtagtgcagccccccaccgtcgagaagtgccaggagctctccaagcagctcttctacacccgcctcgcaagtctaccaggccgctatgaagcattctggaaggagcttgatggtgtcaagcaggtatggaagaacagaaaggagctcaaggttgaggaccttggggttgcgactttatttggagttgagctttatgcatggttctgtgtaggtgagattgttggcagagggtgcaccttaaccggctataaggtctagatgatttctcctggttaagacctgctttgcaatctatacttttagctgatgcttgttgaaacgacgatgatacctgccttcgttcacaattttgtttcttaaaaaaagtttctctagtgctgaatgtcagcaaggacgggcacatcgttgcaacattgcctcaataatttgctcgctcgattgtcc

SEQ ID NO: 15778 - protein, 122 aa, Panicum virgatum
  misc_feature: Ceres CLONE 1785881
  misc_feature (8)..(122): Pfam Name: ATP-synt_G Pfam Description: Mitochondrial ATP synthase g subunit
MAARLAQLRAQAARAAELASKHGCAYYKEVMEKNKQYVVQPPTVEKCQELSKQLFYTRLASLPGRYEAFWKELDGVKQVWKNRKELKVEDLGVATLFGVELYAWFCVGEIVGRGCTLTGYKV

SEQ ID NO: 15779 - DNA, 884 bp, Panicum virgatum
  misc_feature: Ceres CLONE 1785889
  misc_feature: Encodes the peptide sequence at SEQ ID NO. 15780
atccccttcaatctcgattccatcgcttccgccgctagggttttgccttgcagcttcctcgccgcaccacccgacccaccacctcaacccctgttcaaccccggaggtcggatcgatggcgtcggacgcagcggcggggaaggacaagacgctgacgctgatcagctgtgacaaggagaacttcgtggtggatgagtcggtggcgaaggagtcgcggaccatcctgcacatgatcgaggacggctgcaccgacaacggcatcccggtcccgaacgtcaacgccaagatcctcgccaaggtcatcgagtactgcaagaagcacgtcgcggcgcgccgcggcgccgacgcggacgccgccgagccgactgccgcgaccaacaaggccgacgacgacctcaaggccttcgatgctgacttcgtcaacgtggaccagtccaccctcttcgagctcatcctggctgcaaactacctggacatcaaggggctgctggacctgacctgccagaccgtcgcggacatgatcaaggggaagactccggaggatatccgcaagaccttcaacatcaagaacgacttcacacctgaggaagaggaggaagtgaggagggagaaccagtgggccttcgaatgaggctgaggctctaacaacagcaatctcctataaccaggccagcggggaaggtgttatgtcaggaagatgatttgggatgttacaagcttggagcagctatagactgtcttgggtttaacaaatcgcgtagaaggtgtatgtaggttcggttggctgtgagattatttgctgactcctgttattttggtaccactggtggatgctctcttggatcgttaagaggctggttggttaagcattgctggttattccg

SEQ ID NO: 15780 - protein, 171 aa, Panicum virgatum
  misc_feature: Ceres CLONE 1785889
  misc_feature (94)..(171): Pfam Name: Skp1 Pfam Description: Skp1 family, dimerisation domain
  misc_feature (11)..(71): Pfam Name: Skp1_POZ Pfam Description: Skp1 family, tetramerisation domain
MASDAAAGKDKTLTLISCDKENFVVDESVAKESRTILHMIEDGCTDNGIPVPNVNAKILAKVIEYCKKHVAARRGADADAAEPTAATNKADDDLKAFDADFVNVDQSTLFELILAANYLDIKGLLDLTCQTVADMIKGKTPEDIRKTFNIKNDFTPEEEEEVRRENQWAFE

SEQ ID NO: 15781 - DNA, 647 bp, Panicum virgatum
  misc_feature: Ceres CLONE 1785890
  misc_feature: Encodes the peptide sequence at SEQ ID NO. 15782
atctcattccgctttgagcttgcttgcagctccagctcccctcgtctcttggtggctacgccatggccaccgtagtcctgatgagctgcagcctccgcgcgccggcctgcagcggcttatctggcgtccgcgccgccccggcaccggccatcgtcgccatgcccgccgccaagcagcaggttgttggccgcggcgccaggctgcgcgcgcaggccacctacaacgtgaagctcatcacgcccgacggcgaggtagagctgcaggtgcccgacgacgtgtacatcctggaccaggccgaggaggaagggatcgacctgccctactcgtgccgcgcggggtcctgctcctcctgcgccggcaaggtcgtctccggcagcgtcgaccagtccgaccagagcttcctcgaagacgaccaggtcgccggcggctgggtgctcacctgcgccgcctaccccacctccgacgtcgtcatcgagacgcacaaggaggaggagctcacctcctcttcgtaatccgatccagtatatgcggctttcattgcttattaattatctcagctcccttgattatatatatatatatatatatatatatatacatatatgtgcgcgcgatagctatatctatatatatataatactatattg

SEQ ID NO: 15782 - protein, 149 aa, Panicum virgatum; identical to SEQ ID NO: 10105
  misc_feature: Ceres CLONE 1785890
  misc_feature (58)..(133): Pfam Name: Fer2 Pfam Description: 2Fe-2S iron-sulfur cluster binding domain

SEQ ID NO: 15783 - DNA, 1079 bp, Panicum virgatum
  misc_feature: Ceres CLONE 1785913
  misc_feature: Encodes the peptide sequence at SEQ ID NO. 15784
attaatacttgtcttcttctcttgcccccttcttctctctctcctcacccactcgccccgagatctcccccctctctctcatcgtgccggttctctctctacccccggtaatggccgcccccgcccctgccaccaccggcgagctgctacgcatcgaccctctcgagctccgcttcccattcgagttgaagaagcagatctcgtgctccatgcagctgtcgaatctcagcaacgactacatcgccttcaaggtgaaaactacaagtccaaagaagtattcagtgcgacccaacacgggggttgtcttgccacggtctacttgtgatgtcgttgtgacaatgcaagcacaacgggaggcccctcctgacatgcagtgcaaagataagttcttagtccaaagcgttgttgcacctgctggtattactgtgaaggatgtcacaggggatatgtttacgaaggagtcagggaacaagatggaagaggtcaaattgcgagtgacctatgttgctcctccacagccaccctctccagttccggaggaatctgaagaaggttctccgcctagggcttcggaatcagaaagtggagatggccctgctgggggattcaccagagcatttagagagcgcattgaccctcaagaaaagtctttagaggctggagctttgatttccaaactaactgaagaaaagaactctgcgattcaacagaatcatagacttagacaggaacttgattcggttaggcaggagatcagcaagaggcgaggaggaggcttctcctttatcgttgtcataattgttgctttgatcggcatattcctgggttatctgatgaagtcataattctttcagccatatcaaagacattcatgcaagtaatgtctgggaactcaaaaagaccattcacgtcagatgtgaagttctccttcctgttttgttgatataggagtgcgtatgtgaggaatgctgagccagtttaagcttttcttcttttgtttttatttttcgttggatgagtcgtgcgcattgctgacactgtaacttggaaaatgcatcaattgcttttgttcaccgttt

SEQ ID NO: 15784 - protein, 244 aa, Panicum virgatum
  misc_feature: Ceres CLONE 1785913
  misc_feature (12)..(119): Pfam Name: Motile_Sperm Pfam Description: MSP (Major sperm protein) domain
MAAPAPATTGELLRIDPLELRFPFELKKQISCSMQLSNLSNDYIAFKVKTTSPKKYSVRPNTGVVLPRSTCDVVVTMQAQREAPPDMQCKDKFLVQSVVAPAGITVKDVTGDMFTKESGNKMEEVKLRVTYVAPPQPPSPVPEESEEGSPPRASESESGDGPAGGFTRAFRERIDPQEKSLEAGALISKLTEEKNSAIQQNHRLRQELDSVRQEISKRRGGGFSFIVVIIVALIGIFLGYLMKS

SEQ ID NO: 15785 - DNA, 697 bp, Panicum virgatum
  misc_feature: Ceres CLONE 1785940
  misc_feature: Encodes the peptide sequence at SEQ ID NO. 15786
gcaactaacagcaacccatcgtcctcgctactagctagctactcagtggcactctcgctactcgcccatcatctgcttcaattccttcttcttcccaagcaaaagagcaagaccatgtcgacggtgagccgtgcatccctcgatcagaagcttgccctcgccaagcgatgctcgcgagaggcgaccctcgcaggggctaaggctgcagctgtagcgaccatcgcctctgcaattcccacgctcgcgagcgttcggatgctgccatgggcgaaggccaacatcaaccccacaggccaggcactcatcatctccacagtcgccgggatggcctacttcatcgctgccgataagaagatcctgtcgctagcgaggcgccactcgttcgaggacgcacccgagcacctcaagaacacctcctaccagggcgccggcaggccgcaccctgctttcttcaggccatgatcgagcttactgctggatcggagttgatgaataaactacttggccaacaactgcaaatcaatcgacgatgtgctcagagactcggagcaattgcaaattttagtgcctgggccatttagtttgtattagctgtactccaaactattatgcaagcagtatgttgtataaaagtattgtactttgtgtttctcaatcttgaactttgtctatcggtataaaaatagcttgcaaggtt

SEQ ID NO: 15786 - protein, 115 aa, Panicum virgatum
  misc_feature: Ceres CLONE 1785940
  misc_feature (11)..(89): Pfam Name: ENOD93 Pfam Description: Early nodulin 93 ENOD93 protein
MSTVSRASLDQKLALAKRCSREATLAGAKAAAVATIASAIPTLASVRMLPWAKANINPTGQALIISTVAGMAYFIAADKKILSLARRHSFEDAPEHLKNTSYQGAGRPHPAFFRP

SEQ ID NO: 15787 - DNA, 695 bp, Panicum virgatum
  misc_feature: Ceres CLONE 1785955
  misc_feature: Encodes the peptide sequence at SEQ ID NO. 15788
tgattgcagcactcatctccttcattaattcccagctagtaggtgtgcacgccattgccgcgcgaactcttccctcctagcagctacctagctagctagctttatttcagcagctgctgctgcagctctagctaacaataattaagcagcaatggccaccgccctcagcagcctccgcgcgccggccagcagcttctcctccggcgtgcgcgccgccccggcgcccggcgtcgtcgccatgcccgccgccaagcaggttgttgcccgcggcgccaggctgcgcgcgcaggccacctacaacgtgaagctgatcacgcccgacggcgaggtggagctgcaggtgcccgacgacgtgtacatcctggaccaggccgaggaggaggggatcgacctgcccttctcctgccgcgcggggtcctgctcctcctgcgccggcaaggtcgtctccggctccgtcgaccagtccgaccagagcttcctcgacgacgaccaggtcgccagcggctgggtgctcacctgccacgcctaccccgcctccgacgtcgtcatcgagacgcacaaggaggaggagctcaccgcttaagctccatcatcacatcatcatcatatcccatgcataaaattaaagctgctagctgccttgcaagagatctatcgatcgatgtaatcgagttgacgagaatccgatccgccgg

SEQ ID NO: 15788 - protein, 143 aa, Panicum virgatum
  misc_feature: Ceres CLONE 1785955
  misc_feature (54)..(129): Pfam Name: Fer2 Pfam Description: 2Fe-2S iron-sulfur cluster binding domain
  misc_feature: SWISSPROT Homolog: EC 1.14.13.7 Phenol 2-monooxygenase
MATALSSLRAPASSFSSGVRAAPAPGVVAMPAAKQVVARGARLRAQATYNVKLITPDGEVELQVPDDVYILDQAEEEGIDLPFSCRAGSCSSCAGKVVSGSVDQSDQSFLDDDQVASGWVLTCHAYPASDVVIETHKEEELTA

SEQ ID NO: 15789 - DNA, 717 bp, Panicum virgatum
  misc_feature: Ceres CLONE 1785958
  misc_feature: Encodes the peptide sequence at SEQ ID NO. 15790
aatccattcaccgacaagggagaaaaaaaaagaaatcgatggcgacgagcggcggcgacaacggcggcgccgcgggcggcggcgagttctacctgcggtactacgtggggcacaagggcaagttcgggcacgagttcctcgagttcgagttccgccccgacggcaagctccgctacgccaacaactccaactacaagaacgacaccatgatccgcaaggaggtcttcgtctccccctccgtcctccgcgaggccaggaggatcatccaggagtccgatattatgaaggaggacgacagcaactggccggagcccgaccgcatcggccggcaggagctcgagatcgtcatgggcaacgagcacatctccttcaccacctccaagatcggctccctcgtcgatgtccagtccagcaaggacccggagggcctccggatcttctactacctcgtccaggatctgaagtgttttgtgttttcgctcatcaacctccacttcaagatcaaaccaattcagtcctgagctccattccatctgtttcttaactgtgttgtgaaactgcgagtgttttaagagagaaccctgtaccatgtaagtaagatcctatttagattgtgatgatgtgttcgggttgtggagcactgagtggaagtggaactttgagtttgcctgggattgctatttgggttgtgcaaactgcgtgtaatgatatttatgt

SEQ ID NO: 15790 - protein, 160 aa, Panicum virgatum
  misc_feature: Ceres CLONE 1785958
  misc_feature (16)..(158): Pfam Name: Mago_nashi Pfam Description: Mago nashi protein
MATSGGDNGGAAGGGEFYLRYYVGHKGKFGHEFLEFEFRPDGKLRYANNSNYKNDTMIRKEVFVSPSVLREARRIIQESDIMKEDDSNWPEPDRIGRQELEIVMGNEHISFTTSKIGSLVDVQSSKDPEGLRIFYYLVQDLKCFVFSLINLHFKIKPIQS

SEQ ID NO: 15791 - DNA, 652 bp, Panicum virgatum
  misc_feature: Ceres CLONE 1785983
  misc_feature: Encodes the peptide sequence at SEQ ID NO. 15792
atccgtctccgccagattccaacctcaaaccaaaaaatcccccaattccggcgttcgagagcgcgaggagggaggccaaggcggcggcgatgtcggggcgaggcaaggggggcaaggggctgggcaagggcggcgccaagcgccaccgcaaggtgctccgcgacaacatccagggcatcaccaagccggctatccggcggctggcccggaggggcggcgtgaagcgcatctcggggctcatctacgaggagacccgcggcgtgctcaagatcttcctcgagaacgtcatccgcgacgccgtcacctacaccgagcacgccaggcgcaagaccgtcaccgccatggacgtcgtctacgcgctcaagcgacaggggcgcaccctctacggcttcggcggctaggcggcgctgcgccctcgggcgtttcgtggatgcggtgccgtctgtgatttgggatgcttcgttgtttagttacttcgtcggcttgtgtcctggtgggtctggagctgatcttgctagcgatccctgttcgaattgttggtgacgaactgctattaatcttgtctgtctggagtgcctgtgcttctgttgtgattgttgtttcaagcggaatcttgttctgaatataagtgctagtagctacttattgtcgc

SEQ ID NO: 15792 - protein, 103 aa, Panicum virgatum; identical to SEQ ID NO: 12044
  misc_feature: Ceres CLONE 1785983
  misc_feature (25)..(94): Pfam Name: Histone Pfam Description: Core histone H2A/H2B/H3/H4

SEQ ID NO: 15793 - DNA, 848 bp, Panicum virgatum
  misc_feature: Ceres CLONE 1785995
  misc_feature: Encodes the peptide sequence at SEQ ID NO. 15794
aggaagctgcagtgaagtcgccggcgccgccgcgacaggggggagcagcagcggcagcggggcccggcgatctcagctgcggcggcgccgcggtgagggaggaagcggaggcgcggcaggatgcactcgttcgggcaccgcgcgaacgcggtggcgacgttcgcggtcaccatactggccgcgatgtgcttcgccgcctccttctccgacaacttcaacacccccgcccccaccgcctccgtcaagatcttgaacataaactggttccagaaggaggcaaacggcaacgacgaggttagcatgacgctgaacatctcggcagacctttcgtctctgttcacgtggaacacaaaacaggtgtttgtctttgtggcggctgagtatgaaactccacagaatgctttgaatcaagtttccctttgggatggaattatacctgcaaaagagcatgccaagtttttgatccatactacaaacaagtacagatttattgaccagggtagcaatctaaagggcaaggaattcaacttgacaatgcactggcacattatgccaaagactggcaagatgtttgcagataagattgttatgacaggttatcggctcccggagcagtacagatagtctgatagatcttgaacagcaaagacctgggagcagagacctgaaagaagttttagtagcagtggcatagctgatactgagccttttcatctaatctaagccgaacatgtaatcttatgagcttgtactttagctgaaaccaagcgaaacaaaattgtacttttgcgcagatatgtattttccaactttgcttcgtctatcaaaagttgcgcctgaacctgttg

SEQ ID NO: 15794 - protein, 167 aa, Panicum virgatum
  misc_feature: Ceres CLONE 1785995
  misc_feature (1)..(167): Pfam Name: SPC22 Pfam Description: Signal peptidase subunit
MHSFGHRANAVATFAVTILAAMCFAASFSDNFNTPAPTASVKILNINWFQKEANGNDEVSMTLNISADLSSLFTWNTKQVFVFVAAEYETPQNALNQVSLWDGIIPAKEHAKFLIHTTNKYRFIDQGSNLKGKEFNLTMHWHIMPKTGKMFADKIVMTGYRLPEQYR

SEQ ID NO: 15795 - DNA, 636 bp, Panicum virgatum
  misc_feature: Ceres CLONE 1786001
  misc_feature: Encodes the peptide sequence at SEQ ID NO. 15796
acagccaccggagcagagcgccgagccccaggcaggatcccatggccgccaccgccgtcgcggcgtctctgcccgtggcccgggggctcgggaagcccctccgcgccggcggcagcagcggcgcgtcatcgctccgcgtcgtctcgccccgtggcagggtggccgtcgtccgggcgtcgtcgtccgcgcagagcccggccaaggagtgggcggccgcggcggccgtcgcggcggcgctggtgctgccggaggtcgcggaggccgcgcagacagggatctcaccctcgatcaagaacttcctcctcaacatcgtctccggcggggtcgtgctcgtcgccatcgtcggcgccgacgtcgccgtctccaacttcgaccctgtcaagcggggctgagctccaccacaagcacggccgccggccgcgccatggctgtgcgtatacctatgtactgatgagactgagagcggtcggtctggtctcttctccgtgtgcttccgaacgaaacacagtgtctgatgcgtccatcttttgctcgtgtaaatttcatttcctgctcatgaaatctcgtgttcattgagaccccccacacgttcatctaggatcgatcggttcgatttaattttaccgtgggtctgct

SEQ ID NO: 15796 - protein, 116 aa, Panicum virgatum
  misc_feature: Ceres CLONE 1786001
  misc_feature: Useful for making plants with modulated nitrogen use efficiency
MAATAVAASLPVARGLGKPLRAGGSSGASSLRVVSPRGRVAVVRASSSAQSPAKEWAAAAAVAAALVLPEVAEAAQTGISPSIKNFLLNIVSGGVVLVAIVGADVAVSNFDPVKRG

SEQ ID NO: 15797 - DNA, 749 bp, Panicum virgatum
  misc_feature: Ceres CLONE 1786008
  misc_feature: Encodes the peptide sequence at SEQ ID NO. 15798
ctgctcctcaccagcgcttgcaacaactcatccatccagcaccgtatcgtgccctcatcacattcgcgcacaatggctcgcgctcagcaggtcgtggcgatcgccgtcgttgccgccgtcgtgctgctcgccgccgcggccacctccgaggccgccgtgacctgcgggcaggtcaactccgccatcggcccctgcatcgcctacgcccgcgggtccggctccggcccctcctcagcctgctgcagcggagtcaggagcctcaactccgccgccaggagcaccgccgacaggcgcgccgcatgcaactgcctcaagtccgccgcaggcagggtgagcggcctcaacgccggcaacgccgccagcatcccgtccaagtgcggagtcagcatcccctacaccatcagcccatccgtcgactgctccaaggtggcttaatatatatcgtgatgagttggttggagcctgctgccaagcacatccaccgatatatctagctatcgtctatatatgatcgatcgagttcttgctagctcgctgatgaataaaatctctccgccgtcgctcatcatgtgagagacacggccggatcggatgtgtcagtccctgctacgttttgtacgtgtctgctccatgtacacctccatttccgttccagagtctgtaccttgtccactaccttttaatatatacaccactttttggtgtatatatatgctccgatccatgagtttatttcgatgcttctgagc

SEQ ID NO: 15798 - protein, 120 aa, Panicum virgatum; identical to SEQ ID NO: 10108
  misc_feature: Ceres CLONE 1786008
  misc_feature (31)..(116): Pfam Name: Tryp_alpha_amyl Pfam Description: Protease inhibitor/seed storage/LTP family

SEQ ID NO: 15799 - DNA, 540 bp, Panicum virgatum
  misc_feature: Ceres CLONE 1786011
  misc_feature: Encodes the peptide sequence at SEQ ID NO. 15800
actcttgctcccacccgcccacccagagcctgaggcctcagctatagcctacagctgcagcagcagagcgccagcaccggaccacgtcaaccctagctccccgcttccccgtgcccatggtgtccatgagcacaacgccgcaccctctcgattccccgacggcaccgggcaaggaggaagaggcgcgcccgatgcgcctgcgccaggccgccgcgcccatggccctgccgctgggggacgacgacgacgaggggcccaggagggtgcgaaagccctacaccatcaccaagtcgcgcgagagctggaccgaacccgagcacgacaagttcctcgaggcgctgcagctgtttgatcgtgattggaaaaagattgaagcgtatgttggctccaagactgaaatacagatcaggagtcatgcgcagaagtactttttgaaggttctgaagaatataaacaggtggttgtaatctttgcagtgctggtctgtttgttgaatagagtgcttggtgatgaaagtctcgtgcttggtcctgcttcctg

SEQ ID NO: 15800 - protein, 116 aa, Panicum virgatum
  misc_feature: Ceres CLONE 1786011
  misc_feature (60)..(105): Pfam Name: Myb_DNA-binding Pfam Description: Myb-like DNA-binding domain
  misc_feature: The sequence is a functional homolog of SEQ ID NO 392 in the 10/666,642 US patent application
  misc_feature: The sequence is a functional homolog of SEQ ID NO 1752 in the 10/412,699 US patent application
  misc_feature: The sequence is a functional homolog of SEQ ID NO 1974 in the 10/374,780 US patent application
  misc_feature: The sequence is a functional homolog of SEQ ID NO 337 in the 11/479,226 US patent application
  misc_feature: The sequence is a functional homolog of SEQ ID NO 146 in the 10/412,699 US patent application
  misc_feature: The sequence is a functional homolog of SEQ ID NO 1049 in the 11/479,226 US patent application
  misc_feature: The sequence is a functional homolog of SEQ ID NO 454 in the 10/412,699 US patent application
  misc_feature: Useful for biocontainment applications
  misc_feature: The sequence is a functional homolog of SEQ ID NO 156 in the 10/225,066 US patent application
  misc_feature: The sequence is a functional homolog of SEQ ID NO 1636 in the 11/479,226 US patent application
  misc_feature: The sequence is a functional homolog of SEQ ID NO 2560 in the 10/374,780 US patent application
  misc_feature: The sequence is a functional homolog of SEQ ID NO 804 in the 10/412,699 US patent application
  misc_feature: The sequence is a functional homolog of SEQ ID NO 12 in the 10/225,066 US patent application
  misc_feature: The sequence is a functional homolog of SEQ ID NO 1889 in the 11/479,226 US patent application
  misc_feature: The sequence is a functional homolog of SEQ ID NO 2676 in the 10/374,780 US patent application
  misc_feature: The sequence is a functional homolog of SEQ ID NO 390 in the 10/666,642 US patent application
  misc_feature: Useful for making plants with modulated light response
  misc_feature: The sequence is a functional homolog of SEQ ID NO 1067 in the 11/479,226 US patent application
  misc_feature: The sequence is a functional homolog of SEQ ID NO 146 in the 10/374,780 US patent application
  misc_feature: The sequence is a functional homolog of SEQ ID NO 1806 in the 10/412,699 US patent application
  misc_feature: The sequence is a functional homolog of SEQ ID NO 254 in the 11/375,241 US patent application
  misc_feature: The sequence is a functional homolog of SEQ ID NO 464 in the 10/412,699 US patent application
  misc_feature: The sequence is a functional homolog of SEQ ID NO 794 in the 10/225,066 US patent application
  misc_feature: The sequence is a functional homolog of SEQ ID NO 1096 in the 10/225,066 US patent application
  misc_feature: The sequence is a functional homolog of SEQ ID NO 128 in the 10/412,699 US patent application
  misc_feature: The sequence is a functional homolog of SEQ ID NO 1744 in the 10/412,699 US patent application
  misc_feature: The sequence is a functional homolog of SEQ ID NO 303 in the 11/479,226 US patent application
  misc_feature: The sequence is a functional homolog of SEQ ID NO 34 in the 11/375,241 US patent application
  misc_feature: The sequence is a functional homolog of SEQ ID NO 36 in the 10/374,780 US patent application
  misc_feature: Useful for making plants with modulated flowering time
MVSMSTTPHPLDSPTAPGKEEEARPMRLRQAAAPMALPLGDDDDEGPRRVRKPYTITKSRESWTEPEHDKFLEALQLFDRDWKKIEAYVGSKTEIQIRSHAQKYFLKVLKNINRWL

SEQ ID NO: 15801 - DNA, 666 bp, Panicum virgatum
  misc_feature: Ceres CLONE 1786014
  misc_feature: Encodes the peptide sequence at SEQ ID NO. 15802
cacgtccactccatggacgagcccaacatccgcgctctcctgcaagtgctcgaccttgaaaacccagatttgtggaaatggcttactggtcaggagcagccaccagaggatctgaattctaatccagtgttcactgccatcaagtcgaaggtcacagataacctcaccaagcatgcctctcctgagacccgatcaacaccaggtcagccatgggtgagaggatgggatgacataaagaaaggcaaagatggaccaaagtacggaaatcagtgaaaaggggattgaaacaggggtgatagttttatgtcctaaataaggccatatacctgttctctcgcatatggttctggtgtagaataaattgaaccacggctggcatgtttgacgtgtgtgaccgtttgttgaagtgatctgttgaattagtttgtagctgtggatgtgtgctaatatgctctgtatattttgatacccatggtgacagccactggctccactgctgctcatagcagttctggattagggtcttacctcatttttctgctgtgtttatattgtttacctgtttggtggtgtaacaccccaggtgttaatcacctgtagttatggttaatcgtgtatttgatatcgtcattaacactaaccttgcatgcataaaatcatttaatt

SEQ ID NO: 15802 - protein, 90 aa, Panicum virgatum
  misc_feature: Ceres CLONE 1786014
  misc_feature: SWISSPROT Homolog: EC 1.17.4.1 Ribonucleoside-diphosphate reductase
HVHSMDEPNIRALLQVLDLENPDLWKWLTGQEQPPEDLNSNPVFTAIKSKVTDNLTKHASPETRSTPGQPWVRGWDDIKKGKDGPKYGNQ

SEQ ID NO: 15803 - DNA, 699 bp, Panicum virgatum
  misc_feature: Ceres CLONE 1786057
  misc_feature: Encodes the peptide sequence at SEQ ID NO. 15804
atctcattccgctttgagcttgcttgcagctccagctcccctcgtctcttggtggctacgccatggccaccgtagtcctgatgagctgcagcctccgcgcgccggcctgcagcggcttatctggcgtccgcgccgccccggcaccggccatcgtcgccatgcccgccgccaagcagcaggttgttggccgcggcgccaggctgcgcgcgcaggccacctacaacgtgaagctcatcacgcccgacggcgaggtagagctgcaggtgcccgacgacgtgtacatcctggaccaggccgaggaggaagggatcgacctgccctactcgtgccgcgcggggtcctgctcctcctgcgccggcaaggtcgtctccggcagcgtcgaccagtccgaccagagcttcctcgaagacgaccaggtcgccggcggctgggtgctcacctgcgccgcctaccccacctccgacgtcgtcatcgagacgcacaaggaggaggagctcacctcctcttcgtaatccgatccagtatatgcggctttcattgcttattaattatctcagctcccttgattatatatatatatatatatatatatatatatatatatgtgtgctatagagatagctatatatatatataacttaattggtttgtaagtcagctatatgcataatgaatgctagctgtcgctatctatatctg

SEQ ID NO: 15804 - protein, 149 aa, Panicum virgatum; identical to SEQ ID NO: 10105
  misc_feature: Ceres CLONE 1786057
  misc_feature (58)..(133): Pfam Name: Fer2 Pfam Description: 2Fe-2S iron-sulfur cluster binding domain

SEQ ID NO: 15805 - DNA, 691 bp, Panicum virgatum
  misc_feature: Ceres CLONE 1786065
  misc_feature: Encodes the peptide sequence at SEQ ID NO. 15806
acatctcccgtctcgcgcctcgcccacaagccctccggttccgcccccccgcctcgccgtcgtcgtcggctggttgcgagaagagatggcgggccgtggcaaggcgatcggcgcgggcgcggcgaagaaggcgacgtcgaggagctccaaggccgggctccagttccccgtctacctcgccgccgtcctcgagtacctcgccgccgaggttcttgagctggccgggaacgctgcgcgggacaacaagaagacccgcatcgtgccccgccacatccagctggcggtccgcaacgacgaggagctgacgaaactgctcggcggcgccaccatcgcgagcggcggcgtgatgcccaacatccaccagcacctgcttcccaagaagtccgcctcgtccaaagcgtccggccacgacgacgacgacaactgaggcgccgggccgccatcgtgttgctggtttggtaggagtagccttttgttgttttggtgatacctgtgagagcttagatgcggtttgggatggggaagtagaagaaggttgcaataggttcttggctgggtggtaatgttctttcaatgggatgtgaataccactaagtttttgggttgtgaaactcgggggtgtaaaccagatgatgttttgatttatgaatgaagaaatcaaatgggagaaagtgaaactccagtattgcag

SEQ ID NO: 15806 - protein, 113 aa, Panicum virgatum
  misc_feature: Ceres CLONE 1786065
  misc_feature (3)..(70): Pfam Name: Histone Pfam Description: Core histone H2A/H2B/H3/H4
MAGRGKAIGAGAAKKATSRSSKAGLQFPVYLAAVLEYLAAEVLELAGNAARDNKKTRIVPRHIQLAVRNDEELTKLLGGATIASGGVMPNIHQHLLPKKSASSKASGHDDDDN

SEQ ID NO: 15807 - DNA, 869 bp, Panicum virgatum
  misc_feature: Ceres CLONE 1786074
  misc_feature: Encodes the peptide sequence at SEQ ID NO. 15808
accatcgtagtagcaaagctagcccacttttccttgacttgacccgcgcgcgcggcgtcagctcccgcctctccgccgagaagccggacggagctctttttttaaaggcagcagcccaaccaaacccttctccttcgagaggtcgccgaggagagctgcgcctgcgagggaggaggaggagcttcggaggggaagccatgctggaccatctcgtcgggcttgtgagggtgcgcgtgctcaggggggtgaacctcgccatccgcgacctccgatctagcgacccctacgtcgtcgtccgcatcggcaagcagaggctgaggacgaaggtggtcaagaagaacaccaacccggaatggaacgaggaactcaccctctcgattgaagaccctgcacatcctgtcagactggaagtgtttgacaaggacacattcgtcgatgattcgatgggtaccgcagagctggacatccgcccgttggttgaggtcgtgaagatgaagctccaggatgttgccgatggaactgtggtaaagaaactggtgcccaacagacagaactgcctggccgaggagagctccatttacatctccgaggggaaggtgaagcaggacctggttatcaggctgaagaacgtggagtgcggggagatagagctccagcttcagtgggtcgacctccctggttccaagggtgtatgagctccgctctgccctgctgatctcaggggttctcgagtgaaagtaaagttcatgtgacgaatgtaaatgtaatctaaggatggttatggtacagcaagtgctgaactgctgattaggattttttatgttcttttatgattgtatataaggggctgtttggatctgtgttttgcg

SEQ ID NO: 15808 - protein, 165 aa, Panicum virgatum
  misc_feature: Ceres CLONE 1786074
  misc_feature (9)..(87): Pfam Name: C2 Pfam Description: C2 domain
  misc_feature: SWISSPROT Homolog: EC 2.7.11.13 Protein kinase C
MLDHLVGLVRVRVLRGVNLAIRDLRSSDPYVVVRIGKQRLRTKVVKKNTNPEWNEELTLSIEDPAHPVRLEVFDKDTFVDDSMGTAELDIRPLVEVVKMKLQDVADGTVVKKLVPNRQNCLAEESSIYISEGKVKQDLVIRLKNVECGEIELQLQWVDLPGSKGV

SEQ ID NO: 15809 - DNA, 759 bp, Panicum virgatum
  misc_feature: Ceres CLONE 1786076
  misc_feature: Encodes the peptide sequence at SEQ ID NO. 15810
gccagaatagccccttggcctcccgagacggcttctataaagctgccttagttgctaatctcaaccttctcacacttcaggaagctcgccaacctcggatccgctagaagatgagcggctatccaccgccgcggggtcctggaccaccggcctctgtggctgctgcagcgactgcaagagctgctgcttggcgttcttctgcccgtgtgtcgcattcggccaggtggcagagaccttggacaagggatccacatcctgtggtatggctggtacgatctactgcgcgctgctgcacgcgggggtgtgcctgctccactgcctctactcctgctcctaccgccacaagctccgggcggcgtacggcctgccggcgaagccgtgcgccgacggctgcgtccactgcttctgcgagccatgtgcgctctcccagatgtaccgggagctcaagaaccggggcgccgacccggcagatggatgggaagtgaactcacagaagatggccacggctcctgtaccaatgcaagacatgacacgttgacgagtgtgtcctaaagcaagaaaaactcttgatcagtagtcatgttgtgcctcgcagtacatttgtgagctaggtgtttccatgcatagctgaagtaaataaatagagatgcatgtgtgtggatcatgtgtgaattattgctatttaatataactgtaaattaacgtgtgagaaataaaaaaacatcaagcagttttaatgatattagtagcagattttct

SEQ ID NO: 15810 - protein, 91 aa, Panicum virgatum
  misc_feature: Ceres CLONE 1786076
  misc_feature (1)..(61): Pfam Name: PLAC8 Pfam Description: PLAC8 family
MAGTIYCALLHAGVCLLHCLYSCSYRHKLRAAYGLPAKPCADGCVHCFCEPCALSQMYRELKNRGADPADGWEVNSQKMATAPVPMQDMTR

SEQ ID NO: 15811 - DNA, 647 bp, Panicum virgatum
  misc_feature: Ceres CLONE 1786122
  misc_feature: Encodes the peptide sequence at SEQ ID NO. 15812
cgtcagagaacaagatgagcattggtcttatatatgtgaacgagcacttctatggctggaaagaacaatgcttgaaggtgctccagtctaaattcgacagtcaagcacgttcctttgcaccagaccaggagattatagaagctctgaagaactgttccattggtcaggaagcaaacttcaaacaagttcagaagctgtgcatgcctttcatcaggttcaagaaagacgaggcaaaggaggttggacctcaggctttggagttgaagcttccttttggtgaaacagatgttctacaggagaacctggagctgatcagaaggcaattgggccttgagcatgtagaggtgttgtcagcatctgatgaagctgcccgttctaaagctggcaagtatgcgtctctactaaaccagaacccgccgtctcctggcgagccagttgcaatcttcatgagcaagcaggaatttgaagcccaaaattaaggtgttatgggttcagggtcagttatgaaactatttagttcaggtttaagttcagtttagttcagtctattgttgtttacctttatcggtcatcaaactgttttaagctatggttgtaaccagcacaatggtcaagaatcaagactggaggtgataaattgtttctgt

SEQ ID NO: 15812 - protein, 158 aa, Panicum virgatum
  misc_feature: Ceres CLONE 1786122
  misc_feature: SWISSPROT Homolog: EC 6.1.1.4 Leucine--tRNA ligase
SENKMSIGLIYVNEHFYGWKEQCLKVLQSKFDSQARSFAPDQEIIEALKNCSIGQEANFKQVQKLCMPFIRFKKDEAKEVGPQALELKLPFGETDVLQENLELIRRQLGLEHVEVLSASDEAARSKAGKYASLLNQNPPSPGEPVAIFMSKQEFEAQN

SEQ ID NO: 15813 - DNA, 836 bp, Panicum virgatum
  misc_feature: Ceres CLONE 1786141
  misc_feature: Encodes the peptide sequence at SEQ ID NO. 15814
acgctgccactccagcccgagactgctcgaccggagaagcacacacaagccagccaaggcctccccgagctgagatggcacaagccatggcgtccatgaccggcctctcgcagggcgtgctgcccagcaggcgcgccgccagcagggccaggacggccgtcgtcagggcgtcggccgagggcgagggcgaggccgcggcacaggctggccgccgcgccgtgctcgggctggtggccaccggcatcgtcggcagcgtcttcacccaggcggtgcgcgccgatgaggccgtcaagaccatcaagatcggccccccgccgccgccctctgggggacttcccgggaccttgaactcggaccaggccagggacttcgacctcgccttgaaggagcggttctacctgcagccgctgccaccagcgcaggcggcagcgagggccaagtcatcggcgcaggacatcctcaacctcaagccgctcatcgacaagaaggcttggccgtacgtcatgaacgacctccgcctccgggcttcctacctgcgctacgacctcaacaccgtcatcgcctcaaagcccaaggaggagaagaagagcctcaaggagctcaccggcaagctcttcagcaccatcgacgatcttgaccatgcggcaaagatcaagagcaccccagaggctgagaaatactatgcggcgactaaatctgccctcgatgacgttttggccaagctaggctagatggaatataatgggctaatggccatgtaatttcagacttttgtgtttgttcatatggagccggcaatgtaccatctcctgttgatattatatcaacaaacactt

SEQ ID NO: 15814 - protein, 218 aa, Panicum virgatum
  misc_feature: Ceres CLONE 1786141
  misc_feature (12)..(218): Pfam Name: PsbQ Pfam Description: Oxygen evolving enhancer protein 3 (PsbQ)
MAQAMASMTGLSQGVLPSRRAASRARTAVVRASAEGEGEAAAQAGRRAVLGLVATGIVGSVFTQAVRADEAVKTIKIGPPPPPSGGLPGTLNSDQARDFDLALKERFYLQPLPPAQAAARAKSSAQDILNLKPLIDKKAWPYVMNDLRLRASYLRYDLNTVIASKPKEEKKSLKELTGKLFSTIDDLDHAAKIKSTPEAEKYYAATKSALDDVLAKLG

SEQ ID NO: 15815 - DNA, 728 bp, Panicum virgatum
  misc_feature: Ceres CLONE 1786146
  misc_feature: Encodes the peptide sequence at SEQ ID NO. 15816
atcgagaagaaagccatcccattccatcctcacgagcaaggcaagcagataaggaacggcacgcaccaacccccggcgattgccgaaggccggaacgaaccaaaccccctcgtcgtccttctagaagctcccgcgtcccctccccgtagcctctgctctccaatggcgccctccctcctggtcgtcgccgcctcacccttcctcgtcgccggcagcagttgcagccgccggccgctggtcgccgcctccacccaccgggccgggctgcgcgttgccgcgctcaagtacgaccctgccaaggtggcgccgcagtccgaccgggtgctcgtccgtctccagcagatccctgagaaatctgctggaggtgtattgctacctaagtctgctgttaagtttgagaggtatctgatgggtgagattctatcggtcggtgctgatgttagtgaagttgaggctggaaagaaggttctattttcagatatcaatgcttatgaggtggaccttggtactgatgagaagcactgtttctgccgggaatcggatctgttagctgttgttgaatgaattttaccctaaaatttcagacttgggctacaatgctccaagcctacaagtgaaagttcttgacccttgtcccaactttgttgtatgccatttgaatgttcatgagttccacaacctgacgagtgttagttaccagtgaattttggctgccataagcagtaatg

SEQ ID NO: 15816 - protein, 133 aa, Panicum virgatum
  misc_feature: Ceres CLONE 1786146
  misc_feature (46)..(132): Pfam Name: Cpn10 Pfam Description: Chaperonin 10 Kd subunit
MAPSLLVVAASPFLVAGSSCSRRPLVAASTHRAGLRVAALKYDPAKVAPQSDRVLVRLQQIPEKSAGGVLLPKSAVKFERYLMGEILSVGADVSEVEAGKKVLFSDINAYEVDLGTDEKHCFCRESDLLAVVE

SEQ ID NO: 15817 - DNA, 3317 bp, Panicum virgatum
  misc_feature: Ceres CLONE 1786180
  misc_feature: Encodes the peptide sequence at SEQ ID NO. 15818
ccgtcgcgtagccatctccgtcgccgtctccccttcttatccactgaccctcctccccctcccccgtccccgaccgcgagagctgccgccccatccctccctgccctcgctagggctccgttgcggcgccggcgtagcgtccggctcaggcttcattgacacttggctagggattctttgaccggttcaatatggaggggactctagttcagtctgcgattgttcccaccgtattacaccggagcagctctggtcgatctcgtgtgcgcgcgagggccacgatgttgcgcagtacgccgacgcggacgcttactcttggaggcttccaagggctgcggcagacaaattttcttgacacgaggtctgtgatcaagcgtgacttcggatctatcgtagcaagtcagatttcgcggccacggggttcagcgtcaagaggtgtggttcgggccatgtttgagcgcttcactgaaaaggccatcaaggtgattatgcttgcgcaggaggaggccagacgtctaggccacaactttgttgggacagagcagattttactaggtcttattggtgagggaactgggattgcagcgaaggttctgaaatctatgggaattaatctaaaggatgcccgagtggaagttgagaagattattggccgaggtagtgggtttgtggctgttgaaatcccgttcacaccccgtgcgaagcgtgtattggaactatcacttgaagaagctcgccagctagggcacaactatataggatctgagcacttactcctggggctacttcgtgagggtgagggcgtagccgcccgtgtgcttgagagccttggtgctgatccaaacaacatccgtacccaggtcataagaatggttggtgaaagcacggaagctgttggtgctggagttggtggaggtgccagtggccagaagatgcccacacttgaggaatatggtactaatttgacaaaactggcagaagagggaaaacttgacccagttgttggcagacagaaccagattgagcgtgtaacccagattttgggcaggcgaacaaagaataacccctgcctaatcggagagcctggtgttggcaagactgctattgcagaggggcttgcccagcgcattgccaatggggatgttccagaaacaattgaaggaaagaaggttattactcttgacatggggctccttgtggctggtaccaagtaccgtggagagtttgaagaaagattgaagaagcttatggaggaaataaagcaaaatgaagacattattctctttattgatgaagtgcacacgctgattggtgctggtgcagctgaaggtgcaatcgatgctgctaacatcttgaaacctgctcttgctagaggtgaactgcagtgcattggtgccacaactctggatgagtataggaagcatatggagaaagatcctgcattggagagaagattccaaccggttaaagttccagagccaactgttgatgaaacaatacagatcttaagaggacttcgtgagagatatgaactccatcataagctgagatacacagacgaagctctagttgctgcagcacagttatcatatcagtatatcagcgaccgcttcctgcctgataaagctattgacttgattgatgaagctggatcccgtgttaggctgaggcatgcacagctgcctgatgaagccaaagagctggacaaagagcttaggcagataaccaagcagaagaatgaggctgttcgcggccaagatttcgagaaggcaggggaattaagagatcgtgaaatggagctgaaggcccaaattacagctattattgacaagagcaaggagatgattaaagcagagactgaatctggcgaagttggtcctcttgtcacagaggcagacattcaacatatagtctcctcttggactggaataccagtggagaaagtctcatctgatgagtctgaccgtctccttaagatgcaggatacactgcatacacgcatcattggccaggatgaggctgtcaaagctattagccgtgctatccgccgtgctcgtgttggactcaagaatccgaatcgaccaattgctagcttcatattctctggaccaactggtgttggcaaatcagaattagcaaagtctctagcagcctactactttggatcagaggaagccatgatcaggcttgacatgagtgagttcatggagagacatactgtcgccaagctcatcgggtcacctccaggttatgttggctacactgagggtggccaacttactgaagctgttcgtcgccgtccatacacggttgttctctttgatgagattgaaaaggcacatccagatgtcttcaatatgatgcttcagatcttggaagatgggagactaacggacagtaagggaaggacagttgatttcaagaacacactgcttatcatgacatccaatgtcggaagcagtgtcatcgagaagggagaccgcaagattggatttgaccttgattacgaagagaaggacagcagctacaacaggatcaagagcctggtaacggaggagttgaagcagtatttccggccagagttcttgaacagattggatgagatgattgtgttccggcagctgacaaagttggaggtgaaggagattgctgatattatgctgaaagaagtatttgatcggctcaaggcgaaggacattaatctccaagtcactgagaggttccgcgatagggttgttgacgaaggttacaacccgagctatggtgccaggcctctgcgccgagctatcatgaggctcttggaagacagtctggcagagaagattctggctggtgaggtgaaagaaggtgattctgctattgttgacgtggattcagatggcaaggtagtagtcctgaacggtgggagtggtgttgctgagccactggaacctgctctcagcatctagtcaagctgaaaatcctaggtttggaatatggccttcgtcacatcttactggggctcctcatgaatcatggtggtaaaactagatatacatcactagcccttcgttaggtctctttccttttttctttttggaattgaggcagtagaaatgctatggaaatgaatagataggggcaaggtggattctagatcctaagtgctttgttttcgaaaggattttgaaagctttatcatttggaaggatgttggaagcttgatttccttcaattactgtattactaggtcatgcttgcagtaagatacggatatgattgcactgttgtacgtaaccttccaactatttatgagaatataacttatccccgcctcc

SEQ ID NO: 15818 - protein, 918 aa, Panicum virgatum
  misc_feature: Ceres CLONE 1786180
  misc_feature (630)..(805): Pfam Name: AAA_2 Pfam Description: ATPase family associated with various cellular activities (AAA)
  misc_feature (177)..(229): Pfam Name: Clp_N Pfam Description: Clp amino terminal domain
  misc_feature (102)..(154): Pfam Name: Clp_N Pfam Description: Clp amino terminal domain
  misc_feature (291)..(484): Pfam Name: AAA Pfam Description: ATPase family associated with various cellular activities (AAA)
  misc_feature (505)..(540): Pfam Name: UVR Pfam Description: UvrB/uvrC motif
  misc_feature (464)..(806): SWISSPROT Homolog: EC 3.4.21.53 Endopeptidase La
  misc_feature (280)..(372): SWISSPROT Homolog: EC 3.6.4.6 Vesicle-fusing ATPase
MEGTLVQSAIVPTVLHRSSSGRSRVRARATMLRSTPTRTLTLGGFQGLRQTNFLDTRSVIKRDFGSIVASQISRPRGSASRGVVRAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLESLGADPNNIRTQVIRMVGESTEAVGAGVGGGASGQKMPTLEEYGTNLTKLAEEGKLDPVVGRQNQIERVTQILGRRTKNNPCLIGEPGVGKTAIAEGLAQRIANGDVPETIEGKKVITLDMGLLVAGTKYRGEFEERLKKLMEEIKQNEDIILFIDEVHTLIGAGAAEGAIDAANILKPALARGELQCIGATTLDEYRKHMEKDPALERRFQPVKVPEPTVDETIQILRGLRERYELHHKLRYTDEALVAAAQLSYQYISDRFLPDKAIDLIDEAGSRVRLRHAQLPDEAKELDKELRQITKQKNEAVRGQDFEKAGELRDREMELKAQITAIIDKSKEMIKAETESGEVGPLVTEADIQHIVSSWTGIPVEKVSSDESDRLLKMQDTLHTRIIGQDEAVKAISRAIRRARVGLKNPNRPIASFIFSGPTGVGKSELAKSLAAYYFGSEEAMIRLDMSEFMERHTVAKLIGSPPGYVGYTEGGQLTEAVRRRPYTVVLFDEIEKAHPDVFNMMLQILEDGRLTDSKGRTVDFKNTLLIMTSNVGSSVIEKGDRKIGFDLDYEEKDSSYNRIKSLVTEELKQYFRPEFLNRLDEMIVFRQLTKLEVKEIADIMLKEVFDRLKAKDINLQVTERFRDRVVDEGYNPSYGARPLRRAIMRLLEDSLAEKILAGEVKEGDSAIVDVDSDGKVVVLNGGSGVAEPLEPALSI

SEQ ID NO: 15819 - DNA, 728 bp, Panicum virgatum
  misc_feature: Ceres CLONE 1786185
  misc_feature: Encodes the peptide sequence at SEQ ID NO. 15820
gcaagtgatcacggcgcgaccctcggccgcagcgcatgagataaattcggagcaccaccgccggctcagtttcgtctggctggctggcttggcatcggccatcggcacccggcaggcggcgggcggcagcagcgcaggatggccacccacgctgctctcgccgcgtcgcgcatccccacaggcacccggctgcacagcagggcggcgtccaggcagagggtggacttcgccgacttctccgggctgaggccgggatcatgctccgtcagcaccgccgccagggaggcgtcattctccgacgtgctcggtgcgcagctcgtcgccagggtatgtgtatcgagagcatgcttattatgtatgtgctttaattttgcagcgtaaggaaggaaatctagtgccgttcaccgtaaaacgtactggtgtagtagctagtacacagaccatagttgagttatccgacgttaattcgcattcaccagaacatcagacagtctcgattatgcatagttgatttaacagagatcactttctcttgatgaaaaacgattaatagtagatagatccaagcaaggtagtacagctagattcatcatgtatcatgttcagttacagcccaaattactactgcatctttcttttttgtagttattagattataaattgtatcgtcatacgcttattaggttactgctgtatgaatgacagtttcatctgttcatttgctaaag

SEQ ID NO: 15820 - protein, 80 aa, Panicum virgatum
  misc_feature: Ceres CLONE 1786185
  misc_feature: SWISSPROT Homolog: EC 1.2.1.13 Glyceraldehyde-3-phosphate dehydrogenase (NADP(+)) (phosphorylating)
MATHAALAASRIPTGTRLHSRAASRQRVDFADFSGLRPGSCSVSTAAREASFSDVLGAQLVARVCVSRACLLCMCFNFAA

SEQ ID NO: 15821 - DNA, 667 bp, Panicum virgatum
  misc_feature: Ceres CLONE 1786185-R
  misc_feature: Encodes the peptide sequence at SEQ ID NO. 15822
cgcacgtgtcggtggtggacctggtaatcaacaccgagaagaagggcatgacggccgacgacgtcaacggcgcgttccgcgaggccgccgccggcccgctcaagggcgtcctcgaggtctgcgacgtgccgctcgtgtccgtcgacttcaggtgctccgacgtgtcctccaccatcgactcctcgctcaccatggtcatgggcgacgacatggtcaaggtcgtcgcctggtacgacaacgagtggggatacagccagcgcgtggtcgatttggcgcacctggtggcggccaagtggccgggcgcggcggcggcgggcagcggcgaccccctggaggatttctgcaaggacaaccccgccaccgacgagtgcaaggtgtacgaggcatgagactctggccgggggcgttacgatcgatcaggaagagggcagaataactttgttgttcactgcccgtacgtgttcttccatagagagtacacatactactggtttgccgagagagacagacgacgtagcagaaatggatctttgtttctgcgaggtgtaatcatcactgaactcgtacaggcttcagatttcatttcctgttgggactgttgtgtgtttgtttcaatttttcatcatggtggtgacttgttgatcttataaagatgcgtgtcaccatt

SEQ ID NO: 15822 - protein, 128 aa, Panicum virgatum
  misc_feature: Ceres CLONE 1786185-R
  misc_feature (1)..(77): Pfam Name: Gp_dh_C Pfam Description: Glyceraldehyde 3-phosphate dehydrogenase, C-terminal domain
  misc_feature: SWISSPROT Homolog: EC 1.2.1.13 Glyceraldehyde-3-phosphate dehydrogenase (NADP(+)) (phosphorylating)
HVSVVDLVINTEKKGMTADDVNGAFREAAAGPLKGVLEVCDVPLVSVDFRCSDVSSTIDSSLTMVMGDDMVKVVAWYDNEWGYSQRVVDLAHLVAAKWPGAAAAGSGDPLEDFCKDNPATDECKVYEA

SEQ ID NO: 15823 - DNA, 2127 bp, Panicum virgatum
  misc_feature: Ceres CLONE 1786188
  misc_feature: Encodes the peptide sequence at SEQ ID NO. 15824
agcgcacgcaccaccgccgcgcaacccccaacgcccccgccaccgccgccgcaccaccggcgaagagagacaggaggaggggagcagcagcctcctccaggagcctagcctccgcgacccgatccccgacgagctccccccccccccctccgggcgtggccgagttgtaggcatcacggctagcgttgtagccccccggcgcggccccgcagctgcgcaggtggagcccacgggcaccatcgcctccgccgtcgccaccagccccgccccgcacggcggccgcggggcgctgccctcggccggagagagcccgtccgacctcctcttcctcgccggcggcggttgcctctgagccgctcccccacccttctctctctccatctgaccccttctcctcctcctaacaaccgtcgtctgctgaccccccgaccccgacaaacacgcacccaagagatttgagcgagccaccggccggccgccatggagatgaagctcaccatcaggagggtgcccaccgtcgtctccaactaccaggaggacgccgacaagccccgcgccggatgcgggaggaactgcctcggccactgctgcctgtctgtttccaagcttcccctctatgctttcaaggcaaatccggcaaaacctgcacaggaggataagtcccttgtcaatatcctccttgctgagtgggaggacaggatggcccggggcttattccgctatgatgtcactgcctgtgagaccaaggtcatccctggcaaccttgggtttgttgcacaactgaatgaagggcgccaccttaagaagcgccctactgagttccgtgtcgaccgtgtgcttcagccatttgaccctgccaagttcaactttactaaagttggccaggaagaggtgctcttccaatttgagaatggtgctggcgatgacagctacttcctgaataatgctccaatcactgctgctgatcgtgcaccgaatgttgttgctatcaatgtgagcccaatcgaatatggacacgtgcttcttattccccgtgttctggaccgcctgcctcagaggattgatccagagagcttcttgcttgcgctgcagatggcagcagaggcagccagtccatacttcaggcttggttacaatagtctaggtgcctttgctaccatcaatcacctccactttcaggcatactacttgtcagtgcctttccctgtcgagaaggcagctacccacaagatccctctttctgaagacacaatgaagagtggggtgactgtgtccaagctgataaattatcctgtgaggggcctggtatttgagggagggagcacactgaacgacctggcaaatgtggtttccagtgcttgcatttggctgcaggacaacaatgtcccttacaacgtgcttatttcagactgtggcaagaggatctttctcttcccccagtgctacgctgagaagcaggctctgggcgaagtgagccaagagctgctggacacccaggtgaatccagctgtgtgggagatcagtggccacattgtgctgaagcggaggaatgactatgaggaggcatctgaaacctctgcgtggaagctccttgccgaggtctccctgtctgaagaacgcttcgaggaagtgaaagcttacatcttcactgctgctggcctggttcaggcggatgaggaggaagtctgcgagggtgaggaagcaacctacgcgcctgtccctgtcgcccctctgcctgtggcagaaggctgcctcgtcctccagtgagatggtacagctggctgttgcgctattaagcgttgtcattcaccctgttcggctgctgggcggctgctggcggctgcggctgctcggctgctgctggcgcctgcggcgtgagtgcagaaccagcccagagcagccggccggtcaccagccaagcaaccagccgaacactgtaattgttgtctatggcgcctatagctctgccataataaggtccttgtgatgaaactgctgcctagtctggtctggtctggtctgtgcgcgtgagccttgtgctctgccgcaacttgctctcgtttctgtatcctctctgtggtgactgagtgattcagtgctctgcaatattaagcggaggctatgtgc

SEQ ID NO: 15824 - protein, 428 aa, Panicum virgatum
  misc_feature: Ceres CLONE 1786188
  misc_feature: Useful for making plants with modulated nitrogen use efficiency
MEMKLTIRRVPTVVSNYQEDADKPRAGCGRNCLGHCCLSVSKLPLYAFKANPAKPAQEDKSLVNILLAEWEDRMARGLFRYDVTACETKVIPGNLGFVAQLNEGRHLKKRPTEFRVDRVLQPFDPAKFNFTKVGQEEVLFQFENGAGDDSYFLNNAPITAADRAPNVVAINVSPIEYGHVLLIPRVLDRLPQRIDPESFLLALQMAAEAASPYFRLGYNSLGAFATINHLHFQAYYLSVPFPVEKAATHKIPLSEDTMKSGVTVSKLINYPVRGLVFEGGSTLNDLANVVSSACIWLQDNNVPYNVLISDCGKRIFLFPQCYAEKQALGEVSQELLDTQVNPAVWEISGHIVLKRRNDYEEASETSAWKLLAEVSLSEERFEEVKAYIFTAAGLVQADEEEVCEGEEATYAPVPVAPLPVAEGCLVLQ

SEQ ID NO: 15825 - DNA, 2406 bp, Panicum virgatum
  misc_feature: Ceres CLONE 1786197
  misc_feature: Encodes the peptide sequence at SEQ ID NO. 15826
attgcattgcatcttcttgtgagcagctgattctcttgtctgttacaccacgggactacctgatgcttgttcatctatcttggcttcaaagtaacattcccctgaacttcttctcatagtgatcactgctcagtcaggaagtaaacgacaatggcaagatgcactgcgtgcacccgtaagaactctatagtgatgatagatgactccactccttgcactgacaagctagtgatcagctatggtgttgtctgcgtttgtgtcgatcgatctccagcctttgtttattttgttttcctctgacgatgagcatgcatgtgtctgtgtcgcaggtttcgcgaggttcatggagacggacgaacctgcggcgccgcaacgttccgcgctcgtgcacccggacgccgtcgccgttcacatcccgtcgagtctctccgccgaggagccggtcttcagagagcgacacggtgacatgatcgccgccgccatggccgcagcgtccccggggtactcgccgtcgttcccggccgcgcggcaggtgtcgatcagcctgccggcgtcgccgaccgggttccgcgcctccaggacggaggcggagctggagcggcacgccataacggacgcgccgcggcggatgatggtgccccctcgcgccccggtggccgtggcgctggcgcagcctgacaaggtggtgttccggtcccagccgatccccgcggcgccgccgagtgcgaagggcgccgcccaggggcacgaagacccgagccggagcgcgccgcacggggcgaggtccaaggcgcgccgggacaagagctacgactcgttcaagacgtggtccggcaagctggagaagcagatcaccacgcacctcctgggcgggcggccgccggcaccgcagccgcaggaggaggaggagcccgaggaagacgacgcggcgagcaaccgccggctctcgtcctccatgccccaagtgcagcgcttcttcgcggcgctggaaggccccgagctcgacaagctgcggtcctcggaggagctgatcctgccgtccgacaagacgtggccgttcctgctccggttcccggtgtcggcgttcggcatgtgcatggggatgagcagccaggccatcctgtggaagcggatcgccatctcggcgtcgacgcggttcctgcacatcaccgtcaagatcaacctggtgctctggtgcgtctcggtggcgctcatggtcgcggtgtcggcgctctacgcctgcaaggtggtgttctacttcgaggcggtgcggcgcgagtactaccacccgatccgcgtcaacttcttcttcgcgccgtggatcgcgtgcctgttcctggccatcggcgtgccggacctggtggcggccagcctcccgcactggctctggtacgtgctcatggcgcccatcgtgtgcctggagctcaagatctacgggcagtggatctccggcgggcagcggcggctctcgcgggtggccaacccttccaaccacctctccatcgtcggcaacttcgtgggcgcgctgctgggcggcatcatgggcctcaaggagggcccgatgttcttcttctccgtcgggctggcgcactacatggtgctgttcgtgacgctgtaccagcggctgccgacgagcgagacgctgccccgggacctccacccggtcttcttcctctttgtggcggcgcccagcgtggcgtgcctggcgtgggcgaggatcaccggcgagttcggctacgggtcccgggtcgcctacttcatcgccatgttcctctacgcgtcgctcgccgtgcgggtgaacctgttccgggggttcagcttctcgctggcgtggtgggcctacacgttcccgatgacgagcgcggcgatcgcgtccatccggtacgcgtcagaggtgaagaacgccttcacgcagtgcatgtgcatcggcctgacggcggccgcgacgctgaccgtgacggcgctcttcctgacgacgctgctgcacgcggtggtgcaccgcgacctcttccccaacgacatctccatcgccatcacggagcgccggcgcaagcccatcttcgcggaggagatgaggccgagcaagcgccgcggcggcgggacgaagcagcagcaggcggcgctcgacaccgccgccgcgacgtcgtacacgtagctatagaccggggcggctgaacccgccgggcaaccgcgagcatgacagtgatacgcattgatacgtacggtggatcgtcgtcgtcctagctctcggacgcgtctgcttggtaagatgccgtgggggggctgtgcgctcggcagagccactagtgtgagatgcgtggctggattggatgatgaggtatggactcacgcgcactctttgtatgtacaccgtgtatcacagaggaagatatactatagcgcttt

SEQ ID NO: 15826 - protein, 638 aa, Panicum virgatum
  misc_feature: Ceres CLONE 1786197
  misc_feature (280)..(545): Pfam Name: C4dic_mal_tran Pfam Description: C4-dicarboxylate transporter/malic acid transport protein
MVLSAFVSIDLQPLFILFSSDDEHACVCVAGFARFMETDEPAAPQRSALVHPDAVAVHIPSSLSAEEPVFRERHGDMIAAAMAAASPGYSPSFPAARQVSISLPASPTGFRASRTEAELERHAITDAPRRMMVPPRAPVAVALAQPDKVVFRSQPIPAAPPSAKGAAQGHEDPSRSAPHGARSKARRDKSYDSFKTWSGKLEKQITTHLLGGRPPAPQPQEEEEPEEDDAASNRRLSSSMPQVQRFFAALEGPELDKLRSSEELILPSDKTWPFLLRFPVSAFGMCMGMSSQAILWKRIAISASTRFLHITVKINLVLWCVSVALMVAVSALYACKVVFYFEAVRREYYHPIRVNFFFAPWIACLFLAIGVPDLVAASLPHWLWYVLMAPIVCLELKIYGQWISGGQRRLSRVANPSNHLSIVGNFVGALLGGIMGLKEGPMFFFSVGLAHYMVLFVTLYQRLPTSETLPRDLHPVFFLFVAAPSVACLAWARITGEFGYGSRVAYFIAMFLYASLAVRVNLFRGFSFSLAWWAYTFPMTSAAIASIRYASEVKNAFTQCMCIGLTAAATLTVTALFLTTLLHAVVHRDLFPNDISIAITERRRKPIFAEEMRPSKRRGGGTKQQQAALDTAAATSYT

SEQ ID NO: 15827 - DNA, 1975 bp, Panicum virgatum
  misc_feature: Ceres CLONE 1786206
  misc_feature: Encodes the peptide sequence at SEQ ID NO. 15828
gtctccctccccttcgcctccctcctctcctcccactggagccaacagagagtgagactgagagagaagaaatccccaggccggcaagctcttcggaataaaatcacgccgtgatccgcgcgagttgcgccgcgcgtgctccatgcggcgctctagttaaaccgctcggcagtcagcggcggccggcccggcagcattagatcggcgcagctaggtcgctactgcccccctgaagccagcagagggcaggagccagttgagttctacgggaatcggaagctgaagaggatggccgccgcctccgccgccgccacccttcgccctgccctgccccaagggccggagcaaagagcttcttcactgctctgcacgcccaagcacagggtcgctgccagcgggaggagaagcctgagcttcgccgcgagggccagtctgaactcgggtggcaaggtgagcatccccaagcaatggtacaacctcgtcgccgacctgccggtgaagccgccgccgccgccgctgcacccgctgacgcaccagcctctgcatcccagcgacctgtcgcccctgttccccgacgagctgatccggcaggagctcaccgacgagcggttcgtcgacataccccaggaggtcatcgacgtgtacgagctctggcgcccgacgccgctcatcagggccaggaggctggagaagctgctcggcacgccggcgaagatctactacaagtacgaggggaccagcccggcggggtcgcacaagcccaacaccgccgtgccgcaggcgtggtacaacgccgccgcgggggtcaagaacgtggtcaccgagaccggcgccggccagtggggcagcgcgctctccttcgccagcagcctcttcggcctcagctgcgaggtgtggcaggtgcgcgcgtcgttcgaccagaagccgtaccggcggctgatgatggagacgtggggcgccaaggtgcacccgtcgccgtcggaggtgacggaggccggcagggcgatcctggcggcggacccggccagcccgggcagcctcgggatggccatctcggaggcggtggaggtggcggccaccgacgccgacaccaagtactgcctgggcagcgtgctgaaccacgtcctgctccaccagaccgtcatcggcgaggagtgcctggagcagctggcggcgctcggcgaggcgccgcccgacgtcgtcatcggctgcaccggcggcgggtccaacttcggcgggctcgcgttcccgttcatgcgcgagaagctcgccggcaggatgagcccggagttcagggccgtggagcccgcggcgtgccccacgctcaccaagggcgtctacgcctacgacttcggcgacacggccgggctcacgccgctgatgaagatgcacacgctcggccacggcttcgtccccgacccgatccacgcaggtgggcttcgctaccatggaatggcgcctctgatctcgcatgtgtacgagctcggcttcatggatgccgtcgccatacagcagaccgaatgcttccaagcggcattgcaattcgcccggacggagggcatcatcccggcgccggagccgacgcacgcgatcgcggcggcgatccgggaggcgctggagtgcaagaagaccggggaggagaaggtcatcctgatggccatgtgcggccacggccacttcgacctcgcctcgtacgagaagtacatgaggggcgacatggtcgacctgtcgcacccggcggataagctggaggccactcgccgccgtgcccaaaatctgaagttgaatcttgtgatgatccatcagctgtggacgttggcgatatttgtaagatccaaataatgaaatgaatgaataaatttttcagtcgaaagaataaatttgaggagaatgtttggtatggtttttttagtagaagactgctgatatgctgagtttgaacttggcatgatttgataacctgttattctaagtg

SEQ ID NO: 15828 - protein, 517 aa, Panicum virgatum
  misc_feature: Ceres CLONE 1786206
  misc_feature (118)..(460): Pfam Name: PALP Pfam Description: Pyridoxal-phosphate dependent enzyme
  misc_feature: SWISSPROT Homolog: EC 4.2.1.20 Tryptophan synthase
MAAASAAATLRPALPQGPEQRASSLLCTPKHRVAASGRRSLSFAARASLNSGGKVSIPKQWYNLVADLPVKPPPPPLHPLTHQPLHPSDLSPLFPDELIRQELTDERFVDIPQEVIDVYELWRPTPLIRARRLEKLLGTPAKIYYKYEGTSPAGSHKPNTAVPQAWYNAAAGVKNVVTETGAGQWGSALSFASSLFGLSCEVWQVRASFDQKPYRRLMMETWGAKVHPSPSEVTEAGRAILAADPASPGSLGMAISEAVEVAATDADTKYCLGSVLNHVLLHQTVIGEECLEQLAALGEAPPDVVIGCTGGGSNFGGLAFPFMREKLAGRMSPEFRAVEPAACPTLTKGVYAYDFGDTAGLTPLMKMHTLGHGFVPDPIHAGGLRYHGMAPLISHVYELGFMDAVAIQQTECFQAALQFARTEGIIPAPEPTHAIAAAIREALECKKTGEEKVILMAMCGHGHFDLASYEKYMRGDMVDLSHPADKLEATRRRAQNLKLNLVMIHQLWTLAIFVRSK

SEQ ID NO: 15829 - DNA, 2024 bp, Panicum virgatum
  misc_feature: Ceres CLONE 1786227
  misc_feature: Encodes the peptide sequence at SEQ ID NO. 15830
aaccagtgtccagactccagaggcatcgccgctgcccgcccaccccctctccctgtctcatactcacccagtcgcccaccaccgcgcgcccccctccaaatctcagcgccgctcccagatccaggatgtcctcctcctccgatcaggacgacgcccccgacggcggcgaggactcgcccctcttccgccgccgcgccgaaggttcctcccccggcatcgccgacgtccccgtcgcgcagtcgctcatcaaggcggccagcaacgtctgcttctccctcttcgtgctcgccgtcctcctcgtcaccgtcgtcgccgtcacctaccagccgccggacccctggctccagtcttccgccgccatcaccacctcgctctcccgggtcctccccaactccaccttcctcgtccccgacgactcgctccttcccaccggcgaagacttcaactcctccgccgtccccccgcgggcgcgcgccgacaccaaccaggacgacgcggccgcggctgtcgccgccgcctccgctgccgccgcagccaacgcgacctgcgacccggacgcgccgctcaactgctccgatccgcgcgtgctcgccgccgtcaaggcgttcaacgccaaggccttcttccgcaagtccatcgtgttcctcagctacgaggcgccggtgcccggccccaagcccgggcagtgcgacgtcgcgtggcggttccggaaccgccgggagaagtcgtggcgccggtacagggactaccgccgcttcagcctcacctcgggcgatgggtgcgctcttgaaatcgttaaagtcggcaagttccgttcggggacgaatgcagctccccggccatatcggaagggaccgaagagcccccgggtcgtcgtgccaccagtggatccagagatcaacgacacaatcccggtggttggatcagaagcagagttcaagaagggaaagtacttgtactacatgagaggcggtgaccactgcaagagcatgaaccagttcatttggagcttcttgtgcgggcttggagaagccaagttcctgaaccggacgttcgtgatggatctgaatatgtgtttatctggggcgcacacggtggatgggaaggatgtggatggcaaagatttcaggtattattttgattttgagcatttgaaggagagtgtgtctgtggtggaggaaggggactttttgaaggactggaaacgctgggataagaagaagggtccaggccggatcacagtgcgcaaggtgccgtcgtacaaggtgacaccaatgcagcttaagcgggacaagagcaatatcatttggaggcagtttgttgggcaggagcctgagaattactggtacagggtctgcgaagggagagctgccaaggtcatccaaagaccatggtacgcaatttggaagtccaagaggctgatgaacatcgtaacagagatcgcgggcaggatggattgggattatgatggtctgcatgtggtccgagggtggaaggcgcagaacaagcaaatgtacccaaacttggatgccgacacatcacctgatgcgatcgtgaataaggtgaccaagcttgttaagccaatgagaaatctctacattgcaactaatgagccattctacaactacttcgacaagctgaggtcacacttccatgtgcatttgcttgatgattacaagcagctctggtcaaacactagtgaatggtacaatgagacgacatcgcttagtgggggtaggccagtgccgttcgatgagtacatgagggtgattgtagacacagaggtattttacagatcaaaaacacaagttgagacgttcaacaacttgacgagggattgcaaagatggaatcaacacatgcaacttatgacacatgtgttaatgtttggtaatctattggtgttcatatactcttccaatggctggcacattaaaatttggaggaacttcatccagggtttgtcttttggcataccatcttaatgtaattcctgtcatgaaatttttaaatggttacacgtac

SEQ ID NO: 15830 - protein, 581 aa, Panicum virgatum
  misc_feature: Ceres CLONE 1786227
  misc_feature: Useful for making plants with modulated light quality sensitivity
MSSSSDQDDAPDGGEDSPLFRRRAEGSSPGIADVPVAQSLIKAASNVCFSLFVLAVLLVTVVAVTYQPPDPWLQSSAAITTSLSRVLPNSTFLVPDDSLLPTGEDFNSSAVPPRARADTNQDDAAAAVAAASAAAAANATCDPDAPLNCSDPRVLAAVKAFNAKAFFRKSIVFLSYEAPVPGPKPGQCDVAWRFRNRREKSWRRYRDYRRFSLTSGDGCALEIVKVGKFRSGTNAAPRPYRKGPKSPRVVVPPVDPEINDTIPVVGSEAEFKKGKYLYYMRGGDHCKSMNQFIWSFLCGLGEAKFLNRTFVMDLNMCLSGAHTVDGKDVDGKDFRYYFDFEHLKESVSVVEEGDFLKDWKRWDKKKGPGRITVRKVPSYKVTPMQLKRDKSNIIWRQFVGQEPENYWYRVCEGRAAKVIQRPWYAIWKSKRLMNIVTEIAGRMDWDYDGLHVVRGWKAQNKQMYPNLDADTSPDAIVNKVTKLVKPMRNLYIATNEPFYNYFDKLRSHFHVHLLDDYKQLWSNTSEWYNETTSLSGGRPVPFDEYMRVIVDTEVFYRSKTQVETFNNLTRDCKDGINTCNL

SEQ ID NO: 15831 - DNA, 1405 bp, Panicum virgatum
  misc_feature: Ceres CLONE 1786232
  misc_feature: Encodes the peptide sequence at SEQ ID NO. 15832
ttctcaatcccagctcgaggccaaacggaaaagaccaccaccagcagcacaaccaaccataggaggagcagcaagcaagcgagcgagcaactaaccaaccacaaggaaaggaaggaaggaaggaagaaggcatggcggcgatcgccgtgacgagcggccactggaggagactccgcacgctgggccgcggcgcgtcgggcgccgtggtgtcgctcgcggcggacgccgcgtcgggggagctgttcgcggtcaagtcggcggccgcgggcgccgcggcggaggcgctgaggcgggagcgcgggatgctggcggggctgcgctcgccccacgtcgtgcgctgcgccggcgccgccgagggcgccgacggctcctaccagctcatcctcgagtacgcccccggcgggtcgctcgccgacgaggcggcccggaatgggggcgccctcggggagcgcaccgtccgggcgtacgcggccgacgtcctccgcgggctgacctacctccacgggcgctccgtcgtgcacggggacgtcaagccgcggaacgtggtgatcggcgccgacgggcgcgccaagctcgccgacttcgggtgcgcgcgggcgcccggcgccgcgcgccgcgcgatcagcggcacgccggcgttcatggcgcccgaggtggcgcgcggggaggaccagggccccgccgccgacgtctgggcgctcgggtgcacggtcgtggagatggccaccggccgcgccccgtggggcgacgcggacgacgtcctcgccgcgctccaccggatcgggtacacggacgccgtgccggaggtgccgcgctggctgtccgcggaggccaaggacttcctggcccgctgcttcgcgagggacgctgccgaccggccggccgcggcgcagctcctggagcaccagttcgtggcattcgccggcgccgacgacaaggcccggtgggtgtcccccaagagcacgctggacgccgcgttctgggagtcggagtccgacgacgaggcggacgagatgccggagggcggcgcagcggacaggatcaagtcgctggcgttccccgtctcgggcttccccgactgggactgcgaggaaggctggatcgacgtgctcggcgagcagcagcagagcgaggcccaggtggcgcgcggcgcgccaagcaaggtgtcaggcgtcgcggcggtgccagctgggggcatggctgtcggcggcggcggatgcagtgatgaactggaaacagaggaggacgtgccgttcggtggcgatgctcctgcagccgatgcttcagttgggcgccagagcaaacgctgcccgggttcagactgtcgtgtaggagcactgccacttcagctagtgctttgctgtaacggagttactgatgatgaaataaaattatggcttgccac

SEQ ID NO: 15832 - protein, 424 aa, Panicum virgatum
  misc_feature: Ceres CLONE 1786232
  misc_feature (11)..(261): Pfam Name: Pkinase Pfam Description: Protein kinase domain
  misc_feature: SWISSPROT Homolog: EC 2.7.11.25 Mitogen-activated protein kinase kinase kinase
MAAIAVTSGHWRRLRTLGRGASGAVVSLAADAASGELFAVKSAAAGAAAEALRRERGMLAGLRSPHVVRCAGAAEGADGSYQLILEYAPGGSLADEAARNGGALGERTVRAYAADVLRGLTYLHGRSVVHGDVKPRNVVIGADGRAKLADFGCARAPGAARRAISGTPAFMAPEVARGEDQGPAADVWALGCTVVEMATGRAPWGDADDVLAALHRIGYTDAVPEVPRWLSAEAKDFLARCFARDAADRPAAAQLLEHQFVAFAGADDKARWVSPKSTLDAAFWESESDDEADEMPEGGAADRIKSLAFPVSGFPDWDCEEGWIDVLGEQQQSEAQVARGAPSKVSGVAAVPAGGMAVGGGGCSDELETEEDVPFGGDAPAADASVGRQSKRCPGSDCRVGALPLQLVLCCNGVTDDEIKLWLA

SEQ ID NO: 15833 - DNA, 1594 bp, Panicum virgatum
  misc_feature: Ceres CLONE 1786235
  misc_feature: Encodes the peptide sequence at SEQ ID NO. 15834
agggttgcttacactgctcttctgctctagtggtttctccgtctccctcatccatggcttcggcggcggcggcgacccaacaggtgggaacgtacttcctacggaactattacaacctgctgcagcagaaccccgatgtagtgcaccagttctacagcgaagcaagcaccatggtccgcgtcgacgacctcgccggcacgaacaccactgtcagcagcgtgatggacatacactcgctcattatgtccttgaatttcacccaaatcgagatcaagacagcaaactttatcaactcatggggtgatggggtgctagttatggtctctggccttgtgcagaccaaggagtacagccaccagaggaaatttatccagatgttcttccttgctccacaggagaagggttactttgtcctcaacgattactttcacttcgtcgaccaagaacaggtgcagcctgcgcaaatgatttctcatgatgactacgagaacaatttagcctccaacacagctgtcgaaactgttcctgagtacattcatgaggaagaaactcaaacagcacaaataacatctgaaggacatgatgtggtcgacaattatgcttattctgagccacctcagcaagtggtatcatctgacaactggggggaggaacctcttcctgaagaaccaccttcttccttctcaaatgaaattgcagtggcaccagaggagccagtgcaacctcctcctgtgccacctcctcatgtggaggagcctattggtgaaccagtgaagaagacttacgcttccattctaaaaactgcaaaggctccaccggcattcccggtagcccagcaagtccctgtgagtaagccttctcacccttcaacagagtcgaaccaggcccagcattcagttatggcttcatcaacggcaggcgagaaaccgagatctgatgtctacggtgaagttgcggcccatgatgatgaagagagcaaatctgtttatgttgggaatgtgccatcatctgtaagtgaggctgacctcgaaaatgagttcaaaaagtttgggcggcttattcctgatggtgttgctatcagaagccgaaaggagactggtggctattacgcttttgtggaatttgaggagcttagtggtgtacacaatgcgttaaaggcttcaccaatcgaaataaatgggcggcagatatatgttgaggagaggaagcctaacagcggaataagaggtggaaggaggggcggaagagaccgtttcggcggtggaggtcggggatatgccagaggtggaggtgatgagtacaatggtggcaaccggggtaggtcaaacggttacgggcgtgttcctcaccaagagaggggcatccttgggagccatgctcaaaggaattgaactggtgtagcaagagcaagcataaggttttgacctgtcgtcagagggagagagatcctgaacaaagcaacctatatgctgctaggttgcatttgggattttggggcttgttttgtcgatgaatgtgtgcgcgtcgacctatgcgacatccaacttttgctagactgatgttgcctgttgttattaagagctgttgttctgtc

SEQ ID NO: 15834 - protein, 445 aa, Panicum virgatum
  misc_feature: Ceres CLONE 1786235
  misc_feature (11)..(127): Pfam Name: NTF2 Pfam Description: Nuclear transport factor 2 (NTF2) domain
  misc_feature (311)..(381): Pfam Name: RRM_1 Pfam Description: RNA recognition motif. (a.k.a. RRM, RBD, or RNP domain)
MASAAAATQQVGTYFLRNYYNLLQQNPDVVHQFYSEASTMVRVDDLAGTNTTVSSVMDIHSLIMSLNFTQIEIKTANFINSWGDGVLVMVSGLVQTKEYSHQRKFIQMFFLAPQEKGYFVLNDYFHFVDQEQVQPAQMISHDDYENNLASNTAVETVPEYIHEEETQTAQITSEGHDVVDNYAYSEPPQQVVSSDNWGEEPLPEEPPSSFSNEIAVAPEEPVQPPPVPPPHVEEPIGEPVKKTYASILKTAKAPPAFPVAQQVPVSKPSHPSTESNQAQHSVMASSTAGEKPRSDVYGEVAAHDDEESKSVYVGNVPSSVSEADLENEFKKFGRLIPDGVAIRSRKETGGYYAFVEFEELSGVHNALKASPIEINGRQIYVEERKPNSGIRGGRRGGRDRFGGGGRGYARGGGDEYNGGNRGRSNGYGRVPHQERGILGSHAQRN

SEQ ID NO: 15835 - DNA, 1725 bp, Panicum virgatum
  misc_feature: Ceres CLONE 1786246
  misc_feature: Encodes the peptide sequence at SEQ ID NO. 15836
gttgctctctaactctaacgccgccgctacggcttgttctcgcgggggattgtccagtcgtcgccggcggccgcggctgggagcacgcttcgtcgtgacgctcggagctgaacctagagagagaaggcatcggtgtcgggccgcccaggtggagggatcgggcggcggcgcccggcgacccccatcatcctcggcgcggccgcggcatggacggccccaggaggagcgcggccgcggcggccttgctgcccgacgactccatcgtggagatcctctcccgcgtcccggccagatccctctgccgtttcaagtgcgtgtccaaggcctggcgcgacctcatcgccgaccgcttccgctgcaagaagctcccccaaacccccgagggcttcttctacgcctacgacgacaacaagatgcgtggctgcagcagtagcgatgatggcggtagtaagggaaacggcggcggcgcgagctctgatcgcgtcgcccatgggcacttcatcaacacattgggtagatctgtgcccctcgcttcctactccttcctgctggagcagcctggaattgaggccatcggtctcatgcgttcctgcaacggcctcctcctcttcgggcacagaagggattcggacacctatgaatcactgggctatattgtgtgcaaccccgtcaccgagcaatgggtggctgtgcccagctccggctgggaacctttatacccatccgatgagagcgaggactctgactctgaaactggatataactgccctcctttcacctatttgattttcgaccctgctgtgtcctcgcactttcacttggtccagttctggacgtacgatgatgtattcgtggaagaggttcacacttactcgtctgaaactggggtatggtctgagtgtacaagtgagtggtgttcagatgagggcttatcattctttgcaggaagtgcctttgttcatggcatgctgcatttcagtgtcacccgctttggtggggaagggaagaactgtcaccaggagcaaattgttgcagttgatggggaagggaagaagtgtaggatcattagcaggctagagaagcctggtgatgctgtttttgttagtcaatcccaaggactcctgcattacatgagtcaacacagagacaacactctgccacatgactgaactgtccatttgggttcttcaggactacgatacagaagaatgggttctgaagcacaatgtgtcctttatgcagctgtttggaagaacgagttgccaagttgaacatgactacagtatgattgccattcacccagatcgcaacctgatcttcttttttcaggactgggacctgaaactgaaatcatatgacatggatagcaaggaagtgcgcactctccgcactctaggggttggctgtcagaatattttaccatatgttccctatttcatggagtcattggtacttctacttcatagtaagcactgaaattgtgccttgtgaggtactagtcaaatttgatattccaagtaatgtgttccagcacaggagcatctagcaacataaatatatctgtagaattaggtaatgtgttctgatgatgcttcgatgtattactgctcatgcattttgtgtgctagatactgcaaacaaatactcgaggcacgcgtgtaagttaccattacatatgtatgttatgcctaagttgcagaatgtatgatgtttgaaattcaagtt

SEQ ID NO: 15836 - protein, 320 aa, Panicum virgatum
  misc_feature: Ceres CLONE 1786246
  misc_feature (9)..(56): Pfam Name: F-box Pfam Description: F-box domain
MDGPRRSAAAAALLPDDSIVEILSRVPARSLCRFKCVSKAWRDLIADRFRCKKLPQTPEGFFYAYDDNKMRGCSSSDDGGSKGNGGGASSDRVAHGHFINTLGRSVPLASYSFLLEQPGIEAIGLMRSCNGLLLFGHRRDSDTYESLGYIVCNPVTEQWVAVPSSGWEPLYPSDESEDSDSETGYNCPPFTYLIFDPAVSSHFHLVQFWTYDDVFVEEVHTYSSETGVWSECTSEWCSDEGLSFFAGSAFVHGMLHFSVTRFGGEGKNCHQEQIVAVDGEGKKCRIISRLEKPGDAVFVSQSQGLLHYMSQHRDNTLPHD

SEQ ID NO: 15837 - DNA, 1785 bp, Panicum virgatum
  misc_feature: Ceres CLONE 1786265
  misc_feature: Encodes the peptide sequence at SEQ ID NO. 15838
aatctcacacggatttcccctcctccttccctcctcgcaagagagccaccgcgacgccgcgcgactgcagccgccatctaccgcccggcgagacgagagcgccccccgcgcccccagggaatgcggagcgatgaggcggcgctcaggcactgacgtcgccggccagcgcgagctgcgcggcgaccgcacctgccaccgcaagcacgtcgaggacgggtagacgcccccccatcccatccttcccgccgcgcgctagtcgtcgtagggtagagttttctctcagtttggattgggtcgggaggaggagtaggggatcgaccgaccgaccgatcgatcgagcatcatgggggagggtgacggggaggtgaaggcgggcggggtgctgcaggggcgctacgagctcggccgcgtcctggggcatggcaacttcgggcgtgtccacgcggcgcgtgacctgcgcacgggccggagcgtggcggtgaaggtgctgtccaaggacagggtggtgcgcgcgggcatgatggagcagatcaagcgcgagatcgccgtcatgaagcgggtctcccaccccaacatcgtcgagctccacgaggtgatggccacgcgctccaggatctacctggcgctcgagctcgtccgcggcggggagctcttcgcgcggatcgtgcgcgcaggccgggtcagggaggacgtcgcgcgccgctacttccgccagctcatctccgccgtcggcttctgccacgcgcgcggcgtgttccaccgcgacctcaagccggagaacctcctcatcgacgacgcgggcaacctcaaggtggtcgacttcggcctcagcgcgctcgccgaccacacccgcagcgacgggctgctgcacacgctctgcggcacgcccgggtacgtctcgccggaggtgttccggaacaaggggtacgacggcgccaaggccgacatctggtcctgcggggtcatcctctacgtgctcctcgccggctcgctcccgttcccggaggacaacatcgccgccatgttcaagaagatgagccgcggggactaccgctgcccgccgtggctgtccacggacgcgcgcaggctcatccccaggctgctcgaccccaacccggacacacgcatcaccgtcgcccagatcgtcgagacgccgtggttcaagaagccgtccgtcgcgaggcccgtcagtgccgccgccgagccgccggccgagcccgcctgcgccgccaaggacggcggcgacaaggacgagctgccggagacgctgaacgcgttccacctcatctccctctccgcgggcttcgacctctcgcctctgttcgacgtcgaggggggctccgcgaggggccaccgggacggcggcatgcggttcgcgacgcgggagtcggcgagcggcgtcatctcccggctcgaggaggtggccgcccgcggcgggggccggatgcgggtgaccaagagcggcgcccgcggcgtgcggttcgagggcgcggagcgcgggggccccaagggccgcctcgccgtggctgccgacatcttcagcgtggcgccgtccgtgctcgtggtcgacgtcaagaaggacggcggcgacacgctcgagtaccggtccttctgcagcgacgagctccggccggcgctcaaggacatcgtctgggccgccgaccctgcacccgccgccaccgccgtcgtgtgacgccgcgccgccgcgtattgctctgtatcgtagtgccattgtttagtcagtatcgtctttcgaaaaaaaattgttcagtcagtgtcagtttc

SEQ ID NO: 15838 - protein, 449 aa, Panicum virgatum
  misc_feature: Ceres CLONE 1786265
  misc_feature (18)..(273): Pfam Name: Pkinase Pfam Description: Protein kinase domain
  misc_feature (305)..(372): Pfam Name: NAF Pfam Description: NAF domain
  misc_feature: SWISSPROT Homolog: EC 2.7.11.1 Non-specific serine/threonine protein kinase
MGEGDGEVKAGGVLQGRYELGRVLGHGNFGRVHAARDLRTGRSVAVKVLSKDRVVRAGMMEQIKREIAVMKRVSHPNIVELHEVMATRSRIYLALELVRGGELFARIVRAGRVREDVARRYFRQLISAVGFCHARGVFHRDLKPENLLIDDAGNLKVVDFGLSALADHTRSDGLLHTLCGTPGYVSPEVFRNKGYDGAKADIWSCGVILYVLLAGSLPFPEDNIAAMFKKMSRGDYRCPPWLSTDARRLIPRLLDPNPDTRITVAQIVETPWFKKPSVARPVSAAAEPPAEPACAAKDGGDKDELPETLNAFHLISLSAGFDLSPLFDVEGGSARGHRDGGMRFATRESASGVISRLEEVAARGGGRMRVTKSGARGVRFEGAERGGPKGRLAVAADIFSVAPSVLVVDVKKDGGDTLEYRSFCSDELRPALKDIVWAADPAPAATAVV

SEQ ID NO: 15839 - DNA, 1969 bp, Panicum virgatum
  misc_feature: Ceres CLONE 1786268
  misc_feature: Encodes the peptide sequence at SEQ ID NO. 15840
aaaattgcgatgcttcgtcctcctcgtcgcgccgccgcatctaactccggcgactcaccgccggcgatccgatccgcgctgcgccgccacgccacagcctctctgtgacgctcacgtaatcctactccgcgttcctctacctcctccgctccggcgtccgcgcaatccgcccgaatgggcaccgggacggggggtgcgagagggggcgcgggcggcggaggcttggtgcccggcgagcggtggtggcgggtcctcttcctcgcgctggcgtccgtctccttcctcatctctctcatcctcctcttcctctccgccccgcgcctccgactcccgggcgtcgccccatccgcctccacctccgccgcttccgccgtccggcgcgggctagacgcgccgccctgcctcgcctacctccttatcggcgcgcggggcgacgggcgccgcctactaaggctcctcctcgcggtctaccacccgcgcaaccggtacgtgctccacctctccgccgacgcgcccgacgacgagcgacagagcctagctgccggggttgtcgccgccgctcccgcggtgggagcgttcgagaacgtcgctgtcgtcggcaaccccaccgccgggacgctcgtgggctcctccgggctcgccggcacgctccgcgccgcggccgttctgctccggctccacccagactgggactggttcctcactctcaacgccgcggactaccccctcgtcacccaggacgatctgattcatgtcctatcctcggttccaagggaccttaacttcattgaccacaccagtaacattggatcaaaagaacctgagaaagtggaacaaattatagtcgatgctggaatttacttgtcaggaaggaccaacttctttcgaggaacacagaaacgaccagctcctgtggcttttaagttcttcacaggttctccatgggtcatattaaaccgtcggttcatagagtactgcattcttgcttgggagaatctccctcgaattcttctcatgtacttcaacaacataatacaaccccaggaaggatatttccactcggtcatctgcaactctctggaattccgcaatttcactgtgaacaacgacttgaggtttattccgcgggaggatccagctcagaaagagcccccttttctgagtcgagaacattacagtcagatggtggatagtggggcgccttttgcaaggccgtttcgggagaatgatcctctgctggaccagattgatggcaacatactcaagcgttggagccatggaccagttcctggtgcttggtgctctgggaggaagaggtggttcagtgatccatgttcccagtggggcgacgtgaacattgtgagaccaggcccccaagctgtgaaattgcaccaatacgtaaatcggactttacaagaagcaaagtctagcagcaacacatgcaggcaatagcagcattgatgccagtggcctcatatcccatggctgaaagctttgagctattccatttatccacacaggctcttcactctgctgaataaatagctgctacctgcctgaacggaaacaagcattcctggcacctggatagtaacacacaaccgtggaggactgctttcctgatcctttcttttgtgtggcaactatcacagtcacggatcaggggttctaatctgttgaatccccatattctgcacctatgacactgaaggcagatagcttagagccgatgaaaagcagtggcctatattactactgtagtttatatgccgtggtcatttgttgaacggcttgtggtatatagtgcagatgaagttatgagacccttttgctctcaggttgccaggcctggagacaatgtagaacaaggaatcttgttagtcttactgattactgttgtgctttgggcttacatgcctagtcttgtacctagaacaagccttcaattgtcccattttttccccttttg

SEQ ID NO: 15840 - protein, 425 aa, Panicum virgatum
  misc_feature: Ceres CLONE 1786268
  misc_feature (77)..(303): Pfam Name: Branch Pfam Description: Core-2/I-Branching enzyme
  misc_feature: SWISSPROT Homolog: EC 2.4.2.26 Protein xylosyltransferase
  misc_feature: Useful for making plants with altered carbohydrate content
MGTGTGGARGGAGGGGLVPGERWWRVLFLALASVSFLISLILLFLSAPRLRLPGVAPSASTSAASAVRRGLDAPPCLAYLLIGARGDGRRLLRLLLAVYHPRNRYVLHLSADAPDDERQSLAAGVVAAAPAVGAFENVAVVGNPTAGTLVGSSGLAGTLRAAAVLLRLHPDWDWFLTLNAADYPLVTQDDLIHVLSSVPRDLNFIDHTSNIGSKEPEKVEQIIVDAGIYLSGRTNFFRGTQKRPAPVAFKFFTGSPWVILNRRFIEYCILAWENLPRILLMYFNNIIQPQEGYFHSVICNSLEFRNFTVNNDLRFIPREDPAQKEPPFLSREHYSQMVDSGAPFARPFRENDPLLDQIDGNILKRWSHGPVPGAWCSGRKRWFSDPCSQWGDVNIVRPGPQAVKLHQYVNRTLQEAKSSSNTCRQ

SEQ ID NO: 15841 - DNA, 1761 bp, Panicum virgatum
  misc_feature: Ceres CLONE 1786274
  misc_feature: Encodes the peptide sequence at SEQ ID NO. 15842
ggccgcccgcaacagaacagcagaggtcctgatacacacacagcgctctcgccgccgccggcggccagggcgacggcgggcatggaggggaagatcccgcccctgctcatggggcggtacgagctgggcaagctgctcggcaggggcagcttcgccaaggtgcaccacgcgcggaacgtggagaccggcgaggaggtggccatcaagatcatggacaaggaccacctggcccgctccggcgccgcgcagcggcaggtcatgcgcgagatcgacatcatgcgccgcgtgcgccaccctcacgtcgtgcgcatccacgaggtgatggccacccggcggagcatcttcgtcgtcatggagttcgtcggcggcggctccctcgacgcctacctcgtccaccgcgcggggcgcggcgtcggcgaggcccccgcgcgccgcgtgttccagcagctcgtgtccgcgctcgactactgccactccctcggggtgtaccaccgcgacatcaagcccgacaacatcctcgtcgacgccgcgggcaacatcaaggtcgctgacttcgggctctccgcgctcgccggcacggcgcagcgggaggcgctgctccacaccgtctgcgggacgcccatgttcatcgcgcccgaggtcttcatgcgccggggctacgacggcgccagggccgacgtctgggcctgcggcgtcgtcctcttcgcgctcgtcgccggccgcttccccttcaaccacaaggacaccagcctctaccacatgatccgccgctgcgactaccactgcccgccgtggttcagccccggcctcgtccgcctcctccgccgcctcctgtgtcctgacccggcgcgccggatcgccatcccgcagatcacggagaatacgtggttcaagaagggattcaaggagattccacggagcctcggcgagcccgagctgcgggactccgactccgacgacgactcgaccgtatcaatggcgtcgtcggaggatccgtcctctccggtggcgcgcgcgcagcaacgtggctacggcagccgcatgcacacctcggtctcggcgccatcgctgaccacgctcgagagtactggcggcgccgccgtccagggctccccgcgcataggccggccgaggagcctgaacgcattcgacatcatcgcgtcctcgccgagcctggacctgaccgggcttttcgacgagccgggcgagcagatgcggttcgtgtccgccgcgcccgtgtccaagatcatctccaagctggaggagatcgccgggcacgtcagcttcacggcgcgcaccaaggagtaccaggtgagcatcgagggggacgggaacaggggcgcgctgctcgtctccgccaagatcttcgagctcacgccggagctcgtcatgctcaaggtgtggaagaaagccggcgacactgccaggtaccgggagttctgcaacaatgagctcaagcccggtctgcgtggcctcgtggacgggttgccagaggagggaggtgaacccatagcctccaactccggatgatcggtggaatccagcatcagggcgtggctcatgtgtcttcaattttatttcaacagttcgatagtatgttctaggagttttgacagtgtaatgccttattggtgtatcaagggtgtatcatgcaactgttgttgtgttaggtagctaaattctaggtatgccccttctcatctttgggcgctggttttagaaaatgaaaccatctattgtttagtgcacttttcttttacc

SEQ ID NO: 15842 - protein, 482 aa, Panicum virgatum
  misc_feature: Ceres CLONE 1786274
  misc_feature (13)..(270): Pfam Name: Pkinase Pfam Description: Protein kinase domain
  misc_feature (349)..(406): Pfam Name: NAF Pfam Description: NAF domain
  misc_feature: SWISSPROT Homolog: EC 2.7.11.1 Non-specific serine/threonine protein kinase
MEGKIPPLLMGRYELGKLLGRGSFAKVHHARNVETGEEVAIKIMDKDHLARSGAAQRQVMREIDIMRRVRHPHVVRIHEVMATRRSIFVVMEFVGGGSLDAYLVHRAGRGVGEAPARRVFQQLVSALDYCHSLGVYHRDIKPDNILVDAAGNIKVADFGLSALAGTAQREALLHTVCGTPMFIAPEVFMRRGYDGARADVWACGVVLFALVAGRFPFNHKDTSLYHMIRRCDYHCPPWFSPGLVRLLRRLLCPDPARRIAIPQITENTWFKKGFKEIPRSLGEPELRDSDSDDDSTVSMASSEDPSSPVARAQQRGYGSRMHTSVSAPSLTTLESTGGAAVQGSPRIGRPRSLNAFDIIASSPSLDLTGLFDEPGEQMRFVSAAPVSKIISKLEEIAGHVSFTARTKEYQVSIEGDGNRGALLVSAKIFELTPELVMLKVWKKAGDTARYREFCNNELKPGLRGLVDGLPEEGGEPIASNSG

SEQ ID NO: 15843 - DNA, 1834 bp, Panicum virgatum
  misc_feature: Ceres CLONE 1786280
  misc_feature: Encodes the peptide sequence at SEQ ID NO. 15844
aagccaaaccgcacacggccacgccgcccatggacgcgagcggggcgccgccgcccctcctggccgtgtcctccttcgccgcggccgcgctgctcttcgccgcggtgctggggtggctcttcgccgcgcggtcgtccaagcgcgggtcggcgcggctgccgccgggcagcacggggctgccgctcatcggggagacgctgcgcctcatctccgcctacaagacccccaacccggagcccttcatcgacgaccgcgtggcgcgccacggcagcggcgtcttcaccacccacatcttcggcgagcgcaccgtcttctccgccgacccggccttcaaccgcctcctcctcgccgccgagggccgcgccgtcggctgcagctacccgtcctccatcgccacgctgctcggcccgcactcgctgctcctcaccaggggccccgcgcaccgccgcctccacacgctcacgctcacccgcctcggccgccccgcgtcgccgccgctcctcgcctacatcgaccgcctcgtcctcgccaccatgcgggagtgggagcccgccgccaccgtccgcctcctcgacgaggccaagaagatcaccttcaacctcaccgtcaagcagctcgtcagcatcgaccccggcccgtggaccgagagcgtccgccgcgagtacgtcaagctcatcgacggcttcttctccatcccgttccccttcgcccacctccttcctttcaccacctacggccaggccctcaaggcgaggaagaaggtggccggggctctgcgggaggtgataaggaagaggatggacgacaagctggaaaatggttgcgcgaacgggaaggaggatgacaagattgagaagaaggacatggtggaggagcttcttgaagcagagggtgggagcttctccgaggaggaaatggtggatttctgcctgtctctgctggtggctggctacgagacgacgtccgtgctcatgacgcttgctgtcaagttcctcaccgagacacccactgcgctggcgcagctcaaggaagagcatgaaaatatcagagacgtaaaaggcaaaaatcaacctctggaatggagcgatttcaagtcaatgccatttacacaatgtgtgataaatgaaacattgcgtgttgctaacttaattagtggggtattcaggcgtgcaaacactgatattcattttaaagactacgttattccaaagggctgcaaaatatttgcttcattccgagctgtgcaccttaatactgaacactatgagaatgctcggacctttgatccctggagatggcagagtaagaataaactccagaacgcagtaggggccagcttgtttactccctttggtggcggacctcgtctgtgcccaggctatgagcttgcccgggttgttgtttctgtttttctccatcatcttgtgacacgctttagttgggaagaagctgaggaagataggattgtcttcttccccaccacccgaactctcaaaggataccccatcaatctccggcggcgaccagattctgttttctgacctcgcattaggttccagttacccttatggtctaagcaagagtaagcatagataagaaaaatgtccccagtagtcagtgaaattttatctgtaacttggcgcagaaagcagtcggcaaacttggttttgcttgtaaaatgacccaaactgctatgcaatgcgtactggttacagataacattttgccgtgtattatttggctatcctaagatccagcaaagatcttgctagtcgttatatcgctgtcctaacaattgacaaatgatgtgatgattttgtacgatttggtgggc

SEQ ID NO: 15844 - protein, 503 aa, Panicum virgatum
  misc_feature: Ceres CLONE 1786280
  misc_feature (44)..(497): Pfam Name: p450 Pfam Description: Cytochrome P450
  misc_feature: SWISSPROT Homolog: EC 1.14.13.93 (+)-abscisic acid 8'-hydroxylase
MDASGAPPPLLAVSSFAAAALLFAAVLGWLFAARSSKRGSARLPPGSTGLPLIGETLRLISAYKTPNPEPFIDDRVARHGSGVFTTHIFGERTVFSADPAFNRLLLAAEGRAVGCSYPSSIATLLGPHSLLLTRGPAHRRLHTLTLTRLGRPASPPLLAYIDRLVLATMREWEPAATVRLLDEAKKITFNLTVKQLVSIDPGPWTESVRREYVKLIDGFFSIPFPFAHLLPFTTYGQALKARKKVAGALREVIRKRMDDKLENGCANGKEDDKIEKKDMVEELLEAEGGSFSEEEMVDFCLSLLVAGYETTSVLMTLAVKFLTETPTALAQLKEEHENIRDVKGKNQPLEWSDFKSMPFTQCVINETLRVANLISGVFRRANTDIHFKDYVIPKGCKIFASFRAVHLNTEHYENARTFDPWRWQSKNKLQNAVGASLFTPFGGGPRLCPGYELARVVVSVFLHHLVTRFSWEEAEEDRIVFFPTTRTLKGYPINLRRRPDSVF

SEQ ID NO: 15845 - DNA, 1537 bp, Panicum virgatum
  misc_feature: Ceres CLONE 1786283
  misc_feature: Encodes the peptide sequence at SEQ ID NO. 15846
ccctcccacccccctctcaccccattttcgaaagctggagaggaaggagatccattgcttccgatggctgcctcccgtccctgacctccgacctctgccatatccccccacctgacagcaactcctgatcggattcaggctaggccatcgccctcctccgaagctcagaaagcggacctgaacacaagttgatctctgtggtgcaccccagttgaagccatggggtctggggactggttcaagacgatcatcaacaagaaaaaatcaaaacgggcgaaatcaaagcacgcaaagctcgctggtcaagtacaaaatggaggcaaccagacaaatcagaaatcgaatggcccttcttccagtagtgaccacgaagacaatgcagcactagaagaatgggctgctacacggattcagaacgcatttcggaaatacaaggcaaggaaaaccctccgttgtctcaggggagtcaaaagattgcgtattgttggtcaggcaaatccagttaagaagcagactgctgcaacactgagctacatacagtcttggaacaagttgcagtcagagataagaaaccggcgtgctttcatggtcaccgaagggcgcaacaggaagaagaagcaggagaatcaaatgaaacttgaggcgaaactccataatttgcaggttgaatggaatggaggttcggatactatggatgagatacttgctaggatacaacaaagggaagaagcagcagtaaagcgtgagcgagccatggcctacgcgttcaaccatcagtggagagcaaggtctgccacaagtctaggaaacttcagctatgaagttgggaagggtggctggggttggagctggatggaccgctggatcgccgcacggccataggagccgcggtccctggtccaccccgagaacccgaagaaagcacaggcaaagaaggagagcagcaacacgaacccatcggctctgaagttgcaaggctccatcagtctaagcaacaacatcaatgaccggaaagtccctaagaagaagccaacaccatcacctactgatcagaaaaagtcgtcaccgtcacctacagatcagaagaagccatcaccatcaccttcaagcgatcagaagaaagcagcaccgaaggagcagagagcaaaggcggcagacactcctccgaaaccgaaggctaaggaaatgaaagggagacaagaaaagcagatgcagcagcagcaagtggttccttcagtcagcgcatgaagatagcgaccgcggaaatggttactgatcattgtacgatacatcatgtgaagtcctcgtgtttttcacagtttgttgtttgtttttcttttccatttttgtcttcttattacggtaatatggaacaacgagtgccaatgtagaatgtgcttggtttgagcgattatgcacatatgacatatctgatgagagtggttttggttaggagtagaatatctgctattcattgttgtgctgttgtaataagacctgcctggctatctgcttgaatggaaggtcttgttggatc

SEQ ID NO: 15846 - protein, 220 aa, Panicum virgatum
  misc_feature: Ceres CLONE 1786283
  misc_feature (58)..(78): Pfam Name: IQ Pfam Description: IQ calmodulin-binding motif
MGSGDWFKTIINKKKSKRAKSKHAKLAGQVQNGGNQTNQKSNGPSSSSDHEDNAALEEWAATRIQNAFRKYKARKTLRCLRGVKRLRIVGQANPVKKQTAATLSYIQSWNKLQSEIRNRRAFMVTEGRNRKKKQENQMKLEAKLHNLQVEWNGGSDTMDEILARIQQREEAAVKRERAMAYAFNHQWRARSATSLGNFSYEVGKGGWGWSWMDRWIAARP

SEQ ID NO: 15847 - DNA, 1179 bp, Panicum virgatum
  misc_feature: Ceres CLONE 1786285
  misc_feature: Encodes the peptide sequence at SEQ ID NO. 15848
catgcagtgttatcgacaagcgcatcttctcttctgtgtcttcctctccccagaacccgacagctccatcctccatggctcctccgccgcggcgaatctcgccgcaaaaccccgaccggaggaagggtgaggagccgtggctggcggcgagcctacgccccgcgaacttcctcccgggcctcgccatcgggttcctcctcggcctcctcctagacctgtcgtcatcgtggaggcccaaatcgaggcccgcgccggctccggccgcggcgcccgcgcgtggctccagctcgaatcgggcgtcgaagggttcgttcggctccggcggcgaagagctgaagatggttttggtcgtgcgtcaggacctcaagatgggggctgggaaaatagcgtctcaatgtgctcatgcagcaactggcttgtatgcagaattgatgtcaaggtgctaatgcgcaatcgaggtcttttgagacagtgggagcaacttggacaagctaagattgttttgacatgcaagaatcaacaggaaatgttagctattgctctcttactacctacattcccattgagcatatttacatgatggtgaattggtgatgtctacattttgattttactttaacatgctttcgcccctgtgctctattatcaggaacaggctaaaggaaactgcagaacatcgaggtatcccaacgtttattgtggctgatgcaggccgcacacaggtgttggctggatctaaaacagttcttgcaatagggccagggaggaaaactgatatcgatgcagttactgggaaattgcgtttgctgtgatctgcatccctgagatgcttccagcatacgtttgacaatcactttctgggcataaccaatgctaaatatgggcattatgttttgtgtctctccagaatatttcctatcaagagctcactgtgttcctgattagcaccaaaacatttgcctgtttgagattcaaaccaattgctcgtcgaggtcgagtagcaatattatggtccaatcgctgtttgaggcattacaattaaccaactgctgtaattttgtatgcaattggatgctacaatatttcaggatgatgccagctgtagccatttgtaggttaacctggagtgattcgtagagattagtttcagggtggtcgatatgaaatgttattgttcgt

SEQ ID NO: 15848 - protein, 123 aa, Panicum virgatum
  misc_feature: Ceres CLONE 1786285
  misc_feature: SWISSPROT Homolog: EC 3.1.1.29 Aminoacyl-tRNA hydrolase
MAPPPRRISPQNPDRRKGEEPWLAASLRPANFLPGLAIGFLLGLLLDLSSSWRPKSRPAPAPAAAPARGSSSNRASKGSFGSGGEELKMVLVVRQDLKMGAGKIASQCAHAATGLYAELMSRC

SEQ ID NO: 15849 - DNA, 1615 bp, Panicum virgatum
  misc_feature: Ceres CLONE 1786290
  misc_feature: Encodes the peptide sequence at SEQ ID NO. 15850
ggtttttggggagttgcaccaccgggaaggggagcagctaggcttggtggtgggactgcggcggcggagctgctgctgccgccgccgccgcgatggactccggcaacagcgggagtcttcagtcgtccagcggcggcgacgacgagttcgactcgcggggcgggggaggaggaggaggagggggcgtcgactcctccccgctctccgcgctgctccgcccgtcgccgtccccctcggccgccgcgttctcgctccacgggtcctacttcggcctccaagagttcacgtccgcgccgcctccgcagcagcaggcgggggcgtggtcggggtcggtcgccggcgcctcgggtctatccacgccgtcctcgccgcgcgtcgcgcacaccgacgcgggcgcgcggccccagggtgctaacaaggccgtggcggcagcgcaggcgcaggggcaggggcagggagccgaggtgggcgctcccgcgccggcacagccgccgccgcccagagggtcgcggaagcggacgcgcgcgtcgcggcgggcgcccacgacggtgctcaccaccgacacctccaacttccgcgccatggtgcaggagttcacgggcatcccgtccccgcccttcggcgcgggcgtcggggtcgggctcggggtccccgccgcgtcgctccgcacccgcttcgaccacatcttccccccgccgtccaccctacgctccgccgcctccggggacgccgcggctgcctcgctgccgccctacctcctccgcccattcccgcacaagctcccgaccgcgccctccactttcccgcccttcacgtcgtcgtcgtcgtcgacctcgtcatcgacgccgtcctcgtccaacatcggcgtcgccaatgccaatgcggcgacgggcacggcgaccaccgcggcagcagcgtcatccaaccctgtcgccccgacggcggacgccttccagcagctgacgtcctcggcgctcctccggctgcagcaggacgccagcagctacctctccttccagaacctcctcgactcgcaaccctcgtcgcagtccatgttcggcgcggtgggcgggttcgcgcagtcgtcgcggctgcacgatccggcgccgtcgccgtcggatttcctggccggcgccggctccagcagcctcgggctcgcccacggcggactcctggccggctccgaggggctgcacttgcaccactcgcggagcgacgtccacggccacggcggcggcgacgagctgtcgggcgtggtcgcggccggcgcgtcgggcggcagctgcaagctcaactactcgtcccacgccggcgcggtggcgacctcgtcatcggctgccggcagcgcggacaagccaccggacggcggcggcggcggcgcgcccgggcggcctgggcgaggcgacgggctcgacccatggatctgtacatcggagtagggatgcatgctgcggcctccctcgaccctcggccgcttcgtcctgcgagctgctatgctacggctccggcgagacgaaccatgccgaatccgccatgcttgacaaacaaaggtctgattagcctttttagccttacaccttttgctgctactcattaatcacttctttcctgaggc

SEQ ID NO: 15850 - protein, 448 aa, Panicum virgatum
  misc_feature: Ceres CLONE 1786290
  misc_feature (147)..(177): Pfam Name: VQ Pfam Description: VQ motif
MDSGNSGSLQSSSGGDDEFDSRGGGGGGGGGVDSSPLSALLRPSPSPSAAAFSLHGSYFGLQEFTSAPPPQQQAGAWSGSVAGASGLSTPSSPRVAHTDAGARPQGANKAVAAAQAQGQGQGAEVGAPAPAQPPPPRGSRKRTRASRRAPTTVLTTDTSNFRAMVQEFTGIPSPPFGAGVGVGLGVPAASLRTRFDHIFPPPSTLRSAASGDAAAASLPPYLLRPFPHKLPTAPSTFPPFTSSSSSTSSSTPSSSNIGVANANAATGTATTAAAASSNPVAPTADAFQQLTSSALLRLQQDASSYLSFQNLLDSQPSSQSMFGAVGGFAQSSRLHDPAPSPSDFLAGAGSSSLGLAHGGLLAGSEGLHLHHSRSDVHGHGGGDELSGVVAAGASGGSCKLNYSSHAGAVATSSSAAGSADKPPDGGGGGAPGRPGRGDGLDPWICTSE

SEQ ID NO: 15851 - DNA, 532 bp, Panicum virgatum
  misc_feature: Ceres CLONE 1786297
  misc_feature: Encodes the peptide sequence at SEQ ID NO. 15852
gtcatcccgcaacagaacagctcaggtcctgcttctccctttctgctctctccgccggcggcggccagtgcgacggcggtcatggttgggaagatcccgcccctgctcatggggcggctcgagctggtcaagctgctcggcctggtcagcttccccaacgtgcaccacgcgcgtaacgtggagaccgccgaggaggtggccatcaatatcatggacaaggaccacctggcccgctcccgcgccgcgcagcggcaggtcatgctcgagatcgacctcctgcgccccgtgcgccaccctcacgtcgtgcgcatccacgaggtgatggccacccggcggagcatcttcgtcttcatggagttcgtcggcggcggctccctcgacgcctacctcgtctaccgcgcggagcgcggagtcggcgacgcccccgcgcgccgcgtgttccaacagatcgtgtccgcactcgactactgccactccctcggggtgtaccaccgcgacatcaagcccgacaacatcctcctcgacgccgcgg

SEQ ID NO: 15852 - protein, 150 aa, Panicum virgatum
  misc_feature: Ceres CLONE 1786297
  misc_feature (13)..(150): Pfam Name: Pkinase Pfam Description: Protein kinase domain
  misc_feature: SWISSPROT Homolog: EC 2.7.11.1 Non-specific serine/threonine protein kinase
MVGKIPPLLMGRLELVKLLGLVSFPNVHHARNVETAEEVAINIMDKDHLARSRAAQRQVMLEIDLLRPVRHPHVVRIHEVMATRRSIFVFMEFVGGGSLDAYLVYRAERGVGDAPARRVFQQIVSALDYCHSLGVYHRDIKPDNILLDAA

SEQ ID NO: 15853 - DNA, 2367 bp, Panicum virgatum
  misc_feature: Ceres CLONE 1786303
  misc_feature: Encodes the peptide sequence at SEQ ID NO. 15854
gccttggccatctctgatctgaccagccttgccttgctctgactcctcctccgaccgctgccgcgtcgccgacccccagatctgccgcagatctgccgcccgccatggactccggcgcctggggcggcggggccacggccatccgcgtgccctaccgccacctccgcgacgccgagatggagctcgtcagcctcaacggcagcccccgcgcaggggaggggccgcccaaggacccgcaccgggacgccgacggggcgcgccaggcggggggcgccggcacctccaggaccaagctcgtgctcgcctgcatggtcgccgcgggcgtgcagttcggatgggcgctgcagctctccctcctcacaccctacatccagaccctaggaatagatcatgccatggcatcatttatttggctctgtggacctataaccggttttgtggttcaaccatgtgtcggtgtgtggagtgacaaatgccgctcaaagtacgggagaagaagaccatttattttggctggatgcttgatgatatgtgctgctgtaactttaatcgggttttctgcagaccttggttacttcttaggagacaccactgagcactgcagaacatacaaaggttcaagatatcgagctgctattgttttcattcttggattctggatgttggaccttgcaaataatacagtgcagggtccagctcgtgcccttctagctgatctttcaggtcctgatcagtgtaattctgcaaacgcaatattctgttcatggatggctgttggaaatattcttggcttttctgctggtgcgagcggaaattggcacaaatggtttccgattctaacaacaagagcctgctgtgaagcctgtggtaatttgaaagcagctttcttagtggcagttgtatttcttttgttctgcatgtctgttaccctgtacttcgctgaagagatcccactagaaccaaaggatgcacaaggactatatgattccgctccgctactgaatgggtctatagataatggccatgcattgaatgaacaaaacaatgaaagattacctaatggccatgtggatagaaacaatgtctcaggaaactccaacaccggggaattcacagatgggaattccaacttgaacagggacaatggagaagttttcaatgatggcccaggagcagttttggtcaacattttgaccagcatgaggcatctacctccaggaatgcattcagtgcttgtagttatggccctaacatggttgtcatggtttccctttttcctttttgatactgactggatggggcgtgaagtttaccatggggatccaaatagagacttgagtgagaggaaagcttatgataatggtgtccgagaaggtgcatttggtttgctattgaattctgttgtccttggtattggttctttccttgttgatccactatgtcggatgattggtgcaagattggtttgggcaatcagtaactttacagtgtttatctgcatgatggctacaacggtactaagttggatctcttctaatctatactcgagtaaacttcatcacatcattggagcaaataaaacagtcaagaattcagcattggttgttttctctcttcttggattgccactctccatcacttatagtgttccattttctgtaaccgccgagctgactgctggttcaggaggtggacaaggtttggctacaggagtcctaaaccttgctatcgtcgttccccagatagtagtctcactcggagcaggtccatgggatgctctctatgggggaggaaacatccctgcattcgccttggcttcgatcttctctctggcagctggtgtgctcgcagttctcaagctaccaaagctatcaaactcgtaccaatctgccggtttccatggatttggttgatgatgtcctcaaagccctctaggtgtaacattcagaaacacacctacactatactaagccccgttttgccattcgtttacagtgaaatgattctttttcctgcagccactacagaataatactgaaagtagacactaggatagagaggctagttaggttcatgtgcatacaaagccgatgcaaaggtgtacaagctgtatctactttttgacagtgtatgtaagagctgcccgtgcacatggtggaagtgttgtaacaggtttcggccttaacaagcgctcgtttgtagctgtaaatccagcatgtttcttgcgcttttgtaagggaataggctgtgtgccaagctcatgttctttgcaccttttcctagctcctagcttggtagaacacattgagctttgactgcgcggtgattaaaatgacagcgcacataaaaaatagtggcggatgggac

SEQ ID NO: 15854 - protein, 602 aa, Panicum virgatum
  misc_feature: Ceres CLONE 1786303
  misc_feature (67)..(550): Pfam Name: MFS_1 Pfam Description: Major Facilitator Superfamily
MDSGAWGGGATAIRVPYRHLRDAEMELVSLNGSPRAGEGPPKDPHRDADGARQAGGAGTSRTKLVLACMVAAGVQFGWALQLSLLTPYIQTLGIDHAMASFIWLCGPITGFVVQPCVGVWSDKCRSKYGRRRPFILAGCLMICAAVTLIGFSADLGYFLGDTTEHCRTYKGSRYRAAIVFILGFWMLDLANNTVQGPARALLADLSGPDQCNSANAIFCSWMAVGNILGFSAGASGNWHKWFPILTTRACCEACGNLKAAFLVAVVFLLFCMSVTLYFAEEIPLEPKDAQGLYDSAPLLNGSIDNGHALNEQNNERLPNGHVDRNNVSGNSNTGEFTDGNSNLNRDNGEVFNDGPGAVLVNILTSMRHLPPGMHSVLVVMALTWLSWFPFFLFDTDWMGREVYHGDPNRDLSERKAYDNGVREGAFGLLLNSVVLGIGSFLVDPLCRMIGARLVWAISNFTVFICMMATTVLSWISSNLYSSKLHHIIGANKTVKNSALVVFSLLGLPLSITYSVPFSVTAELTAGSGGGQGLATGVLNLAIVVPQIVVSLGAGPWDALYGGGNIPAFALASIFSLAAGVLAVLKLPKLSNSYQSAGFHGFG

SEQ ID NO: 15855 - DNA, 698 bp, Panicum virgatum
  misc_feature: Ceres CLONE 1786315
  misc_feature: Encodes the peptide sequence at SEQ ID NO. 15856
tctctcggaatctctcctcccttgcgcttccttccctggcgacgacgactgggcgagcggcggcgcccagccctttgccggcgaggagcatccaccaggaatcccaataagtttactgcttccatcaagtgaggacctgcctgtctccgagaacttaattgctcctgatcttccgtggcacaagcatcatccgaaaaaatgccatcagtttatctttacatccctaatattattgggtatttcaggatcatcataaatttcaaagcttttgctatttgctattccaacaaggccctctttgctatcctttacttcatcagttttgtccttgatggcgtggatggttggtttgctcggaagtttaatcaaggtaacagttcaaattccccttgttttcaaatcatgtagcttgtccatgtgtaaagaaggttaatttctgacttctttgctacgatgaaatctcattgcacggtatgcttaagaactttcaaatggttattatgctgaaacagtggtctcagctaaaatctccttattcctgttatttttcctggtgtataagctatctggtaagttatgaaattatctgatcagtatatctcattgtatgaatcagcatcaacatttggagctgtgttggacatggttacagataggtactccttgaataaatctttgaactctggatatggagtgtg

SEQ ID NO: 15856 - protein, 69 aa, Panicum virgatum
  misc_feature: Ceres CLONE 1786315
  misc_feature: SWISSPROT Homolog: EC 2.7.8.11 CDP-diacylglycerol--inositol 3-phosphatidyltransferase
  misc_feature: Useful for biocontainment applications
MPSVYLYIPNIIGYFRIIINFKAFAICYSNKALFAILYFISFVLDGVDGWFARKFNQGNSSNSPCFQIM

SEQ ID NO: 15857 - DNA, 996 bp, Panicum virgatum
  misc_feature: Ceres CLONE 1786315-R
gatatggagtgtgaatagtttcacagctcactttgctcttcttcagggttagcactgcttgcttgttggcccttctctcccaattttacaggcctggcttagtcttcttgatactgcttgggttggatatcacaagccactggtttcaaatgtacagttctttcttgtcaggtaagactagccacaaggatgtaaagcacacaggcaattggcttctgaaattatattacgggcacaggccgttcatggccttctgttgtgtttcttgcgaggttttgtatattatcctctttctctttgctgatgagaagtcgacaagcttgcttagtgtatgcagaggtatcctgaatcaaagccccctcattgtcttggtgtttgtttccactctaattggctgggcagtgaaacaacttaccaatatcattcagatgaaaactgctgcagacgcatgtgtcatgtatgatctgaagcgcagcaagtaaagcatgaaggcaccggttttgttcagtttgtattgatattatccaaggaaaattcccgtgaggcttgtacaccatgattcatacatacagtggctacttcttgtgtgccttgacatctttctgactatgcttatctgttgggaagagacggcaacttgctgtgggaagaacataaagaaaacagaggagacaaacgatttacggagaaagtataggctgttaagttgtttgtcagtgtttgttcactatatagttggatgcagagcatgaccttttgttagctggagtggccttttgagtcgatctgaacgatgtttacaagctgcatttttcagagtccaagaatatatgaagtttttgaattgcaaaatttattcttccctgagagggttaaatagttgcctttagcgtgcactatcaaataggcatctgacttttttgttatcttaccttgtattccttacaattatctgatttttctggttatcttgccttgtgtcccttacaattatct

SEQ ID NO: 15858 - DNA, 666 bp, Panicum virgatum
  misc_feature: Ceres CLONE 1786320
  misc_feature: Encodes the peptide sequence at SEQ ID NO. 15859
acaagcagccaccgatcggggaggagcgcgcacccgccgatcgccattgcaagtggcaacggccaccgacgttgccccgccttctaatttgtcgccgtcgtcggagtagacagagaggggaggatccgagaatgggacggctctcctgcggcggcggcgtgcagcccaagctccgcaaggggctctggtcgcccgaggaagacgagaagctgtacaatcacatcatccgccacggcgtcggctgctggagctccgtccccaagctcgcaggcaagcaattaagcttattagcagcaagctcacacattcgatcactgctagctagctagctccactgttctatcggcgacttgggctgaattgcgttctgctgcgtggtgcgtgcagggctgcagcgctgcggcaagagctgccgcctgcggtggatcaactacctccgccccgacctgaagcgcggcagcttctcgcagcaggaggaggacctcatcctcgcgctccacgagatcctcgggaacaggtggtcgcagatcgcgtcgcacctgccggggcggacggacaacgagatcaagaacttctggaacagctgcctcaagaagaagctccggcagcgcggcatcgacccgagcacgcacaagcccatcgccggcgccggcgccgcggaggcgg

SEQ ID NO: 15859 - protein, 65 aa, Panicum virgatum
  misc_feature: Ceres CLONE 1786320
  misc_feature: The sequence is a functional homolog of SEQ ID NO 136 in the 10/412,699 US patent application
  misc_feature: The sequence is a functional homolog of SEQ ID NO 325 in the 11/479,226 US patent application
  misc_feature: The sequence is a functional homolog of SEQ ID NO 1660 in the 11/479,226 US patent application
  misc_feature: The sequence is a functional homolog of SEQ ID NO 840 in the 10/412,699 US patent application
  misc_feature: Useful for biocontainment applications
  misc_feature: The sequence is a functional homolog of SEQ ID NO 1917 in the 10/374,780 US patent application
  misc_feature: Useful for making plants with modulated biomass
  misc_feature: The sequence is a functional homolog of SEQ ID NO 428 in the 10/374,780 US patent application
  misc_feature: The sequence is a functional homolog of SEQ ID NO 54 in the 11/375,241 US patent application
  misc_feature: The sequence is a functional homolog of SEQ ID NO 870 in the 10/225,066 US patent application
  misc_feature: The sequence is a functional homolog of SEQ ID NO 188 in the 10/412,699 US patent application
  misc_feature: The sequence is a functional homolog of SEQ ID NO 2274 in the 10/374,780 US patent application
  misc_feature: The sequence is a functional homolog of SEQ ID NO 704 in the 10/225,066 US patent application
  misc_feature: Useful for making plants with modulated nitrogen use efficiency
  misc_feature: The sequence is a functional homolog of SEQ ID NO 1006 in the 11/435,388 US patent application
  misc_feature: The sequence is a functional homolog of SEQ ID NO 1008 in the 11/435,388 US patent application
  misc_feature: The sequence is a functional homolog of SEQ ID NO 824 in the 10/412,699 US patent application
  misc_feature: Useful for making plants with altered cell wall content and/or composition
  misc_feature: The sequence is a functional homolog of SEQ ID NO 134 in the 10/412,699 US patent application
  misc_feature: The sequence is a functional homolog of SEQ ID NO 321 in the 11/479,226 US patent application
MGRLSCGGGVQPKLRKGLWSPEEDEKLYNHIIRHGVGCWSSVPKLAGKQLSLLAASSHIRSLLAS

SEQ ID NO: 15860 - DNA, 573 bp, Panicum virgatum
  misc_feature: Ceres CLONE 1786320-R
gtgtcggagaacctggggtacggggagagctccagcaacagcagcaactggacctgcggcgagatgagcagcgcggtgctcgacagcgaggtgctgcactgggcctccggcggcggcggcgccgcgaagccggagccgtacacggagctggagcggcagcagcacagcggaggctacggcggcggggagcaggcggtggacgacgacgacgcgctggagcacaagttctcgctgccctgcggccaagagcagagcctggcgcatttcgacttcaacttggaatacttttgatcttttctctctctcgtttgcccttcattcacctttgcctccctgaactatcgatccattccccaacgttttacacacaagaggaagaaagaagcattggaagattagggattgcacttagtagtaaccactatgttaatttcctctagcccacaccacactcctttttcccccataccttttctgtataccctgcttctgcttggtcagaagaacagacagacagtgagtggtagatacgagaatattgtgtacgtactataaacaaagattttttcctgt

SEQ ID NO: 15861 - DNA, 1938 bp, Panicum virgatum
  misc_feature: Ceres CLONE 1786324
  misc_feature: Encodes the peptide sequence at SEQ ID NO. 15862
ctcctcccgtcgcccctcgtgctcgccgctccaacaatggcgccatctgccgccgccgccgccgcctcgagcatcctcctcctcctcctcgctctcctccaccccgccgcggcggccgccggcgccgcgcggcacaggcaccgcctcggcgcgtccttgcgcgccgccccgcccgacgcgtcgcagccgccgaccacgttcttcgaggtggaccgcccgatccgcccgcagcgcggcagcgcggggccctgctccacgctgctcctctccggcaccttcggcgccacctacggccggccccccgccaccgccgcctacgcgccgccagcctgcctcgccgacgcgcgggcccgcggcgcgggcctcgcgctcgccgtgctcgagtggagcgccgactgccgcggccgccagttcgaccgcatcttcggcgtctggctctccggcgccgagctgctccgcagctgcaccgccgagccgcggcccaacggcatcctctggtccgtgtcccgcgacgtcaccaggtacgccgccctcctcgcggagcccggtgaggtcgcggtctacctcgggaacctcgtcgacaagacctacaccggcgtctaccacgccaacctcacgctccacctctacttccacgcggcatcgccgcaaccgccacagcaacagcagcaggccgatctgattctgcccatctcaaggagcctgcctttgaacgacgggcagtggttcgccatccagaattccaccgatgtgcagtccaagaagctcgccattccgtcaaacacctaccgggcggtccttgaggtgttcgtttccttccactccgacgacgagttctggtacaccaatccgcccaatgattacattcaggcgaataacttgtccaacgttcccggcaatggtgcattcagggaagtcgtagctagggtggatggtgaagttttcggtgctgtttggccattcactgtgatttacactggtggtgtcaacccccttctatggcggccaatcaccggaattggctcattcaatctcccaacatatgacattgacatcacaccattcttgggcaagctcctggacggtaaggagcatgattttgggtttggtgtcacagatgctcttgatgtgtggtacattgatgccaatttgcatctgtggttggatcacgagagtgagaagacaactgggagcttgctcagctatgatgcatctggattggactttaatgtgaactctgaattcagtgggttagatggccagtttgtgacaagtgcaagtcggcatatctctgcaactggatgggtaaaatcgtcatacggggaggtcaccacaagtttctaccagagattcagctatgaaaacagcaatgtgtttagagaaaatggcactgtgcaaatcgtgaaccaaacgatcgatgcaaaatctggaatttttgtcaaggatgcttcttctgtgctgctctccggggaatttcatgaggttttcccactgtatctttatactggaacctcagataaagtgggtgatgagtactcattggattcacttgtcaaattcggtatcaatgagaagaagacctctggtaggaaactgggcttctcgttcagctctctgcagaacgcacaatcggcacgcggcactatgagggtgaagaagaatttggtagtccgtggattggggaagacccatcaggtgtataagtatgtgggaactgatggatgctatttcagggatgtgagcagcaggaactacactatactttttgaccgctctgatgattcttgttcaaaaggagcatatagcggggccagcacgaagttgaacaatcagtcagcaagaagaaagttgctggtaaacaaactataaagcaaaggaagggttttaattcgtccatgtttcaatttactttgcttcttcaataaagatttcttaggt

SEQ ID NO: 15862 - protein, 610 aa, Panicum virgatum
  misc_feature: Ceres CLONE 1786324
  misc_feature: SWISSPROT Homolog: EC 3.5.1.52 Peptide-N(4)-(N-acetyl-beta-glucosaminyl)asparagine amidase
MAPSAAAAAASSILLLLLALLHPAAAAAGAARHRHRLGASLRAAPPDASQPPTTFFEVDRPIRPQRGSAGPCSTLLLSGTFGATYGRPPATAAYAPPACLADARARGAGLALAVLEWSADCRGRQFDRIFGVWLSGAELLRSCTAEPRPNGILWSVSRDVTRYAALLAEPGEVAVYLGNLVDKTYTGVYHANLTLHLYFHAASPQPPQQQQQADLILPISRSLPLNDGQWFAIQNSTDVQSKKLAIPSNTYRAVLEVFVSFHSDDEFWYTNPPNDYIQANNLSNVPGNGAFREVVARVDGEVFGAVWPFTVIYTGGVNPLLWRPITGIGSFNLPTYDIDITPFLGKLLDGKEHDFGFGVTDALDVWYIDANLHLWLDHESEKTTGSLLSYDASGLDFNVNSEFSGLDGQFVTSASRHISATGWVKSSYGEVTTSFYQRFSYENSNVFRENGTVQIVNQTIDAKSGIFVKDASSVLLSGEFHEVFPLYLYTGTSDKVGDEYSLDSLVKFGINEKKTSGRKLGFSFSSLQNAQSARGTMRVKKNLVVRGLGKTHQVYKYVGTDGCYFRDVSSRNYTILFDRSDDSCSKGAYSGASTKLNNQSARRKLLVNKL

SEQ ID NO: 15863 - DNA, 1688 bp, Panicum virgatum
  misc_feature: Ceres CLONE 1786325
  misc_feature: Encodes the peptide sequence at SEQ ID NO. 15864
atgcatatggaagcacataggcatagcacaactatggtcgattggtcgccacacgtgtgagcaaggattaaaaaacgatcgtacgtgcaagctaagtgctcactagcagtagcaaagttcacggcatggcggcaccttctgctctcatcttgctcctcgtgcccgtcttgctcctcgtgcccgtccttgcctccatggccgctacagggactgcttcctttgacctccgcgccgagctcaaccacccctacgccggcagcccgctttccaggtacgagatggtccgcgaggccaccagcgcgagcaaggcccggcgcgcttggaccgccgctaggctggccaaagcgtgcgggcgcggcggtagcggtggcaccacctccgcgccggacgtgccggtcacccgcgtcggcaggtccttgtacaccgtgaccgtcggcgtcggcactccgccgcagcggcacacgctcgtccacgacacgggcagcgacctcgtctgggttttctgcaagctggtgggcggcgccgccacgccgacctaccctctctacgacccggacaagtcgtcctccttcgccgccgtcccctgcgacggcaagctgtgccgggagggcgggttcgagtccaagaactgctccaggaacaggtgcctctacacctacgcgtacggcggcggccggacctacggcgagcttgcgtccgaggtcttcacgttcggcgcgcaccacaaggtcccgaccaccctcaacttcgggtgcgggaggttcttgaagggcgacatcttcaacgcctccggcttcctagggctcagcccggacaagctgtccttcgtgacgcagctgaagataccaaggttctcctactgcctcactccttacaccgaccgcaagagtggccacatgttcttcggcgccatggccgacctgtccaggtacaggaccacggggccgatccagaccacttccttaattaacaaccgggtcggcatcaacatctactacatcgtgcccctgatcggcgtctcgatcggggccaagaagctcgacatccctgcatcgagcttcgacgccacattcgtcgactccggctacacgaccggcgccctcacggccccagcgctggacgccctcaaggaggcgctggtggatgccctgaagctgccgcggaggagctcctccgatccggactacgatttctgcttccagctgccgcgcggcgtgcccatggaggcggtgccggcgccaccgctggtgtaccacttcgagggcggcgccgcgatggtgctgccccgggagagctacctcgccgagccgagccccggggagatgtgcctagtaatcggggttgattcgcagccggtcatcggcaacttccagcagcagaacatgcacgtgctcttcgacgtgcagaaccagaagttctccttcgcgccaactcagtgtgaccaaatctgagttgtgacctacatgagcctctgctgctctacattggaatggagtagagcacggaagagttattttctgctgtagtatagtgtaagtttcagtcaggaaagaaataatccgacacgagggctgaggggtcggctacggctaaggtcatcatcatgtccacctcactgtaaggtcgttcatggatgctacctgtgtaatatagttagtttgggttcaaggccatatctatatttgcgg

SEQ ID NO: 15864 - protein, 441 aa, Panicum virgatum
  misc_feature: Ceres CLONE 1786325
  misc_feature (98)..(436): Pfam Name: Asp Pfam Description: Eukaryotic aspartyl protease
  misc_feature: SWISSPROT Homolog: EC 3.4.23.12 Nepenthesin
MAAPSALILLLVPVLLLVPVLASMAATGTASFDLRAELNHPYAGSPLSRYEMVREATSASKARRAWTAARLAKACGRGGSGGTTSAPDVPVTRVGRSLYTVTVGVGTPPQRHTLVHDTGSDLVWVFCKLVGGAATPTYPLYDPDKSSSFAAVPCDGKLCREGGFESKNCSRNRCLYTYAYGGGRTYGELASEVFTFGAHHKVPTTLNFGCGRFLKGDIFNASGFLGLSPDKLSFVTQLKIPRFSYCLTPYTDRKSGHMFFGAMADLSRYRTTGPIQTTSLINNRVGINIYYIVPLIGVSIGAKKLDIPASSFDATFVDSGYTTGALTAPALDALKEALVDALKLPRRSSSDPDYDFCFQLPRGVPMEAVPAPPLVYHFEGGAAMVLPRESYLAEPSPGEMCLVIGVDSQPVIGNFQQQNMHVLFDVQNQKFSFAPTQCDQI

SEQ ID NO: 15865 - DNA, 1957 bp, Panicum virgatum
  misc_feature: Ceres CLONE 1786331
  misc_feature: Encodes the peptide sequence at SEQ ID NO. 15866
agctgcagccagagcgccagcagccactctcctccactcggcctcgcgccctcgccggcgcggcaccgacgcaactctcaaaactagccggtagccaccatccggtgcaatggccgcgcccacgtcgcgcccgcggtccgccggggcggtgttctcgccgctcgcgccccgcggggtcggcgcactcccgggtctggatttcgccccgacgtctctccgcgtctccgcgtaccgccggcgtgcagttagcctaggttcgtccccgtacgcattctctcctgtaccataaccaggaacgatctctctctctctctccttcatctgcacgaactaatactgatttaaaggcaagaaaatgaaacgagtaactcaaatttatcggctgagtacgtattagcatatcttataggaaattacttttttttgacgcgttaatacgaaattactaaaatgaaagcttcagagaaggacagcttcccactgctgcctgacccatttctgaagaacctaaaacaaactgtcactactgtagcttgaatgctgccaaatggactgttagttgatctcctagtgcatactgtaccactcttctcttaaaacaagtaaggatggcaacaaaagagcgtactagatctaacatgcagcggtcatgaaattaaattggagggcagaggtgaaggcgtctggaaacgtgttcggaaactacttccaggttgcaacctatggcgagtctcatggaggtggtgtcggttgtgttatcagtggctgcccaccccgaatcccgctcaccgagggagacatccaagtcgaactcgatcgaagacggccaggtcagagcagaataacctccacgagagaggagactgatacatgcaaaattctttcagggacacatgaagggatgaccactggtacgccaattcatgtaattgtccccaatacagatcaagtgggcggtgataacagtgaaatagctaagatgtaccggccttcccatgcagacgcaacttacgacttcaaatacggtgtcagatcggtgcagggaggtggaaggtcatcaggcagagagaccattggaagggtggctgcaggcgctcttgcaaagaaaattcttaagctcaaatgtggagtagagatcttggcttttgtttccaaagtacatcaagttgtgcttccagaagacgcagttgattatgaaattgtaactttggaaaagatcgagagcaacattgttagatgtcctgatccacaatatgcagataagatgatagctgcagttgacaaagtacgagttcgaggggattccgttggcggggtggtcacatgcattgcaagaaatgttcctcgtgggcttggttctcctgtatttgacaaactcgaagctgaactttcaagagctatgctttctattcctgcaagcaatgggtttgagattggcagtggttttgccggtactgacttcactggaagtgagcataacgatgagttctatatggataaagctgggaatgtgagaacacgaactaatcgctcaggcggtgtacagcgagggatatcgaatggtgaaatcatacacttcaaagtatctttcaagccaacaccatccattgggctgaaacaaaacaccgtgtcaagggagcatcagaacgttgagtttttagcgaggggtcgccatgacccatgcgttgccccacgagctgttcctgtggtggaatccatggccgcgttggtcctcatggaccagctgatggcgcacatcgctcagtgcgagatgtttccactgaacattgccctgcaagaaccggttggccgttggctctgccaccagaacacctgagctggcagcaattgtaccatgagctattctacttgtctgaaacaacctcgagacggcttgtccctgtctctgtgaacatcatgtttgctgcttatttcgtcagttaataaattggtcgtg

SEQ ID NO: 15866 - protein, 395 aa, Panicum virgatum
  misc_feature: Ceres CLONE 1786331
  misc_feature (20)..(370): Pfam Name: Chorismate_synt Pfam Description: Chorismate synthase
  misc_feature: SWISSPROT Homolog: EC 4.2.3.5 Chorismate synthase
MKLNWRAEVKASGNVFGNYFQVATYGESHGGGVGCVISGCPPRIPLTEGDIQVELDRRRPGQSRITSTREETDTCKILSGTHEGMTTGTPIHVIVPNTDQVGGDNSEIAKMYRPSHADATYDFKYGVRSVQGGGRSSGRETIGRVAAGALAKKILKLKCGVEILAFVSKVHQVVLPEDAVDYEIVTLEKIESNIVRCPDPQYADKMIAAVDKVRVRGDSVGGVVTCIARNVPRGLGSPVFDKLEAELSRAMLSIPASNGFEIGSGFAGTDFTGSEHNDEFYMDKAGNVRTRTNRSGGVQRGISNGEIIHFKVSFKPTPSIGLKQNTVSREHQNVEFLARGRHDPCVAPRAVPVVESMAALVLMDQLMAHIAQCEMFPLNIALQEPVGRWLCHQNT

SEQ ID NO: 15867 - DNA, 1862 bp, Panicum virgatum
  misc_feature: Ceres CLONE 1786340
  misc_feature: Encodes the peptide sequence at SEQ ID NO. 15868
aaacccaaatccgcaacctgaaatccccaattccgctctccctccctcccccaccctcccgctcccccgcagcaggcgagagcgcgaagcggagcgtaggcggagagatggagtcggaccagggcaagctcttcatcggcggcatctcctgggagacgacggaggagaagctgagcgagcacttctcctcctacggcgaggtcacccagtccgccgtcatgcgcgacaagatcaccggccgcccccgcggcttcggcttcgtcgtcttcgccgaccccgccgtcgtcgaccgcgcgctgcaggacccccacacccttgacggccgcacggtcgatgtcaagcgggcgctctcgcgggaggagcagcaggccaccaaggctgcgaacccgagcggcgggcggaactctggtggtggaggcggcggtgccggcggtggcgatgccggtggagcgcggacaaagaagatctttgtgggcgggctgccctccactctgacggaggaggcgttcaggcagtacttccagacctatggtgtagtcactgacgtcgtcgtgatgtacgaccagaacacacaacgtcccagggggttcggcttcatcacctttgactcggaggacgcggttgaccgcgtgctgcacaagaccttccacgacctgggtgggaagatggtggaggtgaagcgtgcgatgcctcgtgaggcgaaccctggcggtgctggcgggcgttctggaggaggtgggggctatcagagcaacaatggccatagtgcaaactctggtggctatgatggtagaagtgatggcaggtatgggcaagcacagcagggtagtggtggctatgctggctacggtgcggggggttatggtactggtgcagctggatatggatatggtgctaaccctggagctggatatggaaattatggggctggagcatatggaggtgttcctgctgcttatggtggaccttacggcaacccgagtgtagctggctctggttaccaatgtggtcctccaggctcaaatagaggaccctgggccagtcaagctccatctgcttatggtgctggaggctatggtggcaacgctggctatagcgcttggaacaactcttctggtggtggcaatgctcccacaagtcaggcccctggtggagctgcaggctatggcagccagggctatgggtatggaggatatgggggggatgcgtcatatgctagtcatggaggatatggcgcttatggagcgcgtagtgacggtgctggcaatcctgctagtggtgcagtatctggatatggtgcagggtatgggagtgggagtggcaactctggttacccaggtgcttggaatgatccttcacaaggcggtggatttggtggttcagtcaatggaggttctgaagggcaatcaaattatggcagtggctacggcagtgtgcaacccagggctgctcagtaaagagaggcgattagagtgtctttgaaatgaaccagcacatctgggcattctatgtattgttttgttacgctgctctctgattgttctcagcctcctgaagatggcccatttgctggttaaatcagtatttctccgggttggaatgcttgaacctttagtggcttactactagaacttctagtcaataagtagctataatgtggagtagcagtatcttgcattattttcaagtttagctttatccatctgtgtgcttttccatgagtgaagtttcaggttgcttcatctctagtctcaaaagctagagtagcttgactgcttatgggcaaaattatctagttgtacctctgttctacagatcatatatttgtgtttgacagtagtatctatgctggatcttgttcc

SEQ ID NO: 15868 - protein, 449 aa, Panicum virgatum
  misc_feature: Ceres CLONE 1786340
  misc_feature (8)..(77): Pfam Name: RRM_1 Pfam Description: RNA recognition motif. (a.k.a. RRM, RBD, or RNP domain)
  misc_feature (120)..(190): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MESDQGKLFIGGISWETTEEKLSEHFSSYGEVTQSAVMRDKITGRPRGFGFVVFADPAVVDRALQDPHTLDGRTVDVKRALSREEQQATKAANPSGGRNSGGGGGGAGGGDAGGARTKKIFVGGLPSTLTEEAFRQYFQTYGVVTDVVVMYDQNTQRPRGFGFITFDSEDAVDRVLHKTFHDLGGKMVEVKRAMPREANPGGAGGRSGGGGGYQSNNGHSANSGGYDGRSDGRYGQAQQGSGGYAGYGAGGYGTGAAGYGYGANPGAGYGNYGAGAYGGVPAAYGGPYGNPSVAGSGYQCGPPGSNRGPWASQAPSAYGAGGYGGNAGYSAWNNSSGGGNAPTSQAPGGAAGYGSQGYGYGGYGGDASYASHGGYGAYGARSDGAGNPASGAVSGYGAGYGSGSGNSGYPGAWNDPSQGGGFGGSVNGGSEGQSNYGSGYGSVQPRAAQ

SEQ ID NO: 15869 - DNA, 1859 bp, Panicum virgatum
  misc_feature: Ceres CLONE 1786345
  misc_feature: Encodes the peptide sequence at SEQ ID NO. 15870
tccacgctattctacgccatgtatagcctagctacacatggcactagcaagctactgattcccccactttctagtactctctcggattgctaccctcttggaagccatggcggcgagcaccgtcgtcgactccgacggccaggagttccggcgctacggcgggcgtgtcaccacctttgtcgtcctctcctgcatcaccgctggcatgggcggagtcatcttcggttacgatattggaatctccggtggcgtgacgtcgatggacccgttcttgaggaagttcttccctaaggtgtatcggcagatgaagggttcaagcgtcagcaactactgcaagttcgacagccagcttctcaccgccttcacatcctcgctgtatgtcgccggcctcatcaccactttgctcgcgtcctgggtcacctccaggtgcggccgccgcccatccatgatcatcgccggggccgcgtttctcgctggcggggcgatcggaggagcggcagttgatgtgtacatggtgattttcggacgcgtgctccttggtgtcgggctcggctttgggaaccaggcggtaccgctctacctgtcggaaatggcccctcccgtgtaccgaggtgccttcagcaacagcttccagctctgcgtcagcatcggggccgttaccgcgcacctcatcaacttcggcgccgaaaagatcaagggagggtggggttggcgggtgtccctggcgcttgctgccgtgccaggcggattcctcgccctcggtgcgctcttcctgccggagacgcccaacagcctagtgcagcaaggcaaggaccaggaacacgccagggccctgctgaagaggatccgcggcgtcgacgacgtcagcgacgagatggccgacattgtcgccgccacccagcaggccaaggcaggccgcggcctgcaactgatcctgttccagcggcggtaccgcccccagctcgtgatggccgtcatgatacccttcttccagcaggtgacaggtatcaacgcgatttcgttctacgccccggtgctgctgcgcaccattggcttgggggagagcgcgtctctgctgtcggtggtggtgactggcagcatcggcttggtgtccacggccgtctccatgtctctcgtcgacagggccgggcggcggacgctcttcttcgtcggcggtgctcagatgctggtgtgccagctcatgatcggggccatcatggccacgcagctcggtgaccaagggcaggtgagcaaggccgtcgcgctcgtgctcatcgtcctcatagcggcctacgtggccgcgttcgcgctgtcttggggcccgctggggtggctggtgccgagcgaaatcttcccactggaggtgaggtctgctgggcagagcatcgcggtggccgtcaactttctcctcacgacgttcgtggcacagttgttcctggccatgctgtgccgcatgaagtccggcatcttcttcttcttcgcggcctggctggtgatcatgaccacctttgtgtacctgctgctgccggagaccaaggggaagccaatggagcaggtcggagagctatggggacaccattggttctggaaaaggttcgctggcacggaggaagggcggacaaccaacaagctatcatgcaactaaacttcaattcgttgacaaaaaaagaatatatgtaccagtcttgaattttttatatttgttactagtaaatgtgtttgtgtgttgcacatggagttggagtacgtatggttgcacggtcatcttgtcgatcgcatcatgtaccgatgtacgtgcactaattcttcttatgatcagacgttgtatcatatatttatacgatggttaattcatcttc

SEQ ID NO: 15870 - protein, 512 aa, Panicum virgatum
  misc_feature: Ceres CLONE 1786345
  misc_feature (28)..(488): Pfam Name: Sugar_tr Pfam Description: Sugar (and other) transporter
  misc_feature (23)..(440): Pfam Name: MFS_1 Pfam Description: Major Facilitator Superfamily
MAASTVVDSDGQEFRRYGGRVTTFVVLSCITAGMGGVIFGYDIGISGGVTSMDPFLRKFFPKVYRQMKGSSVSNYCKFDSQLLTAFTSSLYVAGLITTLLASWVTSRCGRRPSMIIAGAAFLAGGAIGGAAVDVYMVIFGRVLLGVGLGFGNQAVPLYLSEMAPPVYRGAFSNSFQLCVSIGAVTAHLINFGAEKIKGGWGWRVSLALAAVPGGFLALGALFLPETPNSLVQQGKDQEHARALLKRIRGVDDVSDEMADIVAATQQAKAGRGLQLILFQRRYRPQLVMAVMIPFFQQVTGINAISFYAPVLLRTIGLGESASLLSVVVTGSIGLVSTAVSMSLVDRAGRRTLFFVGGAQMLVCQLMIGAIMATQLGDQGQVSKAVALVLIVLIAAYVAAFALSWGPLGWLVPSEIFPLEVRSAGQSIAVAVNFLLTTFVAQLFLAMLCRMKSGIFFFFAAWLVIMTTFVYLLLPETKGKPMEQVGELWGHHWFWKRFAGTEEGRTTNKLSCN

SEQ ID NO: 15871 - DNA, 827 bp, Panicum virgatum
  misc_feature: Ceres CLONE 1786350
  misc_feature: Encodes the peptide sequence at SEQ ID NO. 15872
gcttcactccatcgccactccaagagctcccaatcgtcacgccatggccagcatggtcaccaccatggctgccatagcagctttctcggccccaagaagcctccagcaggccccggccccgttgcagctccgcccgaacgtcgtgtcgttcgtcgcacacccggttcgcgcgcaccgccggctggtggccgtggcggccagctcgccggccacgccgccggacctcgccaacaaggtgtccgagagcatcaagcaggcgcaggagacgtgcgcggacgacccggtgagcggcgagtgcgtggcggcgtgggacgaggtggaggagctcagcgcggccgccagccacgcgcgggaccggcagaagggcgccgacccgctcgaggagttctgcaaggacaaccccgagaccgacgagtgccgcatgtatgaggactgagccgcgcgaggctgctcgtcgtgccatccgccgtcgccgtcagcctgtcacctgatctagctggcttagctagagtggcatgacggcaacatgcgtgaatgtatgatggacctgctccttcgtctccttgggcgtttgagtttggtttcttagtttcatctggcttggtttgcaataaagcgaggtttgtctattggtttgttatttacaagaaatatttaggagctcctactgtaatcccaaggcaaagatgtaacaatcattaggaatatgtttgttggtgtgcttctggaacatgattttactaggagtatatctgtatatgtgatatgctgtgaaatatcgcagatgtaacgccttgtttatgccaggaatttaagagtctttgtcc

SEQ ID NO: 15872 - protein, 130 aa, Panicum virgatum
  misc_feature: Ceres CLONE 1786350
  misc_feature (61)..(130): Pfam Name: CP12 Pfam Description: CP12 domain
  misc_feature: SWISSPROT Homolog: EC 1.2.1.13 Glyceraldehyde-3-phosphate dehydrogenase (NADP(+)) (phosphorylating)
MASMVTTMAAIAAFSAPRSLQQAPAPLQLRPNVVSFVAHPVRAHRRLVAVAASSPATPPDLANKVSESIKQAQETCADDPVSGECVAAWDEVEELSAAASHARDRQKGADPLEEFCKDNPETDECRMYED

SEQ ID NO: 15873 - DNA, 668 bp, Panicum virgatum
  misc_feature: Ceres CLONE 1786353
  misc_feature: Encodes the peptide sequence at SEQ ID NO. 15874
gagcgcgaggggagggcatggtctctctcgtcccggccctcccgtctcgagcaaaatctctcttcttctcgctcagcattgtgtcttaggtcatcgagttagcgaaagggaaggaggggctaccatgggtatctcatccaagtggattaaatccttggtcggcataaggaagcatgaaaaaggacacaacacagaaaagcaacaaaagggacaaaatgctgaaagcagtgaaacttggagctctgctgatcagtcgctgcacaaatggaaacattctttggatcctgaaggtgaacttgcagatggagaaattccagtgcaaagtgaagcattgactgatggcagcaatacacaaacgatttcagattcaatttgtcttgacagtgcgtcacttgatgcccatgtctctcaggctgaacatgaaagtaaagaggatatggcagcaacagttatccagtctgcttttcgagcattcttggctagacgtgctttacgagctttgaaaggaatagttctacttcaagcccttatcaggggtcatgctgttagaagtcagacagaagaaacacttcagtgtatgcaagcactggtaaaagcccaagctcgtgtccgagccagacaagttcgtgttgccttagaaaatcaagtggcacgtaaaaagattcctg

SEQ ID NO: 15874 - protein, 181 aa, Panicum virgatum
  misc_feature: Ceres CLONE 1786353
  misc_feature (104)..(124): Pfam Name: IQ Pfam Description: IQ calmodulin-binding motif
MGISSKWIKSLVGIRKHEKGHNTEKQQKGQNAESSETWSSADQSLHKWKHSLDPEGELADGEIPVQSEALTDGSNTQTISDSICLDSASLDAHVSQAEHESKEDMAATVIQSAFRAFLARRALRALKGIVLLQALIRGHAVRSQTEETLQCMQALVKAQARVRARQVRVALENQVARKKIP

SEQ ID NO: 15875 - DNA, 692 bp, Panicum virgatum
  misc_feature: Ceres CLONE 1786353-R
ccttctggtccgagcaagaagaaaggtgcaaaccacaaatagtcatattcagatgttagttgtagttcatttgtgcgaccggtaaatgtattgccgtccacctctttggggtcattcaaacaaaaggcaaaggttacagatgaagtttttgaggaagtcacctcccagccgacagatgtagcttctaaggctaagcacaatstgaaagataagcttgtgcaagcgaatacaccagccaagcggttatccctgccaaataacgttggcagggaagcaggaaatggaccaactygtaggaattcgataaacaggtccgatccaaaagcacgggcagacgctgctaagcaaggtgggaagcaagttgagtgacaggcctgataacacattcctgttcttccaatctataagcgggggcggttcttggtgtgcttctccagctgtgcatggtacattgttgtacataacatttctcctgcatttagatttggccatttgggctgtgttccatattcctttgtgcaacgcggctggtgtgttgtgccatcttttcttatgttttcaccttccctgtaagttctaacagccgaaaggacctgtgttgtgttgtgtccccccaaaacattgatcctttgctgtgtgcacccttgttctctctgattaaaaaatgattgcaaaatatatgctcgctttcc

SEQ ID NO: 15876 - DNA, 721 bp, Panicum virgatum
  misc_feature: Ceres CLONE 1786355
  misc_feature: Encodes the peptide sequence at SEQ ID NO. 15877
acacaagcgccagctacagcaataacagcatggtatagatcatgtgtgttgcagcagcatgccaataattcttactcctcctcattagacctcacctccttctacctcctcttctcctcatatgcatgtgcagatcatatatagccagctgcagataggcaagtaagattgcttgtgtctcaaccgtataggttcatacagcagatcagatcacagtgcagatatatatatagacaagttagcaggagatcgaaaagatctctagatagatacatagctagggatcatccatcgaagtcgaagcagcaggtagctagctaggccgccagctgcaggcatgggcctgagggacatcgagctgactctcccgccggggttccggttctaccccagcgacgaggagctggtgtgccactacctgcacagcaaggtggccaacgagcggatcgccggcgccggcggggccatggtggaggtggatctgcacacccacgagccctgagagctccccgacgttgcgaaactgagcacgaacgagtggtacttcttcagcttccgcgaccgcaagtacgcgacggggctgcgcaccaatcgcgccaccaagtccggctactggaaggccaccggcaaggaccgcgtcatccacaaccccaaggccgccggccgcgccgtcgtcggcatgcgcaagaccctcgtcttctaccgcgggcgcgcccccaac

SEQ ID NO: 15877 - protein, 54 aa, Panicum virgatum
  misc_feature: Ceres CLONE 1786355
  misc_feature: The sequence is a functional homolog of SEQ ID NO 1197 in the 10/412,699 US patent application
  misc_feature: The sequence is a functional homolog of SEQ ID NO 866 in the 10/374,780 US patent application
  misc_feature: The sequence is a functional homolog of SEQ ID NO 1196 in the 10/412,699 US patent application
  misc_feature: The sequence is a functional homolog of SEQ ID NO 865 in the 10/374,780 US patent application
  misc_feature: The sequence is a functional homolog of SEQ ID NO 1198 in the 10/412,699 US patent application
  misc_feature: The sequence is a functional homolog of SEQ ID NO 867 in the 10/374,780 US patent application
  misc_feature: The sequence is a functional homolog of SEQ ID NO 326 in the 10/412,699 US patent application
  misc_feature: The sequence is a functional homolog of SEQ ID NO 760 in the 11/479,226 US patent application
  misc_feature: The sequence is a functional homolog of SEQ ID NO 2776 in the 10/374,780 US patent application
  misc_feature: The sequence is a functional homolog of SEQ ID NO 416 in the 10/225,066 US patent application
  misc_feature: Useful for making plants with modulated light quality sensitivity
  misc_feature: Useful for making plants with altered terpenoid content
  misc_feature: The sequence is a functional homolog of SEQ ID NO 891 in the 10/374,780 US patent application
  misc_feature: The sequence is a functional homolog of SEQ ID NO 2418 in the 10/374,780 US patent application
  misc_feature: The sequence is a functional homolog of SEQ ID NO 554 in the 10/225,066 US patent application
  misc_feature: The sequence is a functional homolog of SEQ ID NO 68 in the 10/286,264 US patent application
  misc_feature: The sequence is a functional homolog of SEQ ID NO 853 in the 10/374,780 US patent application
  misc_feature: The sequence is a functional homolog of SEQ ID NO 104 in the 10/225,068 US patent application
  misc_feature: The sequence is a functional homolog of SEQ ID NO 2014 in the 10/374,780 US patent application
  misc_feature: The sequence is a functional homolog of SEQ ID NO 22 in the 10/286,264 US patent application
  misc_feature: The sequence is a functional homolog of SEQ ID NO 314 in the 10/412,699 US patent application
  misc_feature: The sequence is a functional homolog of SEQ ID NO 734 in the 11/479,226 US patent application
  misc_feature: Useful for making plants with altered lignin content
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: The sequence is a functional homolog of SEQ ID NO 2110 in the 10/374,780 US patent application
  misc_feature: The sequence is a functional homolog of SEQ ID NO 304 in the 10/225,066 US patent application
  misc_feature: The sequence is a functional homolog of SEQ ID NO 954 in the 11/435,388 US patent application
  misc_feature: The sequence is a functional homolog of SEQ ID NO 106 in the 10/225,068 US patent application
  misc_feature: The sequence is a functional homolog of SEQ ID NO 2348 in the 10/374,780 US patent application
  misc_feature: The sequence is a functional homolog of SEQ ID NO 340 in the 10/412,699 US patent application
  misc_feature: The sequence is a functional homolog of SEQ ID NO 778 in the 11/479,226 US patent application
  misc_feature: Useful for making plants with altered carbohydrate content
  misc_feature: The sequence is a functional homolog of SEQ ID NO 890 in the 10/374,780 US patent application
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 492 in the 11/435,388 US patent application
  misc_feature: The sequence is a functional homolog of SEQ ID NO 741 in the 11/479,226 US patent application
  misc_feature: The sequence is a functional homolog of SEQ ID NO 2478 in the 10/374,780 US patent application
  misc_feature: The sequence is a functional homolog of SEQ ID NO 572 in the 10/225,066 US patent application
  misc_feature: Useful for biocontainment applications
  misc_feature: The sequence is a functional homolog of SEQ ID NO 854 in the 10/374,780 US patent application
  misc_feature: The sequence is a functional homolog of SEQ ID NO 2840 in the 10/374,780 US patent application
  misc_feature: The sequence is a functional homolog of SEQ ID NO 450 in the 10/225,066 US patent application
  misc_feature: The sequence is a functional homolog of SEQ ID NO 2416 in the 10/374,780 US patent application
  misc_feature: The sequence is a functional homolog of SEQ ID NO 914 in the 10/225,066 US patent application
  misc_feature: The sequence is a functional homolog of SEQ ID NO 854 in the 11/435,388 US patent application
  misc_feature: The sequence is a functional homolog of SEQ ID NO 1270 in the 10/374,780 US patent application
  misc_feature: The sequence is a functional homolog of SEQ ID NO 1423 in the 10/412,699 US patent application
  misc_feature: The sequence is a functional homolog of SEQ ID NO 898 in the 10/666,642 US patent application
MGLRDIELTLPPGFRFYPSDEELVCHYLHSKVANERIAGAGGAMVEVDLHTHEP

SEQ ID NO: 15878 - DNA, 1760 bp, Panicum virgatum
  misc_feature: Ceres CLONE 1786368
  misc_feature: Encodes the peptide sequence at SEQ ID NO. 15879
aaaaacagcaaaatttacctaggcatggcaatggcctgcatgatatctgtatatgccagacaatgtagtagtaacactctagaaccaagctcaaattaactatgcatttaatggaaattagttaccgtgaaatgcagctgggcatggcgagcgcgctggagacgctgtgcggccagtcctacggcgccaagcagtaccacatgctcggcatctacctgcagcgctcctagatcatcctcttcgcctgctccgtcgtcctgctccccgtctacctcttcaccgagcccatgctcgtcgccctgggccaggaccccaagatctccgccgtcgccggcaccatctccctctggtacatccccgtcatgttctcctacgtttggtccttcacgctccagatgtacctccaggcgcagagcaagaacatgatcatcacctacctcgccatgctcaacctcgccctccacctcaccctctcctggctcatgaccgtcaagttccagctcggcctggcaggggtcatgggctccatgatcatcgccatgtggatccccgtgtttggccagcttgcctttgtcttcttcgggggttgccctctcacatggaccgggttctcgtctgctgcgttcactgacctcggtgccatcatcaagctctcgctatcttctggtgtcatgctctgtttggaattgtggtacaacaccatattggtgctcctcacagggtatatgaagaatgcagaggttgcacttgacgccctttcaatatgccttaatatcaatggttgggagatgatgatttctgtcggctttttggctgcaacaggagtgcgagtggcaaatgagcttggagctggaagtgcaagaagggccaagtttgcgatatacaatgtcgtcatcacgtctttctttatcggatttgtgttatttgtgctcttccttttcttccgtggaagccttgcctacatttttactgagagtcgagcagtggccgatgctgttgctgacctctcgcctctgctagccttctccatattgttaaacagtgttcaaccagtgctatcaggtgttgctgttggtgctggctggcaaagtgtagttgcctacgttaacattacatcatactacttgattggcatccctcttggaggagtcctaggctatgtagtgggacttcatgtaaagggcatttggattggcatgctgctcggaacactggtccaaactattgtgcttctgttcataacattaaagaccgactgggaaaaacaggtggcgaatgctcaagagagattgaagagatggtacatggaagagaacagaaggctgcagggctcaaggggaaatccttgaaccggaagtggacctttgtgggttctccaaaaaaatatttgaagggcatcgagacccaatggcacacaaacataccttctcagttctcacatctcaagaacgaaatgaggaaccttagcctatccagaaaatgtgttcactcttcatgccaagaatgaaatccgttgttagcagtagcgaacatccagtagaaacgcactgcaccaattgccaacaggatggcatatgtacgtgagcctgtgttggctggccgtgagtttggcgagactgtttctctgcatcgattttggatttttgggggtatgctaatgtcgatcccatcaaagccctgcttgtggtttggacctttggggcatttgtgctgattttgtgtgtaaatttgcgcatataactagttccagatgtgcaccg

SEQ ID NO: 15879 - protein, 353 aa, Panicum virgatum
  misc_feature: Ceres CLONE 1786368
  misc_feature (125)..(288): Pfam Name: MatE Pfam Description: MatE
MLVALGQDPKISAVAGTISLWYIPVMFSYVWSFTLQMYLQAQSKNMIITYLAMLNLALHLTLSWLMTVKFQLGLAGVMGSMIIAMWIPVFGQLAFVFFGGCPLTWTGFSSAAFTDLGAIIKLSLSSGVMLCLELWYNTILVLLTGYMKNAEVALDALSICLNINGWEMMISVGFLAATGVRVANELGAGSARRAKFAIYNVVITSFFIGFVLFVLFLFFRGSLAYIFTESRAVADAVADLSPLLAFSILLNSVQPVLSGVAVGAGWQSVVAYVNITSYYLIGIPLGGVLGYVVGLHVKGIWIGMLLGTLVQTIVLLFITLKTDWEKQVANAQERLKRWYMEENRRLQGSRGNP

SEQ ID NO: 15880 - DNA, 731 bp, Panicum virgatum
  misc_feature: Ceres CLONE 1786397
  misc_feature: Encodes the peptide sequence at SEQ ID NO. 15881
cacggtcgacctgagcgacggccaccaccacggcaccacagctcccctccctctcctcctctccccgctcatcccccggccattaccgcagcctctccaagaagccggccgggatggctgcactcaaggcgtcgttcccgagggagctcagcgccgtctccttcctcgactccagcaggggtactttcggccagcacaaagtggattttacatatcaaaggaagggcaaaagagcaaattctctgagaaggacatgctgttctatgcaacaggctccaccaccagcatggcctgggcgagctgtagctgaacctggccggaggttgtgggatggcccgaagcctatctcgattgttggatcaactggttccataggaacacagacattggacattgttgcggagaatcctgataagttccaagttgttgctcttgctgctggctccaatgtgactcttctagctgatcaggtcaaaacattcaaaccaaaactagttgctgtaagaaacgaatcattagttgatgagctgaaagaagccttagctgattgtgaagagaagccagaaattattcctggggagcaaggcatcatagaggtcgctcgacacccagatgcagctacagttgtcacagggatagttgggtgtgcagggctgaagcctacagttgctgcaattgaagctggtaaagacattgcgttggcgaacaaagagacgcttattgcaggtggc

SEQ ID NO: 15881 - protein, 205 aa, Panicum virgatum
  misc_feature: Ceres CLONE 1786397
  misc_feature (78)..(205): Pfam Name: DXP_reductoisom Pfam Description: 1-deoxy-D-xylulose 5-phosphate reductoisomerase
  misc_feature: SWISSPROT Homolog: EC 1.1.1.267 1-deoxy-D-xylulose-5-phosphate reductoisomerase
  misc_feature: The sequence is a functional homolog of SEQ ID NO 2 in US patent 7067647
MAALKASFPRELSAVSFLDSSRGTFGQHKVDFTYQRKGKRANSLRRTCCSMQQAPPPAWPGRAVAEPGRRLWDGPKPISIVGSTGSIGTQTLDIVAENPDKFQVVALAAGSNVTLLADQVKTFKPKLVAVRNESLVDELKEALADCEEKPEIIPGEQGIIEVARHPDAATVVTGIVGCAGLKPTVAAIEAGKDIALANKETLIAG

SEQ ID NO: 15882 - DNA, 678 bp, Panicum virgatum
  misc_feature: Ceres CLONE 1786397-R
  misc_feature: Encodes the peptide sequence at SEQ ID NO. 15883
ctctgaatacgatgacattgagattgtgattcacccacagtctatcatacactctatggttgaaacccaggactcgtctgtcctagctcagctgggatggccagatatgagaataccaatcttgtacaccttatcttggccagatagaatttattgctctgaggtcacctggccccgtctggatctttgcaagttgggttcactgacgttcaaagctcctgacaatgtaaaatacccttcaatggacctcgcctatgcagctgggcgggctgggggcaccatgacaggtgtcctgagtgttgctaacgagaaggctgtggagttgttcattgatgaaaagattagctacctggacatcttcaaggtggtggagtttacatgtgacgcccataggaacgagctggtaacaaggccatcgcttgaggagatcatccattatgatctgtgggcgaggagatatgcagcgagcctacagacatcatttggccggagccctgtccttgcataagtatatgaagtgtgcgcgggtaggggacgtgtccactggtcattctggagctagatgaagcattagtggccatctagctcccctccggaacgtaaatcatgccttcgcatgaataaattgcatgtgttccttataaattttgatgcctgaagtgtggaaagtctgggcgg

SEQ ID NO: 15883 - protein, 168 aa, Panicum virgatum
  misc_feature: Ceres CLONE 1786397-R
  misc_feature: SWISSPROT Homolog: EC 1.1.1.267 1-deoxy-D-xylulose-5-phosphate reductoisomerase
  misc_feature: The sequence is a functional homolog of SEQ ID NO 2 in US patent 7067647
SEYDDIEIVIHPQSIIHSMVETQDSSVLAQLGWPDMRIPILYTLSWPDRIYCSEVTWPRLDLCKLGSLTFKAPDNVKYPSMDLAYAAGRAGGTMTGVLSVANEKAVELFIDEKISYLDIFKVVEFTCDAHRNELVTRPSLEEIIHYDLWARRYAASLQTSFGRSPVLA

SEQ ID NO: 15884 - DNA, 2081 bp, Panicum virgatum
  misc_feature: Ceres CLONE 1786401
  misc_feature: Encodes the peptide sequence at SEQ ID NO. 15885
cacgtgtgccaaccggactccggactccggttggcgaggggttccgatggagggagttggattggagccgcgccccggcggttaatccggagcgatccgtgtcggggttggcttgggtctcctccggcggggagactccaggccgactccgactgcgacacagccctcccgccgggcgttcagacgccaagtagtagcaggcaatcttgtccggacagccagtaccattttaaatggaggtgctctaggtctcgtctccgccccctcccacgactgaccgatcgatcgatcgccgccgtcctgccgtcgtccctcctgcgcacggcgtggggttcttcattttcttactgaatctttcaatctgctgggtttgtttgccggcgtcatgaccaaggcggcggccatggtggatgagcagaagccgaaaccgcggagcgaggcggcggcgaggtaccgggtggtggaagtctccgaggccgtcgccttcatcgtggaggtcaaggcgatgctcgaggaggctccgctcgtccgggacgagctgctcgacctcctcgtcggattcggagagggccgcggcaatgcgcacgccgtcaggtcccgcgcggcggggctcctccgggagcaccccgacgtgctcagccggttcaccgccttcctaggcggggcgaaggctcccgccatccccgcggaaggcctcgccgcgacgaggctgcggcggagcagcacgcgccgctggaacggaaggggcggccggtgccagcccaggccggcggaggaggggccagacgtaacgggcggagcggccggcgccggcacgagcgacggcccccggctacgggaaggcctcgcgttcctggaccgggtggaggaagaagcgggctacgagatcttgcgcaagttcgtcgccgtgctgctcgccgaggacatgtacgccgacgaggtctatgcccgcgtcagggacgcgttcggcccggcgcacgacggcctgctccaggatttcgccgccattttcctcccggggcaggaggagtgggaggcgcaccaagcgcgtcgcgtggcgccgctgcagcgcaggcccgacgacgccgaccgtgaaagctcgggcgccggggccgcggcgcggagcgaggtcgatcgtgacgtcgcgtgcagagccgtcaagaagaagcggcacgccgaagatggcgaccaccggagacacgcgctccgcgtcagcgaaagctccggcggcgcactgggccatggccacggccacgacaacgactacgccccgcggtgcaggaccaagaagccccgcgccgacgacgacggccaccgacgccacgccataagccacggcgagccctcggtcctcgacgccggcgtccacgtgaacggcaacaagaagaagccacgccggcgcgcgccgaacggcggcgagggatccagcgccacggcggcggcggcggcggagcccatccccggggacgacaacttggtccgccagttccgggagctgtgggtgttcaacacccactactcgacgctggtggacacgatggcgcgcgcggaggagctgctgctccgagccaccgccgccggcggcttccccgcttcggtggaggagctgttcccgcgccgcgagagccgggaattcctcaagagctactacgccggccactgggacatcatgcgggcggcgctggagcgcggcgagaccacccgcccggcgctcgaggcggtgctggagagcctgacccggaaggaggaggaggccgtcgccgaggcggtgaggcagcggcggcagcaggacgcggcgcgtgtcgctgaggggctaggcgggctcgtcatcgacagggtgcaccgcgaggtgcgccggcggcaggacgccggcggtggcggcgtgtcagggcagcgtgccagcgcgcgtgtccccggcggtggcagcaaccgtggcatggatcggacacgacatgatgctcagcaaagtctgttgtagtaacttgctaatacgtatccattttagtatgcgtttgttttttttttgctacattgtttattattttagcgtattgccttgtgaaagttattcattttaagag

SEQ ID NO: 15885 - protein, 530 aa, Panicum virgatum
  misc_feature: Ceres CLONE 1786401
  misc_feature (46)..(92): Pfam Name: PAH Pfam Description: Paired amphipathic helix repeat
MTKAAAMVDEQKPKPRSEAAARYRVVEVSEAVAFIVEVKAMLEEAPLVRDELLDLLVGFGEGRGNAHAVRSRAAGLLREHPDVLSRFTAFLGGAKAPAIPAEGLAATRLRRSSTRRWNGRGGRCQPRPAEEGPDVTGGAAGAGTSDGPRLREGLAFLDRVEEEAGYEILRKFVAVLLAEDMYADEVYARVRDAFGPAHDGLLQDFAAIFLPGQEEWEAHQARRVAPLQRRPDDADRESSGAGAAARSEVDRDVACRAVKKKRHAEDGDHRRHALRVSESSGGALGHGHGHDNDYAPRCRTKKPRADDDGHRRHAISHGEPSVLDAGVHVNGNKKKPRRRAPNGGEGSSATAAAAAEPIPGDDNLVRQFRELWVFNTHYSTLVDTMARAEELLLRATAAGGFPASVEELFPRRESREFLKSYYAGHWDIMRAALERGETTRPALEAVLESLTRKEEEAVAEAVRQRRQQDAARVAEGLGGLVIDRVHREVRRRQDAGGGGVSGQRASARVPGGGSNRGMDRTRHDAQQSLL

SEQ ID NO: 15886 - DNA, 344 bp, Panicum virgatum
  misc_feature: Ceres CLONE 1786414
  misc_feature: Encodes the peptide sequence at SEQ ID NO. 15887
ctccaccccacaggccgctgcggcggggcctccgacctccagctctaccgcgtctacgtccactactccgaggagtcttgcggccccctcgcgcctcgcgctgcgctgatgtacctctcgcccggtcccgtggagagcgaccgcaccgggcccgacagtgtgatcttccgcacaggcaactttgccgtcgggttgactcgagctgggaacgcctgggacttgggtctcttctttgagggagtccagctcatccattctgtgcttgatgtctagtagaaaggatgctgagatctgccactgtcgccaaggcgtccaagctggccattcccttgcagtgatgcacg

SEQ ID NO: 15887 - protein, 90 aa, Panicum virgatum
  misc_feature: Ceres CLONE 1786414
  misc_feature: Useful for making plants with modulated flowering time
LHPTGRCGGASDLQLYRVYVHYSEESCGPLAPRAALMYLSPGPVESDRTGPDSVIFRTGNFAVGLTRAGNAWDLGLFFEGVQLIHSVLDV

SEQ ID NO: 15888 - DNA, 2144 bp, Panicum virgatum
  misc_feature: Ceres CLONE 1786422
  misc_feature: Encodes the peptide sequence at SEQ ID NO. 15889
aaaacagcggccgccgcgtctaccccaccccgaccatgccctccctcgccgcgtccacctcctccctgcccgccccgccgcgcggcggtagcgacggctcccccaccgccaccgcgcgctcctcactcaacctcctccgctccctggcgcgcgcccgccgcgcggacctctcccaccgcgcgctgctcctcttccgcacgctccactcctccctctccccctccggccccgcgcccccgccgcacttctccctccccgccgcgctctccgcggccgccttcctcgccgcgctcccggagggccgccagctccacgcgctcgccgccaagctcgccttggcccccgcccacaccgtcgtcgccaactccctcgtccacctctacgcctcctgcggcctcccgggcgaggccgtcgcgctcttccgccggatccccggcccgaccctcgtgtcctggaacaccgccgtcgacgcgctggcgggcaacggagaccacctcgcggcgctggacctgttccgggagatgcggcggggccggccggacctggcgcccgacgcctacaccgtgcagagcgtgctcggcgcctgcgcgggcgccggcgcgctctcgctcgggctctacgcgcacgcgctcctgctccgcgagctcggcgccgccgccgcgggcgcggccgtgtcccgcgacgtgctcatcaacaactcgctcgtcgacctctacggcaagtgcggggcggtcaagctcgcgcgccaggtgttcgaccggatgcccgcgcgggacctcgcgtcctggaacgccatggtgctcgcgctcgccaaccacggccgcgtccgggactcgctggacctgttcgaccgcatgacgcgggtggagaacgtcgtgccgaacgcgatcacgttcgttgcggtgctcagcgcgtgcaaccacggcgggctggtggaggaaggcaggaggtactttgctgccatggtcagcgagtacgggatcaggccgaggattgagcactacgggtgcatggtggacatcctggcgcgggcggggctcatcgaggaggccttggacgttgtggccgggatggactgccgccccgactccatcatctggaggagcctgctcgacgcgtgctgcaagaggaacgcggggctggagctcagtgaggccatggccaagctggcgctcgatgtccctgatgatgccgtgagtggcgtctacgtcctgctatcgagggtctacgcgtctgctcaacggtggaatgacgtgggcatgatccggcgattgatgagcgaagagggtttcaagaaggagccggggttcagctccattgaaatggctggctccgtgcaccagtttgtcgcgggtgacacgtcgcatcctcagtcagaagagatttacgagaagctggatgagattcaacagagactcacgtctgctggatacaagccggacctgtcagaggcgcctatggtcgctgacgctgatcgcaccaagggcgccaccctgcgtttgcacagcgaacggctagccatatcatttggcctactcaatgcaacacacggggcaccaattcgaattctgaagaatcttagagtgtgcaaagattgccacacgatcagcaagcttatatcgaagatctacgatgtggagatcatcgtgagggatcgaattcggtttcaccacttcaaggatggatcatgttcgtgcaaggattactggtgattcttgagccatgattaccggcgatgctgtcttgaaagatcctgctgctgttccattcgacgcatctctgcaggcatccaagaggaggtgaattccatgtccaaagatcatgattacaaagatcacctggagatcactgacaggtggctgttcagcatgctgcgttagatcattctgttcaccatgtttgctctagtgagatactgaccgggagctggatctgttggcatccactgtctggttatatattgacagcatgaggtgatagttcacaacagaaggtaaatactgtctagaagtaaaaaggagaaatggtaaatccgttgtaagatacttgtacgatagaagctcatttgatcagttttcttttgtggaacatatatagcacttgtattaaatgcattttaatggataattcttcacatgccatcc

SEQ ID NO: 15889 - protein, 558 aa, Panicum virgatum
  misc_feature: Ceres CLONE 1786422
  misc_feature (249)..(283): Pfam Name: PPR Pfam Description: PPR repeat
MPSLAASTSSLPAPPRGGSDGSPTATARSSLNLLRSLARARRADLSHRALLLFRTLHSSLSPSGPAPPPHFSLPAALSAAAFLAALPEGRQLHALAAKLALAPAHTVVANSLVHLYASCGLPGEAVALFRRIPGPTLVSWNTAVDALAGNGDHLAALDLFREMRRGRPDLAPDAYTVQSVLGACAGAGALSLGLYAHALLLRELGAAAAGAAVSRDVLINNSLVDLYGKCGAVKLARQVFDRMPARDLASWNAMVLALANHGRVRDSLDLFDRMTRVENVVPNAITFVAVLSACNHGGLVEEGRRYFAAMVSEYGIRPRIEHYGCMVDILARAGLIEEALDVVAGMDCRPDSIIWRSLLDACCKRNAGLELSEAMAKLALDVPDDAVSGVYVLLSRVYASAQRWNDVGMIRRLMSEEGFKKEPGFSSIEMAGSVHQFVAGDTSHPQSEEIYEKLDEIQQRLTSAGYKPDLSEAPMVADADRTKGATLRLHSERLAISFGLLNATHGAPIRILKNLRVCKDCHTISKLISKIYDVEIIVRDRIRFHHFKDGSCSCKDYW

SEQ ID NO: 15890 - DNA, 647 bp, Panicum virgatum
  misc_feature: Ceres CLONE 1786424-R
  misc_feature: Encodes the peptide sequence at SEQ ID NO. 15891
acgccgtgatggaggtcctgcagacgcagatgataccgggagatgaggacggcaaggtgccgcgcgtgtggctcatcatgaaggaaggcgtgaggcacttcgccccggtgtacctcttggaggaagggtccaccatcagctgggtcccgtgcggccggaagctctcctgctcctaccccggcatcaagttcgcgtacggctttggcacttacttcggccacgaggtgtcggtgctggagatggacgggcgtttcgacaagctggacgagctcatgtagttggagacccacctcagcaacctgtcgtccaagttgtacggggaggtgacgcagcagatgctcacgcacgccgacttgccgggcagcaacaacggcacggggctcttccagaccatcgttgggctcaagatcagggaactctgggagcacatcgtcgccatgacggccgacgacgcagtcgaggtctgatgtctgatgaagccggtgttgatcggaggagggcgaccacatattatggttgttgttcttgtaacggtagtgccggatagattatcatgttgcattgcggttcaataaattggtatgtttgtaattgtataggagatgttgcagggacagttcagtgagcagtaagttgcatgcatgttc

SEQ ID NO: 15891 - protein, 91 aa, Panicum virgatum
  misc_feature: Ceres CLONE 1786424-R
  misc_feature: SWISSPROT Homolog: EC 2.7.1.19 Phosphoribulokinase
  misc_feature: Useful for making plants with altered lignin content
AVMEVLQTQMIPGDEDGKVPRVWLIMKEGVRHFAPVYLLEEGSTISWVPCGRKLSCSYPGIKFAYGFGTYFGHEVSVLEMDGRFDKLDELM

SEQ ID NO: 15892 - DNA, 468 bp, Panicum virgatum
  misc_feature: Ceres CLONE 1786424
cgggtaggtgcgccaaaggccccctggtgaaaatcaccgtaacaaggaaatcccactccttcgtcgtgccggcatccgagcccgccccgccgtcggcccatactacaacgctccagctgtcgcgcaagcgaccgcccgccccgccttcgccacactgtgcgcgcccctgcacgtcctccacaacaagaagcaatcctcctgcaccggctgccgcgacgacgaaaacgatgctgcctggccgggggaagtgatccgcgcggcgctgtcccgcacgctggtggaataccggccgctcgcccgccgcttcatcacctcaccccccgccggggaggccagcaccaactgcacctacaacggagcgtgcttcatggaggccgtctcccactgctgcctccaggacgtgaatggcctcaactaccctctcatggtctcagaggaatagctgctgcccgctccagaggaaagcct

SEQ ID NO: 15893 - DNA, 1405 bp, Panicum virgatum
  misc_feature: Ceres CLONE 1786429
  misc_feature: Encodes the peptide sequence at SEQ ID NO. 15894
ggtgctagccttgtctggcctctgggcgggcgcgcgcttcccgctggctgccggcgccccgtgcggctgcgccctgaccccagcgcggcagggcacctccgcgcccggctccgccagcatcccgcagccccgcaccggcttgcaccggtggcctcccgcccggccaccccgacgcgagcggtaggggccacgggcaacagccacagcaggcagcaggcagcaggcattgcccaatttctcagatacaccgaagtgaagcccacacaaaaattctggtgagttcttcgttgagctgccgggccggtctccttgagcctcgttacctcgctgttcgccggcgacccactggggctgacaggagaaggaagtcgctgcggcttccaaagggaaatcacggggttgtgttgtgcctggatgagatcaatgttcacaaacgtgcagcgccaggtcgagcgcaccggccgctccggcactccgcgggacaagtaccttcaggatcttgtgtctcagttccagaacgccacagatgaagagtctaaggagaagatagcggcaaacttggcaaatttcgcgtacgacccttttaattatgcattcatgcgtcagctgaatgttcttgagttattcttggactgcattacagagccaaatgaaaggcttatcgagtttggtattggtggaatttgtaactcatgtgttgatccggcaaatgctttagtcattgttcaatgcggcggaatcccattgattatacaatgcttatcaagcccggtgcggaacactgtgacttatgcacttggggctttgtattatctatgcaaccctgcgacaaagaaagagatcctgaaacctgatgtagttaggattataagagagtatgctgcagcaggagctgttaacaccagcttcagcaacatggctaatgctttcctggagaagcatgttgaccatgacctcgagggtgctatgcaaaggtgccataatgtcatgttcacagaaattggcattatgaaagagggagtaaaatggaaggaggcttcaagaccagaattgaaattctgctgtgcatccatatctgatgcttactcaagcagctagcttattccttgatgagagaacgacgcccataaggcctggctgaacaatgaattcctgctcttcagcaggaacatttccctggttttctatacttatagttcagttatctgtccaagtaatttggtaataccaacaattttctgttcttgaattgccagcttgacatctgcgctggcaatgctatccaacgaatactcactgaagtcaatgtagctgtcatgggttattcttccttttcggtctctggcagaacatgtaatttaaagactctgcaatgtagcttcaaagagttcattttccgttttcg

SEQ ID NO: 15894 - protein, 224 aa, Panicum virgatum
  misc_feature: Ceres CLONE 1786429
  misc_feature (93)..(133): Pfam Name: Arm Pfam Description: Armadillo/beta-catenin-like repeat
MFTNVQRQVERTGRSGTPRDKYLQDLVSQFQNATDEESKEKIAANLANFAYDPFNYAFMRQLNVLELFLDCITEPNERLIEFGIGGICNSCVDPANALVIVQCGGIPLIIQCLSSPVRNTVTYALGALYYLCNPATKKEILKPDVVRIIREYAAAGAVNTSFSNMANAFLEKHVDHDLEGAMQRCHNVMFTEIGIMKEGVKWKEASRPELKFCCASISDAYSSS

SEQ ID NO: 15895 - DNA, 723 bp, Panicum virgatum
  misc_feature: Ceres CLONE 1786434
  misc_feature: Encodes the peptide sequence at SEQ ID NO. 15896
catcggtggccgcgacggcaagatctacgtcgtcactgacccgagcaacgacgacgccgtcaacccgcgcaagggcaccctccgctacgccgtgatccaggacgagccgctctggatcatcttcaagcgggatatggtgatcacgctcaagcaggagctcatcatgaacagcttcaagaccatcgacggacgcggcgccaacgtgcacatcgccaacggcgcctgcatcaccatccagtatgtcaccaacgtcatcatccacgggctccacatccacgactgcaagcccacagggaacgccatggtgcgcagctcgcccagccactacgggtggcgcaccattgccgacggcgatgctgtgtccatcttcggcgccagccacatttgggtggaccactgctcgctggcgaactgcgccgacggcctgatcgatgccatcatgggatccacggctatcactgtgtccaacaactacttcacccaccacaacgaggtgatgcttctgggccacagtgactcctatgtaaaggacaaggcaatgcaggtgacaatagccttcaaccatttcggtgaaggcctcattcagagaatgccaaggtgccggcatggttacttccatgtggtgaacaatgactacacccactgggaaatgtacgccattggcgggagtgctgagccaaccatcaacagccagggcaacccgctaccttgctccgacaaacc

SEQ ID NO: 15896 - protein, 240 aa, Panicum virgatum
  misc_feature: Ceres CLONE 1786434
  misc_feature (50)..(235): Pfam Name: Pec_lyase_C Pfam Description: Pectate lyase
  misc_feature: SWISSPROT Homolog: EC 4.2.2.2 Pectate lyase
  misc_feature: Useful for making plants with altered cell wall content and/or composition
  misc_feature: Useful for making plants with modulated phosphate use efficiency
  misc_feature: Useful for making plants with altered carbohydrate content
IGGRDGKIYVVTDPSNDDAVNPRKGTLRYAVIQDEPLWIIFKRDMVITLKQELIMNSFKTIDGRGANVHIANGACITIQYVTNVIIHGLHIHDCKPTGNAMVRSSPSHYGWRTIADGDAVSIFGASHIWVDHCSLANCADGLIDAIMGSTAITVSNNYFTHHNEVMLLGHSDSYVKDKAMQVTIAFNHFGEGLIQRMPRCRHGYFHVVNNDYTHWEMYAIGGSAEPTINSQGNPLPCSDK

SEQ ID NO: 15897 - DNA, 702 bp, Panicum virgatum
  misc_feature: Ceres CLONE 1786437
  misc_feature: Encodes the peptide sequence at SEQ ID NO. 15898
aggaaggatcctaccaaacctaccaactcctcctccatcgatcgcccgcgcaaaggggaaacctaaaaactaactctcgccattcgccaactagctagctttctctctccgcttcggcgccgctgcggctccaccgcgttcgagcgagaggtttcgtgaagaaaccagagagtagcgtcgaggaactgatcgtcgatcgtgaagacgatgaccgtggtcgacgccgtgtccgcgggcgccggcgacgccgccgccgcggtgccgcagccggcggggaacgggcagaccgtgtgcgtcaccggcgcggccgggtacatcgcgtcgtggctcgtcaagctgctgctcgagaaggggtacactgtcaagggcaccgtcaggaacccagatgacccgaagaacgcgcacctcaaggcgctggacggcgccgccgagcggctcatcctctgcaaggccgacctcctggactacgacgccatctgccgcgccgtggagggctgccacggcgtcttccacaccgcctcccccgtcaccgacgaccccgtgagtaccacgcccacacctcgatctccggccaccgccgaactcgatcaactgctcccttgcggcggcggcggcggctgccgccatgaccgaccaagctaagacagccgcagcggacatcgatcgatcatgcatgatgacgttctgctaaccgcgcatgcg

SEQ ID NO: 15898 - protein, 144 aa, Panicum virgatum
  misc_feature: Ceres CLONE 1786437
  misc_feature: SWISSPROT Homolog: EC 1.1.1.219 Dihydrokaempferol 4-reductase
  misc_feature: Useful for making plants with altered carbohydrate content
MTVVDAVSAGAGDAAAAVPQPAGNGQTVCVTGAAGYIASWLVKLLLEKGYTVKGTVRNPDDPKNAHLKALDGAAERLILCKADLLDYDAICRAVEGCHGVFHTASPVTDDPVSTTPTPRSPATAELDQLLPCGGGGGCRHDRPS

SEQ ID NO: 15899 - DNA, 676 bp, Panicum virgatum
  misc_feature: Ceres CLONE 1786437-R
  misc_feature: Encodes the peptide sequence at SEQ ID NO. 15900
tggtggtggtgaacccggtgctggtggtgggcccgctgctgcagccgacggtgaacgccagcatcgcgcacatcctcaagtacctggacggctccgcccgcaccttcgccaacgccgtgcaggcctacgtcgacgtccgcgacgtcgccgccgcgcacctccgcgtcttcgagagccccgccgcctccggccgccacctctgcgccgagcgcgtcctccaccgcgaggacgtcgtccgcatcctcgccaagctcttccccgagtaccccgtccccaccaggtgctccgacgaggtgaacccgcggaagcaggcgtacaagtttacgaaccagaagctccgggacctggggctggagttccggccggtgagccagtcgctgtacgacacggtgaagagcctccaggagaagggccacctgccggtgctcgccgacgagcaggcgccggaggccgcccccggcgccgaggcgcagcagggcgggatcgccatccgtgcgtgaggtccaggccgatggcgccacgaatgaacagaatgcaagcgatgttcatatactgcccctgatgtgtaacccaagtagtgtttgttgcctgtctgatgtccctagcaagacttgaaacgtcgtgctcgtccttgtgaactacatggtgggtgaataaatatggttaatgttcgttc

SEQ ID NO: 15900 - protein, 165 aa, Panicum virgatum
  misc_feature: Ceres CLONE 1786437-R
  misc_feature: SWISSPROT Homolog: EC 1.1.1.219 Dihydrokaempferol 4-reductase
  misc_feature: Useful for making plants with altered carbohydrate content
  misc_feature: Useful for making plants with altered cell wall content and/or composition
  misc_feature: Useful for making plants with altered lignin content
VVVNPVLVVGPLLQPTVNASIAHILKYLDGSARTFANAVQAYVDVRDVAAAHLRVFESPAASGRHLCAERVLHREDVVRILAKLFPEYPVPTRCSDEVNPRKQAYKFTNQKLRDLGLEFRPVSQSLYDTVKSLQEKGHLPVLADEQAPEAAPGAEAQQGGIAIRA

SEQ ID NO: 15901 - DNA, 1182 bp, Panicum virgatum
  misc_feature: Ceres CLONE 1786439
  misc_feature: Encodes the peptide sequence at SEQ ID NO. 15902
gcaagagcttccccatttcgaacgccggagcgcgaggaagacgcacgcagaggagatttggcacactacaaagattagaaactgaattgtaagatggcatcagcggagctttcccgtgaggagaatgtgtacatggccaagctcgctgagcaggctgagaggtacgaggagatggttgagttcatggagaaggtagccaagaccgttgactcggaggagctcactgtcgaagagcgcaacctcctgtctgttgcctacaagaatgtcattggagcccgccgtgcttcatggcgcatcatctcctccattgagcagaaggaggagggccgaggcaatgaggaccgtgtaacactcatcaaggactaccgtggcaagattgagactgagctcaccaagatctgtgacggcatcctcaagctgctcgagtcccaccttgtgccctcatccactgcccccgagtccaaggtattctacctcaagatgaagggtgattactacagataccttgctgagttcaagactggggctgagagaaaggatgctgctgagaataccatggtggcatacaaggctgcccaggacattgctttggctgagctagctccaactcaccctattaggcttggcttggcacttaacttctcagtgttctactatgagattctcaactcacctgatcgcgcctgcagtcttgcaaagcaggcttttgatgaggccatctcggagctggacaccctgagcgaggagtcctacaaggacagcactttgatcatgcagctccttcgtgataacttgaccctatggacatccgacatctcggaggaccctgctgaggagatcagggaggcgccgaagcacgactcaagcgaggggcagtaaagcaggctttacgtgccctagaaactagtagctagtgtttgctgctgtctaatgacactatgcaaatgttatctggaccctggtttcttcggtgcgacgcttgtagccgtgctatgattattgtcggcaaaatctgggggctccccatatgagatgttgccgggcaaggcctcggtgcgtcccacttgtagcaggtgggttacactggagccaggtttggttgggtagggaagccccaaatactgttggtgtcacttgtatttttatcttttcatcgctgtttattgtgagttgtcctgagtt

SEQ ID NO: 15902 - protein, 261 aa, Panicum virgatum
  misc_feature: Ceres CLONE 1786439
  misc_feature (8)..(245): Pfam Name: 14-3-3 Pfam Description: 14-3-3 protein
  misc_feature: The sequence is a functional homolog of SEQ ID NO 789 in the 11/479,226 US patent application
  misc_feature: The sequence is a functional homolog of SEQ ID NO 786 in the 11/479,226 US patent application
  misc_feature: The sequence is a functional homolog of SEQ ID NO 2350 in the 10/374,780 US patent application
  misc_feature: The sequence is a functional homolog of SEQ ID NO 344 in the 10/412,699 US patent application
  misc_feature: The sequence is a functional homolog of SEQ ID NO 790 in the 10/225,066 US patent application
  misc_feature: The sequence is a functional homolog of SEQ ID NO 805 in the 11/479,226 US patent application
  misc_feature: The sequence is a functional homolog of SEQ ID NO 801 in the 11/479,226 US patent application
  misc_feature: Useful for making plants with modulated drought sensitivity
  misc_feature: Useful for making plants with modulated water use efficiency
  misc_feature: The sequence is a functional homolog of SEQ ID NO 342 in the 10/412,699 US patent application
  misc_feature: The sequence is a functional homolog of SEQ ID NO 782 in the 11/479,226 US patent application
  misc_feature: The sequence is a functional homolog of SEQ ID NO 797 in the 11/479,226 US patent application
  misc_feature: The sequence is a functional homolog of SEQ ID NO 793 in the 11/479,226 US patent application
  misc_feature: The sequence is a functional homolog of SEQ ID NO 809 in the 11/479,226 US patent application
  misc_feature: The sequence is a functional homolog of SEQ ID NO 1777 in the 11/479,226 US patent application
MASAELSREENVYMAKLAEQAERYEEMVEFMEKVAKTVDSEELTVEERNLLSVAYKNVIGARRASWRIISSIEQKEEGRGNEDRVTLIKDYRGKIETELTKICDGILKLLESHLVPSSTAPESKVFYLKMKGDYYRYLAEFKTGAERKDAAENTMVAYKAAQDIALAELAPTHPIRLGLALNFSVFYYEILNSPDRACSLAKQAFDEAISELDTLSEESYKDSTLIMQLLRDNLTLWTSDISEDPAEEIREAPKHDSSEGQ

SEQ ID NO: 15903 - DNA, 2323 bp, Panicum virgatum
  misc_feature: Ceres CLONE 1786444
  misc_feature: Encodes the peptide sequence at SEQ ID NO. 15904
ggcagctcgcggccgcgggcgaattctaaggtgttatttcgcgcttggttccatggattcacgtgtgctgctcttgcttgtctggtgattcaggaggaggagggggagccgactggcgcgcgctgatcggcggatggcgcgtcggattggagctgcggagctcggcggattccgagcccctcgggagggggatcgaatgccaggagctccagtttcagctccagactgtgttcttgtcgcctcgcctgcctcagctaagctctgactttgctcagtccttgttgcaagttgctgtttgctctcccgtatcctgcctgttccgggcgtccgtctgacttgagactgcgaggagatggacgacgaggactactcgtgggtgcggcgcacaagattctcgcagtccatcgtcaggtccagctccggcagggagcagttcagtcgcgacgccgaactgaagctcaacggattgggcacggggcgcaggcttcatcgccaggatctgcagcacctggcgaagggatccgtgctctcgagctcagcaaggctgccgattcccaaagccaaatcggcaggtgctcagtcggaacggaagctgaagcatgcgtcttcagaaggccaattgaaccgagacaggagcagtgatcgttcgtcgcggcaagcatcgccgaagcaggaccggatcaagggggtcgacctgagcttggacattccacagcggcatgcggttcggccatccgacgatgagagcccaaacgcgctggatttctccttccactcggatgagcagagccagacgcttcagagagtgtgctccagccctgctcctttctactcgcgggatgcagcaccgccagctgatgatttcagagcgcgaagtgcatctatgaagggcgccggagaggtgtcgaagccgacgccaaagccgaagcgcagggcaaaatcccccatccccaagcgcgccatctctgaagtgttcaaggaggccaaggctgccaccaagcgattctccagcccgcaacggcagaggaagcccacgtctccaaggtcacctgaagacagccctccgttcggcttcgcttcgctgagaacaccgagcaagctgaagattaataggaggacctcctcatggccgaggaggaactctgatgatggaccggcaaaggttgctgcatcggatatccttgagagatggacagttgaccgctcgcagttgctcatcggccacagatttgcatccggggcgtataaccgattgttccatgggatttacaaggagcaacctgttgctgtgaagtttatcaggcagcctgatgatggtgaggatgacgagttgtctgctcggcttgagaagcagttcactacagaggttaccattctggcaaggctccaacatcgaaatgtcatcaagcttattggagcatgcaattgtccaccggtcttctgtgtcatcaccgagttcctgtctgggggttctttgagggctttcttacgcaagttggagcgtaagactcttcccatggagaaggtcatttctattgccttggatattgctcgtggcctggaatacattcacctgcaaggaattgttcaccgtgatgtgaaacccgagaacattctatttgatggagaattctgcgctaaggtcgtcgattttggagtggcctgtgaagaagcacactgcaatttgttaggggatgatccgggtacttatagatggatggcaccagagatgtacaagcacaagccatatggccggaaggttgatgtttatagctttggacttgtcttgtgggaattggtcagtggctcactcccttatgaagatatgacaccactccaagcagctttcgcagttgtcagtaagaacttgagaccggctattccttctagctgcccgccagcagtaaaaatccttattgagcagtgttggtcctggcaaccagagaggaggcctgagtttcgacagattgtttcaatccttgaaaacctcaagacagttcttgaaagaaatggaacgctcgacaaaatcccaagcttcatctgccagccccaggaatgcaacgatcagaacaagaagaaggtttccagctggatccagaggctctcatacactcaacctgatttttccggacctccacccccgaagttactgtaattatgcgtcttcttgtcaatttttagtagcgtgttatctggtaggtagcaactctgtaaatttaattttttctccttttctgttgagagatcagaagtttttcaatggtatatactcggacacagtgcatacacatttttgaggatcatagtaaacactttttttggc

SEQ ID NO: 15904 - protein, 600 aa, Panicum virgatum
  misc_feature: Ceres CLONE 1786444
  misc_feature (287)..(543): Pfam Name: Pkinase Pfam Description: Protein kinase domain
  misc_feature: SWISSPROT Homolog: EC 2.7.11.1 Non-specific serine/threonine protein kinase
MDDEDYSWVRRTRFSQSIVRSSSGREQFSRDAELKLNGLGTGRRLHRQDLQHLAKGSVLSSSARLPIPKAKSAGAQSERKLKHASSEGQLNRDRSSDRSSRQASPKQDRIKGVDLSLDIPQRHAVRPSDDESPNALDFSFHSDEQSQTLQRVCSSPAPFYSRDAAPPADDFRARSASMKGAGEVSKPTPKPKRRAKSPIPKRAISEVFKEAKAATKRFSSPQRQRKPTSPRSPEDSPPFGFASLRTPSKLKINRRTSSWPRRNSDDGPAKVAASDILERWTVDRSQLLIGHRFASGAYNRLFHGIYKEQPVAVKFIRQPDDGEDDELSARLEKQFTTEVTILARLQHRNVIKLIGACNCPPVFCVITEFLSGGSLRAFLRKLERKTLPMEKVISIALDIARGLEYIHLQGIVHRDVKPENILFDGEFCAKVVDFGVACEEAHCNLLGDDPGTYRWMAPEMYKHKPYGRKVDVYSFGLVLWELVSGSLPYEDMTPLQAAFAVVSKNLRPAIPSSCPPAVKILIEQCWSWQPERRPEFRQIVSILENLKTVLERNGTLDKIPSFICQPQECNDQNKKKVSSWIQRLSYTQPDFSGPPPPKLL

SEQ ID NO: 15905 - DNA, 1578 bp, Panicum virgatum
  misc_feature: Ceres CLONE 1786453
  misc_feature: Encodes the peptide sequence at SEQ ID NO. 15906
acctcctcgcacacttctcttcgcccaatcgacgcccccgcttcgtctccccatcctatcgcagccgccgccgccggaagcccgaaaccgtagccccctcgcccctcgacctcggcagagcgatgacgatgcggtccggcaggcggatgttgtagccagaagggtcagttccccagtccccacatacaagaacgccgactgtagggtgacctttcccgccgccgtctccatggcgaccctcaatccctttgaaatcctgggcgccgacgacaacgacgatcccacgcagctgctggccgctgctgcggcagcgaagcagaaggccgaggcgaagaagcaggcggcggcggcggcggcggcggcggccacaggaaagggcgcgcagccagcccccgccaagttgccaaccaagcctgctcccccagcccaggccgtgagggagtctcgcagtggtggtgctccctctcgtggaggatacgaacgtggcgaacgcggccgtggcagaggcgggcgagggtatggccagaaccgtgagtatggcagcgaagatgctaatgggtttcagggaggatatggtgctggaggtggtgccagagctggaggtgaaaaaggtgcccaagacagaggtcctcggccaccctaccgtgtaggcggaggaggccggcggggtgggtaccgtgatggtgagtttggcgatgactctgagaggccataccggaggacctatgagcgccatagcggtaccggccgtgggtttgaaatgaagcgtgagggtgcagggcgtgggaactggggaactaccactgatgaaattatcgcccaggaaactgaggaaggcctgaagctggatgagaaggcccctgttccagagaagcagggtgcactggaggatgctccacaggcagaggagaacaaggatagcaaggacacaaatgaggaagaagagaaggaagaggataaggagatgaccctggaggagtttgagaaaataagggaggaaaagcggaaggcacttcttgccctaaagactgaagagaggaaggttgaagttgataaggacctgcagtctatgcagccgctttccactaagaaaggaaatgacgatatttttgtaaaactgggttctgataaggatgctctgaagaaaaaagaaaatgctgaacgcgatgagcgtgctaagaagtctctgagcatcaatgagttcttgaaacctgctgatggagaaaggtactatggtggccgaggtcgtggtaggggtcgtggtgaccgtggtggcttcagaacaggatatggtgggggttaccatgctccaccagctgctcctgcaattcaagatcaatcccaattcccgtcacttggtgggaagtgaaaaacacctgcctgaaaacagaatttgctgccagaaaacacatctttgttgtcaatgtcgagtccttgtttttctgcagattaccgtgccaattctaatcagacataatggtgtgtttattccctgctgtgtcagtcgactttgtatatcagagttgcttgtaagaattttgtcaggctattatcagtgtccttccttcgacagcagtc

SEQ ID NO: 15906 - protein, 379 aa, Panicum virgatum
  misc_feature: Ceres CLONE 1786453
  misc_feature (163)..(273): Pfam Name: HABP4_PAI-RBP1 Pfam Description: Hyaluronan / mRNA binding family
MATLNPFEILGADDNDDPTQLLAAAAAAKQKAEAKKQAAAAAAAAATGKGAQPAPAKLPTKPAPPAQAVRESRSGGAPSRGGYERGERGRGRGGRGYGQNREYGSEDANGFQGGYGAGGGARAGGEKGAQDRGPRPPYRVGGGGRRGGYRDGEFGDDSERPYRRTYERHSGTGRGFEMKREGAGRGNWGTTTDEIIAQETEEGLKLDEKAPVPEKQGALEDAPQAEENKDSKDTNEEEEKEEDKEMTLEEFEKIREEKRKALLALKTEERKVEVDKDLQSMQPLSTKKGNDDIFVKLGSDKDALKKKENAERDERAKKSLSINEFLKPADGERYYGGRGRGRGRGDRGGFRTGYGGGYHAPPAAPAIQDQSQFPSLGGK

SEQ ID NO: 15907 - DNA, 632 bp, Panicum virgatum
  misc_feature: Ceres CLONE 1786464-R
  misc_feature: Encodes the peptide sequence at SEQ ID NO. 15908
tgcaaatgaccgggaatccatctctgttactgttcaagaagtaactcctagaactgtcggagcactgattgctctttatgaacgtgctgtggggatttatgcttctttggtaaatataaacgcttatcaccagcctggtgttgaggctgggaaaaaggcagctggagaagtactggcacttcagaaaagggtgctgactgtattaaatgaggccgcttgcaaggaccctgctgagccattgaccctggatgaaattgcagatcgctgtcactgcccagaagatatcgagatgatctacaaaataatccagcacatggctgcgaatgacagagcgcttatagcagaaggcagctgtggttctcctcgcagcgtcaaggtgtatcttggagaatgcaatgtagatgaagacatgcaggctgcatagattcggggcagtcggaattggtgtaaaattgtgttggaataaaaagagcagcgccatggtgtggccatgcgtgcgtgttcctgatgtgccatcacccatttgtttcttgtttgaatgtggcacggttgctgcaacgatgtatcttttattccccttgggtctccctttgcatacaaaatacaaagggatgaagaaagatagctgcatc

SEQ ID NO: 15908 - protein, 140 aa, Panicum virgatum
  misc_feature: Ceres CLONE 1786464-R
  misc_feature: SWISSPROT Homolog: EC 5.3.1.9 Glucose-6-phosphate isomerase
  misc_feature: Useful for making plants with modulated flowering time
ANDRESISVTVQEVTPRTVGALIALYERAVGIYASLVNINAYHQPGVEAGKKAAGEVLALQKRVLTVLNEAACKDPAEPLTLDEIADRCHCPEDIEMIYKIIQHMAANDRALIAEGSCGSPRSVKVYLGECNVDEDMQAA

SEQ ID NO: 15909 - DNA, 586 bp, Panicum virgatum
  misc_feature: Ceres CLONE 1786464
atattcctcccaaataaagccaagcccagcgaggccaccaactccccctcgtggactcttccccccaaaactaaaccctctctggcgccgtcaacgcggcggatgtgcgtgagcccgtgaggcgaaccgagcgaggggccaaccaccaccgccgccccctcctgctgcgacgacgatggagtccatctccggcgcggcggcgccgccctcgtgcgccgcgtgcggcctgcgggtgctgggacacctcctgctccgcccctccgaactccgcctccgcgcgccccgctcctttgcccatctctcccgctgctccatcttctctaaatcccttccgattccagacgattggctggacgcttatgcgtgggaaaggagctgcgacagctgacgctgagtggaaaaagacccggtagaacagtggaaactttacggaatctggctgtaactgtgtttagttctcgtctggatagtttacatctctgtgatggagttataatgagagttgcttcaccaaaaggagatattgatgggtaggacctgcagaaacgtgttggactgatagaaagatacaattgacacttaaggc

SEQ ID NO: 15910 - DNA, 1775 bp, Panicum virgatum
  misc_feature: Ceres CLONE 1786465
  misc_feature: Encodes the peptide sequence at SEQ ID NO. 15911
accttaaacctactatcccccttctcccgccgccgcttcctccctccctccgcacgcgcgccgccagctccggccgcgtctggcgactctaccgccgcctcctcctccccccgcacgcgtgacccagttatcgccgtgcgtcaaggctctccgccgccgcgaccgccttccgcccgcgcaccgctaattgctctagggatggcgacttccgcgctgctccgcgctctccggcggccttcgcccgaagccgcgctgcgattggcaatgagtgcaaatgcgcaagcaattactggatatagacatctgaataacaggaatctaagtgttttcaatgagttctcgaagcaactaaagggggaggccaagagtaatcctgaactccagaaatccatgaaagagtttagcgagaaacttggtgtggtaaaggaagacctcaaagtaagaactaagaaaacaacagagacaatatacaaaagtgttgatgatgtctggactgaagctgaggagacatctaaaaaggttactgcaaatatcaaagaaaaagtgtttgctgctaaagaagaggtaaaggaaagttttggacttggaaaagaagagagtacaagttgcaaggatggttcgcctggagcttcaaaaaatgagaaaaccgaggcatcctcgcattcagaccgcgcgtctgaagatgccagccatacattatttactaaattgaagtcaacaatctcatctgcttcacctgttgtatctggtgcatttgcaaagttgaaggatacaaaagtatcaactttagctaaacagggatatgaagttatcaaggatgaattaagctctacctctagcagaaagaagaaacatcaagctagacatgcttctgctaaggtagaaaagagtacaagaactgatttagttattatgccaacaaagaagtcggtgctgggtgaaaaatgggaagcatttaagaataagatccgaggtcacccagtctataagagagttgatgaatacaccaaacctgttgtaaccaagggacaagaggtagctgaggacgtccgagaaagatgggagacaagtgacaatccagtagttcagaaaatccaagatttgaacgaatctttgcttgaagaaaccacagctgcggtgacattcagagaaatccggcaacgagacccgtccttttctttatctgattttgttgctgatgttcaagaaatgatcaagcctgttctcactgcatattcaaagggtgatatggagactttaaaaaaatattgcaccaaggaagtgattgagcgctgcaaaggagagagacaagcgtatgcatcacagggcatattttttgaccacaagatcctgcatatttcagaagctgatgtattggaaacaaaaatgtttggatcttcacccctgattatcttgcgtttccaaacgcaacagatatactgtgtccgagatagagaaggacaagtcatggaaggaggacaggataccattcaaaccgtcttttattcatgggctatgcaacttcttgacagcgatgaggtgccagaagaggaatcatattacccggtttggcggctgcgtgagatgcaacaagctggcatcaaagccctcatatagagcagactgtcttgttttcgttcttgttcttcatttgatcagctattgctctactttcactgctgctcaacgagccatgtgcccccttggtgcaaagcaattttccacattgtttcttttgatgtgtcctgatggtagcagtctgttcctattctttc

SEQ ID NO: 15911 - protein, 472 aa, Panicum virgatum
  misc_feature: Ceres CLONE 1786465
  misc_feature (312)..(465): Pfam Name: Tim44 Pfam Description: Tim44-like domain
MATSALLRALRRPSPEAALRLAMSANAQAITGYRHLNNRNLSVFNEFSKQLKGEAKSNPELQKSMKEFSEKLGVVKEDLKVRTKKTTETIYKSVDDVWTEAEETSKKVTANIKEKVFAAKEEVKESFGLGKEESTSCKDGSPGASKNEKTEASSHSDRASEDASHTLFTKLKSTISSASPVVSGAFAKLKDTKVSTLAKQGYEVIKDELSSTSSRKKKHQARHASAKVEKSTRTDLVIMPTKKSVLGEKWEAFKNKIRGHPVYKRVDEYTKPVVTKGQEVAEDVRERWETSDNPVVQKIQDLNESLLEETTAAVTFREIRQRDPSFSLSDFVADVQEMIKPVLTAYSKGDMETLKKYCTKEVIERCKGERQAYASQGIFFDHKILHISEADVLETKMFGSSPLIILRFQTQQIYCVRDREGQVMEGGQDTIQTVFYSWAMQLLDSDEVPEEESYYPVWRLREMQQAGIKALI

SEQ ID NO: 15912 - DNA, 215 bp, Panicum virgatum
  misc_feature: Ceres CLONE 1786467
  misc_feature: Encodes the peptide sequence at SEQ ID NO. 15913
aacttgttccctgtccttcaggatcgaaagtcaatacatgttatccttgctctaggtgaacagcgtaagaatgtagccactttactagttcacgctgggattgcaaggaaggagaacatctacattcacggcttctaacggatctgtcaatgcctgcgtgccccattggccgcgtttcatcatacttggaaccgtgaagtcccgatattatagtt

SEQ ID NO: 15913 - protein, 45 aa, Panicum virgatum
  misc_feature: Ceres CLONE 1786467
  misc_feature: Useful for making plants with modulated biomass
  misc_feature: Useful for making plants with modulated flowering time
NLFPVLQDRKSIHVILALGEQRKNVATLLVHAGIARKENIYIHGF

SEQ ID NO: 15914 - DNA, 655 bp, Panicum virgatum
  misc_feature: Ceres CLONE 1786483
  misc_feature: Encodes the peptide sequence at SEQ ID NO. 15915
cgcttccgcactcccccacccgtccctcccgcgccgccaccccccccccccccccacaggtaaggaggaggaggcgaggatgtcgcaccgcaagttcgagcacccgaggcacggttccctcggcttcctccccaggaagcgcgcctcccgccaccggggcaaggtgaagtccttccccagggatgaccccaagaagccatgccacctcaccgccttccttggctacaaggctggcatgacacacattgtccgtgaggtcgagaagcctggatccaaactccacaagaaggaaacctgcgaagctgttaccatcattgaaactcctcctgttgtcattgttggtcttgtggcatatgtgaagactcctcgtggcctccgcaccctcaactctgtctgggcacagcacttgagtgaggaagtgaggaggaggttctacaagaactggtgcaagagcaagaagaaggctttcactaagtatgctctaaagtatgacagtgatgcaggcaagaaggaaattcagctgcagcttgagaaratgaagaagtatgcttctgttatccgcgtgattgcccacacccagattaggaagatgaagggtttgaagcaraagaaggctcacctcatggagatccaggtcaatggtggtaccattgcc

SEQ ID NO: 15915 - protein, 191 aa, Panicum virgatum
  misc_feature: Ceres CLONE 1786483
  misc_feature (50)..(191): Pfam Name: Ribosomal_L3 Pfam Description: Ribosomal protein L3
MSHRKFEHPRHGSLGFLPRKRASRHRGKVKSFPRDDPKKPCHLTAFLGYKAGMTHIVREVEKPGSKLHKKETCEAVTIIETPPVVIVGLVAYVKTPRGLRTLNSVWAQHLSEEVRRRFYKNWCKSKKKAFTKYALKYDSDAGKKEIQLQLEKMKKYASVIRVIAHTQIRKMKGLKQKKAHLMEIQVNGGTI

SEQ ID NO: 15916 - DNA, 712 bp, Panicum virgatum
  misc_feature: Ceres CLONE 1786483-R
  misc_feature: Encodes the peptide sequence at SEQ ID NO. 15917
cgccttccccgcaagacccacaggggtctccgcaaggttgcctgtattggtgcctggcatccggctagggtttcctacactgttgcccgtgctggtcagaatggttaccaccaccgtactgagatgaacaagaaggtttacaagattgggaaggctggacaggagagccatgatgcctccacagagtttgacaggacggataaagacatcactcccatgggtggcttccctcactatggtatcgtgaagggcgactacctgatgatcaagggttgctgcgtcggccccaagaagagagtggtgaccctccgccagtccctgttgaagcagacgtcgcggctggccctggaggagatcaagctcaagttcatcgacacatcttccaagtttgggcacggtcgcttccagaccaccgacgagaagcagaagttctacggcaaggtcaaggcctaagcttctgcagctggtggtgctcgttctgcccctgcgaacatccttaattgtactaagttctgtagcagaagatgtttttgagaacctgttccaagtttatctgtggatttgtgtcctgtgctgtagtcccttgttggcgtgattttggcatatctgcaatgcatttgccattcggagtgttttggagatcaatcattgttccattggtttggttcgtccgttgagaacttggtagagacaatagttccattcgtcgttt

SEQ ID NO: 15917 - protein, 150 aa, Panicum virgatum
  misc_feature: Ceres CLONE 1786483-R
  misc_feature (1)..(104): Pfam Name: Ribosomal_L3 Pfam Description: Ribosomal protein L3
RLPRKTHRGLRKVACIGAWHPARVSYTVARAGQNGYHHRTEMNKKVYKIGKAGQESHDASTEFDRTDKDITPMGGFPHYGIVKGDYLMIKGCCVGPKKRVVTLRQSLLKQTSRLALEEIKLKFIDTSSKFGHGRFQTTDEKQKFYGKVKA

SEQ ID NO: 15918 - DNA, 2216 bp, Panicum virgatum
  misc_feature: Ceres CLONE 1786488
  misc_feature: Encodes the peptide sequence at SEQ ID NO. 15919
aggcacacaaacgcgtgcagcagccgtcggtccgccgcctgtgactctcgttccgctcgtgacttctctcttcttgccgtcgtcaagctcccccgccgcctgaaattccttggccgtgggtcatcaactcgcacctgggagtagcagaatcggtcgcccttgtccttctctgctcccaatttcctgttgggaatctatctcgatttcctgttggagcagcgcagcagagagcgtgttggtcaacttcaattcagcccctcacgagctacctcggcggcggaggctaatgagcatggaagcagcaaggggcggctcatcgagcgcgccctccggcggcggagtctacggctcgctcaaggattggtttctgaactggcggcggccacagcatccaacaccaacggcgtacaccagtggcggcagcaagtcaggatcaggtacaaccctatccagcacctacacatccggatccggggcctcccacctgtcatcctacgaccatcgcctgctcaacgcgcttgccgtggaggaaagagcggaggagctcgcgaaagagagggcggcggagctctggggcggcgccgacgacggccagcggccggagaaatccatgacccccagtggcaacttcagtgcgctggagcggtggctcatgggactggacgtcggctgggtgctctgcatcgccgacgatgcctccgccgccgcagcggcggggggcttgtggcacctctccggcgccatggtgcagcgtgactacgcggggaggtggatccaggctctcactgtgatcacgcgcaccatcctccgagcttactcggaccctttcggctgtggcttgtccgacctgtacattgtgctcgaggaagatgagcttgcgacgacggagcaggagcaagatccggatcagctccagcagtcccgcgcgcggtttgccgaggcagccatcttgcgaatgctcccctttgttgatgccatagctgctgcttccagcattgccggtgccggtgccaatggagcaccggcgccaacgccaaccgataggctgcaggtactcctgaacgtgcgtgaagccttgtccagtgcctcgtccggtatccagctatggctgcactcggcgtcctcggcagaagccaagcagaaaagcgatgaggtgctcggtctcctggcagcgaaagagaggagattagatgaggccatctggaacgccatggaggatctcagggctcgcatcctgtcggcaccggacgacaaagctctgtggggtgctcaaagcccgcagggatcacctgacgttgtcagggtcacccggtccctgataaaccacatcaggttgctgtggggtaatcacaagctagtgaggcacatcgtcggcgtagcagctgacattggcgactatgtcccggagtatgacaggatcagctacttcctctcgggacaggagatgagcgctggcgagccttttgccagcctgacgctggagatggtctcggccttggaagaaaagcttgccgagagatcggagtcattcccggatcacggcctcagggtcctgttcttgatcaacaacacgcgcttcatatggcagcagcttcatccactgctgctcggcatggagcgccacatgtcagtgctcgctcggagaatcgaggactacatacagaggtatctgcaggtgtcgtgggcgccggtggtgtcatgcttgtccgatctagcaccgctttgctttggacgaaattataactcctgcctggctagattcgaatcagaatttcagaaaacctactctgcccaaaagctctggaaggtgccggaccctgagctcaggagaaggctgcggcaagctgtcaccgagagagtggtctcaggcttcagagagtacttggaacatgacaacatcagcactacacccccaaggatcactctgactccactagagctggaacacatgctgcaagagctattcgaaggatgaacagaggacaaagttgcattatatagtctccatgtgtctagagtatttgtttcatggtggctttaagcccccttttggattgcgggatttttttctttttttttctttctgcattttccctgtgaaatttatgtgtttcaaaggaggccttagtggtgctgcaccctgtactgctgcttgactgctttagagtaccctggtttctgaagttttgttcttttcaataatatatatcaatctg

SEQ ID NO: 15919 - protein, 562 aa, Panicum virgatum
  misc_feature: Ceres CLONE 1786488
  misc_feature (22)..(561): Pfam Name: Exo70 Pfam Description: Exo70 exocyst complex subunit
MSMEAARGGSSSAPSGGGVYGSLKDWFLNWRRPQHPTPTAYTSGGSKSGSGTTLSSTYTSGSGASHLSSYDHRLLNALAVEERAEELAKERAAELWGGADDGQRPEKSMTPSGNFSALERWLMGLDVGWVLCIADDASAAAAAGGLWHLSGAMVQRDYAGRWIQALTVITRTILRAYSDPFGCGLSDLYIVLEEDELATTEQEQDPDQLQQSRARFAEAAILRMLPFVDAIAAASSIAGAGANGAPAPTPTDRLQVLLNVREALSSASSGIQLWLHSASSAEAKQKSDEVLGLLAAKERRLDEAIWNAMEDLRARILSAPDDKALWGAQSPQGSPDVVRVTRSLINHIRLLWGNHKLVRHIVGVAADIGDYVPEYDRISYFLSGQEMSAGEPFASLTLEMVSALEEKLAERSESFPDHGLRVLFLINNTRFIWQQLHPLLLGMERHMSVLARRIEDYIQRYLQVSWAPVVSCLSDLAPLCFGRNYNSCLARFESEFQKTYSAQKLWKVPDPELRRRLRQAVTERVVSGFREYLEHDNISTTPPRITLTPLELEHMLQELFEG

SEQ ID NO: 15920 - DNA, 710 bp, Panicum virgatum
  misc_feature: Ceres CLONE 1786498
  misc_feature: Encodes the peptide sequence at SEQ ID NO. 15921
gagagccagcatccagccatccacacaccctcaggcatacagagttgagtggcaaagaaagaacagaaaagcaagcatgactcaagctcattccaagtcatgcttccaacaattttgggatggagctcaagttaagaggagcagcgacagcttcacgattgagctcctgccatctcttggcgcgacaataaatcactctaacaagttgcagaagttcatcatatctccatatgatccccgttatagatactgggagttgttccttacagtcctagttatttactccgcctggatttgcccgtttgaactagcattcttgagggacttaccctctaagcttctgctagttgagaacattgtcaatggcttctttgcgattgatattattttgacattcttggtagcttatgtggacagcaaaacacatcttcttgtggatgatcgaaagaaaattgcagtaaggtacctatcaacctggttcatctttgatgtatgttccacagctccattccaaccaatcagtcttctgttttcacacaagggaaatgaccttgcttttaagatactcaacatgttgaggctgtggcgtcttcaccgagtcagctcgctgtttgccaggctggagaaggatataagattcaactatttctggattaggtgttcgaaacttattgctgttactctgtttgcggtgcattgtgcgggatgct

SEQ ID NO: 15921 - protein, 211 aa, Panicum virgatum
  misc_feature: Ceres CLONE 1786498
  misc_feature: The sequence is a functional homolog of SEQ ID NO 1838 in the 10/374,780 US patent application
  misc_feature: The sequence is a functional homolog of SEQ ID NO 3 in US patent 7235713
MTQAHSKSCFQQFWDGAQVKRSSDSFTIELLPSLGATINHSNKLQKFIISPYDPRYRYWELFLTVLVIYSAWICPFELAFLRDLPSKLLLVENIVNGFFAIDIILTFLVAYVDSKTHLLVDDRKKIAVRYLSTWFIFDVCSTAPFQPISLLFSHKGNDLAFKILNMLRLWRLHRVSSLFARLEKDIRFNYFWIRCSKLIAVTLFAVHCAGC

SEQ ID NO: 15922 - DNA, 518 bp, Panicum virgatum
  misc_feature: Ceres CLONE 1786500
  misc_feature: Encodes the peptide sequence at SEQ ID NO. 15923
accagcgcatcgcattccaatcccatttcccccttgagcaaaggaggaggcaggcagccagagcgagagcatcaccatgtcgggcatcatccacaagatcgaggagaccctccacatggggggcgaccacaagaaggaggaggagcacaagaaggcggaggcgcacaagaaggccgaggagcaccacaagaaggacggcgagcacaaggagggcatcgtcgagaagatcaaggacaagatcaccggcgagcacggcgacaagtccggcgagcacaaggacgacaaggaccacaaggagaagaaggtagcccgagtttgatggagaagtttgtgatggtactcgttcctgtttttctccttttttttcctttccctttttttctgattgctcataagaggatacataccacttcacagcgataacacataatactgtatttttcatttctttcttttttttcccaaagacctttcatttctttcttatgctgcaaatagaatcatacaaattgtggtac

SEQ ID NO: 15923 - protein, 80 aa, Panicum virgatum
  misc_feature: Ceres CLONE 1786500
  misc_feature (2)..(77): Pfam Name: Dehydrin Pfam Description: Dehydrin
MSGIIHKIEETLHMGGDHKKEEEHKKAEAHKKAEEHHKKDGEHKEGIVEKIKDKITGEHGDKSGEHKDDKDHKEKKVARV

SEQ ID NO: 15924 - DNA, 1573 bp, Panicum virgatum
  misc_feature: Ceres CLONE 1786510
  misc_feature: Encodes the peptide sequence at SEQ ID NO. 15925
gaatatccaatcgagacctaccaccaaacgagtccaaatccgctcgtctcccctcgaagccactccgccggcgacgccattcgcctcagcctcaggccctccgccgagcaggagcccccaacccgtccaagcggctgcaggagcgcgggggccggacgagcgcctcccaaatttagcagccgcggagctcgtggcgcgtgggcgtttgccgtggcgcgaggagcgggggagggtcgatggggtacctgccgtccctgggcagcaaggcggcgcacttcgtgtccgacctcaccaccgtcatcctcaaccccgtctccgagcgcgagagctcccacctccccgaggttgatgaagtgcaagaaaattcggaggatggtaacgattctgagcacaactctgacagccttgatggccctgacacgtcttcctttagagcattcttgatctcatttttgtcgtcatctagctctaataataacgattcaatggagatacttcctgaacaaaatgtggacatgagttacccaactttgacacccatggggaagggaagcaagggaaggtcaggtctgataagtagagggaagcattcaattggaaaaattattaacaaggcagctaggattggtggttttaaacaagctactgcagcgcctaaaattgacagggagacagtaaatcataccgaaccagttgcacctgttttggagcttgaggaaacaaaggaagttgcttctgtcagtagtttgccaactatgtcagaaccatctgttcttttgtcagaaatgatgcaatcaattctctatacctctctccctgttcttgcccagggaaggaactgggtgttgctatacagcacatggaggcatggcatatctttatctactttatataggaggagcatgctttgccctggtttctcacttttggtagtgggggataagaaaggcacagtttttggtggtttagttgaggctccattgcagccatccagttcaaagaagtatcaggggaccaataattgctttgttttcactaatttacatgaccgccctgttatatatcgcccgaccggtgcaaataactatttcaccgtgtgctccactgactatttggctctgggaggaggaggtcattttgcactctatctagatggagacctcttgaccggttcaagttctaattcagagacttttaacaacgagtgtttatcgcattccccagacttctccgtgaaagatgttgagctgtggggcttcgtctatccttccaagtatgaggagatgctcacactctgccggactgagaaaccaggaatttgtcgatggtgatcgccagtcggaattcgcaatcaatcaatcgtagttcgtagacatgctgcacatctgtacagttctcagtagactccgtgagttgcgagcattttttttatcttctttagtgcgcagggcaaagtaggagtactggacttgcttttctcaagccagtttgctcagatttgtaaataccgtactttgtaatttttcatgctgtcactttgctcagatttgtaaataccgtactttgttgttcc

SEQ ID NO: 15925 - protein, 364 aa, Panicum virgatum
  misc_feature: Ceres CLONE 1786510
  misc_feature (204)..(342): Pfam Name: TLD Pfam Description: TLD
  misc_feature: Useful for making plants with altered protein content
MGYLPSLGSKAAHFVSDLTTVILNPVSERESSHLPEVDEVQENSEDGNDSEHNSDSLDGPDTSSFRAFLISFLSSSSSNNNDSMEILPEQNVDMSYPTLTPMGKGSKGRSGLISRGKHSIGKIINKAARIGGFKQATAAPKIDRETVNHTEPVAPVLELEETKEVASVSSLPTMSEPSVLLSEMMQSILYTSLPVLAQGRNWVLLYSTWRHGISLSTLYRRSMLCPGFSLLVVGDKKGTVFGGLVEAPLQPSSSKKYQGTNNCFVFTNLHDRPVIYRPTGANNYFTVCSTDYLALGGGGHFALYLDGDLLTGSSSNSETFNNECLSHSPDFSVKDVELWGFVYPSKYEEMLTLCRTEKPGICRW

SEQ ID NO: 15926 - DNA, 681 bp, Panicum virgatum
  misc_feature: Ceres CLONE 1786515
  misc_feature: Encodes the peptide sequence at SEQ ID NO. 15927
ctaggtgatgcaccaaagaccctgcacgatgcacttagccagtgcaagaggtggactgtggggcaatatgaggtgggatttactcgacactcaaccttaacctttggagtcagaaaaacatctcttggtttggggttgacttactcccatcttgccttttggggtctttggtgtatccctatcaccacatatgctcttttgccacagctggctctggtcaacagcaggccattatttccaaagtcatcagatccatggttctatctctacgcatacctctttgtggcagcctatacccaagacatgctcgacttcatttaccacaagagcacgttaagatgttggtggagtgaccagaggatgtggcttatgcgtagcctcacctcgttcaccttcggttcaatccaatttgcatgcaagcagctcaacatctccacccaaagtttcaatgtgacaaacaaggtcatggacgatgaacaactcaagcggtacgatgagggcactttcgattttggtgtagattctccattcttcgtcatactaagcacagcggcattgctcaatctgtgtgcgttcctggtgggaattttcagatacaacatcaacatggttgcagaaatgctgttaactggatatggcgtggccaatagctggccgatatatgaggcaatgtttctcagg

SEQ ID NO: 15927 - protein, 226 aa, Panicum virgatum
  misc_feature: Ceres CLONE 1786515
  misc_feature: SWISSPROT Homolog: EC 2.4.1.12 Cellulose synthase (UDP-forming)
LGDAPKTLHDALSQCKRWTVGQYEVGFTRHSTLTFGVRKTSLGLGLTYSHLAFWGLWCIPITTYALLPQLALVNSRPLFPKSSDPWFYLYAYLFVAAYTQDMLDFIYHKSTLRCWWSDQRMWLMRSLTSFTFGSIQFACKQLNISTQSFNVTNKVMDDEQLKRYDEGTFDFGVDSPFFVILSTAALLNLCAFLVGIFRYNINMVAEMLLTGYGVANSWPIYEAMFL

SEQ ID NO: 15928 - DNA, 653 bp, Panicum virgatum
  misc_feature: Ceres CLONE 1786519-R
  misc_feature: Encodes the peptide sequence at SEQ ID NO. 15929
ggatgttcgtggtgatatttctgttgctgaatgtcaatggttggcacacatatttttggatggcttttcttccccttgttcttctgctggctgttggcaccaagctggagcacatcatcgctaagcttgcctacgatgtagccgcgaggcagacggcggtcgagggcgatttggttgtgaagccatcagacgagcacttctggttcgggcagccacgaatcgtcctgcacctgatccacttcatcctcttccagaacgcatttgagctctcattcttcttctggatactgatgacctatggattacactcctgcttcatggaccatgtcggtttcttggtgccgaggctcgttctagggatcgtcatccagcttctctgcagctacagcaccctgcctctgtatgcaattgtaacccagatggggagctactacaagaaggagatcttcaacgagcacgtgcagcagggcgtcctgggctgggcggagaaggccaagaagaaatcagggctgggctcgcatcatgtgtagttttcctgcgttgtaaggcagagacgtgacataattttctcatacagcttcactcacagcagccataaatggtgctgatctatctgtaatctcacaagtagtcatcggcatcaaaatttactc

SEQ ID NO: 15929 - protein, 175 aa, Panicum virgatum
  misc_feature: Ceres CLONE 1786519-R
  misc_feature (1)..(175): Pfam Name: Mlo Pfam Description: Mlo family
  misc_feature: Useful for making plants with modulated biotic stress sensitivity
MFVVIFLLLNVNGWHTYFWMAFLPLVLLLAVGTKLEHIIAKLAYDVAARQTAVEGDLVVKPSDEHFWFGQPRIVLHLIHFILFQNAFELSFFFWILMTYGLHSCFMDHVGFLVPRLVLGIVIQLLCSYSTLPLYAIVTQMGSYYKKEIFNEHVQQGVLGWAEKAKKKSGLGSHHV

SEQ ID NO: 15930 - DNA, 377 bp, Panicum virgatum
  misc_feature: Ceres CLONE 1786519
agtatcctgtctgtgctctctgctctctgctcctcctctgatccgactgttattttgtcagtcccatctatatattccttccaagggagtgttgcagcgtcgtatctcgctgcacatgcctgtcgtgcttccctcacgctagccggcaccctaacaatgaagatagacaaagatcgcggacctgcatccaccacccgcgccggtgagacccaaaaaaagaagaccggcctgtcccaccccgaaccggacactggaaacacggccgctccccgatagtgctgaaatagctgcagctgccagcgctgacgatgctgatgccgatggggtcaacgtcctaacacactcagcatgcatgcttgctacctactacatacgac

SEQ ID NO: 15931 - DNA, 720 bp, Panicum virgatum
  misc_feature: Ceres CLONE 1786526
  misc_feature: Encodes the peptide sequence at SEQ ID NO. 15932
accacaccactagcagatcgaaaggaaaatgaggcatcggggagagaagcagctcatcagctgcagcttgttgctcgtgctcatgctggccgcagccggtgtagtatcttgtgcagctgctgctactgccaacaccaccagcaccacgagatccaagccccaggcggctgccctcatcgtcttcggcgattccattgtcgaccccggcaacaacaacggcatcaacaccatcatcaaggccgacttccctccctacggccacgacttcatcaaccaccgacccaccggacgcttctgcaacggcaagatacccacggacttcatagcgtcccggctgggcctcaaggacctcctcccgccctacctctcccctcagccgctggacaagcacgacctcatcaccggcgtcagcttcgcctccggcggcaccggcttcgacccgctcacgcccaagctcgcctccgtcatctcgctgcccgaccagctcgccatgttccacgagtacctgggccaggtgcgcgccgccgccggggacgccaaggccgccgagatcctctcccggggcatcttcgccatctgcgccggcagcgacgacgtggccaacacctacttcaccatgcgcgcgcgcagcaactacgaccacgcctcctacgcgcgcctcctcgtgcagcacgcctcggccttcgtccaggacctcatccacgccggcgcccgccgcgt

SEQ ID NO: 15932 - protein, 230 aa, Panicum virgatum
  misc_feature: Ceres CLONE 1786526
  misc_feature (49)..(228): Pfam Name: Lipase_GDSL Pfam Description: GDSL-like Lipase/Acylhydrolase
  misc_feature: SWISSPROT Homolog: EC 3.2.1.51 Alpha-L-fucosidase
MRHRGEKQLISCSLLLVLMLAAAGVVSCAAAATANTTSTTRSKPQAAALIVFGDSIVDPGNNNGINTIIKADFPPYGHDFINHRPTGRFCNGKIPTDFIASRLGLKDLLPPYLSPQPLDKHDLITGVSFASGGTGFDPLTPKLASVISLPDQLAMFHEYLGQVRAAAGDAKAAEILSRGIFAICAGSDDVANTYFTMRARSNYDHASYARLLVQHASAFVQDLIHAGARR

SEQ ID NO: 15933 - DNA, 701 bp, Panicum virgatum
  misc_feature: Ceres CLONE 1786526-R
  misc_feature: Encodes the peptide sequence at SEQ ID NO. 15934
cccggcgcccgccgcgttgccttcatcggcatcccgcccatcggctgcgtgccgtcgcagcgcaccctgtccggcggcctggagcgcggctgctcccagggccacaacgaggtggccgccgcctacaacgccggcatggtcagggagctggcggcgctccgggccaagtaccccggcacgctgctcgtcttcatggacatctacggcttcctctacgacatgatgatgcacccgcgcaggtacggcttcgcgcaggccaccaagggatgctgcggcacgggcctcctcgaggtctccgtcctctgcaacggcgccacctccgccgtctgcgaccccgtcggcgactacctcttctgggacagctaccaccccacggagaaggcctacaagatcctcgccgacttcgtctacgacaactacgtcaagctcatcatctgaaatctcatctgatatagatggattcatttaattattccttccttcttcaattcctttaattattataattaattaatctcttccggactaccgggcatctgctagctagctgcatctgatagatgattcatttctttctccatctgttttaggactctctcgattgttgatctatagctctcttcatcatcgatacgatgattgagatcttcatgtttatttgctatatatatagtcgatctgtccttgttgattccagcatc

SEQ ID NO: 15934 - protein, 145 aa, Panicum virgatum
  misc_feature: Ceres CLONE 1786526-R
  misc_feature: SWISSPROT Homolog: EC 3.2.1.51 Alpha-L-fucosidase
PGARRVAFIGIPPIGCVPSQRTLSGGLERGCSQGHNEVAAAYNAGMVRELAALRAKYPGTLLVFMDIYGFLYDMMMHPRRYGFAQATKGCCGTGLLEVSVLCNGATSAVCDPVGDYLFWDSYHPTEKAYKILADFVYDNYVKLII

SEQ ID NO: 15935 - DNA, 2254 bp, Panicum virgatum
  misc_feature: Ceres CLONE 1786531
  misc_feature: Encodes the peptide sequence at SEQ ID NO. 15936
aggactctggaacttggccgttcagcggcagcgtgacctcaacaggggactgtgagtcagggaggggagcaaccgaaagcaatggaggcggcggggaagagcgtgtgcgtgaccggcgcgggcggcttcatcgcgtcgtggctcatgaagctcctcctctcccggggccactacgcggtgcgcggcaccgtgcgcgacccaggtgctagcaagaatgctcatctcaaggcgctggaaggtgctggagaaaggctgcagcttctcaaagctgatttattggaatacaacagcgttgtatcagcagttgccggctgtgagggcgtcttccatgtagctagccctgtcccctctggtcggtcctccaatcctgaggtgaatttttcaagaacatctgttttattttacaaaattttgagatgaaataaggcagtaatagaaggtatagtacggttacttctaggctgcaactgatgctattgctggcatggcaagactgcaagctctctgtgaagtatagttgacgtatgtaattttcctaaagtagtttgataaacaagggatttttttttcagaattccttcaaattacctattctaatttataggaaaaatgctaattcattgaatatcataaataagcatgatatatgcaatattttgaccgttcttttagggtatccgcgtctccctagaacctacaaactaagataatgatttctcacttctgcgctctgcagagcatcattttcgctttggctatctgtttgtattgctcatagaacctgttacatattacatttctttagcttgttcagtgctaggctgctagcatgtaagttttggtttatttatagaataagcatgtaatgtgatagatttctcctatttgtgcattttatgtaataaaactgatttgcaggtagaggtcataggtcctgctgtaacaggcactaccaatgtgttaaaggcttgctatgaggcaaaagttaggcgagttgtggtggtatcatcaattgcagctgtgtttagtaatcctaactggcctaagggtaagcccttcaacgaagattgctggtcagatgaggagcactgcaggaagaatgaggtgatacagtagtcccttagtatagcaatgcctttgctcatgctgatattcgtgtgcaaatatcggcatacttctccgagatactttttagccaaattggagggtgaactgattattagagctttatatccagtatgcacccagcacccttgatttacagttaacaaccatatagtttggaattccttatttgctattttcacatgctgaaatttgcatctcatgctttctttccttatttttctcagtgcacttccaaatgggaagcaatcattaacagttacttggtctcgctatatcacataatgtcgttgtactaaccacagaaactattgctggtattgtgttcgggcatcataaacttcctgctctggcttgcctaacgggtcttccattatcctgcaggattggtattacctttccaaaactctggcagaacgtgaggcttttgctcatgcagcaaaaacaggtttggatgttgtaactatttgcccgtctttagtatggggacccttgatgcagcctacagtaaattcgagcagtaaaatcctccttaattattttagaggtatttttcacaatattctatgttagttttttattgtttcatattcagttatataattaaaatgataatctatccaatggtgttcgtctatcatttatttctgattattcatttataaagcatattgatcaatagctggaaggtaattcatctacttaggttggggagccgtcatttgaagaatggtgggaaaacataaacacgagggtttcaggtcaagtgaagaagggcttaaattccattgttatcttaggagcttggagtttgtggaaccatcggaatcgttgtgtctttgatggagccgttctagtttatccaccatagtttcacacataaatgaggagctgctgcattggtcctttgctggggctcgaggaatttctttcctccttgcccaagcacctgcagccacttaagtgtgtggtcttgagttccggtctagtttcaatttaaaagtaaaagttagttagctctccagttgttaaaagggtgggttacaggccctgatatctgtaacaccttggggttctctaccccttttttcttcttaatatattgatgcgcagctctcctgcgctttcg

SEQ ID NO: 15936 - protein, 112 aa, Panicum virgatum
  misc_feature: Ceres CLONE 1786531
  misc_feature: SWISSPROT Homolog: EC 1.1.1.219 Dihydrokaempferol 4-reductase
  misc_feature: Useful for making plants with altered carbohydrate content
  misc_feature: Useful for making plants with altered cell wall content and/or composition
  misc_feature: Useful for making plants with altered lignin content
MEAAGKSVCVTGAGGFIASWLMKLLLSRGHYAVRGTVRDPGASKNAHLKALEGAGERLQLLKADLLEYNSVVSAVAGCEGVFHVASPVPSGRSSNPEVNFSRTSVLFYKILR

SEQ ID NO: 15937 - DNA, 1588 bp, Panicum virgatum
  misc_feature: Ceres CLONE 1786532
  misc_feature: Encodes the peptide sequence at SEQ ID NO. 15938
tttgtactaccccccgtcagttccatcagattttgcggccaacggcatggagcgggcgggtctcgtagggggccggcggcagctcctgggcgcggcgccggcgccggcgagcggcggggagaggcacggctccggctccaggtcgagcccggacgcggtgcggatcatggtgggcgtgctggcggcggtcatcgcctgcacgctgctctactgcgtctactgctggcggtggcggaagcgcaacgccatccggaggtccctgctcgacagcctgtggccgcgctcgagctcggacctgccgctcatggacctcgcctccatcctcgccgccaccgacaacttctccaaggccaacaagctcggcgagggcggcttcggccccgtctacagaggcgtgctgagcggcggatcggagatcgcggtgaagcggctgtcggcgcggtcgcggcagggggcggcggagttccggaacgaggtggagctgatcgccaagctgcagcaccgcaacctggtgcggctgctgggctggtgcgccgagcgggacgagaagctgctcgtctacgagtacctccccaaccgcagcctcgacgccttcctcttcgacccgagcaagagcgcgcagctggggtggagcacccggcacaacgtcatcgtcggcatcgcccgcggcctgctctacctccacgaggactcgctgctcaaggtcgtgcaccgggacctcaaggccagcaacgtgctcctcgaccacaagatgagccccaagatctccgacttcggcatggccaagatcttcgaggacgacgccgacgccatcaacaccggccgcgtcgtcggaacatacgggtacatggcgccggagttcgccttggagggcatcttctcggtcaagtccgacgtgttcagcttcggagtcctcctcctcgagatcttgagcgggcagcgcaatggcgccctgtacctggaggagcaccagcaatccctcatccaagatgcatggaagctgtgaaccgaggaccgggcggccgagttcatggacccgtcgctggggcgcttgtactccaaggacgaggcgtggcggtgctaccacgtcggcctgctctgcgtgcaggaaaaccccgacgcccgggccaccatgtccaacgtcctgctcatgctcatcagcgaccacgccaagctcccggagccggccatgccgccgctcttcacgcgcctcaggaacgtccccttgtcggcggtgccgctcgccaccaagaccgagtcgaccatgtctccccagtcgatcaacgacgtgtccatcaccatgatcgagccgcgatgagctccttcttcttctttgatcgcttcgtccgctcgtcgacaggtgtgttactgtttacataggtgtccgctgattttgcagttctgaaaatggggagataatgggatcctcaagagggaatctgtgtgtttgtgtgtgagagagagcctgtgatgagttgaactgtaaataagagtgcagccattttagaatataagagtgcagccattttagaatgagtgacatgtaactattgtaagagcaagtaggtgacttactggacacgtaggc

SEQ ID NO: 15938 - protein, 319 aa, Panicum virgatum
  misc_feature: Ceres CLONE 1786532
  misc_feature (99)..(319): Pfam Name: Pkinase Pfam Description: Protein kinase domain
  misc_feature: SWISSPROT Homolog: EC 2.7.11.1 Non-specific serine/threonine protein kinase
  misc_feature: Useful for making plants with altered carbohydrate content
  misc_feature: Useful for making plants with altered cell wall content and/or composition
MERAGLVGGRRQLLGAAPAPASGGERHGSGSRSSPDAVRIMVGVLAAVIACTLLYCVYCWRWRKRNAIRRSLLDSLWPRSSSDLPLMDLASILAATDNFSKANKLGEGGFGPVYRGVLSGGSEIAVKRLSARSRQGAAEFRNEVELIAKLQHRNLVRLLGWCAERDEKLLVYEYLPNRSLDAFLFDPSKSAQLGWSTRHNVIVGIARGLLYLHEDSLLKVVHRDLKASNVLLDHKMSPKISDFGMAKIFEDDADAINTGRVVGTYGYMAPEFALEGIFSVKSDVFSFGVLLLEILSGQRNGALYLEEHQQSLIQDAWKL

SEQ ID NO: 15939 - DNA, 731 bp, Panicum virgatum
  misc_feature: Ceres CLONE 1786548
  misc_feature: Encodes the peptide sequence at SEQ ID NO. 15940
atctgccgtactacgccatttcctgagcgctctcctttcgctcgagcttgcagtgaaggtcacagagatggagggcgctatccccaatccccccaacgcaaggattgcggtggtcaccggcgggaacaaagggatcaggctggaggtgtgccggcagctcgccggcgccggcgtcaccgtcgtcttgacggccagggacgagacgaggggcgcagccgccgtggagaagctcagagaagcagggctctccgatgtcatgttccatcagctggacatcaccgacgctccgagcatcgctcggttggctgatttcttgaaggctcgtttcgggaagcttgacatcctgataaataatgctgcaatcgttggtgttgagtacctcctagatcctttggatagttcaccgaccagcgaggaaaaggtgagctttacatcctcagcttgttaggggattaaaaagaacaagaaaaagtccaatttacacctttaaactatcgcaaaagtttgattttaaacattcaactataaaaccgaataatagagaccatccaactgttaaaattgatcaaatttgacccttggaaggtttcaaatgcggttttatatttttttaaaaaatataaaaattctaattatatctaaaaaatcaaaactaatccattttaaatcgaaaaaatatgaaactactaccaaatttttttctcaaaatgtaaactatctattattgctct

SEQ ID NO: 15940 - protein, 126 aa, Panicum virgatum
  misc_feature: Ceres CLONE 1786548
  misc_feature (12)..(126): Pfam Name: adh_short Pfam Description: short chain dehydrogenase
  misc_feature: SWISSPROT Homolog: EC 1.1.1.184 Carbonyl reductase (NADPH)
MEGAIPNPPNARIAVVTGGNKGIRLEVCRQLAGAGVTVVLTARDETRGAAAVEKLREAGLSDVMFHQLDITDAPSIARLADFLKARFGKLDILINNAAIVGVEYLLDPLDSSPTSEEKVSFTSSAC

SEQ ID NO: 15941 - DNA, 567 bp, Panicum virgatum
  misc_feature: Ceres CLONE 1786548-R
  misc_feature: Encodes the peptide sequence at SEQ ID NO. 15942
aggctggacgaggtgctggacacgttcctgaacgacttcaaggccggcgagctggaggcgcgcgggtggccggagcatttctcggcgtacaaggtgtccaaggtgaccatgaacgcgtactcgaggatcctggcgaggcggcaccccgagctgcgcgtcaactgcgcgcatcccggctacgtgaacaccgacatgaccatccactccgggcccctgacgcccgaggaaggcgccgccaacgtggtgaaggtggcgctgctgccggaagccggggtcaccggcgccttctttgaagacggcgaggaggcgccgttcgtgtgacgctcacactgcacacctacacgggcacggccgatcggcagttcggcaccggccccgttgttcgccgtcctactccaactgcctgctatcatcgtgcaacggaaataagctgctggatctttagttcctctccatgtcgaagtccaaaattgttggcactttaatttgtcgacggaagtgtacttgttactttgaattactccagcttaactcaagtaaacaattcacggaagatgtgttagtttt

SEQ ID NO: 15942 - protein, 106 aa, Panicum virgatum
  misc_feature: Ceres CLONE 1786548-R
  misc_feature: SWISSPROT Homolog: EC 1.1.1.184 Carbonyl reductase (NADPH)
RLDEVLDTFLNDFKAGELEARGWPEHFSAYKVSKVTMNAYSRILARRHPELRVNCAHPGYVNTDMTIHSGPLTPEEGAANVVKVALLPEAGVTGAFFEDGEEAPFV

SEQ ID NO: 15943 - DNA, 2739 bp, Panicum virgatum
  misc_feature: Ceres CLONE 1786555
  misc_feature: Encodes the peptide sequence at SEQ ID NO. 15944
caacgccaagatccggtgaaccttccgcctgcggtccaggcgagaaaagagagggagggggcaccgcacgaggcggcggcggcggcgtcatcggtcgtcgtcgtcggcgacgatgtggcgcctcgggatgccaagaatttccctcgcctagccctcttttttccagcaggccgcagagccagccagccatctcttcctcgctccccttgtttggcttttcctctcccaacttgtccctttctctctcccctcccttttctcccgttgcttctccctctcgcggtctcgctcgcctccgcaataaaaccagccgcctgccgagccgggcacgcacgctgcccgcccccgcccgctccttcgcccagctcttcggaggcccaaaggccgtgcgcttttgagcgcggcgtcttcctcagcgccctttcggaattcgcgaccccttttctcctcgccacccccttgccattggaggcgggagctagcctttcttgcgcaggtacaggtgaggcccaaccaaggtcgggatggcgaacctgaccagcggctttgcaagcctccgatgcgcaggggcgatgcatgccgacaaaggtcacatgcaagcttctggactaccatttctctctttcagaagatgcgcccagctcgatatctctagactaggtagcatgcctcgtttcatgggtgcaagatctgctactgtctctcaacaacatgtgaggcacagggtcagcgccatcagagcctctacactctcgtgctttcaagacgacaccacaaaattctttgatttcgtggttattggcagtggtgttgctggcttaaggtatgctttggaagtttcaaagcacggctctgttgctattatcaccaaagccgagcctcatgagagcaacacaaactatgcacaaggtggtgttagtgccgttctgtgtccctcggattctgtagaaagtcacatgaaagacacaattgttgcaggcgcttatctgtgcgatgaagagactgtgaggatagtttgcacagaaggcccagagcgcgtcaaggaactaattgccatgggtgcctcatttgaccatggtgaagatggtaggctgcaccttgcaagggaaggtggacattctcacaacagaattgtccattctgctgatatgactggaagagagattgaaagagcactgctgcaagcagttgacaacgatgataacatatctttgtttggtcaccacttcgccattgatctattgacatgtcagaaaaatggtgaaatccattgctatggagtggattcgatagacatcgaaactcagaagatagtccgtttcatctcgaaagtaacgttgcttgcatctggaggagctggccatatatatcccacaacaaccaatccaccggtagctactggggacggaattgctatgtgtcaccgtgctcaggctgtaatttccaatatggagtttgttcagttccatccaactgcactttcagatgagggcctcccaataaagccaaccacaaaaagagagaatgcattcctcataacagaagccgtcaggggggatggaggaatcctctacaaccagtccatggagagattcatgccgctgtacgatgatcgcgcggagttagcaccaagggatgtggttgccaggagcatagatgatcagctgaagaagcgcggcgagaactacgttttcctggacatcagccacaagccgagagacgaggttcttacccacttccccaacatcgccgccgagtgcctgcgctacggcctggacatcacccggcagcccatccccgtcgtgcccgcggcgcactacatgtgcggcggcgtccgggcggggctgcagggggaaacgaacgtgaagggcctgtacgtcgccggcgaggtcgcctgcacggggctgcacggcgccaaccggctcgcgagcaactcgctgctggaggccctggtcttcgccaggcgggcggtgcagccgtccatcgaccacatggtggacgccgacgccggcgcgtccctcgccgcgcggtgggcgcgcccgacgctgccgtcgccgtcggcgctcgggggcggcgcgctgtcggacatcgtggcgcggacgcggcagacgaggacggagctgcaggccgtgatgtgggagtgcgtcggcatcgtgcggtcgacggggcggctgaagcaggccgagtggaagatcggcgacctggaggcggagtgggaggggttcctgttccggcgggggtggacgccgaccatggtggggatcgaggcctgcgagatgcgcaacctcttctgctgcgccaagctcgtcgtcaagagcgcgctggccaggcgcgagagccgcggcctgcacttcaccgaggacttcccgtacctggaggagagcaggaggaagcccacggtgatcttcccggccgccgtccaggagctgacatggagctccaagccgctgcagaggcagctgcagtgcaaatagatggcattgccatgctgcagatgcagttcatgcatggagctgggacttggggattcgttagtttatcagaactgggctgaagcagcccactttgattcgacagcaaactcatattcatccagtgaaactggaattcatcgggtacacagttaggctgaagtagcctgtgtacttgtgccaatcttagcattcttgccggttccagctgttgtaacttgtaaaagatattgttggagctgcactctgggctgaacctttgatgggt

SEQ ID NO: 15944 - protein, 649 aa, Panicum virgatum
  misc_feature: Ceres CLONE 1786555
  misc_feature (88)..(472): Pfam Name: FAD_binding_2 Pfam Description: FAD binding domain
  misc_feature (530)..(633): Pfam Name: Succ_DH_flav_C Pfam Description: Fumarate reductase/succinate dehydrogenase flavoprotein C-terminal domain
  misc_feature: SWISSPROT Homolog: EC 1.4.3.16 L-aspartate oxidase
MANLTSGFASLRCAGAMHADKGHMQASGLPFLSFRRCAQLDISRLGSMPRFMGARSATVSQQHVRHRVSAIRASTLSCFQDDTTKFFDFVVIGSGVAGLRYALEVSKHGSVAIITKAEPHESNTNYAQGGVSAVLCPSDSVESHMKDTIVAGAYLCDEETVRIVCTEGPERVKELIAMGASFDHGEDGRLHLAREGGHSHNRIVHSADMTGREIERALLQAVDNDDNISLFGHHFAIDLLTCQKNGEIHCYGVDSIDIETQKIVRFISKVTLLASGGAGHIYPTTTNPPVATGDGIAMCHRAQAVISNMEFVQFHPTALSDEGLPIKPTTKRENAFLITEAVRGDGGILYNQSMERFMPLYDDRAELAPRDVVARSIDDQLKKRGENYVFLDISHKPRDEVLTHFPNIAAECLRYGLDITRQPIPVVPAAHYMCGGVRAGLQGETNVKGLYVAGEVACTGLHGANRLASNSLLEALVFARRAVQPSIDHMVDADAGASLAARWARPTLPSPSALGGGALSDIVARTRQTRTELQAVMWECVGIVRSTGRLKQAEWKIGDLEAEWEGFLFRRGWTPTMVGIEACEMRNLFCCAKLVVKSALARRESRGLHFTEDFPYLEESRRKPTVIFPAAVQELTWSSKPLQRQLQCK

SEQ ID NO: 15945 - DNA, 1588 bp, Panicum virgatum
  misc_feature: Ceres CLONE 1786556
  misc_feature: Encodes the peptide sequence at SEQ ID NO. 15946
aagatggataggaccccccgtgagtgggtgggtcgtcgtcgtccggcggaattcggctcggctcgtcttccccctggatctgccgcccggtggcgcctcgccgccggtggtaggcatggcgcgggcggagaagaagcgcgccgcaagaacggccacggccacggcggcggtggagaggccgtccgggacgtccgaccggaggccgctctacttcgccgccctcctggtgctcgccaacgccgcgctcgtcgtgctcatcatcgccttcgtcccgtataccaagatcgactgggacgcctacatgtctcaggtggatgcctttctggagggggggagggactataccaagatcgagggagacacaggaccattggtctacccggctggattcctctacgtttactccgccattaagttccttaccggcggccaagtcttccctgctcagattttgtttggcgtcctgtacattgtcaacctgtgcctcgttcttctgctttacgtcaagactgaagtgcttccatggtgggctttaggtttgctttgtttgtccaaaagggttcactccatttttgtgctccgccttttcaacgactgcttcgccatgacattgctccatgctgctatggttttgattatttatcataagtggtaccttggcctaatagttttcagtggagctgtctcggttaagatgaatgtccttcttttcgctccttctttgcttctactgatggtgaagagcataagcatcaaaggagtcttctttgccttgtttggagctgctgtagtacaggtattgttgggtatgccattcttgctgtcacatccagttgagtacatctcaagggcattcaatctcggccgtgtcttcatccatttctggtctgtgaactttaaattcgtcccagagaagttgtttgtatccaaagagcttgctattgcgttgttgattcttcacctcacgacccttatggtatttgcacactacaagtggttaaagcatgaaggaggcctattcagtttgttgcattccagatttaaacacgccaaatcaattgtacagcttttttccagcaaacccagaccatccattctcagtaaagaacatattgtaactgttatgtttgtcggcaacttcattggcatcgtgtgtgcccgatcattacactaccaattctattcctggtacttctattcattgccttttctgttgtggaaaacacattttccgacacctttgaggatcattatatttcttggtgtggagctctgctggaacatttacccttctactgcctattcatcactgcttttgctatttctacacatctccgttttgttgggtatatggttttcaccgactgagtacccttatattgataaaagaacatgacaaatatatcaagaagtcacaggtcaatatgaggcttccctgtaaaattctttaatcttttaaggtagcagtagttatatcctttttgtgtggatagaaacaacgccaaaggcttttggaatgtgtgagatgtatttctccaatactcttggtattaattgccgaaagatttctagagtagcatctagacat

SEQ ID NO: 15946 - protein, 426 aa, Panicum virgatum
  misc_feature: Ceres CLONE 1786556
  misc_feature (33)..(398): Pfam Name: ALG3 Pfam Description: ALG3 protein
  misc_feature: Useful for making plants with altered carbohydrate content
MARAEKKRAARTATATAAVERPSGTSDRRPLYFAALLVLANAALVVLIIAFVPYTKIDWDAYMSQVDAFLEGGRDYTKIEGDTGPLVYPAGFLYVYSAIKFLTGGQVFPAQILFGVLYIVNLCLVLLLYVKTEVLPWWALGLLCLSKRVHSIFVLRLFNDCFAMTLLHAAMVLIIYHKWYLGLIVFSGAVSVKMNVLLFAPSLLLLMVKSISIKGVFFALFGAAVVQVLLGMPFLLSHPVEYISRAFNLGRVFIHFWSVNFKFVPEKLFVSKELAIALLILHLTTLMVFAHYKWLKHEGGLFSLLHSRFKHAKSIVQLFSSKPRPSILSKEHIVTVMFVGNFIGIVCARSLHYQFYSWYFYSLPFLLWKTHFPTPLRIIIFLGVELCWNIYPSTAYSSLLLLFLHISVLLGIWFSPTEYPYIDKRT

SEQ ID NO: 15947 - DNA, 2712 bp, Panicum virgatum
  misc_feature: Ceres CLONE 1786557
  misc_feature: Encodes the peptide sequence at SEQ ID NO. 15948
atctctacccgtcttccgccgccccttcttgcatccggctcaggatttcgaacggcctccaaatccctctccagcttacccttccccttcccaagacttccctcccgatctggccgccgtacctgcgtccgtacccccgcgtctccgtctctccggcactgcttgagaaccccggttggtcccaattggcgagaaacaccggatcgaattggctctcggagccggaggtcttgcaggattcgattcttggaggctggacggctgcttgagcgcttgacggagcctggcgagctgggctttctccagctccaggtgggaaagataatttggaggcaggatggagccagaaatgatagagcattatggagggtaggaagaggaggggaagattccggaattctctcaggcggatggcgatggagtgtctatgctccggtgagcagctgaagggggctgatgagactgtcaggtcgtctgattctacaatcacaaaagatttctcggccagcgggtactcttctaggaatgaagaaattgaacagtaccttgataatggcaacatagaggaagccgagttgtcgctccaggagggcatatgcctaaattatgaggaagcaagggcattgctaggaaggctagaatatcaacggggtcatgtagaagcggcactccgtgtctttgatggaatagacatatctgcattggttcctaaggtgaaaatctcaattgctagaaaagctgatcgtcgaaagacccgttcgcagtgggattctccaccaatgcccttgcatgctgtcagccttcacatggaggcgatatatcttaaagcaagagcgcttcatgatcttggaaaatacaaagaagctgcacaagaatgtagaatgatattggatattgtggaagcagcaatacctgagggtttaccaccaggctttggaaaaggttgtaaattgaatgaaataatatgcaaggctgtagagttgctccctgagctgtggaaatcagggggtttttcacttgaagccatttcttcatataggaggtcccttctcaataattggaatcttgatggagagactgtagcaaggatacaaaagaaatttgctgtttttctcctatatagtggttgtgaagcacgccctccaaatctccattctcagttggatggttcatttgtaccttgcaacaatatggaagaggctattcttcttttgatgattctattgaggaagttcaatctcaagaggattgagcgggatccctctgtcatgcatcaccttacttttgcactggccatgtcagggcagctaattccactggccggacaatttgaagaactgttacctggagtgttagataaaagagaatggttatataatgttgcattgtgttacttagcagaagaagatgatctgagcgccctgaatctactcagacaaattctgaaggctggagaggattctgatcatctcaaagaacttctcctagcttcaaaggcttgtgttgaggtgagtgctcatactgaaggtgcttcctatgcacggagagccattgccaatatgcagggaggatgcaaacaaatgcccggagttgcagagctgttgcttggtgttacgctttctaatcaagctagaagtgcaatatctgaaacagatagaactgcttggcagtgtgaagcactggaagtgctggggaatgctgacaagaagatgcatgggaaagattctagggcattgtacagtctgagccttgaaaatgctgagcagaggaaattagaacctgcttctttttatgcaaagaagctggtgaaacttgaggctggatcagagctgaggagttggcttcttttagctcgaatactgagtgctcagaagcagttcgccgatgctgaaataattgttgatgctgctctagatcagactggcaaatggagtcaaggagatctcttgcgaaccaaagccagaattcaggctgcacaagggcaattcagagatgcagttgagacatacacccaacttcttgctataattcaacttagaacgaaaagtttagcttctgggattcactcggcaaagggcaacaaggatgataaaggcctggaaatagagacctggtatgatctagctctcttgtacctaggtatggcacaatggagggatgcagaggtttgtgtattgaagataagatccatcagtccttattctgcattggcttggcatgctacaggaaaaatatatgaagcaaaaggtcttacaaaagaagctttgggagcttttttcagagcattagaccttgatcctaaacatgtcccaagtttgatatcgattgccactgttctacggcaacttggtgacaggccgttatcttctgtacggtgcttcctgactgatgcattgcaactggatagaactaatcatgttgcatggttcaatcttggcctgctttacaaagaggaaggtggcagatcagtagttgaagctgctgaatgctttcaagcttctgcttttcttgaagaaacagcacctgtagagcctttcagatgacagatatatgtacaggggctatagatttaagctgctgtatgtatattttatatattttacctatactggtaaaatagtggattacagagtaccaggaacgattttcaggagatcatagcattagaaactgttggaaaaggttttgtttaacaattcaatctatagttcc

SEQ ID NO: 15948 - protein, 726 aa, Panicum virgatum
  misc_feature: Ceres CLONE 1786557
  misc_feature (615)..(648): Pfam Name: TPR_2 Pfam Description: Tetratricopeptide repeat
MEGRKRRGRFRNSLRRMAMECLCSGEQLKGADETVRSSDSTITKDFSASGYSSRNEEIEQYLDNGNIEEAELSLQEGICLNYEEARALLGRLEYQRGHVEAALRVFDGIDISALVPKVKISIARKADRRKTRSQWDSPPMPLHAVSLHMEAIYLKARALHDLGKYKEAAQECRMILDIVEAAIPEGLPPGFGKGCKLNEIICKAVELLPELWKSGGFSLEAISSYRRSLLNNWNLDGETVARIQKKFAVFLLYSGCEARPPNLHSQLDGSFVPCNNMEEAILLLMILLRKFNLKRIERDPSVMHHLTFALAMSGQLIPLAGQFEELLPGVLDKREWLYNVALCYLAEEDDLSALNLLRQILKAGEDSDHLKELLLASKACVEVSAHTEGASYARRAIANMQGGCKQMPGVAELLLGVTLSNQARSAISETDRTAWQCEALEVLGNADKKMHGKDSRALYSLSLENAEQRKLEPASFYAKKLVKLEAGSELRSWLLLARILSAQKQFADAEIIVDAALDQTGKWSQGDLLRTKARIQAAQGQFRDAVETYTQLLAIIQLRTKSLASGIHSAKGNKDDKGLEIETWYDLALLYLGMAQWRDAEVCVLKIRSISPYSALAWHATGKIYEAKGLTKEALGAFFRALDLDPKHVPSLISIATVLRQLGDRPLSSVRCFLTDALQLDRTNHVAWFNLGLLYKEEGGRSVVEAAECFQASAFLEETAPVEPFR

SEQ ID NO: 15949 - DNA, 2018 bp, Panicum virgatum
  misc_feature: Ceres CLONE 1786558
  misc_feature: Encodes the peptide sequence at SEQ ID NO. 15950
aaaaaagcattctactagctagctccggccacttccttcgtcttaggctgctggagagccttgtcctccgctccatccaccagaccaccaccatggtcctccaaacataccttgctcaagagtgaccatatcgggtcctctagattctttcatcaacagtgccggaagcccatcagcaaccatggactcagcagatgaggagacgccattgattcaccacctgcgtccacagtatgaaggtccagaatacactagcgacggaacagttgatattaacaagaagccggctctgaagcggagcacggggaactggagagcatgctatttgattttaggtgccgaaatcggtgaaagcctggccttctctgggatacagaagaacttggtcacctatctcacgagcgtgcttcacgaaagcaatgtcgacgctgccgcgaacgtgtccacttggctcggcagctgcttcttcacgccgctcctcggagctttcctggccgacacatactggggaagatacaggacagtagtgattttcatctcgatccaggccgttgggatgatcgccctcaccctttcggcatggcttccactgctaatggattcgtccttcagcagcagcagcagcagcagtcatcgtgctgcggtgtacctggggctctatctcatcgccatcgggtccggtggcatcaagccctgcacctcgtctcttggcgccgaccagttcgatggcgccgacccggcggagcgggtgaacaagggctcgttcttcaattggttcttcttctccatcaacctgggctccctgctgtcgtcgacggcccttgtctgggtgcaggacaacgttgggtggggaattggattcgccatcccgatggcgctcaccgtgttcggcctcgccgtgtttgttgccggccggaaggtgtacaggtacaagaagctggaagggagtcctctcacaagactctcgcaggtggtcgttgcagccgtaaggaattaccatttgaagctgcctgaggatagctcatccctgcatgaggtgccttcaccaaatgaggcgaattattgcaagactgcacatacctgccaattcaggttcttcgacaaggctgccattgtagcgcggtcgtcatccgacgagaaaggcgcggcgtcgacggttagcccgtggaggctgtgcacggtgtcccaggtggaggagctgaagatgctgctccggctgttccccgtgtgggcatcgatggtgctctacttcgcggtgacgtcgcaggcgtcgtcgacgttcatcgagcagggcatggccatggacacccgcgtcggcccgttcaccgtgccgccggcctccctctcgatcttccacaccatcagcatcatcgtcggcatccccatctacgacgccgcgctggtgccgctggcccggcgcgtcaccggcgacgaccgtggcctgtcgcagctgcgccgcctcggcgttggcctggcgctgtccgtggccgccatggcgtacgcggcgctggtcgaggcgaggcgtctggcggccgcgggcgcgagcgcggcgacgacgagcatcgtctggcaggcgccgtccttcgccttggtcggcgctgcggaggtgttcaccaccaccggcgtgctcgagttcttctacgaccagtcgcccggcggcatgaagagcatgggcacctccctggcgcacctcgcgatcgcggccgggagctacctgaactcggccgtgctgggcggcgtcgagtgggccacggcgcgggacggggcgcccgggtggatccccgacgacctgaacgaggggcatctggactatttcttctggttgctggcggccctgaacgtggtgaacctgctgcacttcgtgcactgctccaggagatacaggggcaacaaggccgcgtcctgacaagcagaacggcaggagaaaccattttacgctcatgtgtagaacgaatcagcactgtttggttactatttaatatttactagcaaatatgcccgtgcgttgcaacggggtg

SEQ ID NO: 15950 - protein, 574 aa, Panicum virgatum
  misc_feature: Ceres CLONE 1786558
  misc_feature (112)..(506): Pfam Name: PTR2 Pfam Description: POT family
MDSADEETPLIHHLRPQYEGPEYTSDGTVDINKKPALKRSTGNWRACYLILGAEIGESLAFSGIQKNLVTYLTSVLHESNVDAAANVSTWLGSCFFTPLLGAFLADTYWGRYRTVVIFISIQAVGMIALTLSAWLPLLMDSSFSSSSSSSHRAAVYLGLYLIAIGSGGIKPCTSSLGADQFDGADPAERVNKGSFFNWFFFSINLGSLLSSTALVWVQDNVGWGIGFAIPMALTVFGLAVFVAGRKVYRYKKLEGSPLTRLSQVVVAAVRNYHLKLPEDSSSLHEVPSPNEANYCKTAHTCQFRFFDKAAIVARSSSDEKGAASTVSPWRLCTVSQVEELKMLLRLFPVWASMVLYFAVTSQASSTFIEQGMAMDTRVGPFTVPPASLSIFHTISIIVGIPIYDAALVPLARRVTGDDRGLSQLRRLGVGLALSVAAMAYAALVEARRLAAAGASAATTSIVWQAPSFALVGAAEVFTTTGVLEFFYDQSPGGMKSMGTSLAHLAIAAGSYLNSAVLGGVEWATARDGAPGWIPDDLNEGHLDYFFWLLAALNVVNLLHFVHCSRRYRGNKAAS

SEQ ID NO: 15951 - DNA, 759 bp, Panicum virgatum
  misc_feature: Ceres CLONE 1786582
  misc_feature: Encodes the peptide sequence at SEQ ID NO. 15952
atcgatccgcggctcgtgtccgtcccccggctcctcggcgtctcgctcgtcaacgccaccgccggcgcacgagcccaccgtcgactccgcagacccgcgcgccgccgcacgggaggacagatcggcgctccgcagcttgcaagcatgtatatccgagtgaagcgcaacaagagtacctacttcattcaatgtgaaccgacagagacaactttgagcgtcaaacagaagttgcattcactaatagatcagcctccttgcaatcagcagttggtcttgttggctaccaatgacgtgctggaagattcaaagacattggcagaccaaaaggtggaaaatgattctgttgttgccttggcactgagaaaagatgacgatgagtttgaggaaattttcatcgccaggccagaggatttcatgtcatcttcatgatgaagatcagttcatcatatgtgcaagggcacccgcacgccgtcactaagcgaatcctgctgcttgctctatgtttgtccctctaggatctggggtgtagcccagttgtccctttggaaagaaaaaataacgttataaaagatctcaaacaaccatcacggatggcattaagctttgatttgacactccaactgattctgtgctcttgtacctactggtgtctgtcctgatgttaggatccagcacacctaattgtccttttgtaccagctctagcatgtgagttccatccgtgcctccatcacctaatacacttgtgttgctgctggcc

SEQ ID NO: 15952 - protein, 94 aa, Panicum virgatum
  misc_feature: Ceres CLONE 1786582
  misc_feature (4)..(75): Pfam Name: ubiquitin Pfam Description: Ubiquitin family
MYIRVKRNKSTYFIQCEPTETTLSVKQKLHSLIDQPPCNQQLVLLATNDVLEDSKTLADQKVENDSVVALALRKDDDEFEEIFIARPEDFMSSS

SEQ ID NO: 15953 - DNA, 944 bp, Panicum virgatum
  misc_feature: Ceres CLONE 1786588
  misc_feature: Encodes the peptide sequence at SEQ ID NO. 15954
gttgcagctttgctttgctatcccctgcttatcccttcgcgaatcatggcggcggcggcggcggtgaccctcctccgcctccctctcgcccgtctcaactaccacctccgctccgtccctccccctcgtatcccgcccccacgcctccgcatctccacctcctaccgcttcctgtcctccctgggccacggctccgccgccgcggccgtggccgaggcggtagccgcgccggacgcggagggggacctggtcgatgcagaggatgagagtcacgaggaggagtctacggccgaggcggagacggaagcggaagcgccccggtcgttcgtgctcccgcggctgccgcggccgaagctgagcgtgaaggagcgcaaggagctggcctcgtacgcccacggcctcgggaagaagctcaagtcgcagcaggtgggcaagggcggcgtcacacccaacctcgtctccgccttcagtgacaacctcgagtcgaacgagctcctcaagctaaagattcacgggaactgccctggggaactaaccgatgtgatactgcaacttgaggagtcaacaggatctattgctgttgaccaaatcggccgctcagttattttgtataggcctagcactagcaagatgaaaaagaggcaagaggttgctgaaaatgctaggagatttgcaagatctaaagaagaaaatgctaggcgatttgtaaattctgaagaatcatttgaagaacgtcctagaaacagcacaggcagaagatttgttaaatctggatccacatttagctctcagcagaagaggagaccaatggcatccaagggatcgtcatacggccgagggtagcagcagcataaaaaggcatatggcttgttttcttgttgtctggactctggagagaccatgtaaattttagacaaactaactggtatatggatgttagtgcg

SEQ ID NO: 15954 - protein, 265 aa, Panicum virgatum
  misc_feature: Ceres CLONE 1786588
  misc_feature (104)..(190): Pfam Name: CRS1_YhbY Pfam Description: CRS1 / YhbY domain
MAAAAAVTLLRLPLARLNYHLRSVPPPRIPPPRLRISTSYRFLSSLGHGSAAAAVAEAVAAPDAEGDLVDAEDESHEEESTAEAETEAEAPRSFVLPRLPRPKLSVKERKELASYAHGLGKKLKSQQVGKGGVTPNLVSAFSDNLESNELLKLKIHGNCPGELTDVILQLEESTGSIAVDQIGRSVILYRPSTSKMKKRQEVAENARRFARSKEENARRFVNSEESFEERPRNSTGRRFVKSGSTFSSQQKRRPMASKGSSYGRG

SEQ ID NO: 15955 - DNA, 857 bp, Panicum virgatum
  misc_feature: Ceres CLONE 1786597
  misc_feature: Encodes the peptide sequence at SEQ ID NO. 15956
agaccgcagcagcacgcagccgacgagagacccgagccgtgccggcgacgtggaaggggaggggcgattggttcgatggcgaagctgtacatgcaggcggtgccgcccccggatctgaacaggaacaccgagtggttcatgtaccccggggtctggaccacctacatcctcatcctcttcttctcctggatcctcgttctctccgtcttcgggtgcgcccccggcacggcgtggacgctcgtcaacctcggccacttcgcgatcacataccactttttccactggaagaaggggactccgtttgctgatgaccaagggatgtataacacattgacatggtgggaacaaatggataatggcaaacagcttactcgcaacagaaaatttttgactgcggttcctgttgttctgtacttgatagcttcccacaccacggactatcaacatcctatgctcttcctcaacaccctagcagtcactgtgctggttgttgccaagctaccaaacatgcacaaagttcggatttttggaatcaatgccggcagctaaggagcagtgtctctcggttgatacatgtacatgtcatgtttgatttggattacgggatgtgttgagcctagttctttattgaatcaccggtgtacgtgagtagtgcttgagagctgttcgtagatgacatgtaatcattgtacagagaaatgctatgaaggctggaacgatgatgcttttctgcaactagtgaacaaaggttctgtagactggtaatatcgctatacgttctctagcaagaatttggcaattgatacatgtacagttttgctcttttgtcaagaggcaataatcaatcgttatttgac

SEQ ID NO: 15956 - protein, 157 aa, Panicum virgatum
  misc_feature: Ceres CLONE 1786597
  misc_feature (14)..(156): Pfam Name: ORMDL Pfam Description: ORMDL family
MAKLYMQAVPPPDLNRNTEWFMYPGVWTTYILILFFSWILVLSVFGCAPGTAWTLVNLGHFAITYHFFHWKKGTPFADDQGMYNTLTWWEQMDNGKQLTRNRKFLTAVPVVLYLIASHTTDYQHPMLFLNTLAVTVLVVAKLPNMHKVRIFGINAGS

SEQ ID NO: 15957 - DNA, 1090 bp, Panicum virgatum
  misc_feature: Ceres CLONE 1786602
  misc_feature: Encodes the peptide sequence at SEQ ID NO. 15958
aaaaaaaaaccggcacacttcaattccacacaaaacttttcctcctcatcatcatcttcgtcttcctctcctcctcatcctctctctagctgctgtggtcatactttctctctcttctattctctttctctgccaagaacaccggccggctagcagctcgtgctcccatggagatcgacgccgacaacctcagcgccaccgagctccgcctcggcctgccgggaatcagcagcggcgacgccgaccgcccgaagaggccggcgccctccgtcggcgccaagcgcgcgctcgacgacaccaggagcgaggcctcgggcaccagcccggccgccgggggcgaccacgacgccgccacgcctgccaaagcgcaagtggtggggtggccgccggtgagggcgtacaggaagaacaccttccaggcggcggcggcgaagaaggccgagcagcccggagggctgtacgtgaaggtgagcatggacggggcgccatacctcaggaaggtggacctccggatgtacaaggggtaccgggagctcagggaggcgctggacgccctcttcacccagtccttctccgcctccgccggagcgaagggcggcgacggccagcacgccctcgcctacgaggacaaggacggcgatctcatgctcgtcggagatgtgccctgggagtaagtaccatcggatcaacatgttagctctctgtcagatctgaagatgaatgagtgagcagaactctaattgtgagctctctatctttgcagcatgttcatctcttcgtgcaagaagctcaggataatgaatggttctgaggccaggtgaccgctgatgcacaggcagaggctgcaactcatggggtgaatcgaggagcacaggtcgtgcaaaggagctgtgtggcttggagtcttggactctccagtgctgtacaaagagatggttgtttctgaaaccaaggagaaggatctacgaattgtgtatatagttgtttaggctcttagttagccgccttgttttttgagttgtgttttgtatgagcgaaggctgtaaaagaactgaaaaagaaaaaagagaaacttgacttaagtttggtt

SEQ ID NO: 15958 - protein, 168 aa, Panicum virgatum
  misc_feature: Ceres CLONE 1786602
  misc_feature (7)..(168): Pfam Name: AUX_IAA Pfam Description: AUX/IAA family
  misc_feature: Useful for making plants with altered terpenoid content
  misc_feature: The sequence is a functional homolog of SEQ ID NO 636 in the 11/479,226 US patent application
  misc_feature: Useful for making plants with altered alkaloid content
  misc_feature: The sequence is a functional homolog of SEQ ID NO 652 in the 11/479,226 US patent application
MEIDADNLSATELRLGLPGISSGDADRPKRPAPSVGAKRALDDTRSEASGTSPAAGGDHDAATPAKAQVVGWPPVRAYRKNTFQAAAAKKAEQPGGLYVKVSMDGAPYLRKVDLRMYKGYRELREALDALFTQSFSASAGAKGGDGQHALAYEDKDGDLMLVGDVPWE

SEQ ID NO: 15959 - DNA, 993 bp, Panicum virgatum
  misc_feature: Ceres CLONE 1786604
  misc_feature: Encodes the peptide sequence at SEQ ID NO. 15960
ctcttccgacaccacacgaggagtagctcgcctcgcgctccgaccggcttccggcagccatggcgatgagcgacaccggctcgagcttcgcgccatgggccgagctcttccaccgcgaccccaccccgggcctgcccgtcgccgatgacgccgtcgcggcgagcccgccgacctcgggcgggtccggcgggagcctgaccaaggcggcccgccagcagcagcagcagcagctgggcgtcgacgggccccgggtcggcaagccggcgcggcggcggtcccgcgcgtcgcggcgcgcgcccgtgacgctgctcaacacggacgcggccaacttccgcgccatggtgcagcagttcacgggcatccccgcgccccccgccggcgcgttcggggccccggtcatcagcttcgccggcgactacggtttcccgccgccctcaggcgtcatgtccttcgaccacctccaccggagccacccgcccccggcggcgccgctccaggaccagctgatccgcacgcagccgcagtacaccggcgaggccttcggctacagcaacagcagcctcctgcacggcggcggcggcgacatgttcgcctcctcccacgggctcgcgtcggcggccgaggaccggatgctcctgcagagcatccagcaggcgacgacggcccaccaccacatgccgccgccggcgtccgccgctaacgccaccgctaatggcttcttcgcctgagcaagcaaaccgatcgagatgccggagagctgaagtgaaggattaacatgaaaaaaagttcagtcaggatcgatcaagttgtgatgcttagtttcctcttggcatgtgatgcttagtttccttttcctcctccgcttgttcaattagttcatgcagaagctcggtttgtcggccgcggaggttgtaaatatcttgttaattttgatgacctgtactcagtcttggtcactctcatggtgattagttctcatccaagatttatccg

SEQ ID NO: 15960 - protein, 222 aa, Panicum virgatum
  misc_feature: Ceres CLONE 1786604
  misc_feature (77)..(107): Pfam Name: VQ Pfam Description: VQ motif
MAMSDTGSSFAPWAELFHRDPTPGLPVADDAVAASPPTSGGSGGSLTKAARQQQQQQLGVDGPRVGKPARRRSRASRRAPVTLLNTDAANFRAMVQQFTGIPAPPAGAFGAPVISFAGDYGFPPPSGVMSFDHLHRSHPPPAAPLQDQLIRTQPQYTGEAFGYSNSSLLHGGGGDMFASSHGLASAAEDRMLLQSIQQATTAHHHMPPPASAANATANGFFA

SEQ ID NO: 15961 - DNA, 1090 bp, Panicum virgatum
  misc_feature: Ceres CLONE 1786608
  misc_feature: Encodes the peptide sequence at SEQ ID NO. 15962
aaaaacgcgcgacgccttcgtcgagaaatcgcggtcgcgcccccgcgactcccaccgcaaatcgcacgcaaaaatcccacccgccgccgcgccgtgccatggcgcccgcctcgctcccgctctcctttccgcgcgcggccggcgcgcctctcccgccgccagctatccccggcagcaccagcgtcgccgcctgcccccacgttgccgcaccgtcgcggggcaccgggcggaggagagggccgcgcgtcgcgctcgccgcggcgccggcggggcgccaggccggccggtggagggcgggcgtgtcgtccttctccttcctcccgtcgttcttcacggggaataaaggggagaaggacgccgagaaggcggtgaggctcaaggaggggctcctcgccgccatcgcgccgctcgaccgcggcaccgaggccacgcccgaggacaaggagcgcgtcgagcagattgttcagcagctggaggcggtgaaccaggtgaaggaaccgctcaagtccgatctcctcaacggcaaatgggagcttctctacaccacctccacaagcatactgcaaccacagaggccaaagtatctgaggccatttgggaagatttaccaagcaatcaacgcggacactttgagagcccaaaacatggaaacctggccttactttaatcaggttactgccaacttggtacctcttaatcctagaagagtggcagttcagtttgattacttcaagatatttagtttgatctcaatcaaagcgcctggaagcggtaaaggtgaactagaaattacttatcttgatgaagagctcagggtttcaagaggagacaagggaaatttgtttgtattgaagatggttgacccaacatacagagttccattgtaataatgttaaacgataatactttttgcaatgcagtccttaaaaaataggaaaaagtaaaatatgtcagtatagatttaggtgtcagctttatgtgtaacattccctgcggtaacgtaatgcctgtaaatattaaagattctacttgtaatgtgggaatcccattggaacatgcctcgtgaaaactaaaatatatcgatgcttgg

SEQ ID NO: 15962 - protein, 262 aa, Panicum virgatum
  misc_feature: Ceres CLONE 1786608
  misc_feature (91)..(252): Pfam Name: PAP_fibrillin Pfam Description: PAP_fibrillin
MAPASLPLSFPRAAGAPLPPPAIPGSTSVAACPHVAAPSRGTGRRRGPRVALAAAPAGRQAGRWRAGVSSFSFLPSFFTGNKGEKDAEKAVRLKEGLLAAIAPLDRGTEATPEDKERVEQIVQQLEAVNQVKEPLKSDLLNGKWELLYTTSTSILQPQRPKYLRPFGKIYQAINADTLRAQNMETWPYFNQVTANLVPLNPRRVAVQFDYFKIFSLISIKAPGSGKGELEITYLDEELRVSRGDKGNLFVLKMVDPTYRVPL

SEQ ID NO: 15963 - DNA, 518 bp, Panicum virgatum
  misc_feature: Ceres CLONE 1786641
  misc_feature: Encodes the peptide sequence at SEQ ID NO. 15964
ctgcccctccccgtctctctcgtgctctctcgccgccgccgagaatgatggtagaggacgaggactgagttgtcggagatgggccactccaacgtccggaactcgcaccccaagaactacgggcccggctcccgcgtctgccgggtctgtgctaacccccttggattgatcaagaagtatggtctcatgtgctgcaggccctgcttccgcagcaacgccgaggacattgacttcatcgagtaccgctaaaggcattgccttgctggcgtcgagaacttcacctgcgttgaaaagaaatggatccttcaatagaaggctcaacttatgtgcattagattttcgttcagacttgagactgctagtaaactacttgttccagttttgatgggtactatatgcctgttaaactaattataattaactgattggagtattttgtcatgtttgatatctggtgtactccacctgcttgtattgctgccctccaaggctcccaagttattgtactgccaattctg

SEQ ID NO: 15964 - protein, 56 aa, Panicum virgatum
  misc_feature: Ceres CLONE 1786641
  misc_feature (3)..(56): Pfam Name: Ribosomal_S14 Pfam Description: Ribosomal protein S14p/S29e
  misc_feature: Useful for making plants with modulated nitrogen use efficiency
MGHSNVRNSHPKNYGPGSRVCRVCANPLGLIKKYGLMCCRPCFRSNAEDIDFIEYR

SEQ ID NO: 15965 - DNA, 808 bp, Panicum virgatum
  misc_feature: Ceres CLONE 1786687
  misc_feature: Encodes the peptide sequence at SEQ ID NO. 15966
gtgcgcatcgatctagcgcctcttctccaaatccaaccccgccgcccttgctcacgaaggctactggaagcctagaagtgccctcctctccggcgccttctcctcagatccccagctgataccgccgaccaaccaggatcgtggatccatggaggcgaagatggggcgcttcttcgagtccgtgggcaacttcttcaccggcggcgacaacatcccctggtgcgaccgcgacatcatcgccggatgtgaaagagagcttgccgacgctgcaactgaagagcagaggaatgatagccttatgaggctttcttgggcccttgtgcactccaggcagacggacgatgtaaatcgtggaattagcatgcttgaagcttctttggataattctggcagccctctgcagactagggaaaagctgtacttgttggctgttgggcactacaggaatggtgactactcaaaaagccggcaacttgtggaacgctgtttgcagattcaacctgattggaggcaggctatttctctgaagaaagcaatagaagataaaattgcgaaagatggtcttattggaataggaattgcgacaactgctgtgggacttctggttggtggaattgcagctgctgttgcccgaaagaagtaagatgaatagatggtgtctctgctcaccgatgaacaaggagacgctttcagttgtactggtgttaagctggtgatacatgagtcgaattgaaatggattttatatgtacaaagtgagtagatgataatactattgaggcaatgtagcctttgtttagttttttatc

SEQ ID NO: 15966 - protein, 164 aa, Panicum virgatum
  misc_feature: Ceres CLONE 1786687
  misc_feature (87)..(120): Pfam Name: TPR_2 Pfam Description: Tetratricopeptide repeat
MEAKMGRFFESVGNFFTGGDNIPWCDRDIIAGCERELADAATEEQRNDSLMRLSWALVHSRQTDDVNRGISMLEASLDNSGSPLQTREKLYLLAVGHYRNGDYSKSRQLVERCLQIQPDWRQAISLKKAIEDKIAKDGLIGIGIATTAVGLLVGGIAAAVARKK

SEQ ID NO: 15967 - DNA, 786 bp, Panicum virgatum
  misc_feature: Ceres CLONE 1786711
  misc_feature: Encodes the peptide sequence at SEQ ID NO. 15968
acgcgcccgcgcggcacacctgttcgacgaatttccccgctaggtcgccaggcgccaggccggcccttccccgcgccatggcgttgccacgcgccgcgattgtccatccgccattctcgccgtgtcccgcgctcccggcctgccgccttccgacctcgacgacaggctccggggctagctttgcgtacttccggacccagcatcccggcgtcggcgcggcgcggcgcgcgtaccccaggatcgaggcggcggcgaggcgcggcgcgcgcacggagaaccccagggtcaggaaccgacggctgcagaagaagttccatggcacggcgacgaagcccaggctgtcggtgttctgctccagccggcagctctacgccgtgctcgccgacgaccacaacaagaagatcctcttctacggcagcaccctgcagaagtccatctgcagcgacccgccctgcagcaccgtggaagctgcccggagggttggggaggagctcgtcagggcgtgcgaggagcttggcatctccgagatctcctacgactgcgacggcttcgctcgaggcgagaagatgatggcgttcgaggttcccgtctcacagcacgggttcctgccaagataaggaggcaccaggcttgcactgacagttcaccgtagcagcttattcaggagacgagaaaggaagtttgtcccattccatgtgatactgtaatttgtatgatccagcagtccttcaacatcatgtagttcatatttcacagcagtcactaagcaagtcaggcattgccagc

SEQ ID NO: 15968 - protein, 179 aa, Panicum virgatum
  misc_feature: Ceres CLONE 1786711
  misc_feature (63)..(169): Pfam Name: Ribosomal_L18p Pfam Description: Ribosomal L18p/L5e family
MALPRAAIVHPPFSPCPALPACRLPTSTTGSGASFAYFRTQHPGVGAARRAYPRIEAAARRGARTENPRVRNRRLQKKFHGTATKPRLSVFCSSRQLYAVLADDHNKKILFYGSTLQKSICSDPPCSTVEAARRVGEELVRACEELGISEISYDCDGFARGEKMMAFEVPVSQHGFLPR

SEQ ID NO: 15969 - DNA, 684 bp, Panicum virgatum
  misc_feature: Ceres CLONE 1786720
  misc_feature: Encodes the peptide sequence at SEQ ID NO. 15970
gaaagggagagggcggagaagaaggctagggtttaaggttgctcggcgatggcgtcggcggcgaaggccctggccgcgcgggcggggtcctccctcctcggccgcctcctcgcgtccccgtccacgcccctcctccgcgcggggctgccgcagctcgccaggctgcaggcgcacgccccgccgccggcgccgtctgtggatgcctacgaggcggaggcggtcgcgaggctgacgtcggtccccggcgagatctcgttcccctgcggcctcccctcgctccgcttcttcatcgacgacggtactgctgttgagaatcctgttgttaatgaaccccttctgctaataaagagaacttaccagcccagtaccatcaagcggaagagaacccatggatttcttacacgtaagtcgaccaagggtgggcgcaaggtgatcgcacggaggatcgccaaaggcaggcacaggctttccgtttagtgagatcccgtagcagctctggacgttgttttcttcacagcagatttgtactattccttgtatgaaaccttagagtttcagtctatgtatgcttaacgagtaccaaccctctgctaaaggcgagccccagcaaaaagcaacagaccgtgtgtggattttcttcgtgtcaaaacgactgttccgcgaaataaactcaagtttatctgc

SEQ ID NO: 15970 - protein, 142 aa, Panicum virgatum
  misc_feature: Ceres CLONE 1786720
  misc_feature (99)..(142): Pfam Name: Ribosomal_L34 Pfam Description: Ribosomal protein L34
MASAAKALAARAGSSLLGRLLASPSTPLLRAGLPQLARLQAHAPPPAPSVDAYEAEAVARLTSVPGEISFPCGLPSLRFFIDDGTAVENPVVNEPLLLIKRTYQPSTIKRKRTHGFLTRKSTKGGRKVIARRIAKGRHRLSV

SEQ ID NO: 15971 - DNA, 1163 bp, Panicum virgatum
  misc_feature: Ceres CLONE 1786738
  misc_feature: Encodes the peptide sequence at SEQ ID NO. 15972
acccgagctctcgttttgccatcaccactctgcttgctcttcccctttgcagggtagtctccgcgttcccgagagaagaggtcgaggagcctgcgcgaggctcgcgtctggagctggctacccactacaagggtcagggagcggcctcgccgcgcccgaacgaggcggcggagctggccgccctcgcggggacggaggagtcggaggagcagcgcaaccgcttcctggtgctgcgcctctacgaggcgctcaacgcccgcgacgcgcgccgggcgcaggagctgctggcgcccgacctcgagtggtggttccatggcccccccgcgcgccagcacatgatgcgcctcctcaccggcgccgagaaaggcagcggcggcttcgtcttctccccgcgctccgtcgacgcctttgggtccaccgtcatcgccgagggcgccgacgacgcgcgccagctctactgggtgcacgcctggaccgtgggacccgatggggtgatcacccagctcagggagtacttcaacaccgacctcaccgtcaccctcctctccggcgccgcctccgccaagaacgccgcaattgcagccgctcctccgaagcaggacgccgcatcttcctcctcctcctcggcgccttccgcgggcgcctcctcctccacaggccccaagtgcctgtggcagagccgccgcgccgaccgcgcgcacaagtcgctgccgggcctcgtcctcgccatctgatcggcagcagagacggcaagagtgacctgatcccctccataactaatccaataaaccaccggaaaattacatagtatttgcgcataaataatctgcaactggtctagccttttaccaggtaattaatgatcaaagccaatcagtcggtgaaggcgtatggtctgaactgaaactgctgcgagttgtggggttccgttaccggttgcattgctcagcgtgtgtgtgttggattagtagtgtgataagtccaagtcctcgtgtcaaaaaaaaaagtccaagtcatggactatggtgtgtactgctgccattactactatcgtggtggtctattatggtctgatggaagtgatggtctgttgtggtcgaatgaaagttgcttgagttggagggttaagcaactggctaatgtgcgtgttcggcattctcttc

SEQ ID NO: 15972 - protein, 243 aa, Panicum virgatum
  misc_feature: Ceres CLONE 1786738
  misc_feature (113)..(243): Pfam Name: WI12 Pfam Description: Wound-induced protein WI12
PSSRFAITTLLALPLCRVVSAFPREEVEEPARGSRLELATHYKGQGAASPRPNEAAELAALAGTEESEEQRNRFLVLRLYEALNARDARRAQELLAPDLEWWFHGPPARQHMMRLLTGAEKGSGGFVFSPRSVDAFGSTVIAEGADDARQLYWVHAWTVGPDGVITQLREYFNTDLTVTLLSGAASAKNAAIAAAPPKQDAASSSSSSAPSAGASSSTGPKCLWQSRRADRAHKSLPGLVLAI

SEQ ID NO: 15973 - DNA, 891 bp, Panicum virgatum
  misc_feature: Ceres CLONE 1786818
  misc_feature: Encodes the peptide sequence at SEQ ID NO. 15974
gaaccatcgaacgccaaaccctccggccaccatcggtgtcgcggaagtccagagggagtcgatccaaggcggcgcgctgcaggacgccgacgcggcgggatcaaggaagaaaggaaccagggcaagcgagcgaggttctcataggctccgacgaccgccatggacatggcctccgcgtccgcgcccagcacctcctcccacaacatctccctggcgcaggccgtgctgacgctctccatcaacgccgtcctcgtcttcctcaccgccgtcatcaagtccgccacctcctcctcatcgtcctcgtcccgcggccgcgaggctgcccccgctcctgctcctgcggccgccgccgcacccgcgtcgccggctccggctaagcccgccgccgccgcgatcgacatggacgtggtgctcggggtgatgggcgccggcggcgccgccgtgtcggtggggttcgaggaggccgcggcgctgttcgacgaggaggaggcgmccgtggaggaggcccgcgccgcgttygcggtcttcgaccgcgacggcgacgggttcatcgacgccgcggagctccggagcgtgctcgggtcgctcgggctcggcgccgccgccggcgccgcggagtgccagcgcatgatcgacgcgtacgacgaggacagggacggcaggatcgacttcagcgagttcgtcaagctcatggagacgagctcgtgagttagaatagggactaattggacagccgggccggaggcccggatgactcggtcggatttgttcagagattctttgttcgtttgttctttctatgtttttcttggccggaatcgagccgaatgatgcatacagtacatgtgtatactcaaaatctagatatggatacatgattttctgaagatc

SEQ ID NO: 15974 - protein, 182 aa, Panicum virgatum
  misc_feature: Ceres CLONE 1786818
  misc_feature (115)..(143): Pfam Name: efhand Pfam Description: EF hand
  misc_feature (153)..(181): Pfam Name: efhand Pfam Description: EF hand
  misc_feature (112)..(112): Xaa is any aa, unknown, or other
MDMASASAPSTSSHNISLAQAVLTLSINAVLVFLTAVIKSATSSSSSSSRGREAAPAPAPAAAAAPASPAPAKPAAAAIDMDVVLGVMGAGGAAVSVGFEEAAALFDEEEAXVEEARAAFAVFDRDGDGFIDAAELRSVLGSLGLGAAAGAAECQRMIDAYDEDRDGRIDFSEFVKLMETSS

SEQ ID NO: 15975 - DNA, 760 bp, Panicum virgatum
  misc_feature: Ceres CLONE 1786820
  misc_feature: Encodes the peptide sequence at SEQ ID NO. 15976
gcaaaccctaacgcagccgccgccgcctgctgccccgccgctcctcgcctccccgacagcccctatcctcctcagccagccgcagccatggcggacgtcgacgtcgatacggaggtcgccgccgcaggacagcccaagaagaggacgttccggaagtacagctaccgcggagtggacctcgacgcgctcctcgacatgtccaccgacgacctcgtccagctcttccccgcccgcgcccgcagaaggttccagaggggtctaaagaggaagccgatggccctgatcaagaggctgcgcaaggcgaaaaaggaggcgcctgctggtgagaagcccgagcctgtcaggacccatctgcgcaacatgatcattgtgccagagatgataggctccataattggagtgtacaatgggaagacattcaaccaggttgagatcaagcctgagatgattgggcactaccttgctgagttttccatcagctacaagcccgtcaagcacggaaggcccggtatcggtgctacccactcctccaggtttatcccactcaagtgagggatcccagggcatgctcatgtccaggcaaaagttatctggcccgctgttatcttttatcggatataaaactttgctccttagcacttagtgtttttgtctgaggaaagtttgcccagcaagtattctagttttgcagtggaattttgagaacctgagtgctacttctttttccaaattgaaagtggagatctggtgtctatggtgc

SEQ ID NO: 15976 - protein, 154 aa, Panicum virgatum
  misc_feature: Ceres CLONE 1786820
  misc_feature (56)..(137): Pfam Name: Ribosomal_S19 Pfam Description: Ribosomal protein S19
MADVDVDTEVAAAGQPKKRTFRKYSYRGVDLDALLDMSTDDLVQLFPARARRRFQRGLKRKPMALIKRLRKAKKEAPAGEKPEPVRTHLRNMIIVPEMIGSIIGVYNGKTFNQVEIKPEMIGHYLAEFSISYKPVKHGRPGIGATHSSRFIPLK

SEQ ID NO: 15977 - DNA, 814 bp, Panicum virgatum
  misc_feature: Ceres CLONE 1786822
  misc_feature: Encodes the peptide sequence at SEQ ID NO. 15978
gacgatcccaaagaagagaaagaagcacgcgcagcatccgttccttgccgctgccgctgccgctgccgctgcactctcccatagtccatagcagaacccccaccccgcgcaaaagcagagcaaccactttcccctcccgccccccatctcagtcctcctccatggcgagatcgacgcgcggcgcgctcctcctcctcctcgcgctcctggcgctggcagcggcggcccgcgcgggcgacgtgccggcggcgctgggctgggagctcggggtggtgggcgccgcggaggacgaggagttcggcttccccgccggcggcgactccgtggcgcgccgggtgctgcagggcgggcccgggtacatcagctacggcgcgctgcggagggacaacgtgccgtgctccgtgcggggggcctcctactacaactgccgccccggcgcgcaggccaacccctactcgcgcggctgctccgccatcgcccgctgccgcggctgatccgcccgcccgcttcagcgcaggcggccggcgactgccgggaggacgaggagaaggttcaattcatcccgttagtccctcgccgttcagaaaaaacaaaagagagagaagaaactgttcatctgccctttttaatcaattattgttgttagttagtacttgtattatttgtcttgtcgtccatgcttaaccgaggatgattggtggtagttgggctggcgcccgcgcgattccagtcggatccgtctgtccggtcctgtaaattgcacgcatgatttgtttgatcattgatccactggtgtataaactgatgatgattg

SEQ ID NO: 15978 - protein, 110 aa, Panicum virgatum
  misc_feature: Ceres CLONE 1786822
  misc_feature (44)..(110): Pfam Name: RALF Pfam Description: Rapid ALkalinization Factor (RALF)
  misc_feature: Useful for making plants with modulated biomass
MARSTRGALLLLLALLALAAAARAGDVPAALGWELGVVGAAEDEEFGFPAGGDSVARRVLQGGPGYISYGALRRDNVPCSVRGASYYNCRPGAQANPYSRGCSAIARCRG

SEQ ID NO: 15979 - DNA, 775 bp, Panicum virgatum
  misc_feature: Ceres CLONE 1786844
  misc_feature: Encodes the peptide sequence at SEQ ID NO. 15980
tcagtgcggagagtgttcgtgcgaaggctacccctccctcccctccacctccgcacgccgaccgccgacgccatggtgaagtactcgcaggagccgggcaacccgaccaagtcggccaaggccatgggcagggatctcagggtccacttcaagaacacaagggagacagcttttgcacttcgcaagcttcctttggccaaggctaagcggtaccttgaggatgttatggctcacaagcaggcaattcccttccggagatactgcgggggcgttggtcgcactgctcaagcaaagtctcgccactcaaatggccagggtcgctggcctgtgaaatcagccaggttcatattggatttgctgaagaatgctgagagtaacgctgatgtgaaaggattggatgtcgacaacctctatgtttcacacatccaggtgaaccaagctcagaagcagaggcgtcgcacgtaccgtgctcatggacgcatcaatccttacatgtcctcaccttgccacattgagttgatcctgtcagagaaggaagagcctgttaagaaagaggctgacaatattgttgcatcaaggaagcaatgaagtacgttagcttgagcaaggctattttaatttgtcgaagaattatagctgtagctcttatgttctttttctggcagccttgcctcttgagatgttcctggttacaacgcttgaatcaggatttgctgagcttgatgctgtgcttcagattgtacgggggattctcaatatattttacaatagtttt

SEQ ID NO: 15980 - protein, 171 aa, Panicum virgatum
  misc_feature: Ceres CLONE 1786844
  misc_feature (17)..(153): Pfam Name: Ribosomal_L22 Pfam Description: Ribosomal protein L22p/L17e
MVKYSQEPGNPTKSAKAMGRDLRVHFKNTRETAFALRKLPLAKAKRYLEDVMAHKQAIPFRRYCGGVGRTAQAKSRHSNGQGRWPVKSARFILDLLKNAESNADVKGLDVDNLYVSHIQVNQAQKQRRRTYRAHGRINPYMSSPCHIELILSEKEEPVKKEADNIVASRKQ

SEQ ID NO: 15981 - DNA, 835 bp, Panicum virgatum
  misc_feature: Ceres CLONE 1786852
  misc_feature: Encodes the peptide sequence at SEQ ID NO. 15982
acacgccgacgccgatcgagctacctcccaccgacatcttgcggagttgcagtcctatctcttccgatccgtcctgcccgccgccgcagcttgggattagttcttctccgcgcggagatccgtgagccatggctgctgagactgttgtcctcaaggtggctatgtcatgccagggttgcgccggggcggtcaggagagtgctctcaaagatggaaggagttgagacctttgacatagacctcaaggaacagaaggtgacagtcaaaggcaatgtcaagcctgaggatgtcttccagacggtttccaagtccgggaagaagacctcctactgggagggcgaagccacagcccaggctgctccggctccagcagcagaagcagctcccagcactgaggcagaagcgcctgccgcggaggctgcaccagagagcactccagccgaaactgctgcaccagagatcaccccagtcaaatctgacgcttgatcgtcacatgagatgatgtgaccccaaaaccttactctagaactagctgggaaaccgagtcttgtgtggtttgcatcatgttgttgccactctagcaagtgattgcgaattatagaataaatgataaaacccagtgtgtgcttgcgtgtgatttcaagatgaacacatcccttgcaggattgttgttcactacattttacatttaccttaccattgcttacgagatcccccaaaaaggatcttggacgagtacaacccatgttaaacctcatagcttgtgacttctagattctaatatgatctttcgatgataatacattatgttgaccggtaaataactcaccttatgg

SEQ ID NO: 15982 - protein, 118 aa, Panicum virgatum
  misc_feature: Ceres CLONE 1786852
  misc_feature (6)..(67): Pfam Name: HMA Pfam Description: Heavy-metal-associated domain
  misc_feature: SWISSPROT Homolog: EC 3.6.3.4 Copper-exporting ATPase
MAAETVVLKVAMSCQGCAGAVRRVLSKMEGVETFDIDLKEQKVTVKGNVKPEDVFQTVSKSGKKTSYWEGEATAQAAPAPAAEAAPSTEAEAPAAEAAPESTPAETAAPEITPVKSDA

SEQ ID NO: 15983 - DNA, 690 bp, Panicum virgatum
  misc_feature: Ceres CLONE 1786855
  misc_feature: Encodes the peptide sequence at SEQ ID NO. 15984
ctcctcttccgtcactcctccctcctctcctcctcctgcgcccccactatttattcatcccaccacgccgatgcgccgccccggtggtgccgccgtcgtgccgccgtagaccgaccgccactcttttacaccccgcccccagtcgcaggtgagacggaggcgtggcgccggcgatggcgtcggagcccgtggcgcgcgcggtggccgaggaggtggcgcggtggggcgccatgcgccagaccggggtcagcctccgctacatgatggagttcggggcgcggcccacggagcggaccctactcctcgccgcgcagttcctgcacaaggagctccccatccgcatcgcgcgccgcgcgctcgacctcgagtcgctccccttcggcctctccaacaagccccccatcctcaaggttgatttgtcgcccgcatgcgtcttcctcgttgctaaattctcccgtggcggccggcgcatcctgatttgggcggttgcgcgtgcgggtcgatttgttcattacttcatttgtaaattgttgcgctgggtggtttcgttcttcgcgagtgatcgatttgcctcttgcttatctcctaggatgtttacaattttataatatttcttttaggattcagtgctctgttcctagatattctataatataaatatataataatgtgcctgtttccatgttatgc

SEQ ID NO: 15984 - protein, 144 aa, Panicum virgatum
  misc_feature: Ceres CLONE 1786855
  misc_feature: SWISSPROT Homolog: EC 2.7.11.2 [Pyruvate dehydrogenase (acetyl-transferring)] kinase
MASEPVARAVAEEVARWGAMRQTGVSLRYMMEFGARPTERTLLLAAQFLHKELPIRIARRALDLESLPFGLSNKPPILKVDLSPACVFLVAKFSRGGRRILIWAVARAGRFVHYFICKLLRWVVSFFASDRFASCLSPRMFTIL

SEQ ID NO: 15985 - DNA, 864 bp, Panicum virgatum
  misc_feature: Ceres CLONE 1786877
  misc_feature: Encodes the peptide sequence at SEQ ID NO. 15986
gtcgcatctctccacggtagccatctcttcaaggaaagtaaaggttcctcatcatcctttcgtttcttgggagccgagagccgctgggaccggtgcctttcctcctctgcttcccttcgcccttcctgtagtcttgctggttgctgctgtgaatttctcctcctcggttcttgattgctgagggtgagagaggatgccggcggagctcggctccgacgcctgatctttccgtcgattgaccaggcagcgggtggcggtggtgcatttctgggatgggactgctgttcgtggagcggctcgagagggagggcgtgttcaaatgccggcgctgccgcgtggacgccgcctccaaggacgccatcatctccagggacttctacggccgcaccggccgcgcctacctcttcgaccacgttgtgaacatatgcctaggaccgaatgaggatcgaaatcttgcaactggcctccacacagtgaatgacatctactgtagctgctgccaacagattcttggctggagatatgagagagcctacgaccaaagccagaaatacaaggaagggaagtacatcctggagagagctagaatggtgaaagacggctgacgatcatcggaatgttttttttgaaagtttatcatcggaatgttcttaccaccgaaaattgaagaagcgcacaaccataaagatatcgggcagcttgagctcgctgccgattagctagggagatgattgcagatgctgtgatttgtggaaaattaccgattctgaattctcataaaaggattctggtaacttgttagcagtgctaacgtttggtgacttattggtgatccggtgaatagtaatgaagctgatttcactc

SEQ ID NO: 15986 - protein, 110 aa, Panicum virgatum
  misc_feature: Ceres CLONE 1786877
  misc_feature (1)..(109): Pfam Name: Yippee Pfam Description: Yippee putative zinc-binding protein
MGLLFVERLEREGVFKCRRCRVDAASKDAIISRDFYGRTGRAYLFDHVVNICLGPNEDRNLATGLHTVNDIYCSCCQQILGWRYERAYDQSQKYKEGKYILERARMVKDG

SEQ ID NO: 15987 - DNA, 822 bp, Panicum virgatum
  misc_feature: Ceres CLONE 1786884
  misc_feature: Encodes the peptide sequence at SEQ ID NO. 15988
ggatgtgccccaaagatcccctcctctctcctcctctcctctgccttgcctgcccagagctgacttttgctccgacccccctccctctctctctaccacgcttgtttgccttcgctttgccccccagcctcatgttcttcctctccttcgtgtagcttccatcccactcccaccgccgcccccccgctcgagccgaatccccaattggggcccaggcccccctcccgccggcttcaaaatccggttctggggaggcttgctgccgcagatcggggatacgctccctgttcattcggtccgccggtgtccgcgtcccccgtccttcctaggtgctgtcttcttccgggggtggtgcttggatgagctgcttcgtgtgcttcgaatcggcccacgatggggaggccgacaagcccgccgccgccgacgccaaggactcgcgcaagaacgggccgccggatcgcggggtggtcagggtcggatcagataaatctagatcacagggtggatcagactctaagaaggacatcattatccatagagatgggaacagtcaaaatattgcagcacagactttcacttttcgtgaacttgctgctgccacaaagaacttcaggcaagagttggatggccaaaaatagactttactcgctatcatatatgttcggtgtgctaaaatttcacttctttcaactggctgtaattttcatatgctacaatttcagttctttcggtttttgcgcgagacttgtgtgtgtatttagccagacttatgggtgaagcttgctgattgaaaaaataaaaaatataagatagaaactgcgg

SEQ ID NO: 15988 - protein, 92 aa, Panicum virgatum
  misc_feature: Ceres CLONE 1786884
  misc_feature: SWISSPROT Homolog: EC 2.7.11.1 Non-specific serine/threonine protein kinase
MSCFVCFESAHDGEADKPAAADAKDSRKNGPPDRGVVRVGSDKSRSQGGSDSKKDIIIHRDGNSQNIAAQTFTFRELAAATKNFRQELDGQK

SEQ ID NO: 15989 - DNA, 585 bp, Panicum virgatum
  misc_feature: Ceres CLONE 1786891
  misc_feature: Encodes the peptide sequence at SEQ ID NO. 15990
aaagcactccgcggcagagagggttcgagaaagccaaaaggaaggggcgagcagatttggggagggcgaggcgaaggaagccagccagcgagccggggcaggcatccatggcggactggggccccgtgatcgtggcgacggcgctgttcgtggtgctgacgccgggcctgctctgcacgctgccggggcgcggccgggtggcggagttcggcagcatgcacaccagccccgtcgccatcatcgtccacgccgtcctctacttcgcgctcatcaccatcttcctcatcgccatcgggatccacatctacgccggctagccggcaccagcagccgccggccgatcgatcgagccgggggggcgtcgggcggcggcggccgccggcgtgtgattcgaaactagatctggcttttcctcctgtccctctctctcctgctgatccgttgttcctcccccccgctgcgggagtaggactcgatgatttattactactgtgctctgtgctggttgttatggatcaagactttgcatgtgatcttgtttatctgcctgcctgccatgagatggggatcgatcgcccttttgct

SEQ ID NO: 15990 - protein, 69 aa, Panicum virgatum; identical to SEQ ID NO: 15658
  misc_feature: Ceres CLONE 1786891
  misc_feature: Useful for making plants with altered cell wall content and/or composition

SEQ ID NO: 15991 - DNA, 748 bp, Panicum virgatum
  misc_feature: Ceres CLONE 1786902
  misc_feature: Encodes the peptide sequence at SEQ ID NO. 15992
actcgtcttccacccggaccaccaccccaccttcgctccgcagccgcaacaaccacacctcccctcgccgccgccaccgcaagtacagcgcagccgcgtcgcgtcgccgcttccgatccccttccgaggctaaagcacgcgcataccccccgaatggcggcggcgaggagtctgattctgagacacctccgcttggcggcggccccgtcgtcagcggcgtccctcaggccggcggccgcgctgcaggaggccctgtcggggcggcgatggatgtcctcagaagaggcaaaggggtcgttcctggacaaaagcgaagtcacggaccgcatcatcaaggtcgtcaggaacttccagaagattgacgacccctccaaggtgacaccagatgcccatttcaagaatgatcttggcctagacagcttggatacagtggaggttgtcatggccctggaagaggaattcggattcgagatacctgacaatgaagctgacaaaattgactccgtcaaagttgctgttgagttcattgcctcacacccgcaagcgaaatgatcaggcaaattgtcttctgttgtcttttaaggtttttatgaagaagagtttggcttgatgatgagcactgttgtgactgtttcaccattttactgtctgccacagtcctttcgggaacgctttctgctactgtgggttatactgcactaaataagattataatttagaacatggatggggctttcccttctcaccg

SEQ ID NO: 15992 - protein, 132 aa, Panicum virgatum
  misc_feature: Ceres CLONE 1786902
  misc_feature (57)..(125): Pfam Name: PP-binding Pfam Description: Phosphopantetheine attachment site
  misc_feature: SWISSPROT Homolog: EC 6.1.1.13 D-alanine--poly(phosphoribitol) ligase
MAAARSLILRHLRLAAAPSSAASLRPAAALQEALSGRRWMSSEEAKGSFLDKSEVTDRIIKVVRNFQKIDDPSKVTPDAHFKNDLGLDSLDTVEVVMALEEEFGFEIPDNEADKIDSVKVAVEFIASHPQAK

SEQ ID NO: 15993 - DNA, 763 bp, Panicum virgatum
  misc_feature: Ceres CLONE 1786914
  misc_feature: Encodes the peptide sequence at SEQ ID NO. 15994
acgcggagccaaaaaaataaaaaaatctcgctttcggttcgcgtggagtgaggagtcggagggaagcgaaaactcgcgaaagggcatcggtttcgctcggagcggaggagatggccgggaagggaggcaaggggctgctcgcggcgaagacgacggcggccaagacggcggagaaggacaaggggaagaaggcccccgtctcccgctcctcccgcgccggcctgcagttccctgttggccgtatccaccgccaacttaagcagaggactcaggcaaatggtcgtgttggtgccactgcagccgtctactctgctgccatcctggagtacttgaccgctgaggttctggagttggctgggaatgctagcaaggatctgaaggttaagcgtatcacccctcgccaccttcagctggccatccgtggagatgaggagctcgacaccctcatcaagggcaccatcgcaggtggaggtgtaatcccgcacatccataagtccttgatcaacaagtcctccaaggagtgagtgaggggctagagatgatgtgcatcttagtttaaactggacttttgtgtgcccgtgttgtaagtcctggttgtttagtttttagtggagctgtctggttgaagggatccttgtgtgtaacactttcctggtactgcatctgttatttgaacatcgtgtctgtgttgagttgttaacttcaggggtgcaaacctggatgcttatttagttatttgggactgcctgttatttcagttctt

SEQ ID NO: 15994 - protein, 137 aa, Panicum virgatum
  misc_feature: Ceres CLONE 1786914
  misc_feature (32)..(106): Pfam Name: Histone Pfam Description: Core histone H2A/H2B/H3/H4
  misc_feature: SWISSPROT Homolog: EC 2.7.7.7 DNA-directed DNA polymerase
MAGKGGKGLLAAKTTAAKTAEKDKGKKAPVSRSSRAGLQFPVGRIHRQLKQRTQANGRVGATAAVYSAAILEYLTAEVLELAGNASKDLKVKRITPRHLQLAIRGDEELDTLIKGTIAGGGVIPHIHKSLINKSSKE

SEQ ID NO: 15995 - DNA, 506 bp, Panicum virgatum
  misc_feature: Ceres CLONE 1786933
  misc_feature: Encodes the peptide sequence at SEQ ID NO. 15996
ccttgctccagtcctcggcggcggcggcagccatggacaagagcatgctcggcgacctggacggcctccccgaggaggacaagatgcgcatggcctccatgatcgagcagctccagatccgtgacagtctgagaatgtacaattccctggtggagagatgcttcacggactgcgtggacacgttccgccgcaagaccctggacaagcaagaggagtcatgcgtccgccgctgcgctgagaagttcctgaagcactccatgagggttggcatgagatttgctgagcttaaccagggtgtggccacacctgactaaactttgttgcccttgccaagttccccccgtggggatttttgtcagcatctatttgtaatcctaaaaatgattttagcaccccttgagaaatgcaactcggtaaggttgcccttgaaccaactgctgggtatgacattgaataaaattacctagaatcattttatccaatggtacattttccatttcgtggtt

SEQ ID NO: 15996 - protein, 93 aa, Panicum virgatum
  misc_feature: Ceres CLONE 1786933
  misc_feature (20)..(85): Pfam Name: zf-Tim10_DDP Pfam Description: Tim10/DDP family zinc finger
MDKSMLGDLDGLPEEDKMRMASMIEQLQIRDSLRMYNSLVERCFTDCVDTFRRKTLDKQEESCVRRCAEKFLKHSMRVGMRFAELNQGVATPD

SEQ ID NO: 15997 - DNA, 716 bp, Panicum virgatum
  misc_feature: Ceres CLONE 1786952
  misc_feature: Encodes the peptide sequence at SEQ ID NO. 15998
acacgccgacgccgatcgatcgagctagctcccacttgcagtcctccgtcccgcccgccgcgcgcgcttcagcttgggttggagatccgtgatccatggctgctgagactgttgtcctcaaggtgactatgtcatgcgagggttgcgccggggcggtcaggagagtgctctcaaagatggaaggagttgagacctttgacatagacctcaaggagcagaaggtgacagtcaaaggcaatgtcaagcctgaagatgtcttccagacggtttccaagtcggggaagaagacctcctactgggagggcgaagccacagcaccgtctgctccggctccagtagcaaaagcagctctcagcaccgaggcagaagcgcctgccgcggaggctgcaccagagatcaccccagtcaagcctgacgcttgatcatcacatgagatgctgtgacccctaaaccttactctagaactagctaggaaaaccgagtcttgtgtgatttgcatcatgttgttgccactctagcaagtgattgcaaattatagaataaatgataaaacccagtatgtccgtctgtgtgatttcaggatgaacacatcccttcactacattttactttattttaccattgctttcgagttccccctaaacacttgtctagaccctattgtcttacagaaaagaacatgaatgaaatccatgttaaacctcatagcttgaggt

SEQ ID NO: 15998 - protein, 108 aa, Panicum virgatum
  misc_feature: Ceres CLONE 1786952
  misc_feature (6)..(67): Pfam Name: HMA Pfam Description: Heavy-metal-associated domain
  misc_feature: SWISSPROT Homolog: EC 3.6.3.4 Copper-exporting ATPase
MAAETVVLKVTMSCEGCAGAVRRVLSKMEGVETFDIDLKEQKVTVKGNVKPEDVFQTVSKSGKKTSYWEGEATAPSAPAPVAKAALSTEAEAPAAEAAPEITPVKPDA

SEQ ID NO: 15999 - DNA, 988 bp, Panicum virgatum
  misc_feature: Ceres CLONE 1786968
  misc_feature: Encodes the peptide sequence at SEQ ID NO. 16000
gtctcggcttcctcctcaccgccccgccgtgcacgagcgcagctcgccgtcgcctccctcgccgagaggcccggggcctgatccccacgccgagagcagtggtggtgcgaggaggttagcgatggcgaggtggcgcccggcggagctgctgctggtggtgctggcggcggtcctggcggcggcgcggcgggcggacgcgctgtcggtgacggtgacggacaccgagtgcatccacgagttcgtgccctacgagggcgacaccgtgtccgggaacttcgtcgtcgtcgaccacgacatcttctggagctccgaccaccccggcatcgacctcacggtaacttcaccaggtggcaacactgtacatacgttgaaggggaaatctggtgataaatttgagtttaaagctccaaggggtggcatgtacaagttttgcttccataacccatatggagcacctgaaactgtttctttctacattcatgttgggcacatacccaatgaacacaatctggcaaaagatgagcacttggaccctattaacgttaaaattgcggagctgaaggaagcattggaatccgtaactgctgagcagaagtacctaaaggcacgtgaagctcgtcaccgacacacaaacgagagcacgcgaaagcgtgtgatgttctacacaatggcggagtacctagctttcatggcagctagcgcattgcaagtcgtctacatccgccgcttgttcagtaaaaatgtggcatacaacagagtgtaggatacagctctactttgaaggcgtcaatggaggcagcgcatggttggaatgggaaaacatcttctgtcaatttgacaaattgtagctctgcaccctcttttcttcttttcttagtctataagcaaaactttttaatctatcatgtacttttagcaactcttgtgagatgtgaagtgcatttgttgtgaacgttgatccataattaatcttcagagaattgtcgtg

SEQ ID NO: 16000 - protein, 213 aa, Panicum virgatum
  misc_feature: Ceres CLONE 1786968
  misc_feature (55)..(121): Pfam Name: EMP24_GP25L Pfam Description: emp24/gp25L/p24 family/GOLD
MARWRPAELLLVVLAAVLAAARRADALSVTVTDTECIHEFVPYEGDTVSGNFVVVDHDIFWSSDHPGIDLTVTSPGGNTVHTLKGKSGDKFEFKAPRGGMYKFCFHNPYGAPETVSFYIHVGHIPNEHNLAKDEHLDPINVKIAELKEALESVTAEQKYLKAREARHRHTNESTRKRVMFYTMAEYLAFMAASALQVVYIRRLFSKNVAYNRV

SEQ ID NO: 16001 - DNA, 839 bp, Panicum virgatum
  misc_feature: Ceres CLONE 1786998
  misc_feature: Encodes the peptide sequence at SEQ ID NO. 16002
aaaccctacccgcgccgccgcctcgcatcgccagccgccgcctcgcatcgccagccgccgccgccgcgccgtgcgagctcagaccagcttccaccatggcggacatcgatgtcgagcccgaggtcgccgccggcgcgcctaagaagaggacgttccgcaagtacagttaccgcggcgtcgacctcgacgcgctgctcgacatgtccaccgacgacctcgtccagctcttccccgcgcgcgcaaggagaaggttccagaggggtctgaagaggaagcccatggcgctcatcaagaagctgcgcaaggcgaaaaaggatgctcctgccggtgagaagccggagccagtgaggacccatctccgcaacatgatcattgtccctgagatgattggaagcatcatcggtgtctacaatggcaagacattcaaccaggttgagatcaagcctgagatgattggccactacctcgctgagttctccatctcctacaagccggtcaagcacggtaggcctggtattggtgccactcactcctcgcggttcattccactgaaatgagttattgcccagttgtcagccccagaatccagcacggaaggcgcatggcatgtcatgtttccttccagctgtgctgcttgttttgaagaagttgcatattaccaatggtgttttgctctgtttcagctctagaatcctagctaagcactgcacaatttatgctgttttgagttaatcttatctatactgcgatgtggttgcttgtcagcattgtgatcgcttcattgttcttatgcgctgtatgctggattgctgaaatttgaacaccgccctatccttggt

SEQ ID NO: 16002 - protein, 153 aa, Panicum virgatum; identical to SEQ ID NO: 15400
  misc_feature: Ceres CLONE 1786998
  misc_feature (55)..(136): Pfam Name: Ribosomal_S19 Pfam Description: Ribosomal protein S19

SEQ ID NO: 16003 - DNA, 728 bp, Panicum virgatum
  misc_feature: Ceres CLONE 1787027
  misc_feature: Encodes the peptide sequence at SEQ ID NO. 16004
ctcttcccttcgcgcaccgctccaccccaccccgccgccgcttcgccgccaccgtcgccatggcccggatcaaggtgcacgagctccgggggaagaacaaggcggagttgcaggcgcagctcaaggagttcaagtccgagctctccctcctccgcgtggccaaggtcaccggcggagcccccaacaagctctccaagatcaaggtggtgcgcacctcgatcgcgcgcgtgctgacggtgatctcgcagaagcagaaggcggcgctgcgggaggcgtacaagaagaagaagctgctccccctcgacctccgccccaagaagacccgtgccatccgccgccgcctcaccaagcaccagctttctctgaagacggagagggaaaagaagcgtgagaagtacttccccatgaggaagtatgctatcaaggcctaggtcagaactgtgagatgtttctagcatattgtgggctgtttctttgcctaggaagtgttttaagttttgggttttatggacctttgctatgggttgaaactacggtacaatccctctgttacctcaaatacctagatgggtttaaggggcaattcgtattggcaatgaaaccttgcatgcttgttgtgatatggtcctttctacagttgtatcgctagacgatgatttttgtgtaggcctgctggatgtattgtgacagacttagacaagttatagattccttttagtttcaacttt

SEQ ID NO: 16004 - protein, 123 aa, Panicum virgatum; identical to SEQ ID NO: 10653
  misc_feature: Ceres CLONE 1787027
  misc_feature (6)..(64): Pfam Name: Ribosomal_L29 Pfam Description: Ribosomal L29 protein

SEQ ID NO: 16005 - DNA, 802 bp, Panicum virgatum
  misc_feature: Ceres CLONE 1787042
  misc_feature: Encodes the peptide sequence at SEQ ID NO. 16006
gcttcatcagcagaacaaaagacaaccagacatctgatccacaacaccacactcgctaggtagcgagacctgtcgagaggaaccaccgaccggtgcaacatggagtacggccagcaggggcagcacggccacggaaccactggtcgcgtcgaccagtacggcaacccggtgggcggcgttgggcacggcaccgggaccgggaccggcggcatgggccagctgggggagcacggcggcgccggcatgagtggcggccagttccagcctgcgagggaggagcacaagaccggcggcgtcctgcaccgctccggcagctccagctccagctcgtccgaggacgacggcatgggcgggaggaggaagaagggcattaaggagaagatcaaggagaaattgcccggaggccacaaggacgaccagcacaccacggccaccggcggtgcctacgggcagcagggacacaccggcatgactggcacgggaaccggcggcgccgcctacaccgagggcaccggcgagaagaagggcatcatggacaagatcaaggagaagctgcccggacagcactaagcccggctgcgtagtacgcgcgagaagccgtgtgcttgtctgtcacggcgttccgagataataagatgaacccatcagaagtgaagtgtcccttgaacgcgtccgctcgcgtggggcggacggtttgcacctgtgtgtgcagtgtgatttgtatgtaacgtcatatacgtagagtgagctgtaatgtgtaaactgctttgtgtttctctgaataaatatacgtggtttgtgt

SEQ ID NO: 16006 - protein, 156 aa, Panicum virgatum
  misc_feature: Ceres CLONE 1787042
  misc_feature (14)..(156): Pfam Name: Dehydrin Pfam Description: Dehydrin
MEYGQQGQHGHGTTGRVDQYGNPVGGVGHGTGTGTGGMGQLGEHGGAGMSGGQFQPAREEHKTGGVLHRSGSSSSSSSEDDGMGGRRKKGIKEKIKEKLPGGHKDDQHTTATGGAYGQQGHTGMTGTGTGGAAYTEGTGEKKGIMDKIKEKLPGQH

SEQ ID NO: 16007 - DNA, 524 bp, Panicum virgatum
  misc_feature: Ceres CLONE 1787057
  misc_feature: Encodes the peptide sequence at SEQ ID NO. 16008
gtctgtcggccggcgtcactcccccctccttccctgctccgccgccgggtggctcctctccctctccttccgccgcggatccatggcgatgtggagggccgccgcgaggcagctggtcgaccgggcgctcggcgcaagggccgcgcacacgtctgcaggcagcaagaagatcgtgggggtgttctacaaggctggcgagtacttcgacaagaaccccaacttcgtaggatgcgtcgagggggcactcggcatccgcagctggctcgaatcacagggccatcactacattgtcactgatgacaaggagggccccaacagcggtcagtagctccccaaagatcagtgtttgttactgttattttttccccttctcaagtctgtggtacttctgaactcgtagaattctgatatagtctcatagaagcatccatagtccacgtatggtgcctcctttacatgaaaagctctggtgtttaggttgctacatgatgcatatatgaatatatgatataatatatcttgcc

SEQ ID NO: 16008 - protein, 81 aa, Panicum virgatum
  misc_feature: Ceres CLONE 1787057
  misc_feature: SWISSPROT Homolog: EC 1.2.1.2 Formate dehydrogenase
MAMWRAAARQLVDRALGARAAHTSAGSKKIVGVFYKAGEYFDKNPNFVGCVEGALGIRSWLESQGHHYIVTDDKEGPNSGQ

SEQ ID NO: 16009 - DNA, 814 bp, Panicum virgatum
  misc_feature: Ceres CLONE 1787100
  misc_feature: Encodes the peptide sequence at SEQ ID NO. 16010
aaaaaaaaaactccccgaagccggcggcggcggacgaagcagcggcagccggcaggccatggcgtcgtcgtcgaccccggcggccgtccgcgagatgcagaaggatctcgaggtccaggctaacgccctcagcaagatccagaaagatatcgcgaagaaccaccagttccgcaagcagtacaccatccaggtcggcgagaacgagctcgtcctcaaggagttggagctactgaatgatggggcgaacgtgtacaagctcatcggaccggtgctcgtcaagcaggaccttgcggaggccaaggccaacgtcaagaagcgcatcgagtacatctcggcagagctgaagcggatggaccgggcactgaaggatttggaagacaagcagaacagcaagaaggaatcaatattcaagttgcaacagaggatgcaggctgtacaagctaaggcttagacacctgcttgctgaatgcaactagtccaagccttcctgcaatcacccatcccaataccatccagtttttttgtgtggacttaggtgtccagtgttctggtctctgaaacgaaagattggttgtgcctgtattcatgatgttgatgtgagattgaaacgttcttgacgtctatgtagcaaagaatgttatctggatgctctgatgtaaaagccggtcactagattgaaggtgtatggtaagcctgtagtggtttccttggtagagcttattggtgggccattgcattttgtgccatttttccttctctggactgaatgcttctgaaagaggaatgttagtcacggtatttcagctctttctgc

SEQ ID NO: 16010 - protein, 130 aa, Panicum virgatum
  misc_feature: Ceres CLONE 1787100
  misc_feature (18)..(123): Pfam Name: Prefoldin_2 Pfam Description: Prefoldin subunit
MASSSTPAAVREMQKDLEVQANALSKIQKDIAKNHQFRKQYTIQVGENELVLKELELLNDGANVYKLIGPVLVKQDLAEAKANVKKRIEYISAELKRMDRALKDLEDKQNSKKESIFKLQQRMQAVQAKA

SEQ ID NO: 16011 - DNA, 789 bp, Panicum virgatum
  misc_feature: Ceres CLONE 1787103
  misc_feature: Encodes the peptide sequence at SEQ ID NO. 16012
aaaaaaaagacactcaacgaccatcacaattattcaatcctcgcatttgcggcgcccacaaacccgcgaagaaaggaaggaagagaagctgctcccgatggagaacgccgacgcccctcccgccgccgtgaagccgtcgctgtccaagaagccctcgccgtcgttccgcctccggaacggcagcctcaacgcgctgcggctgcgccgcgtgttcgacctcttcgaccgcaacggggacggcgagatcaccctcgacgagatggcctcggcgctcgacgcgctcggcctcggcgccgaccgcgccggcctggaggccgccgtcggggcgtacatcccggccggcgccgcggggctccgcttcggcgacttcgagtccctccaccgcgcgctcggggacgcgctgttcggccccatcccggaggcggtgcccgaggaggacgaggagggggacatgaaggaggcgttccgcgtgttcgacgaggacggcgacggctacatctcggccgccgaactccaggccgtgctcaagaagctcggcctgcccgaggcgcggaacctcgccacggtgcaggagatgatatgcaacgtcgacagcgaccgcgacggccgcgtcgacttcggcgagttcaagaacatgatgcaggggatcaccgtgtggggcgcctagctgcagcgcccctgcgttgccagccctctactgcgtgttgacatgtatgtatctagctaggcagcgccttttcttctacccagcgcttcttcttcttcttgatcgcgcagtggattcttctt

SEQ ID NO: 16012 - protein, 189 aa, Panicum virgatum
  misc_feature: Ceres CLONE 1787103
  misc_feature (118)..(146): Pfam Name: efhand Pfam Description: EF hand
  misc_feature (34)..(62): Pfam Name: efhand Pfam Description: EF hand
  misc_feature (156)..(184): Pfam Name: efhand Pfam Description: EF hand
  misc_feature: SWISSPROT Homolog: EC 2.7.11.1 Non-specific serine/threonine protein kinase
MENADAPPAAVKPSLSKKPSPSFRLRNGSLNALRLRRVFDLFDRNGDGEITLDEMASALDALGLGADRAGLEAAVGAYIPAGAAGLRFGDFESLHRALGDALFGPIPEAVPEEDEEGDMKEAFRVFDEDGDGYISAAELQAVLKKLGLPEARNLATVQEMICNVDSDRDGRVDFGEFKNMMQGITVWGA

SEQ ID NO: 16013 - DNA, 646 bp, Panicum virgatum
  misc_feature: Ceres CLONE 1787134
  misc_feature: Encodes the peptide sequence at SEQ ID NO. 16014
gaccaggcgatctccagcgagcgagagaggaagcagcacccgcgcgtgaggggggctccgctcgtcgaggccgcgcccaccatggggttctgggtgtccacggtcatcttcctcctcgccggcgtcgtcgcctaccttttcacgctcctctgctgcaaccgcgggccatccaccaacctattccatttgaccttggtgactacggctgtaatttgttgttggatgatgtatgccatcgtttaccttgctcagatgaagcctttgatcaaccccatcctgagtggggagtgagctttctgttgaaaataattaaatccaacatgctgtaccattattcagtctgtgaaccttttattcattttggccacccagaaataaagaaactgccatgagttttttgctactctacctccaggttattgaggaggcacgctgtgattagtgtacccaattgtatgataacgcaataataatatttatggtgtttttatctgaatgtctgggcactgatctgtccaactttgtcgagtgtttctctgttagatttgaaacacaaaacatcaggcattatttgtggtttccgtgtacttagaatcatcacgaatcttgttaagagcaagaaataataatcttcatcttttgacgc

SEQ ID NO: 16014 - protein, 69 aa, Panicum virgatum
  misc_feature: Ceres CLONE 1787134
  misc_feature (1)..(69): Pfam Name: ATP_synt_H Pfam Description: ATP synthase subunit H
  misc_feature: SWISSPROT Homolog: EC 3.6.3.14 H(+)-transporting two-sector ATPase
MGFWVSTVIFLLAGVVAYLFTLLCCNRGPSTNLFHLTLVTTAVICCWMMYAIVYLAQMKPLINPILSGE

SEQ ID NO: 16015 - DNA, 607 bp, Panicum virgatum
  misc_feature: Ceres CLONE 1787137
  misc_feature: Encodes the peptide sequence at SEQ ID NO. 16016
atctctccctttcctccccgaggctccaaaacctagctcttcccttttcctcgggcggcggcggcggcggcggcagccatggacaagagcatgctcggcgacctggacggcctccccgaggaggacaagatgcgcatggcctccatgatcgagcagctccagatccgtgacagtctgagaatgtacaattccctggtggagagatgcttcacggactgcgtggacacgttccgccgcaagaccctggacaagcaagaggagtcatgcgtccgccgctgcgctgagaagttcctgaagcactccatgagggttggcatgagatttgctgagcttaaccagggtgtggccacacctgactaaactttgttgcccttgccaagttccccccgtggggatttttgtcagcatctatttgtaatcctaaaaatgattttagcaccccttgagaaatgcaactcggtaaggttgcccttgaaccaactgctgggtatgacattgaataaaattacctagaatcattttatccaatggtacattttccatttcgtggttaacgctgtatccattgatatctgatagctgctgagaagagtttggattctcgttt

SEQ ID NO: 16016 - protein, 93 aa, Panicum virgatum; identical to SEQ ID NO: 15996
  misc_feature: Ceres CLONE 1787137
  misc_feature (20)..(85): Pfam Name: zf-Tim10_DDP Pfam Description: Tim10/DDP family zinc finger

SEQ ID NO: 16017 - DNA, 673 bp, Panicum virgatum
  misc_feature: Ceres CLONE 1787317
  misc_feature: Encodes the peptide sequence at SEQ ID NO. 16018
atctcactccagagtccagacttccagagccagccagccgcttaatttgatttgaacaaccggcagcttaatttgattaagcgatcgatctatctcagttggagctctgcgagcgaacgcgcgtctacgttcaacggacagctgctcggagagatcatggacggcaagctgggcgtgcaccacgggcaccaccacagcggcatctccaagccgccggcgcaccaccaccacggcggcaagaggggcgccaggaggcacgccggcagcggcggaggggggagtaataaggggatcaaggtggtgtacatctccagccccatgaagctcaccgccagcgccgaggagttccgcgccgtcgtgcaggagctcaccggccgcgactccaacgtcgccgaccacgacctcgccggcgcctactatgcgccgtcgtcgtcctcgtcctcgtcctcatcctcgtacgcatcgttcgggcgcgtctccccgacgggggccggcgcggcaggcggcgccgcacgcgctctgtcgccgacgatggccacgggggcgagcgtcggcgcgggacgggcggccgagtacggcgccgcgatggccgcgccgccgccgttccagggcatgtacgactacactgccgggagcttgctttacggccaggactactggtaggaacgaacgg

SEQ ID NO: 16018 - protein, 168 aa, Panicum virgatum
  misc_feature: Ceres CLONE 1787317
  misc_feature (50)..(80): Pfam Name: VQ Pfam Description: VQ motif
MDGKLGVHHGHHHSGISKPPAHHHHGGKRGARRHAGSGGGGSNKGIKVVYISSPMKLTASAEEFRAVVQELTGRDSNVADHDLAGAYYAPSSSSSSSSSSYASFGRVSPTGAGAAGGAARALSPTMATGASVGAGRAAEYGAAMAAPPPFQGMYDYTAGSLLYGQDYW

SEQ ID NO: 16019 - DNA, 951 bp, Panicum virgatum
  misc_feature: Ceres CLONE 1787322
  misc_feature: Encodes the peptide sequence at SEQ ID NO. 16020
gactgctcgcccagcgctattcctccagtgttcggattccccgatgtcgcgtgcggccactagatttttcctgacgcggtcgctgctcccacttgccctcccgaagtcgcagcggcggcaggggcggccggggtctagcatttgcgcggcgagggctttctccatggcggcctcggggttcggcggcggcgaggcgttccggctctcggccgcgccgggggccggcgcgctgaagctgcacaagggcgacatcaccctctggtccgtcaacggcgccacggacgccatcgttaatgctgctaatgagcgaatgctaggaggtggaggtgttgatggagcaatacatcgagctgctggaccagaattagtgcaagcatgccgcaaagttccagaggtcagaccagaagttcgttgcccaactggagaagctaggattactccagctttcaagcttcctgtgtcccgagtgattcacactgttggacccatatatgacatggacaagcatccagaggtgtcgttgaagaatgcctatgaaaatagcttgaagcttgctaaagagaatggcattcagtacatcgcattccctgctatatcttgtggtgtttaccgttatccgcccaaagaagcatcgaaaatagctgtttctactgcacaacaattttcggaggatatcaaagaggtgcattttgttctgttttcggatgatttgtacgagatttggcacgagactgcccaggagatgctgtcacaatttcagaaatgagtggtcctatagtttctgatgcggctgtgtacttggctgctgtccttgttgacatgcgagagccagaggccgtttaccgatgtaacaactaacaatatgagtgtattaaatgacatttaaatctttaaccatgtcgtgcacttgtgtaaactgtaatgtcgaatgaataaggattgcgggtttgt

SEQ ID NO: 16020 - protein, 240 aa, Panicum virgatum
  misc_feature: Ceres CLONE 1787322
  misc_feature: SWISSPROT Homolog: EC 2.4.2.30 NAD(+) ADP-ribosyltransferase
MSRAATRFFLTRSLLPLALPKSQRRQGRPGSSICAARAFSMAASGFGGGEAFRLSAAPGAGALKLHKGDITLWSVNGATDAIVNAANERMLGGGGVDGAIHRAAGPELVQACRKVPEVRPEVRCPTGEARITPAFKLPVSRVIHTVGPIYDMDKHPEVSLKNAYENSLKLAKENGIQYIAFPAISCGVYRYPPKEASKIAVSTAQQFSEDIKEVHFVLFSDDLYEIWHETAQEMLSQFQK

SEQ ID NO: 16021 - DNA, 602 bp, Panicum virgatum
  misc_feature: Ceres CLONE 1787332
  misc_feature: Encodes the peptide sequence at SEQ ID NO. 16022
ggaagtccccctctctcctctctcctctctctctctctcggccgccttctttcttctcctttccaagcggcgacgacaggggagtggcgccgcccttgccagtttcgtcgggcgcttcgccggccaagtctccttttctaaactcgtagtcgctgatggggaaagcaaagcgtgcctcaatcttcatcaggctggtttctgcggccggtactgggttcttctatgtgaagcgcaagaatcctcggcggatcactgagaagcttgaatttaggaagtatgatccccgtgtgaacaagcatgttctgttcacagaagcaaagatgaagtgagatcttctaccttcacacaatgcagaacaggaataggttgtcagcattttgcaatcagaaatctctagtaccattaaggatgtcatgttctggtttccagtgttccatttggataactgtaatgggcatatgattaaggatttgatgtgctcttccagtcgattttttgcaacaataaacattttgttgctcgagtgagctgcagacctgcaaacgactagttttttttaaataattttcttttgaggtatgagctataatcagctcctgacg

SEQ ID NO: 16022 - protein, 57 aa, Panicum virgatum; identical to SEQ ID NO: 9772
  misc_feature: Ceres CLONE 1787332
  misc_feature (8)..(55): Pfam Name: Ribosomal_L33 Pfam Description: Ribosomal protein L33

SEQ ID NO: 16023 - DNA, 665 bp, Panicum virgatum
  misc_feature: Ceres CLONE 1787340-R
  misc_feature: Encodes the peptide sequence at SEQ ID NO. 16024
gatgcccaagaaagctctctgcttgcttgtgttccagcctctgaatcttgtgaggatggtcgtgctgcggaggcaactgcgggtgcggctccggctgcaggtgcggctccggctgcggagggtgcaagatgtacccggacatgactgagcagggcaccaccaccaccagccagactgtcatcatgggcgttgcaccaaccaacaaggggcacgccgagggcggatttgaggccggcgccggagccgagaacggctgcaagtgcggtgccaactgcacctgcaacccctgcacctgcaagtgaggagctcatggccatggccggaccggaggagatctgaagctagtatagcggcgttgtgtgtgcgtcgttcgtttgtctgaaagtgtgtgtggcatgcttaataacggtgttgcgcgtgctgctagtagatggtactgatggggaacaataataatgatggtgctgagatgtcgtcggcgtcgccgccgccgtcgtgtccttcctccccggccggtcgggcacctgtggcggtgctctagcagtgtgttgtgtgtgcagcagaccatgctctgatctttgtggtgtatgtgtgtggcctgctgcttggtgtccctagtgtcatgtgtaaccatccatctatatctatctacatccatcttgtgc

SEQ ID NO: 16024 - protein, 57 aa, Panicum virgatum
  misc_feature: Ceres CLONE 1787340-R
  misc_feature (1)..(56): Pfam Name: Metallothio_2 Pfam Description: Metallothionein
MYPDMTEQGTTTTSQTVIMGVAPTNKGHAEGGFEAGAGAENGCKCGANCTCNPCTCK

SEQ ID NO: 16025 - DNA, 511 bp, Panicum virgatum
  misc_feature: Ceres CLONE 1787340
atcccctctcctctcgctctctgttgtgtgactgattgccaataaagctctccgcttgcttgtgttcctatcctctgaatgtcgtgaggatgtcctgctgtggacgcaactgagggtgccgctccggttgccggtgcagctccggctgctgagggtgcaagatgtacccggacatgactgaacacggcaccacccccaccagccattactgtcatctatgggcgttaccccaaccaacaaggggcacgccgagggcggatttgaggccggcgccggagccgacaacggctgcaactgcggagccaactgcacctgcaacccctgcacctgcaagtgaggagctcacggacacgcccggaccggatgatatctgaagctagcatagctgcgttctctctgcatacttcgtctgtctgaaagtgtgtgtggcatgcttaataacagtgttgcgcgtgctgctaatatatgggactgatggagaacaataataatgatggtgctgagatgtcgt

SEQ ID NO: 16026 - DNA, 768 bp, Panicum virgatum
  misc_feature: Ceres CLONE 1787355
  misc_feature: Encodes the peptide sequence at SEQ ID NO. 16027
agacgacagatggatcgatctctctccgtggcggcggccggcgtcgctgtggcgctcctctgcttctccggcctctgccacggggagcggctcggggcgcgggagtgcgaggacctgggcttcaccggcctcgccctctgctccgactgcaacgccctctccgagttcgtcaaggaccaagaactagtggaggattgccgtaaatgttgcactgaggattcagatgattcaatcagcaagctcacattctctggtgcaattattgaggtgtgcatgagaaagctggtgttttatccagaagttgttggcttcctcgaagaggataaagatgacttcccttatgtggaagcccgttattcgtatggttctccaccaaagctcataatgcttgatgacaagggagaacaaaaggagaccataaggatcgacaactggaagcgggagcacattcggcagtttctcaaggagaaagtgaagcctgtgaaatcagacagctgagttcctgccataaatgcctgaacatttccatgttgacgtttcagtaaccctatggaatttggtactttgcaagcaaaagcggctgatatgagatgtgcatcaaattctgtgtgacatctgtacaccaatgtttgtacaagaagcttctgtagtgttatttctggcatacttgtatccagttccaattatagtcaggtagctgggcaactggcaccgtgattcatgaaaattagttgtagtactagttgtttcccggagctttataactcg

SEQ ID NO: 16027 - protein, 162 aa, Panicum virgatum
  misc_feature: Ceres CLONE 1787355
  misc_feature (81)..(157): Pfam Name: Sep15_SelM Pfam Description: Sep15/SelM redox domain
MDRSLSVAAAGVAVALLCFSGLCHGERLGARECEDLGFTGLALCSDCNALSEFVKDQELVEDCRKCCTEDSDDSISKLTFSGAIIEVCMRKLVFYPEVVGFLEEDKDDFPYVEARYSYGSPPKLIMLDDKGEQKETIRIDNWKREHIRQFLKEKVKPVKSDS

SEQ ID NO: 16028 - DNA, 907 bp, Panicum virgatum
  misc_feature: Ceres CLONE 1787362
  misc_feature: Encodes the peptide sequence at SEQ ID NO. 16029
agcataggaacgctcgtctcacctgtcagccgaaagccaatggggtcagcatcctgcgccgccgccgtgcgcgcgctgggcgtagccgtggcggccgcgctcctggcgtgccggtgcgcggcgcagccgtcgggctccggctgcatgccggagctggtcggcctgtcgccgtgcatggactacctgtcgggcaacgccacgacgcccgacgtgccgtcgtgctgctcggcgctctcgggcatgctgaggtcgagcccgggctgcctctgcacggtgctcggcggcacggccacgtcgctcggcgtcgccgtcgacggcgcccgcgtggcgcagctgcccggggcgtgcaaggtccaggcgcctcctgccacccagtgcaacgccgtgggagctccagtggcgtctccggcggcgccgtcagacgccaacgcgacccctgcaggtacagcagcagccatacacaggtcacgctgaaatcgctgcatcattttgtatctctgaatttgtgaagctgcaggagggtctggatcgaagtctacaccagcatccacccttccatactctgacggaaatactgggaggcctggaaggatcttcgtattcgccgcagcagcactggcgttgctccatcgtttgtgagatgaatcagatgacgcgaaagcttcttgtgttcgtctccgagcgaccgaatcgtttcacacgagcagcttgtacagtttggggtgcttgttgctccaggattcagaggagcagagcattttttacattgttcactcgagcattttttttttgtagctatcgattaggccgcctgttttggggtctcttacgggtccatctcatggtggatgatccgttggattctttgttctccaaaatcccaacaagccgtagtaagcttgcccct

SEQ ID NO: 16029 - protein, 144 aa, Panicum virgatum
  misc_feature: Ceres CLONE 1787362
  misc_feature (35)..(113): Pfam Name: Tryp_alpha_amyl Pfam Description: Protease inhibitor/seed storage/LTP family
MGSASCAAAVRALGVAVAAALLACRCAAQPSGSGCMPELVGLSPCMDYLSGNATTPDVPSCCSALSGMLRSSPGCLCTVLGGTATSLGVAVDGARVAQLPGACKVQAPPATQCNAVGAPVASPAAPSDANATPAGTAAAIHRSR

SEQ ID NO: 16030 - DNA, 661 bp, Panicum virgatum
  misc_feature: Ceres CLONE 1787370
  misc_feature: Encodes the peptide sequence at SEQ ID NO. 16031
ctcggtagcagccggttcacttctccaggtaaggtaaagggttgggactcatggcgccgacgcagcccaagtccggcctcttcgtgggcatcaacaagggccatgtcgtcaccaagcgcgagctgccgccgcgcccgtcccaccggaaggggaaagcaacgaagcgggtgaccatgggcaggggcctgatcagggaggttgctgggtttgctccttatgagaagcgaatcactgagcttctgaaggttggcaaggacaagcgtgctctgaaggttgctaaaagaaagctcggaactcacaagagggcaaagaagaagagagaggagatggccaatgtcctcaggaagatgagatctgctggtacccacactgataagaagaaatagagcatctcaagtccgtgaagctgggggcaacattctcctgtgtcggttttccctacctgtagaacctaatagacttgtcaaagtacctgccagcaaaacatcgtgttgttagttatgtgttgaaccaccccatgagtttttgatccaactttgaatgcatctatggtttgtctatcctttgctgtggtttacaataccttatatcttgttcacttcggtgattttgggttacttacccgttgccaggcattaacggtactgcattgttgttgtcc

SEQ ID NO: 16031 - protein, 111 aa, Panicum virgatum
  misc_feature: Ceres CLONE 1787370
  misc_feature (5)..(103): Pfam Name: Ribosomal_L36e Pfam Description: Ribosomal protein L36e
MAPTQPKSGLFVGINKGHVVTKRELPPRPSHRKGKATKRVTMGRGLIREVAGFAPYEKRITELLKVGKDKRALKVAKRKLGTHKRAKKKREEMANVLRKMRSAGTHTDKKK

SEQ ID NO: 16032 - DNA, 710 bp, Panicum virgatum
  misc_feature: Ceres CLONE 1787371
  misc_feature: Encodes the peptide sequence at SEQ ID NO. 16033
actctccctcactctactctttccatccagcgcgagaggcaggtcggcagcagagcgagagcgcgtgccagcccatggcgagcaccaacatggcgtcggccacctcgcggttcatgctggccgcgggcgtgcccgcggcgggcagcggccgcgtcggcttcgcgtcggtgcccggcaggccgcagggcaggaggctcgtggtgcgcgccgaggaggaggccgccgcggcggccgagccggcgccggaaggggagggcgccgtagccaccaagcctaaggccgagaagccgccgccgatcgggcccaagaggggcgccaaggtcaagatcctgaggagggagtcctactggtacaacgggattggcaacgtcgtcacagttgatcaggaccccaacacccgctacccggtggtggtgcggttcaacaaggtgaactacgccggcgtatccaccaacaactacgccttggacgagatccaggaggtgaaatgagcagcgaggctggctggctggctgtgaaatgagggcaactttttatagcgcaatatgaatttgtattgagtaaggttagttttctgtttactaagtccctaaaatataaccttcgttccatgtagtgttcttttctttctttagccatgtttggatttatttcctgtcatagacagaggattctgcatataatttcaatgaaatttctgttagctagtc

SEQ ID NO: 16033 - protein, 138 aa, Panicum virgatum; identical to SEQ ID NO: 14209
  misc_feature: Ceres CLONE 1787371
  misc_feature (77)..(138): Pfam Name: PSI_PsaE Pfam Description: Photosystem I reaction centre subunit IV / PsaE

SEQ ID NO: 16034 - DNA, 519 bp, Panicum virgatum
  misc_feature: Ceres CLONE 1787377
  misc_feature: Encodes the peptide sequence at SEQ ID NO. 16035
atcccttgctacctgcatccatcgaccttagcgagctcacagttcaatcaggtccggttcggcttcaggccgggctcgtcaccgaggagatggcgctctctcgccgcatggccgcgccggtcctcgtcttcctgctcctcctcgtcgccacagagatggggccggcgacggtggcggaggcgaggcactgcctgtcgcagagccaccacttcaagggcctgtgcgtgagcagcagcaactgcgccaacgtctgccggaccgagaacttccccggcggcgagtgcaagacggagggcgccacccgcaagtgcttctgcaagaggatctgctagccgccggcgccgcccggcacgcaatgcgagccgagcactggtcttggttctgttcgtcggttcttcgtcatgcacgctgcgccgtgatgctgcagcgggctgtgttcccgggatactggtttttaggttactgtaacttttctttctcctggtcaatttttttccaccaaaacacatggtgggcccc

SEQ ID NO: 16035 - protein, 80 aa, Panicum virgatum; identical to SEQ ID NO: 11903
  misc_feature: Ceres CLONE 1787377
  misc_feature (32)..(80): Pfam Name: Gamma-thionin Pfam Description: Gamma-thionin family

SEQ ID NO: 16036 - DNA, 670 bp, Panicum virgatum
  misc_feature: Ceres CLONE 1787380
  misc_feature: Encodes the peptide sequence at SEQ ID NO. 16037
gccgccagcacgactccgcctccttcccgcttgctcttggtcgtccccggcgccggcgagctccttcatcggcatctcttccccttccttctgagcgcttcattttcgtcgtcgtcgggctctccgcctccgcagccacagaaccgaagtggcgtcgatgggaggcgaggccacgagtgccggcggcgggggtttccgcgcgcggatggagcactacctgtacagtggagagaagaagcacgtcctcgccggcatcgccatcttcgccgccgtcttcggcgtcccgtggtacttcatgacccgaggagcaaagcatgaatctcaccaagattatatggaaagggctaacaaggcgaggtcggagagactttcttctggacagccatcggcactgaaagaatgaagttgtagtgcctattctggcgcctgatgtctagagctcagcatactcgttttgcttgtaatcggaggattttggtctattgtgaaataagcagatatctttcttatctcgctagatgtaaaaacatagtattggtgtaatacgtaccagaaaatttgtctactggagcctacgtttccgtctgtcatattctcgaaggcatgacccgtacagaagtcttgcaatattttctacctgttgcgtagtatttctgctaaatgtttccct

SEQ ID NO: 16037 - protein, 81 aa, Panicum virgatum; identical to SEQ ID NO: 13008
  misc_feature: Ceres CLONE 1787380
  misc_feature: Useful for making plants with modulated biomass

SEQ ID NO: 16038 - DNA, 789 bp, Panicum virgatum
  misc_feature: Ceres CLONE 1787383
  misc_feature: Encodes the peptide sequence at SEQ ID NO. 16039
ctcctcgatcacccccctattaaatcctcctccccaatctagggtttggccaccctcaatacctccaaactccgcgtcctctaatccttttcctatctctatccttcatcccaatggcctccgcggcggcgaagcggaagccggtgttcgtcaaggtggaccagctcaagcccggcacggccggacacacgctcgtcgccaaggtgctcagctccaagaccgtcctccagaagggccgccccggcgctgccgccgccggccctgcggcgcggcccgccaggatcgccgagtgcctcatcggcgacgagaccggttgcatcctcttcactgcccgtaacgagcaggttgacttgttgaagcctgaaagcactgttattatccgcaatgcaaagattgatatgttcaaaggttcaatgaggcttgctgtggacaaatggggccgcatcgaagtcactgaacctgcaagcttcagtgtgaaggaggacaacaatctctcacttgtggagtatgagcttgtcaacgttactgaagagtgaaggccttgttgatctcattcgataaccagaatttcagttggtaaaaaaattctacttgtcgcaccaagaatgagaacttgaggagatggagaagcttatgaagtagattggagctgttgggtcgaactagtgcaagttcctcgttatcatgcatttatgtctatcaatggatattagttgctgcagcattgtggttgtccgaacaaatgtgatgtgctgagcagttaatacgccaatggttcttgagctcttc

SEQ ID NO: 16039 - protein, 140 aa, Panicum virgatum
  misc_feature: Ceres CLONE 1787383
  misc_feature: Useful for making plants with modulated drought sensitivity
  misc_feature: Useful for making plants with modulated water use efficiency
MASAAAKRKPVFVKVDQLKPGTAGHTLVAKVLSSKTVLQKGRPGAAAAGPAARPARIAECLIGDETGCILFTARNEQVDLLKPESTVIIRNAKIDMFKGSMRLAVDKWGRIEVTEPASFSVKEDNNLSLVEYELVNVTEE

SEQ ID NO: 16040 - DNA, 796 bp, Panicum virgatum
  misc_feature: Ceres CLONE 1787396
  misc_feature: Encodes the peptide sequence at SEQ ID NO. 16041
aaaaacccacggcaaacgcctactgctccccatcctctcttgcccccctcctccgccatggccgtctcctccactacgtcccagctcccgctcctcttgctccaccgcggcaccgcgaaccctagccccgcgtctctctccttcccctcctctctccgcgcgacgtccctccgctcccgcgccgccgccgccgcttcgcccgcagacaccctttccgaagacggcatccccgacgcgccaccggaaggggaggggacgggaattccgttgccatcgtcgattggggatgatggagagcagttggcacccaagcagaagatcagaatcaagctgcggtcctactgggttcctttgatagaggactcatgcaagaagataattgatgctgccaaaacaaccaacgcgaagaccatgggtcctgttcctctgccgaccaagaggagaatatattgtgtgctcaactctcctcatgtgcacaaggattcacggttccatttcgagatccggacacatcagcggctgattgatatcatgtatccaactgcccaaacaattgactcactgatgcagctccagctccccgccggtgtgggtgttgaggttaagctatgattctgttggagctgaagttttcaaagtatgatgtagtatggactcattttccgcagcctttcttcgttgatccttttgttgtctgggactgaaagaaatgtagagcttgtaataggaaagaagatgttaagacatgagttatcttgcgatgaagcatattgaatgaaatgttttacatgaagtc

SEQ ID NO: 16041 - protein, 184 aa, Panicum virgatum
  misc_feature: Ceres CLONE 1787396
  misc_feature (87)..(182): Pfam Name: Ribosomal_S10 Pfam Description: Ribosomal protein S10p/S20e
MAVSSTTSQLPLLLLHRGTANPSPASLSFPSSLRATSLRSRAAAAASPADTLSEDGIPDAPPEGEGTGIPLPSSIGDDGEQLAPKQKIRIKLRSYWVPLIEDSCKKIIDAAKTTNAKTMGPVPLPTKRRIYCVLNSPHVHKDSRFHFEIRTHQRLIDIMYPTAQTIDSLMQLQLPAGVGVEVKL

SEQ ID NO: 16042 - DNA, 752 bp, Panicum virgatum
  misc_feature: Ceres CLONE 1787398
  misc_feature: Encodes the peptide sequence at SEQ ID NO. 16043
tttgtagactacgacggctgaacttgccgaattttctagctatgcgtgtcctcgattagtcagccctcccaagtcccaacgcaacacaattcagcacagcccgatctagtctcttcaatggcgtcatcgtccgtcgcctcccgcttctccgccgcctcggctctccccgccggcgtcggcgcgcgccagcagccgaggcggccgaggcggctggtggcggcagcggcggcggcgaagcgccggtacaaggggacggtgaggagggaggcggcgctggctgagctggcggagctggtggagcggaaggtggcggaggcgatggaggcgtgcgcggggcgcgaggcggaggccgggtgccgcgtgacgtgggacgaggtggaggaggtgagccaggccagggccgacctccgccgccgcatcgccggggcccccggcgacccgctcgagcccttctgcgcgcacaaccccgacgccgacgactgcgccgtcgtctacgtcgacgactgactctgaaccatcatgggcgtggtctttgcttactgcctgcagatcgatcgaggctctagaaagagggcatgtttcagctttcagctttgcattgaattatcagacacgttagttatagcaatggtatgattaggcaccattagcgttgcctcttcaattagagagcaagaatttatttcagtttcatggcggtttcaactgccccctgtattctgaatctgaatgcgacaagcatttcttatcgc

SEQ ID NO: 16043 - protein, 129 aa, Panicum virgatum
  misc_feature: Ceres CLONE 1787398
  misc_feature (56)..(128): Pfam Name: CP12 Pfam Description: CP12 domain
MASSSVASRFSAASALPAGVGARQQPRRPRRLVAAAAAAKRRYKGTVRREAALAELAELVERKVAEAMEACAGREAEAGCRVTWDEVEEVSQARADLRRRIAGAPGDPLEPFCAHNPDADDCAVVYVDD

SEQ ID NO: 16044 - DNA, 623 bp, Panicum virgatum
  misc_feature: Ceres CLONE 1787444
  misc_feature: Encodes the peptide sequence at SEQ ID NO. 16045
ctctcgccaccaactctctcactttctcaggggcgctaaggtttcctgcggcggcggcggcggaggaaggcggctatggggcactccaacgtgtggaactcgcaccccaagaactacgggcccggatcccgcgtctgccgggtctgcgccaaccctcacggactgatcaggaagtacgggctgatgtgctgcaggcagtgcttccgcagcaattccaaggacatcggcttcatcaagtaccgctgaagtcagctgtgggcaataagaatgccaccttccggtatgacatggaccatgtgatagaagcagggcgataatttaaattccagtaatttagatgttttgttcagaactctgcaagtgaattctgttgcctgtgttttttatggataacttggccatgtccataatgttcgactcatgagttgcctgcatatgtccagaatttgagctaccttgtttgatgaccatcttagctgtgtccttttgtccatgaagttggatggttattgctcaacttgcgatatataacttgcaggttatctcattgtgcattggcactgtagattcagcacgaatcatttcttaaatgaggtgtgaaatgcgaatcgctgatgagcttt

SEQ ID NO: 16045 - protein, 56 aa, Panicum virgatum
  misc_feature: Ceres CLONE 1787444
  misc_feature (3)..(56): Pfam Name: Ribosomal_S14 Pfam Description: Ribosomal protein S14p/S29e
  misc_feature: Useful for making plants with modulated nitrogen use efficiency
MGHSNVWNSHPKNYGPGSRVCRVCANPHGLIRKYGLMCCRQCFRSNSKDIGFIKYR

SEQ ID NO: 16046 - DNA, 726 bp, Panicum virgatum
  misc_feature: Ceres CLONE 1787455
  misc_feature: Encodes the peptide sequence at SEQ ID NO. 16047
tcctttgtatcagtgggaaccaagagcaggagtgtaccactatattgtactccctccgttttaaattatagcatcatcacagaggaagagcgagtggaaatcgaagcagcagcagcaatggcggcatccatgatcacgtcgtcagctctggtggcgccggccagggcccagggcctgccgtcccacggccgccgcgcctcctccttcgccgtcgtctgcggcaccggcaagaagatcaagaccgacaagcccttcgggattggaggtggcctcaccgtcgaccacgatgcctccgggaggaaggtcaagggcaagggcgtgtaccagttcgtcgacaagtacggcgccaacgtcgacggatacagcccaatctacaaagaggaggactggtctcccaccggtgacgtctacgtcggtggaaccaccggacttctgatctggtccgtcaccctcgtcgggctccttgccggcggcgccctccttgtttacaacaccagcgccctcgccagctagcaacattattcatgcatagtccatgaaagcgcttgcggccggtccatatataagatttatcatcagcccgggtgtctgtgtgtaatctagcctgcagcttcgatgcccaatataatgcttggttcatgcaacaatgctactacggctctccatacttttggaacaattaattattatattacttcatgctatatatttagattaataactggc

SEQ ID NO: 16047 - protein, 131 aa, Panicum virgatum; identical to SEQ ID NO: 12594
  misc_feature: Ceres CLONE 1787455
  misc_feature (35)..(131): Pfam Name: PsbR Pfam Description: Photosystem II 10 kDa polypeptide PsbR

SEQ ID NO: 16048 - DNA, 698 bp, Panicum virgatum
  misc_feature: Ceres CLONE 1787478
  misc_feature: Encodes the peptide sequence at SEQ ID NO. 16049
cccgcacccgatccccaaattccccccggcggcgatggcggccagcctgtggcgcgccgtgatggacagcgtcagcgggtcctcctccccctcggcgcccgacgcggcgtccggcggcgtcgagttctggcacggggccgagcgcgcggggtggctcaacaagcagggcgagtacatcaagacgtggcgccgccggtggttcgtgctcaagcagggccgcctcttctggttcaaggaccccgccgtgacgcgggcctccgtgccccgcggcgtcatccccgtcgcctcctgcctcaccgtcaagggcgccgaggacgtgctcaaccgccagttcgccttcgagctctccacccccgccgagaccatgtacttcatcgccgactccgagaaggagaaggaggagtggatcaactccatcggccgctccatcgtccagcactcccgctccatcgccgacgccgaggtcgtcgactacgacagccgcccccaggccacgacgcagtccaaggacagccaagagaccgagccggcggcgtagcatcgcggtgatccctgtgaatctctccatatggctctcaattgtagtatatgtacttcctagtgattgtgggctttgttccttcactcttagttatatatgtatattaactactatcaatgacttggctgtgccaataaatgataatttcgtgctttga

SEQ ID NO: 16049 - protein, 167 aa, Panicum virgatum
  misc_feature: Ceres CLONE 1787478
  misc_feature (35)..(133): Pfam Name: PH Pfam Description: PH domain
  misc_feature: SWISSPROT Homolog: EC 2.7.11.1 Non-specific serine/threonine protein kinase
MAASLWRAVMDSVSGSSSPSAPDAASGGVEFWHGAERAGWLNKQGEYIKTWRRRWFVLKQGRLFWFKDPAVTRASVPRGVIPVASCLTVKGAEDVLNRQFAFELSTPAETMYFIADSEKEKEEWINSIGRSIVQHSRSIADAEVVDYDSRPQATTQSKDSQETEPAA

SEQ ID NO: 16050 - DNA, 198 bp, Panicum virgatum
  misc_feature: Ceres CLONE 1787478-R
accccggccgagaccaggcgcgacagagccgacgccgcgacggagaaggaggaggggggcaacgccaacggccgacccagggaccagcacccccgccccagcgccgacgaggaggagcccgacgccggcagccgcccccaggccccgacgcaggccaagaacagccaagagaccgacccggagggggagcacggcggg

SEQ ID NO: 16051 - DNA, 729 bp, Panicum virgatum
  misc_feature: Ceres CLONE 1787479
  misc_feature: Encodes the peptide sequence at SEQ ID NO. 16052
acagccatcaaaattccccatccccaaatcgaccgagcgaatccctcccggcctctcgccaccgcgaacccaagcagccgcatcgatggcccccaaggcggagaagaagccggcggcgaagaagcccgcggaggaggagcccgcgacggagaaggcggagaaggccccggcggggaagaagcccaaggccgagaagcggctgcccgcgggcaagtccgccggcaaggagggcggcgagagcaagaaggggaggaagaaggggaagaagtcggtggagacctacaagatctacatcttcaaggtgctgaagcaggtgcaccccgacatcggcatctcctctaaggccatgtccatcatgaactccttcatcaacgacatattcgagaagctcgccggcgaggccgccaagctcgcgcgctacaacaagaagcccaccatcacctcccgcgagatccagacctcggtccgcctcgtcctccccggcgagctcgccaagcacgccgtctccgagggcaccaaggccgtcaccaagttcacctcatcttaggttggtggtaggagtagtcgagtggtgttggtagatttggctcattttatcctgtagggctggtgcttgtagtttatgaaactagaaatggatggatgctgatctctatgtagttaatttcgtaatgaattattgtaatgcttttggaacacttgggagtgttcatggtgcttgctctacat

SEQ ID NO: 16052 - protein, 153 aa, Panicum virgatum
  misc_feature: Ceres CLONE 1787479
  misc_feature (60)..(130): Pfam Name: Histone Pfam Description: Core histone H2A/H2B/H3/H4
  misc_feature: Useful for biocontainment applications
  misc_feature: Useful for making plants with modulated flowering time
MAPKAEKKPAAKKPAEEEPATEKAEKAPAGKKPKAEKRLPAGKSAGKEGGESKKGRKKGKKSVETYKIYIFKVLKQVHPDIGISSKAMSIMNSFINDIFEKLAGEAAKLARYNKKPTITSREIQTSVRLVLPGELAKHAVSEGTKAVTKFTSS

SEQ ID NO: 16053 - DNA, 961 bp, Panicum virgatum
  misc_feature: Ceres CLONE 1787490
  misc_feature: Encodes the peptide sequence at SEQ ID NO. 16054
gcccccgttcccaagaacactccggcggctccccaccgacagcgctcgatcgagctaagcttggttgcccggccgcgtgcaaaagatctatccatggcgcggctcccgcgactgcccgccgcggcggccttcgccgtggccgtcctcctctcggccgccgcgctgccggcggcgcgggccgcgtctccggcggcggacgacgcgcccgagtaccggaaccacaccgtgggcggcgccgacggctggttcttcgacgccaggaccaacgccacctccggaaactactccggttgggccaacggcgagacgttctacctcggtgactacctcatattcaagacgaacgacaactcgtcggtggtgcacaccaccaacgccaccacctacgacctctgcgacccctccgacgacctgtctccggctacctacatctacggcggcggtggcggcggcctcgagcagatcaacaccatcccggttcctctcgtcgaggagggcgccaactacttcttctccgaagccgacggcggcacgcagtgccagcaggggatgcgcttcgagatcaaggtcgagcacggccagggcctgccgccgtcgctgaagaacccgcccccggcgcccaaggagcgcgtcctcgcgccgcccccggccgggacggccttctcgggcacaggcggggtcgagcctggggacggcgccggggataacggcggcgcgggcaggagcggcgcgtgcagagcggcggcggccggcggtcggttcttgggggcggctgtcgctgtggcgctggcggctctggtcgctgcctgagtggacttggtggggtcgcgatgtcagagataggagttctgccattggttgtttggatttctgtatttaattttatttatttgaccttactattttggtgggcgatatattgtcattgttttactagttttatttatttttctccttttgc

SEQ ID NO: 16054 - protein, 238 aa, Panicum virgatum
  misc_feature: Ceres CLONE 1787490
  misc_feature (51)..(153): Pfam Name: Cu_bind_like Pfam Description: Plastocyanin-like domain
MARLPRLPAAAAFAVAVLLSAAALPAARAASPAADDAPEYRNHTVGGADGWFFDARTNATSGNYSGWANGETFYLGDYLIFKTNDNSSVVHTTNATTYDLCDPSDDLSPATYIYGGGGGGLEQINTIPVPLVEEGANYFFSEADGGTQCQQGMRFEIKVEHGQGLPPSLKNPPPAPKERVLAPPPAGTAFSGTGGVEPGDGAGDNGGAGRSGACRAAAAGGRFLGAAVAVALAALVAA

SEQ ID NO: 16055 - DNA, 733 bp, Panicum virgatum
  misc_feature: Ceres CLONE 1787527
  misc_feature: Encodes the peptide sequence at SEQ ID NO. 16056
agccgctcgctccctcttctcgtccgcacaacaccgagcaagcgagaggagacggagagccgggtggcgatggcgggcaccggctgccactcgctcctctcgccgctctcccccaacatcttctcgcaccgtcgagcctccgccgtcggcagcggagcctgccggcccagtaaagtgcgacctcagatcaggtgttgctcgaaagttgatgatgcaaaggatgaagaaactagaccttcaagacgaaaatgtcttgtctgcctaggtgctgtaaccataatcagtacaacaggcccaacgatttgtacaccaaacggaatcgccgcagatatgacgaacaagtctgggatacagaaagctgtttgcagaaattgcaacggcagtggtgctgtgatatgtgatatgtgcggtggcacaggaaaatggaaggccctcaacagaaagagggcaaaagatgtttatgaattcacagagtgccccaattgctacggccgagggaagctggtctgccctgtctgtcttggaactgggctgcctaataataagggactcctccggcgaccagaagccaagcagttgctcgataagatgtacaacggcaagatattgccaaggtcgtagttcgtagaccgcacaagcagtcagccacatgattttgcatcagttatcgagtaggaataacattcgcgacaaatgattttgcatgattttgtactaagttcaaagattatat

SEQ ID NO: 16056 - protein, 183 aa, Panicum virgatum
  misc_feature: Ceres CLONE 1787527
  misc_feature (88)..(161): Pfam Name: DnaJ_CXXCXGXG Pfam Description: DnaJ central domain (4 repeats)
MAGTGCHSLLSPLSPNIFSHRRASAVGSGACRPSKVRPQIRCCSKVDDAKDEETRPSRRKCLVCLGAVTIISTTGPTICTPNGIAADMTNKSGIQKAVCRNCNGSGAVICDMCGGTGKWKALNRKRAKDVYEFTECPNCYGRGKLVCPVCLGTGLPNNKGLLRRPEAKQLLDKMYNGKILPRS

SEQ ID NO: 16057 - DNA, 592 bp, Panicum virgatum
  misc_feature: Ceres CLONE 1787531
  misc_feature: Encodes the peptide sequence at SEQ ID NO. 16058
gtgctctctcagaggtgggttggcttctcctccccctccggttcgcggttcggttcggtccgggttcgtgaggttcttgggggtgagaggaagagatggcggcgtcggatgttgagtaccgctgcttcgtcggcggccttgcctgggccaccgacgacaactcgctccacaacgccttcagccccttcggcgaggtcctcgagtccaagatcatcctcgatcgtgagacccagaggtcccgcggcttcggcttcgtcaccttctcgagcgagcaggcgatgcgcgatgccatcgaggggatgaacggcaaggagctggacggccgcagcatcaccgtcaacgaggcccagtcccgcggcggcccgcgctccggcggcggcggcggcgggtacgggcgccgcgagggcggcggcggctacggcggcggtggctacggcggcggcggcggtggctacgggcgccgcgagggcggcggcggctacggcagcggcggcggctacggcagcggcggcggcggcggctacggtggtcgtggaggctacggtggcggcggcggcggcggctacggccactccgatgggaactggaggag

SEQ ID NO: 16058 - protein, 165 aa, Panicum virgatum
  misc_feature: Ceres CLONE 1787531
  misc_feature (10)..(81): Pfam Name: RRM_1 Pfam Description: RNA recognition motif. (a.k.a. RRM, RBD, or RNP domain)
  misc_feature (48)..(161): Pfam Name: GRP Pfam Description: Glycine rich protein family
  misc_feature: SWISSPROT Homolog: EC 5.2.1.8 Peptidylprolyl isomerase
  misc_feature: Useful for making plants with altered alkaloid content
  misc_feature: Useful for making plants with modulated flowering time
  misc_feature: Useful for making plants with altered lignin content
  misc_feature: Useful for making plants with modulated nitrogen use efficiency
  misc_feature: Useful for making plants with modulated biomass
  misc_feature: The sequence is a functional homolog of SEQ ID NO 1039 in the 10/374,780 US patent application
  misc_feature: The sequence is a functional homolog of SEQ ID NO 849 in the 10/666,642 US patent application
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: Useful for making plants with altered terpenoid content
  misc_feature: Useful for making plants with modulated phosphate use efficiency
MAASDVEYRCFVGGLAWATDDNSLHNAFSPFGEVLESKIILDRETQRSRGFGFVTFSSEQAMRDAIEGMNGKELDGRSITVNEAQSRGGPRSGGGGGGYGRREGGGGYGGGGYGGGGGGYGRREGGGGYGSGGGYGSGGGGGYGGRGGYGGGGGGGYGHSDGNWR

SEQ ID NO: 16059 - DNA, 472 bp, Panicum virgatum
  misc_feature: Ceres CLONE 1787537
  misc_feature: Encodes the peptide sequence at SEQ ID NO. 16060
attgtgctcaatcatcaagcaatcaacaaaacctcccaattatcctttcattacatcatcttcattcttctaaattgtcttgcatctgctgatcaagctgctactgctgctcctactgctactgctgcaagatgtaccctgaccttgatgacaataacaacaacagcactcacgccaccatcgtcctcagcgtgccccccgagaacaaggacaacaaggtcgaggcggccgaggagtccggcgagaccgcccacacctgcaactgctgtaacagctgcaactgctacccctgcaactgctgatttcgatgattaacatcagaacacacctacatgcatgctatctactacctactactctgcttgtgtgtgacttgatgaatgaacaaaaataacgataatcctgatcaatcatatctcatgtatctctttggctcctgcctcatcaaccatgcatgcctcgtctgcccctc

SEQ ID NO: 16060 - protein, 56 aa, Panicum virgatum
  misc_feature: Ceres CLONE 1787537
  misc_feature (1)..(56): Pfam Name: Metallothio_2 Pfam Description: Metallothionein
MYPDLDDNNNNSTHATIVLSVPPENKDNKVEAAEESGETAHTCNCCNSCNCYPCNC

SEQ ID NO: 16061 - DNA, 827 bp, Panicum virgatum
  misc_feature: Ceres CLONE 1787542
  misc_feature: Encodes the peptide sequence at SEQ ID NO. 16062
accctccaccgccgcactgactagctaaacccaagccgcagcagccgagcttccctccctcctcgcttcttcctcaccctagcttgtgcagcgcgccgccgcggcgtggtagtaggacagaaggaatggacctgctgagcccggagcagatctccgagttccgggaggcgttcgccttcttcgacaaggacggcgacgggtgcatcacggcggaggagctggcgacggtgatgggctcgctgcaggggcagcgccccggcgcggaggagctccgcgagatgatccgcgacgccgacgccgacggcgacggcgccatcgacttcgccgagttcctgggcctcatggcgcgcaagacggcggcgggggcgggcggggacggcgacggcgccgccgaccccgacgaggagctccgcgaggccttcaaggtcttcgacaaggaccagaacggctacatctccgccaccgagctgcggcacgtgatgatcaacctcggcgagaagctgacggacgaggaggtggagcagatgatccgggaggcggacctcgacggcgacggccaggtcgactacgacgagttcgtcaggatgatgatgctctccgacggccaccaccaccaatgaaccgccggccggccggccggccatgtagctagcagcagggctaccgattctttatttgcatcgaccgacgattccattttctcttcgatagatggaggatcatctcgatctctccgcagctctggggcttcttcctcctccacgtttattcgttatctgtactgaactactgatctgattaatcaacaatttattggtatcgtgatc

SEQ ID NO: 16062 - protein, 164 aa, Panicum virgatum
  misc_feature: Ceres CLONE 1787542
  misc_feature (94)..(122): Pfam Name: efhand Pfam Description: EF hand
  misc_feature (11)..(39): Pfam Name: efhand Pfam Description: EF hand
  misc_feature (130)..(158): Pfam Name: efhand Pfam Description: EF hand
  misc_feature (48)..(76): Pfam Name: efhand Pfam Description: EF hand
  misc_feature: SWISSPROT Homolog: EC 2.7.11.1 Non-specific serine/threonine protein kinase
MDLLSPEQISEFREAFAFFDKDGDGCITAEELATVMGSLQGQRPGAEELREMIRDADADGDGAIDFAEFLGLMARKTAAGAGGDGDGAADPDEELREAFKVFDKDQNGYISATELRHVMINLGEKLTDEEVEQMIREADLDGDGQVDYDEFVRMMMLSDGHHHQ

SEQ ID NO: 16063 - DNA, 936 bp, Panicum virgatum
  misc_feature: Ceres CLONE 1787545
  misc_feature: Encodes the peptide sequence at SEQ ID NO. 16064
gtgctctctcagaggtgggttggcttctcctccccctcttaccaagtcctcggctctagggttttagtgggaagggagatggcggccgcggatgtggagtaccgctgcttcgtcggcggcctcgcctgggccaccgacaacgcgtccctccagcaggccttcgcctcctacggtgacgtcctcgactccaaggtccgtttgcttcgagttccgtctcgcctgagggcgttctgtgattgggttcctgcagatgccggtctagctagatctgatctgcgccgtggttcgccagatctgccatgttttggcccggatctgatctcacccgaatcgaacgcccgcgctgatcctgtggttttttcttccatctgtttgcaggtcatcaccgaccgtgagacggggaggtcccgcgggttcggcttcgtcaccttctcctccgagcagtcgatgctggacgccatcgaagccatgaacggcaaggatctcgacggccgcaacatcaccgtcaaccaggctcagtcccgcggcggcggcggcggcggctacggcggcggtcgtcagggtggctacggcggcggcggcggcggctacggaggcggtggtggctacggcggtggtcgccgtgagggcggctacggcggaggcggtggcggcggtcgccgcgagggcggctacggtggtggtggctacggcagccgcggtgactccggtggtaactggaggaactgatggggtggccctcccgtgctggcagccaagttatcctatatatctattagtgttcgtgtcactgtttgatccgagttacccctgagttttgtccgtgtgttaccgttcgattaggtgttggttcccatgtttaccgttcccgagttgtttccgcaatgaaatgagaagaaaagagtgtccgcaatgaaatgagatttgatctgcgcg

SEQ ID NO: 16064 - protein, 216 aa, Panicum virgatum
  misc_feature: Ceres CLONE 1787545
  misc_feature (94)..(143): Pfam Name: RRM_1 Pfam Description: RNA recognition motif. (a.k.a. RRM, RBD, or RNP domain)
  misc_feature: Useful for making plants with altered alkaloid content
  misc_feature: Useful for making plants with modulated flowering time
  misc_feature: Useful for making plants with altered lignin content
  misc_feature: Useful for making plants with modulated nitrogen use efficiency
  misc_feature: Useful for making plants with modulated biomass
  misc_feature: Useful for making plants with altered terpenoid content
  misc_feature: Useful for making plants with modulated phosphate use efficiency
MAAADVEYRCFVGGLAWATDNASLQQAFASYGDVLDSKVRLLRVPSRLRAFCDWVPADAGLARSDLRRGSPDLPCFGPDLISPESNARADPVVFSSICLQVITDRETGRSRGFGFVTFSSEQSMLDAIEAMNGKDLDGRNITVNQAQSRGGGGGGYGGGRQGGYGGGGGGYGGGGGYGGGRREGGYGGGGGGGRREGGYGGGGYGSRGDSGGNWRN

SEQ ID NO: 16065 - DNA, 637 bp, Panicum virgatum
  misc_feature: Ceres CLONE 1787591
  misc_feature: Encodes the peptide sequence at SEQ ID NO. 16066
aaggaatctattctgagaacctcttcacacactttccccttcacccttgagaggccatctccaattcatcaccgtgctattccttcatactcacgccatcatcatacgagatttgacaatcagcaaggactggtaagaagatgctgaacaaattgttgccaaaaactaatagcaagaataagaaggacgcaccctcctctgctatacccacgttggatcggctccatgagactctacaaatgctggacaacaaagagtgtttccttcagaaaaagtgttctgctgaaatacaaaaggctaacgattatacaaaatccaataataacaatgctgcaattcagtgtctaaagaaaaaaaagttgtacgagacacaaattgaacatctatcaaattttcaattgcgagttcatgaccagattataatgcttgaaagtgcaaaggcaactaccgatactgttgatgctttgcgttctggatcatctgctgtcaaagctattcagcaatcactggacatcgatgatattgagaacgccattgatgaggcaaacgaacagacagaaaatatgaggcagatacaagaggcacttgcaacaccagttggtgcttctgctgattttgacgaggatgagctacaagc

SEQ ID NO: 16066 - protein, 165 aa, Panicum virgatum
  misc_feature: Ceres CLONE 1787591
  misc_feature (23)..(165): Pfam Name: Snf7 Pfam Description: Snf7
MLNKLLPKTNSKNKKDAPSSAIPTLDRLHETLQMLDNKECFLQKKCSAEIQKANDYTKSNNNNAAIQCLKKKKLYETQIEHLSNFQLRVHDQIIMLESAKATTDTVDALRSGSSAVKAIQQSLDIDDIENAIDEANEQTENMRQIQEALATPVGASADFDEDELQ

SEQ ID NO: 16067 - DNA, 928 bp, Panicum virgatum
  misc_feature: Ceres CLONE 1787593
  misc_feature: Encodes the peptide sequence at SEQ ID NO. 16068
gtctctccacgtgacccgattgcggcccttgcgggcacagcacgcgctttccatcgtcgccgtgccgccaccaccgcccgtggccgtcggagcagggctgcgccacctctccgacgtccggaggttgctgcgtaggcagtaggcacatacacgcaggcggcggcggcggcggccatggcgtcgcgcaagcttctcctgagcctcaccgccgggaggcggctccggtcccgcactcaacaactcttctgcgccgccagtctccctgaagctaccacctctcgctccctcgcagccgccgttgccgccgcgcagcagtcggttgggtcgccagtggctcacatcttctcttcgaggaccatctcgtcgacgcgccccgcgacacagtccgctggagatgcgcccagttcatctgcagtggaccaccacaagttggtaatgcctgaggacgagtttcataaattagcagatgagacgattcacgatttgcttgaaaaacttgaggaatatggtgactccattcagatggatggtttcgacattgactacgggaatcaggttttgacattgaggcttggggatttgggaacatatgttgtaaacaagcaaacaccaaacagacaaatctggttatcttcacctgtgagtgggccttctaggtttgattgggatgcatcaacagatggttgggtatacaaacggaccggagcaaatcttgtgcagcttctggaaaaggagattggtgagctctgtggtaccccagtagaactttcataatatcacaggaaatgacacacatctagattggacggagtagtgtgcctgaggtacagtatgagggagacaacactcttgtaatatgttttttcacaaaattttgttgttctacacatttgcacactttggaataaataacttccctttgctgatc

SEQ ID NO: 16068 - protein, 199 aa, Panicum virgatum
  misc_feature: Ceres CLONE 1787593
  misc_feature (88)..(199): Pfam Name: Frataxin_Cyay Pfam Description: Frataxin-like domain
MASRKLLLSLTAGRRLRSRTQQLFCAASLPEATTSRSLAAAVAAAQQSVGSPVAHIFSSRTISSTRPATQSAGDAPSSSAVDHHKLVMPEDEFHKLADETIHDLLEKLEEYGDSIQMDGFDIDYGNQVLTLRLGDLGTYVVNKQTPNRQIWLSSPVSGPSRFDWDASTDGWVYKRTGANLVQLLEKEIGELCGTPVELS

SEQ ID NO: 16069 - DNA, 132 bp, Panicum virgatum
  misc_feature: Ceres CLONE 1787651
  misc_feature: Encodes the peptide sequence at SEQ ID NO. 16070
aagaaaggagaacaggttatgtatgattttaaggacaagatcatcgctgccgtctttccaggtctgcaacgtggtcctcataaccacaccattaatggcttagctgttgcgcttaaccccgccactactcca

SEQ ID NO: 16070 - protein, 43 aa, Panicum virgatum
  misc_feature: Ceres CLONE 1787651
  misc_feature: SWISSPROT Homolog: EC 2.1.2.1 Glycine hydroxymethyltransferase
  misc_feature: Useful for making plants with modulated nitrogen use efficiency
KKGEQVMYDFKDKIIAAVFPGLQRGPHNHTINGLAVALNPATT

SEQ ID NO: 16071 - DNA, 579 bp, Panicum virgatum
  misc_feature: Ceres CLONE 1787664
  misc_feature: Encodes the peptide sequence at SEQ ID NO. 16072
attttcaggcaccgcgattttgtctcgccaggccgacaactccggcctcctccaacgcggcgtccagatcggcgcagtcccctcggcaacacctcccctccccgactccgcgcccgccgtgcaccagatcctgtaatgccaaccagacgccatgttcaatattcatctcttcctacagaggacagagataatctacggttcacatatactccaaaatctcataggaaaattccatggaagtcaattgccctagcactttttctcctcctcatagggattttactcctctccctgtcatattttatattcacaagtcacgtggagggtgatgattctcaggcatatggcctcttattcctgggtgtgcttgctttccttcccggctattacgtgacccgagttgcttactattcctggagaggagcaccagggtacacctttgcatccatcccagattattagccatttatgtattcacaagacctcaagtgcggtgctcacacaggaaggccaagcacatagacaattaaatgaacacctgtgcatgatatatatatagtcaacatgtcctctgaaacc

SEQ ID NO: 16072 - protein, 108 aa, Panicum virgatum
  misc_feature: Ceres CLONE 1787664
  misc_feature: Useful for making plants with altered protein content
MPTRRHVQYSSLPTEDRDNLRFTYTPKSHRKIPWKSIALALFLLLIGILLLSLSYFIFTSHVEGDDSQAYGLLFLGVLAFLPGYYVTRVAYYSWRGAPGYTFASIPDY

SEQ ID NO: 16073 - DNA, 527 bp, Panicum virgatum
  misc_feature: Ceres CLONE 1787669
  misc_feature: Encodes the peptide sequence at SEQ ID NO. 16074
gctgacgaggaggactcggaagggcggcgaggcctgcacttcgcgtgcgggtacggcgagctcaagtgcgcgcaggtgctcctggaggccggcgcggcggtggacgccgtggacaagaacaagaacacggcgctgcactacgccgccggctacggccgcaaggaatgcgtcgcgctcctgctcgagaacggcgccggcgtgacgctgcagaacctggacgggaagacgcccatcgacgtcgccaggctcaacaaccaggaggacgtcctcaagctgctcgagaagcacgccttcgtatagacgccgccgccgccgccatcttcatgccctcctttgcgtgctctgctttctcggccgaaacaagtttcttttctttagttgttgggtgtatgtatgtattgagagtgtccatgcatgccagattttgcttgcgtaattaaggtgggattgggttcgttggattgctgttctattatggatcgtccatgagttttacttaatgaataaggaagagattttcatttcag

SEQ ID NO: 16074 - protein, 99 aa, Panicum virgatum
  misc_feature: Ceres CLONE 1787669
  misc_feature (40)..(72): Pfam Name: Ank Pfam Description: Ankyrin repeat
  misc_feature (7)..(39): Pfam Name: Ank Pfam Description: Ankyrin repeat
  misc_feature: SWISSPROT Homolog: EC 2.4.2.30 NAD(+) ADP-ribosyltransferase
  misc_feature: The sequence is a functional homolog of SEQ ID NO 1839 in the 10/374,780 US patent application
ADEEDSEGRRGLHFACGYGELKCAQVLLEAGAAVDAVDKNKNTALHYAAGYGRKECVALLLENGAGVTLQNLDGKTPIDVARLNNQEDVLKLLEKHAFV

SEQ ID NO: 16075 - DNA, 929 bp, Panicum virgatum
  misc_feature: Ceres CLONE 1787673
  misc_feature: Encodes the peptide sequence at SEQ ID NO. 16076
aacctttcccttctcttggtctcggactctctcttgcttccccggcggcgacgactgggcgagcggcggcgccatttgtcacgtcttcgccccaccctttgccggcgacgagcatccaccaataagatgattaatcttttcaaaataaagggtcaaaagaaagaagaggcggcaagtgctgctggaaaggcccctgttaagaaacagtctgctggggagctacgcctccataaagatattagtgagctcaacctaccgaagactacatcgatttcttttcctaatggcaaggatgatctaatgaattttgagatcatcatccgacctgatgaaggatattatatgggaggcactttcattttcacctttcaagtgtccccatcttatcctcatgagcctccaaaggtcaagtgcaagaccaaggtgtaccatccaaatattgatttggaaggcaatgtatgtctgaacattctgcgtgaagattggaaacctgttcttaacatcaacactgttatttatggcctgaatcttcttttcacgcaaccaaacgacgaggatccattgaaccatgaagctgcagttgtccttcgcgacaacccgaagatgttcgaggcaaatgttaagagggcgatggctggaggctacgtaggccaacactatttcccaagatgtgcttgacttggcgcttgctgtgaaacgatttcagctttgctggatttgtgtggttttcagtgcgcggaaactgcttctgggagcaaaattaaaatcccccgtggtgtgatgtgcatgtttgcccgtccttgtgatgtgtttaaaacccgtaaattaaatttgacgatggggtggtagtgaagatgacaatgatatgtatcaatgtatgtcaactatgtaacttgataaatcctaaatggggaatgggaagtgaattc

SEQ ID NO: 16076 - protein, 183 aa, Panicum virgatum
  misc_feature: Ceres CLONE 1787673
  misc_feature (33)..(169): Pfam Name: UQ_con Pfam Description: Ubiquitin-conjugating enzyme
  misc_feature: SWISSPROT Homolog: EC 6.3.2.19 Ubiquitin--protein ligase
MINLFKIKGQKKEEAASAAGKAPVKKQSAGELRLHKDISELNLPKTTSISFPNGKDDLMNFEIIIRPDEGYYMGGTFIFTFQVSPSYPHEPPKVKCKTKVYHPNIDLEGNVCLNILREDWKPVLNINTVIYGLNLLFTQPNDEDPLNHEAAVVLRDNPKMFEANVKRAMAGGYVGQHYFPRCA

SEQ ID NO: 16077 - DNA, 854 bp, Panicum virgatum
  misc_feature: Ceres CLONE 1787677
  misc_feature: Encodes the peptide sequence at SEQ ID NO. 16078
acccgtagaaattagaatcccctcctgagtcctgacctctgccttcgcagctccggcaagaccgatgttgccgatgaggtccgccgccgccgcgccgtgctcgctggcagcgctgctgctccgccgcctctcctcccactcgtcctcttctgcctattccgtcagccgccgcgcctcctctgccctgtcctctcagccctccgcctcccacctcgccaccagccccccttgccccctttccagcagccgcaggaccaggggattcgcggcctgggcctcggcgccggggcccgccgaatcccccgccactaaggcgctagaggccaagatcaaggagcagctggaggccgacgcggtcagggtcgtcgacaactccggggacggccgccacgtctgcatagatgtggtttccaaggtattcgagggaaaatctgcagtaaataggcagagaatggtctacaaggttatatgggaggagcttcagagcaccgtgcatgccgtggacgaaatgactaccaagacaccagatgaagctgctgcgaacaagtaattcaatactcctgtggaggcagttaagctctccgtcgaagatcaggcccttgccttcaccaagtttctgttttttttcctgaataatcaataattcgcgatgtgattagtgtgctttcaaaaagaaatatatgccattcgatttgcctccacaaacaaattgtgatgctatgtgcaagcgtctgtggctgctaattagctgtgtaagggctaaatataagtcatgcagagtataaagtgggtagacaggtgtaaactccagcacgccgatgtatccaaaaaaaaaactcacgttttaggcctac

SEQ ID NO: 16078 - protein, 161 aa, Panicum virgatum
  misc_feature: Ceres CLONE 1787677
  misc_feature (80)..(157): Pfam Name: BolA Pfam Description: BolA-like protein
MLPMRSAAAAPCSLAALLLRRLSSHSSSSAYSVSRRASSALSSQPSASHLATSPPCPLSSSRRTRGFAAWASAPGPAESPATKALEAKIKEQLEADAVRVVDNSGDGRHVCIDVVSKVFEGKSAVNRQRMVYKVIWEELQSTVHAVDEMTTKTPDEAAANK

SEQ ID NO: 16079 - DNA, 1007 bp, Panicum virgatum
  misc_feature: Ceres CLONE 1787711
  misc_feature: Encodes the peptide sequence at SEQ ID NO. 16080
agcggcgagcgaaccgagtcaactgaagaccaaacctcgccggggcgccgtacaaccaccgaagactgcagcatgtcgccagcgacctctgccgccgccgccgctcccgtgcccggcgtcctcatcctccaatctccgtcgaccctgcgaccctcccccgtcgcccgcctcctcccatctggggctgcgaggccgctccaagcgacgtcggcctctcgtcgcctccctgcctccgccgtgcgcgcccagagcgccgccgacccagggtacttgcctgaatcggagttctacaagatcgaggccattcttaggccgtggagggtgccgcacgtgtcctcgggcttgttggagatggggatcagaggtgtgacggtgtcggatgtgcggggattcggggcgcagggagggtcaacggagcggcatggagggtcagaattttcggaagatacatttattgctaaagtcaaaatggaaatagtggtctgcaaggagcaggttgaagcagtaatcgacaaaataattgaaaaggcaagaacaggagaaattggcgatgggaagatattcttgatccctgtctcggatgtggtaagaatccgcaccggcgaaagtgggaaggaagcagagaggatgactggaggactgtcggataggctgtcctctgtggtttcaatctcatgagccaaacagattgcctgcctgttgcaaggtcaaacgcgcccctccctcagcacttgcattgcacaataaactgcgcaatgtgtttcttgcaagtgtcgcccgaatcacgcagtgtgcactgggcctgatcaataaaatccgatggaactggtgtgaattttccctcgctgttgtttcttaacctgtgaaagataagaattaagatgatgctagtttggcaacaggttaagctggctgcaatgagaatgaactgggctggctctgttgtatataacttttgttgggccgatctctgtctggcccaaagacacgaaagactcgtgcagtgc

SEQ ID NO: 16080 - protein, 201 aa, Panicum virgatum
  misc_feature: Ceres CLONE 1787711
  misc_feature (75)..(177): Pfam Name: P-II Pfam Description: Nitrogen regulatory protein P-II
MSPATSAAAAAPVPGVLILQSPSTLRPSPVARLLPSGAARPLQATSASRRLPASAVRAQSAADPGYLPESEFYKIEAILRPWRVPHVSSGLLEMGIRGVTVSDVRGFGAQGGSTERHGGSEFSEDTFIAKVKMEIVVCKEQVEAVIDKIIEKARTGEIGDGKIFLIPVSDVVRIRTGESGKEAERMTGGLSDRLSSVVSIS

SEQ ID NO: 16081 - DNA, 1177 bp, Panicum virgatum
  misc_feature: Ceres CLONE 1787713
  misc_feature: Encodes the peptide sequence at SEQ ID NO. 16082
tcccggtccagacaaaatctgctgccttgctgtcctcggtctcccacgtacaggagccgccaacactcaaactcaaacgcgtgcgctgcagcaatgctagcctcaacctgcctatccccttccttcctgcccaccgccaccgccgccacacacagactcctcgtcgtctccggcaactccggcagccgccgtcctccgcggcgcatgtcaggtggaggtggtctcgtccttcacgccaggctgggcgatggcgacggagccggcggcgagctcaccccgtcgcgacgacacgcgtaagccgcacatcacattcctcatccgcacgctactgctcgcgtgcaagatagcccgcgtggccgccgcgctgatccgcgtcctctacctcgtcgcgctggccgcccccgccaaaagcctcctcgccgccgccacggccgccttcgcgctcgtgaacgcgccgtgcctccggtacatgaaccaggccgcgctcgggcggagcttcacgggcaccttctgcggcgacctgctggtcggggccatggcgcactcctggaggctgctcgtgcagggcctcacgtcgctcatgtttctctgtgcccgcgccgatgagtacgtccggccgccgcccagcccgctggtgctcatggcgcacgacaaaccggcgtcccatcctcagcaggtacacatctccgtcgtcggggcgaagaacatgcgcatctcatgggtcaccgacgaccggagcgcgccgtccgtggtcgagtacggcagatccccgggcaagtacacggcgtccgcgacgggcgaccacatcacctaccactacttcttctacaagtccggcgcgatccaccacgtcaccatcggcccgctggatcccggcacgacgtactactatcggtgcggcaaggccggcgacgagttcaggctccggacgccgccggccaccctgcccatcgagttcgtcgtcatcggcgacctgggccagacggggtggactgcgtcgacgctgtcgcacatcggcggcggggactacgacatgctcctgctccccggcgacctgtcgtacgcggacacgcggcagccgctgtgggactcgttcgggcggctggtgcagccgctggcgagcgcgcgggcgtggatggtgacagaggtcaaccacgagatggagacgctgccggtg

SEQ ID NO: 16082 - protein, 309 aa, Panicum virgatum
  misc_feature: Ceres CLONE 1787713
  misc_feature: SWISSPROT Homolog: EC 3.1.3.2 Acid phosphatase
MATEPAASSPRRDDTRKPHITFLIRTLLLACKIARVAAALIRVLYLVALAAPAKSLLAAATAAFALVNAPCLRYMNQAALGRSFTGTFCGDLLVGAMAHSWRLLVQGLTSLMFLCARADEYVRPPPSPLVLMAHDKPASHPQQVHISVVGAKNMRISWVTDDRSAPSVVEYGRSPGKYTASATGDHITYHYFFYKSGAIHHVTIGPLDPGTTYYYRCGKAGDEFRLRTPPATLPIEFVVIGDLGQTGWTASTLSHIGGGDYDMLLLPGDLSYADTRQPLWDSFGRLVQPLASARAWMVTEVNHEMETLP

SEQ ID NO: 16083 - DNA, 674 bp, Panicum virgatum
  misc_feature: Ceres CLONE 1787713-R
  misc_feature: Encodes the peptide sequence at SEQ ID NO. 16084
gcgaggggtcggagcagcgccggtggctggaggcggacctggcgcgcgtcgaccggcggcggacgccgtggctgctggtgctgctccacgcgccgtggtacaacaccaaccaggcgcaccagggggagggcgagaggatgcgcctcgccatggagcggatgctctacgacgcacgcgtcgacgtcgtcttcgccggacacgtccatgcctacgagcgctttacgaggatctacgacaatgaggccgacagccggggcccgatgtacatcaccattggcgacggaggcaacagggaaggccttgctctcaggttcatcgaggaccacaagtcggcgcacctgtcggtgttccgggaggcgagcttcgggcacggccggctgaggatcgtcaacgagacgagcgccgtctggacgtggcaccgcaacgacgacgagtacgccaccgtccgcgacgaggtctggctcgagagcttggccgccggaaaacagagcctagcaacaaccaccggtcgtcacactgatgagctgtaggaaacatgaaagagaggtggaaaattagttaaactcacaatgctgtaacatttttcttttttatatatagttgtaacatatttcttagtgaagtggatgtgggaagtttatacatccatgccatgatgtttttttttatatgac

SEQ ID NO: 16084 - protein, 175 aa, Panicum virgatum
  misc_feature: Ceres CLONE 1787713-R
  misc_feature: SWISSPROT Homolog: EC 3.1.3.2 Acid phosphatase
EGSEQRRWLEADLARVDRRRTPWLLVLLHAPWYNTNQAHQGEGERMRLAMERMLYDARVDVVFAGHVHAYERFTRIYDNEADSRGPMYITIGDGGNREGLALRFIEDHKSAHLSVFREASFGHGRLRIVNETSAVWTWHRNDDEYATVRDEVWLESLAAGKQSLATTTGRHTDEL

SEQ ID NO: 16085 - DNA, 2057 bp, Panicum virgatum
  misc_feature: Ceres CLONE 1787753
  misc_feature: Encodes the peptide sequence at SEQ ID NO. 16086
atttcccgtaatttcctcctccttttcccaccttgcttcctcttctcgctttgctctctctctctccccccttcttccctaggcagcatcaaggctagctcgctaggctcttggctctcccatccacctcgtccccattgcatgcgaaacaagcaagcaagaggtcaagagggggagcgagctagtgagtggcgtttggtgtgaagtgagggctcgaggaggacgaagcgagcgagagggagagtcatggcatggtgatggacctgctgctccgcgccgatctaatcactttgccctacctagagctgggaggaggaggacaaggtctctgatcagctgagcttgtctagtcaaagctgagagctttgttgtgctgcgagtccaagctcgacaggaccactgccactgtgaagcacagcggcagcggcgacaagacgaggaggcggaagctgccaagcgggtagatctacgcaaatggagaccaaggacgtggccccgctccccgccaccaccgcagccggcgccgccgcgcccgtgcctgcaccggcgtctcagacgccgccgccttcttctatgccgccgccgccgccgcagccgcagcaccaccagcccccgccgccgccgttcgcgcagcagcaggcggcccccgcgtcgtcgcctggggcccccatgcccggcggcatgcgcctctcgttcgaccagatggcggggaagacggagcaccaccagcaccacgcggcgcccatgctgtacgcgccgccgccgcagtccgccgcgggcgcgccggggggcaatgtgctgggcatgggcgagctgatgcgcaagaagcgcgggcggccgcgcaagtacgctcccgacggcagcatggccctggcactggcccccatctcctccgcctccgccggcggcggcgcggcccctggccagcagcagcacggcgggttctccatcagcagtcccccgtccgaccccaacgccaagcgccgtggcaggcccccgggctccggcaagaagaagcagttcgaagccctgggttcttggggcatcgccttcacccctcacatcctcaccgtcaaggccggcgaggatgttgcatccaaaataatgacgttctcacagcaaggccctcgcacagtctgcatcctttctgctaatggtgcaattagcaatgtaactcttcggcagcctgctacatctggtggattagttacttatgagggccgctttgagatcatctcactatctggttctttcctgctcgcggaggatggtgacactcgcagcaggactggtggtttaagtgtcgcacttgcaggatctgatggacgagtgcttggaggatgtgttgctggaatgctcatggcagcaactcctgttcaggttgtggtggccagtttcatcgcagagggcaagaaatcaaagccagccgaggcacggaaggtcgaaccaatgtctgctcctccaccacagatgcctaccttcgtgccacctcctgtggccaccagccctccatctgagggcacatccagtgcatcatctgatgactctggcagcccgattaaccacagcaccatgcccttcaaccactccggccagcaccagcatcagcaccctcaccagcaccagcacatgccgcctgcctatgcttctggtggctggtccctctccgcgcaccagcagaacaggcatgactctgacatgaagatgatgtcgaactaacactgctcaaccttaagtgctccatttcttggttgggctggagaggaagctgctgatggttgattggtactgctgctatggatgatcctttcgcgtcgtctgctctgatcggtggtgacggtgtatctgctatagctaagctagctaggagagtagggttcatggtctcacctgctgttgtttccccgagtaagattaatttaattcgaattagccgcccgttgtaatgctgtagctttgtcctaaaagtctgtcagtcagcccctaacgcgagttgtgatggatgcctgatgagatattcacctcctaggctagttaaaataccattctctagtgtt

SEQ ID NO: 16086 - protein, 349 aa, Panicum virgatum
  misc_feature: Ceres CLONE 1787753
  misc_feature: The sequence is a functional homolog of SEQ ID NO 1012 in the 10/225,066 US patent application
  misc_feature: The sequence is a functional homolog of SEQ ID NO 124 in the 10/374,780 US patent application
  misc_feature: The sequence is a functional homolog of SEQ ID NO 2536 in the 10/374,780 US patent application
  misc_feature: The sequence is a functional homolog of SEQ ID NO 264 in the 10/225,066 US patent application
  misc_feature: Useful for making plants with modulated light quality response
  misc_feature: The sequence is a functional homolog of SEQ ID NO 1499 in the 11/479,226 US patent application
  misc_feature: The sequence is a functional homolog of SEQ ID NO 2526 in the 10/374,780 US patent application
  misc_feature: The sequence is a functional homolog of SEQ ID NO 720 in the 10/412,699 US patent application
  misc_feature: The sequence is a functional homolog of SEQ ID NO 762 in the 10/225,066 US patent application
  misc_feature: The sequence is a functional homolog of SEQ ID NO 1503 in the 11/479,226 US patent application
  misc_feature: The sequence is a functional homolog of SEQ ID NO 646 in the 11/435,388 US patent application
  misc_feature: The sequence is a functional homolog of SEQ ID NO 1446 in the 10/666,642 US patent application
  misc_feature: The sequence is a functional homolog of SEQ ID NO 2606 in the 10/374,780 US patent application
  misc_feature: The sequence is a functional homolog of SEQ ID NO 296 in the 10/225,066 US patent application
  misc_feature: The sequence is a functional homolog of SEQ ID NO 74 in the 11/375,241 US patent application
  misc_feature: The sequence is a functional homolog of SEQ ID NO 878 in the 10/412,699 US patent application
MPGGMRLSFDQMAGKTEHHQHHAAPMLYAPPPQSAAGAPGGNVLGMGELMRKKRGRPRKYAPDGSMALALAPISSASAGGGAAPGQQQHGGFSISSPPSDPNAKRRGRPPGSGKKKQFEALGSWGIAFTPHILTVKAGEDVASKIMTFSQQGPRTVCILSANGAISNVTLRQPATSGGLVTYEGRFEIISLSGSFLLAEDGDTRSRTGGLSVALAGSDGRVLGGCVAGMLMAATPVQVVVASFIAEGKKSKPAEARKVEPMSAPPPQMPTFVPPPVATSPPSEGTSSASSDDSGSPINHSTMPFNHSGQHQHQHPHQHQHMPPAYASGGWSLSAHQQNRHDSDMKMMSN

SEQ ID NO: 16087 - DNA, 2654 bp, Panicum virgatum
  misc_feature: Ceres CLONE 1787763
  misc_feature: Encodes the peptide sequence at SEQ ID NO. 16088
aagctaaccagattttaggtggttaactctgtcgccgcgacgcctctctttccgcccggcgcccaggataatagttcccgctctggccgcttgcgcatgtatcttcttcctcgcctcagctcagggcctttcggttcgggctggccgagcgaattcggccacgaggcgagtgcgcggccggagggggagcaccggcgcttggctgggtaacggaactcgctcgctttccaggccaggaggcgacgaccgccgcctcggcacttttctattcgagcagcctcggttctacttcttctacgacttccgggtcagacattggttgcaggcgtgcagccagcagcagccgggcggcttcgtcttgtgtcagcgcggagtccacggcgacaagtggttgagctaaccggcggccccgccgtgctagttactgaccagctccgtgggcgcgccatggcggcgaggtgcgcctcgtgctgatttcttgaggcgatcgcgagccgggggcgagcaggcgccatggcggtggaggagcgcggggagggcgtcggccggtgcatactggtggggctgcacatggacgccgtcggcagggacctgctccgttgggcgctcaaccaggcggcgaggccgggggaccgcgtcgtcgccgtgcacatttaccgcaagtccgacctgtgcaagacgaacactctgaggctgatcaggacgctggacgactacctggcggagtacgagtccctctgcagccggaaagagatcgttctggtcggccgggtgacgccggggagctcgatccagaaggagctggtgaaggaggccaagctctgcgccgccatggtcgtggtgctcggcgccaacaagaagtactccttcggagggtcgacttgcctggccaagtactgcgccaagaagctgccgccgacgaccaccgtggtcgccatccagaacggcaagcccgtcttcgtccgggaggcgcccaagccgccacttggagcagagccgaagccggtgctgcgcatggtgctgcacccgagcgtggggctggaggccaaggtcatcatcccgaaccaggaccggagcgcgcggtccatggacttcgacgccgagggatgcggccacggtgcgccggcgacggagtccgtcgaggacgccactaaggccagcggcggcgtggcgccagagcagaggctcgggtggccgctcctccgccgcgcgcacgccgccgcagcggccgcggcggtggcggcggccgtccccgcgccaagcgccaaggagcaagagccgcggaagcagtcggtggtgcagtgggtgatgagcctgccccggcggaccacgccgtcggagtccgccggggcgcccgcgggggcggggctcgcgtcggagctcaaggcaatgctcgacggcggcggcgcgcggtgccggtggttccgctacgaggagctctacgactccaccaaccacttctccgcagagaacctgatcgggaacggcgggaacagccgggtgtacaggggcagcctagcctgcgggcagcaggtggcgatcaagctgtccaaggcgtcggccgaggcgtccaaggacttcctccgggaagtggacatcatcaccaagctccagcaccagcggatcctcccgctgatcggcgtctgcgtggaaggccccaacctcatctctgtctacagctacctcccccgaggcagcctcgaggacaacctgcacggggagaggtcaaagccggcgctgtcatgggagaaacggtacaaggcggcgctggggatcgcggaggccctgagctacgtgcactccggcggcccccggccggtgatccacagggatgtcaagtcctccaacatcctcctcacggaagagttcgagccccagctttccgatttcgggctcgccatctgggcgccgacgaacccgacctccatggcgcacagcgacgtcgtcggcacgttcgggtacctggcgccggagtacttcatgtacgggaaggtgacggacaaggtggacgtgtacgcgttcggcgtcgtgctgctggagctcctgtccgggcggaagcccatcagcagcgacggggcgtcgcccaagggccaggagagcctcgtcatgtgggcgactccggtgctcagcagcggcgacatcacggacctgctggacccgaggctagacgtggagcacgacgacgcggaggtgaggcggatggtcacggccgcgtgcctctgcctccggaggtcggctcggctcaggccgccgatatcgcagatactgagcatactacgaggagagagcgcggcgagcatcgccgaccagggcggtgccgcggagctggactgcctggacgacgaggcgtacccggcggcgaacgtgaggtcgcacctgggcctcgcgctgctggacgtggaggactcggagtccatctccagcacggagcacagcagcggcctcagcccgttggaggagtacctgcgggaacggtggagccgatcgtccagcttcgactgatttgacgcttgcgatcttgtggacatgtaattttcattttctcccccggtatctcctttgttcgtcgtttggttttgttaccgggaccgtgtacagtatagaatcaaagaatcatcacagccacattttcggcaagaagattcagattatcc

SEQ ID NO: 16088 - protein, 662 aa, Panicum virgatum
  misc_feature: Ceres CLONE 1787763
  misc_feature (316)..(588): Pfam Name: Pkinase Pfam Description: Protein kinase domain
  misc_feature: SWISSPROT Homolog: EC 2.7.11.1 Non-specific serine/threonine protein kinase
MAVEERGEGVGRCILVGLHMDAVGRDLLRWALNQAARPGDRVVAVHIYRKSDLCKTNTLRLIRTLDDYLAEYESLCSRKEIVLVGRVTPGSSIQKELVKEAKLCAAMVVVLGANKKYSFGGSTCLAKYCAKKLPPTTTVVAIQNGKPVFVREAPKPPLGAEPKPVLRMVLHPSVGLEAKVIIPNQDRSARSMDFDAEGCGHGAPATESVEDATKASGGVAPEQRLGWPLLRRAHAAAAAAAVAAAVPAPSAKEQEPRKQSVVQWVMSLPRRTTPSESAGAPAGAGLASELKAMLDGGGARCRWFRYEELYDSTNHFSAENLIGNGGNSRVYRGSLACGQQVAIKLSKASAEASKDFLREVDIITKLQHQRILPLIGVCVEGPNLISVYSYLPRGSLEDNLHGERSKPALSWEKRYKAALGIAEALSYVHSGGPRPVIHRDVKSSNILLTEEFEPQLSDFGLAIWAPTNPTSMAHSDVVGTFGYLAPEYFMYGKVTDKVDVYAFGVVLLELLSGRKPISSDGASPKGQESLVMWATPVLSSGDITDLLDPRLDVEHDDAEVRRMVTAACLCLRRSARLRPPISQILSILRGESAASIADQGGAAELDCLDDEAYPAANVRSHLGLALLDVEDSESISSTEHSSGLSPLEEYLRERWSRSSSFD

SEQ ID NO: 16089 - DNA, 2650 bp, Panicum virgatum
  misc_feature: Ceres CLONE 1787769
  misc_feature: Encodes the peptide sequence at SEQ ID NO. 16090
cggagagtcttttttttttttgggaactccgactccggagagtcgagtctcgactcccgagtcccgactcccaagcaagtctcccctcccgatctaaacccgtcgaaaccctaatccccatcgccgccgccatggtgagccccatcctgaccctccccgcgccggagggcaacggaggcgcggtcggtgacgccgacaagcagcagcagacggcgccttccacgccccctcccggcgcgaaggcggacccgccggcgacggtggccacccacacgcgcaccatcggaatcatccaccctccgcccgacatccgcgccatcgtcgagaagaccgccgtcttcgtcgccaagaacgggcccgagttcgagcgccgcatcatctccctcaaccagggcaacgccaagttcaacttcctccagccctccgacccctaccacgcctactaccagcaccgcgtctccgagatcgctgcggcgccgcccggctccgacgcccccgcgggcgccgagcccgacggaggcccccccgccgcgccagcggcggccccggcggacggcgccgccgcacctgctgatggcgctgcggcggcggcagatgcgaagcccgaccactccgcgcccttccgcgtggcaccgcctgccaaggtgctggtgccgcccaaggcggagctgtacacggtgcggctgcccgagggcatcacaggggaggagctggacatcatcaagctgacagcgcagttcgtggcccggaacgggaagaacttcctgacgagcctggcacagcgtgagagcaacaacgtgcagttccattttatccggcccacgcacagcatgttcccattcttcacatcactaacggatgcatactcgagtgtgctgaggccggaagagggggtgccggcactgttaaaggagttgagggaggggtcgaaggatctgactacggtgctggagagatacctgaatcggttggagtgggatcggtcgcaggagcaggcaaggcagcaggcggaggataagattgagcaggaaaggatgcagatgtcaatgatcgactggcatgattttgttgttgttgagacaattgaatttgcagaggatgagtatgaggggcttcctgtgccacctactctggaagagttgaaacgccggaagaggatgcagaatttgggagaggacgaagcgatggaaatggctgaaccagctaaggaggttgagatggaaatggatgaagacgagatgcaacttgttgaggaaggaatgcgggcagcacagcttgaggagaatgaaggagcagcgcaggttaaggtggctggtgatgatgaggctcctatgaggattgtcaaaaactacaagaggcctgaggagaggatccctgcagagagggacccaaccaagtttgttgtctcaccgataactggggagctgattcccatcagcgagatggaggaacacatgcgcatctcactcattgaccctaagtacaaggagcagaaagagaggatgctggccaagattaaggagaccacccttgcacctgatgatgagatttcaaggaacattgttggtcttgctcgcactcgccctgatatttttgggaccactgaggaagaggtttctaatgctgttaaggcagaaattgaaaagaaaaaggatgagcagccgaagctggttatttgggatggtcattctggtagcattggtcggactgccactcatgcattgtctcagccccagggtggtgaggaacagtttgatgcttcaaattctcatgttcctggtccagctccgcctctccggcctggcatgcaattgccccgacctcctcagccacttcctcttcttaatgttcctcgctttattgcccctccagcaccgtattctgtcccaccaccaggtcctcatatgcctggagctcaacatatgatgcctcatatgcatccacctccacaacagataacagggcagccgcagatgatcaggatgccaggacagatggttcatatgccaaccaatattcctccacctcctggccagactcagtttatgcctggtccaccgcgctcatttccaatgcccccaccaccacacatgccacccatggtcaatcctattggaatccctcagcctccagcaccgcctctgcctccacagcctcctgccgaagagcagccacctccacctgatgaaccagaaccaaagaggttgagagcagatgatgcttctcttatcccggcagagcagttcctcactcagcatccgggtcctgctagcatctcagtatctgtacccaaccttgatgaaggaaatctgcgtggccaagttttggagattcgtgtccaatcactgtcagacacagttggtagtctgaaggagcagattgctggagagttgcagctccctgctaataagcagaagttgagtgtgaggactagtttcctcaaagacaacctttctcttgcttactacaatgtgggtcctggagtggtgatcaatctaacactgagggagcgtggtgggagaaagaaatgaagcattttcaacctcagctcagtgtcaggttaatgcgtagaaccattgttcagagctatcatggagaacctttttactggatcttgctgcggtatttttcatattattttcttgagcac

SEQ ID NO: 16090 - protein, 799 aa, Panicum virgatum
  misc_feature: Ceres CLONE 1787769
  misc_feature (64)..(108): Pfam Name: Surp Pfam Description: Surp module
  misc_feature (197)..(241): Pfam Name: Surp Pfam Description: Surp module
  misc_feature (725)..(794): Pfam Name: ubiquitin Pfam Description: Ubiquitin family
MVSPILTLPAPEGNGGAVGDADKQQQTAPSTPPPGAKADPPATVATHTRTIGIIHPPPDIRAIVEKTAVFVAKNGPEFERRIISLNQGNAKFNFLQPSDPYHAYYQHRVSEIAAAPPGSDAPAGAEPDGGPPAAPAAAPADGAAAPADGAAAAADAKPDHSAPFRVAPPAKVLVPPKAELYTVRLPEGITGEELDIIKLTAQFVARNGKNFLTSLAQRESNNVQFHFIRPTHSMFPFFTSLTDAYSSVLRPEEGVPALLKELREGSKDLTTVLERYLNRLEWDRSQEQARQQAEDKIEQERMQMSMIDWHDFVVVETIEFAEDEYEGLPVPPTLEELKRRKRMQNLGEDEAMEMAEPAKEVEMEMDEDEMQLVEEGMRAAQLEENEGAAQVKVAGDDEAPMRIVKNYKRPEERIPAERDPTKFVVSPITGELIPISEMEEHMRISLIDPKYKEQKERMLAKIKETTLAPDDEISRNIVGLARTRPDIFGTTEEEVSNAVKAEIEKKKDEQPKLVIWDGHSGSIGRTATHALSQPQGGEEQFDASNSHVPGPAPPLRPGMQLPRPPQPLPLLNVPRFIAPPAPYSVPPPGPHMPGAQHMMPHMHPPPQQITGQPQMIRMPGQMVHMPTNIPPPPGQTQFMPGPPRSFPMPPPPHMPPMVNPIGIPQPPAPPLPPQPPAEEQPPPPDEPEPKRLRADDASLIPAEQFLTQHPGPASISVSVPNLDEGNLRGQVLEIRVQSLSDTVGSLKEQIAGELQLPANKQKLSVRTSFLKDNLSLAYYNVGPGVVINLTLRERGGRKK

SEQ ID NO: 16091 - DNA, 598 bp, Panicum virgatum
  misc_feature: Ceres CLONE 1787771-R
  misc_feature: Encodes the peptide sequence at SEQ ID NO. 16092
aaggtgcaaaagcaatggcgataagggaaaaggcaaaggccttgaaagaggtagcgcaagcagcagcaggtataggcggggctgctgagagaaaccttcgtgactttgtcaaagcaataccatgtcggaatcaataataaagccatggccgtgtttggtaacttgtcatatcaagatttacacgctaattaagagaaaccttcgtgactttgtcaaagcaataccatgtagtctatttgcaaaatcttttcaggaacggaggtaactcttcgagatgaatctaatgacggtaattaattgatgatttgctacagtgatgctacagtaccattctctaatcacgcgtcaaaggcctcattagattcgtttcgcgatttacacggggggttgtggaggtggttttgtaattagacttcatttaatactctaaattagtggtcaaagggcaaaaaaaaattcgcgaaattttttaccacctcaaccaaacacggcccatgatagaaaactggatctggtccattcatgacagcgacctcttttgttcttgtactgcagtatgtatcacaaattcaatccagccaaattattagctggagac

SEQ ID NO: 16092 - protein, 44 aa, Panicum virgatum
  misc_feature: Ceres CLONE 1787771-R
  misc_feature: Useful for making plants with altered carbohydrate content
GAKAMAIREKAKALKEVAQAAAGIGGAAERNLRDFVKAIPCRNQ

SEQ ID NO: 16093 - DNA, 129 bp, Panicum virgatum
  misc_feature: Ceres CLONE 1787771
acgtgcagctgccgaagcctcctccaatgtcacaccctccgtggacccacactctcgatgtcgccatcggctcctccagcgcatgtgagcgaacggtcaccacgatccccgcaatcccttcctcccccc

SEQ ID NO: 16094 - DNA, 1779 bp, Panicum virgatum
  misc_feature: Ceres CLONE 1787772
  misc_feature: Encodes the peptide sequence at SEQ ID NO. 16095
accacgatcgatcactccaacaacagatccagcccaaccagcagcatctcgtcgcagtacaccgaggcacacacactacctccctctccctccccgtcccgggctcgcaatcattcatatctccatggcggcgcccgcgctgctcgccgccgcggcgctcctggcgctggcggcggcgtggctgtgggactacgccgtggcgcggcacctgctgcggccccgcgccgtgggcgccgtgttccgggcgcagggggtccgcggcccgccctacaggtacctccgcggcagcaacggcgacatccggaggatgaggatgagggccgaggccgacgccgcggcgctcgacgcccgcgaccacgactacctccgcagggtcctgccccacttcctcgcctggaaggacaagtacggagccccgttgctgcactggttcggtccgcaaccgcgcatctgcctcttcgactacgagtcggtgaggcaggttctctggaacaagtccgggcatttcgccaagaccgacgcgcacccggctatcctggcattgcttggcaaagggctggtgctggtggacggcgccgactgggtgcggcatcgaagggtggccaatccggctttcgccatggacaagctcaagatcatggcgacgacgatggtcacctgcgccgagcggttgatcagggagtgcgaggagcttgcgtccaccagcaagagcggggaagtggaagtggaattcagcaggcactttcaggagttgacagcagaagttatttcccgcaccgctttcgggagcagctataaagagggaaaagaagtcttccatacgcagcagcagctcctggcacttgccctggccactctcctcaatttgcaactgccaggattcaagtatcttcctactaaaaacaacagattgaagtggatgctggaaaagaagatgaagacgacgctcacggcgatcatacagccccggctagcatcgaaaggaagcggatacggagatgatctgctcggtttgatgcttgaggcatgcttcacgacagaacaaggagagaaacaagataagctggccctgaccatggatgagataatagatgagtgcaagacgttcttctttgcagggcatgagaccacatcccacttgcttacctggacaatgttcttgctcagcctgtatccggaatggcaggagcggctaagggaggaggttctgagagaatgcggaagggcaaatcctactgcagacatgcttagcaaattgaaagagatgacaatggtactccttgagacactaagactctatggccctgttttgaccatgctaaggaagcccatatccgacatgagactgggaagcctcagtatacctaaaggcactggaattataatacctattccatttctccaccgagacaaagaggtctggggtgaaaatgccaatgagtttgatccgttaaggtttgagaatgggatcacaaatgcagcaaagacgccacaagctcttctgtcattctcaataggaccaaggtcatgcatcggtcagaactttgcaatgttggaagcaaagtcattgatggccatgatcctgcagaaattctccttcacactttccccaaagtatgtgcatgcaccaacaaatcttataacacttcaaccgaagttcggtcttcccatagttttgaggccactggatgtataataatgttagatgattctgtatgtatcctatgaagctgaattatgatgtgtaaataaatatacatgtgtcagtattttgggacc

SEQ ID NO: 16095 - protein, 523 aa, Panicum virgatum
  misc_feature: Ceres CLONE 1787772
  misc_feature (44)..(517): Pfam Name: p450 Pfam Description: Cytochrome P450
  misc_feature: SWISSPROT Homolog: EC 1.3.3.9 Secologanin synthase
MAAPALLAAAALLALAAAWLWDYAVARHLLRPRAVGAVFRAQGVRGPPYRYLRGSNGDIRRMRMRAEADAAALDARDHDYLRRVLPHFLAWKDKYGAPLLHWFGPQPRICLFDYESVRQVLWNKSGHFAKTDAHPAILALLGKGLVLVDGADWVRHRRVANPAFAMDKLKIMATTMVTCAERLIRECEELASTSKSGEVEVEFSRHFQELTAEVISRTAFGSSYKEGKEVFHTQQQLLALALATLLNLQLPGFKYLPTKNNRLKWMLEKKMKTTLTAIIQPRLASKGSGYGDDLLGLMLEACFTTEQGEKQDKLALTMDEIIDECKTFFFAGHETTSHLLTWTMFLLSLYPEWQERLREEVLRECGRANPTADMLSKLKEMTMVLLETLRLYGPVLTMLRKPISDMRLGSLSIPKGTGIIIPIPFLHRDKEVWGENANEFDPLRFENGITNAAKTPQALLSFSIGPRSCIGQNFAMLEAKSLMAMILQKFSFTLSPKYVHAPTNLITLQPKFGLPIVLRPLDV

SEQ ID NO: 16096 - DNA, 2062 bp, Panicum virgatum
  misc_feature: Ceres CLONE 1787788
  misc_feature: Encodes the peptide sequence at SEQ ID NO. 16097
ctctctcctccgctagcggccagcctcgcgaacagacccgcctccggcgtccttccgccttccgccggtcggagaacgctagctacctcgaaggccctcgcactctcctgctttgccactccctggtgttgccggattgacgcggactagagatccatcctgacatggaattgaccccttttcctgattttgagattaaactccagaagttcagctaggcgcgcataacatttagctgttgctcaaccatggataactctcagaatcaaccattaccacctggtgttggaacatggccacaggcacctcccaatcacccgccacagttccattctggcccacagtcttatcattctccatttgacactagacctgacaatgctagtgccaacggtagtgatagtgcagcaaatattgagtcagctgtccaagaggctgttcttcacgcacaggacattgagacccagcaagtcatacaaaatcaaagacatgcaaacacaacaagtgaacctacaacctatggggaagacttactgtctaaccgccgtgaccctaatgcattgaaggaacacttgctaaagatgacagctgatcatcgtgcagagatggcaaacaaaagggggaagccacttcatccaaacaatggaaatgttgaaattggcaatggctatggtgtcccaggagggggtgcttattatgctgcaaacttgccaagtgctcaaatgaacaaacctagagatgaatctgataaagaaaaatgtggaaatgatctccctgattttttgaagcagaggttaagggcaaggggaattctcaaagatgagacaacaaataagaatagcacgggtacacagaaagtggattctcaagaaaaccagaacaaatctgtgcatgagttgcctcctggttgggttgaagcaaaggacccgacaaccggtgctccttatttctacaatcaaagcaccggagtgagtcaatgggatcgtcccgttggtgctgtgaacaccatgcaacatcaagtttcttcatccttgccagagaattgggaggagacaattgataaaacaacaggccacaaatactattataatacaaagacacaggccacacagtgggagcctcctacttctgtgaacaccattgttacacctcatgttcccaccaacactgcagtagagccagtcactcaaactgcagatatttgggactctcaaatgcagagatgttcaggctgtggtggttggggagttggtcttgtccaatcttggggatactgcaaccactgcacaagggttcaaaacctcccttttcaacaatatccatcttacacagacaatacggcgcactctggtaacaatggtaccagaactcaggggaatgttgcagctaaggacagatcaagctcaaaaccaccctctgggaaaccaaacagaaaagatcaccgcaaaagaaatcgccccgaggatgatgagcttgacccgatggacccaagttcttactcagatgctccacggggtggctgggttgttggtttgaagggtgtacaaccacgagcagcagatactactgcagctggacctttgttccaacaaagaccatatccctccccaggtgctgttttgaggaaaaatgcagaagtagcaacccacggcaagaaacgtggtggtatggctccgataacaaaaagaggagatggcagcgatgggcttggggaggcggattagtcttttgatgaactgaaattcttgtgcaatcagagtattttctgtggtttggtttctggagctgctgaaccatgggtgcagtgcagtatggagaaaatcaacagaattatgggcagccaattttcaggaagaaactgtgcagcagctagagtatatagtgaactcactggacctaagaggctacagtctacagagcagtccgctcaccccgttttgtagaggccattcactgtgccctggtttgcttggaatctgtaatttgtaagtggaaagagacaatatctcgtagtttacgcaatgttcctatagagataaggaatcaaattttccaaagagac

SEQ ID NO: 16097 - protein, 491 aa, Panicum virgatum
  misc_feature: Ceres CLONE 1787788
  misc_feature (217)..(247): Pfam Name: WW Pfam Description: WW domain
  misc_feature (262)..(292): Pfam Name: WW Pfam Description: WW domain
MDNSQNQPLPPGVGTWPQAPPNHPPQFHSGPQSYHSPFDTRPDNASANGSDSAANIESAVQEAVLHAQDIETQQVIQNQRHANTTSEPTTYGEDLLSNRRDPNALKEHLLKMTADHRAEMANKRGKPLHPNNGNVEIGNGYGVPGGGAYYAANLPSAQMNKPRDESDKEKCGNDLPDFLKQRLRARGILKDETTNKNSTGTQKVDSQENQNKSVHELPPGWVEAKDPTTGAPYFYNQSTGVSQWDRPVGAVNTMQHQVSSSLPENWEETIDKTTGHKYYYNTKTQATQWEPPTSVNTIVTPHVPTNTAVEPVTQTADIWDSQMQRCSGCGGWGVGLVQSWGYCNHCTRVQNLPFQQYPSYTDNTAHSGNNGTRTQGNVAAKDRSSSKPPSGKPNRKDHRKRNRPEDDELDPMDPSSYSDAPRGGWVVGLKGVQPRAADTTAAGPLFQQRPYPSPGAVLRKNAEVATHGKKRGGMAPITKRGDGSDGLGEAD

SEQ ID NO: 16098 - DNA, 1664 bp, Panicum virgatum
  misc_feature: Ceres CLONE 1787802
  misc_feature: Encodes the peptide sequence at SEQ ID NO. 16099
gatatgaatcgactggccatcacatttattcagacagataattacataagcatggccgctcaccttaaattgtttttcacccaactccttctcttgcttctttcctgttatgttaccgccgcagtgtctgatccttcttctcgtcaagaactattccacgaaacaagccagcatcctataccatacgaccttcagccagagctcttccccaacgagcggctctaccaagcctacctggccatccagcgtttcaagagcactatcactagtgaccccaagaacataacagcaacctggaccggccaagacatctgcggcgagaagacctacctcggcttctactgcgccacgctgccagggttagctgagaagctaacagtcacggaggttcttttgaatggatttggcctgcgcgcgcccaaattgcaaggcttcatcgatcagctcccggatatcgcgcttttccatgctgcctccaacaacttcggtggaaatatccctcaactcgacagactgccttacctgtaccagctcagtatatctaactacgacacccagcctttgcatccttctggtactaggggcgaatttacttcgggagctaatggaggatacggccaacgaccacaagtgtcatcaacacaatgcacaaataaggggtttcttcattttacatttcacatcagtgctggcaatgcgacttcaggaggcctcattccgggcattccgaatccaaggattccgggccttccagagcatccaaagtttccgggcataccgggcgccacggattctaaggcgctcctcctcaactacaacaacctgtccgggcaacttccggcgaacctcggcctctccaagttgagctacctcgccctcgccaacaacaggctcacggggccaatccctccgtcgatcgagcacctgcaagactccctcttcgagctcctcctcctcaacaaccagctctccggctgcctcccccacgagctcggcatgctccgcaaggcggccgtcatcgacgccggcatgaaccagctcaccggcccgatcccgtcatccttctcctgcctcagcagcgtcgagcagctcaacctcgccgggaaccgcctctacggcccggtgcccgacgcgctctgcaagcttgccgggcccgccgggcgcctcgccaacctcacgctgtccggcaactacttcacctccgtcgggccggcgtgcgcggcgctgatcaaggacggcgtcctcgacgtgaagaacaattgcatcccgggcctcgccaaccagaggcgcccggcggagtgcgcggcgttccagagccagcccaagacgtgcccggcggcgagcactccggtggcatgccccgccgcagctgcgaccaagggcgaggtggcgccgggggagaggaaggctagggactactccagctacgtgacctacgctactctgcatgagtgagcagcctcagctcggcatgcagtaggagacagatcgtctcggtggcgttttggctatttgttcttgtattcttatgtactagtaccgtgtgttggtgtgtttgtgattgctgtctattttctccgcacgtgttgctgtccagccgtccaggttgctgcacacctagatccatctttgtatccatttgagtgaaaaattgttgttgttgc

SEQ ID NO: 16099 - protein, 467 aa, Panicum virgatum
  misc_feature: Ceres CLONE 1787802
  misc_feature: SWISSPROT Homolog: EC 2.7.11.1 Non-specific serine/threonine protein kinase
MAAHLKLFFTQLLLLLLSCYVTAAVSDPSSRQELFHETSQHPIPYDLQPELFPNERLYQAYLAIQRFKSTITSDPKNITATWTGQDICGEKTYLGFYCATLPGLAEKLTVTEVLLNGFGLRAPKLQGFIDQLPDIALFHAASNNFGGNIPQLDRLPYLYQLSISNYDTQPLHPSGTRGEFTSGANGGYGQRPQVSSTQCTNKGFLHFTFHISAGNATSGGLIPGIPNPRIPGLPEHPKFPGIPGATDSKALLLNYNNLSGQLPANLGLSKLSYLALANNRLTGPIPPSIEHLQDSLFELLLLNNQLSGCLPHELGMLRKAAVIDAGMNQLTGPIPSSFSCLSSVEQLNLAGNRLYGPVPDALCKLAGPAGRLANLTLSGNYFTSVGPACAALIKDGVLDVKNNCIPGLANQRRPAECAAFQSQPKTCPAASTPVACPAAAATKGEVAPGERKARDYSSYVTYATLHE

SEQ ID NO: 16100 - DNA, 1657 bp, Panicum virgatum
  misc_feature: Ceres CLONE 1787817
  misc_feature: Encodes the peptide sequence at SEQ ID NO. 16101
ggcatcaaagaaaataatactggtgcctgctccacctcaccactccacgcgtttcatactctctctctctctctctctcatcaccatcggccgacctccctatctgctacatccctataattgtaccatagcattaccaaactttgctcctctctctagccatctcttcctttttcgttcctcacccacacgcacaaaccccggccggccctatacaagaatcatatgccatatgctagtcatgacctaatcacctagagatacatttctcatccaacaacaagaacaggcacagctctatcctcaattcagaagtgcctcagaagtcagaaacctgcaatggctgctactgctgctgccaccgatctctcgctccatatcagccctcctgggccggccgccgacgctgggaggagcagtggcggcgaggcgtgccaagagacacaaggattcttcgccaagccgaagctactatgtcttggacttgagacggcgacggcaacagagcaggatggccaatgcgacctccagcttcagcagcggctgcaccaacctagccagatccagaggttcaagaaaagctcgtcgtcgtcagcggcgttatccggaggcacgacgacgagatctgggaataatggcagcggcggcggtgggaagaggagctccagggcgccgaggatgaggtggacgacggctcttcatgcgcacttcgtgcacgccgtggagctcctcggcggccatgagagagcgacaccaaagtcagtgttggagctgatgaacgtgaaggatctcacactggctcatgtcaagagccacctgcagatgtatcgaacagtgaagggaacgacggcagacagatcatgtgctgcaggccaccatgtccagatgagagacatgggctttctgcagagggcttgtgaactgaatggctttgaagcgtttaaccacagtactctgaataccaggatgctggcatcatcagctgcagggtcgtcgtcgttgccggcagggaaacaggaggtcgcctggtgcctgcggccgcccttggcgcaccaaagcgagctgccgctgccgctcccctgcccctacctcatgtctgcccaccacaaccgctacttgctctcacaagatcatcatcatcagggatggcggagaggtgcgcagcaagaagctgcctcgcgcgtcctaggtcatcaggacgacaccactgcacggcgtctgcacgcaggccgtgctggcgacgcggccatcaggaggtcatcgtggagcgccgctggcgttgcgagccgctcgtcgtcgttgtcagcgacggcgcctttgccgtcgaccggcggcaccagaaggagcagcagcacagagcaggcatgctggatgatgaacaagcagcagcagcaggcgccatcatcaagggccatcgcggcaccgaacctggagatcagcctggggcggcaggggtggcaacttaacctgcaggatcagcagcagcgcggcggggagcccgccgcagcggcgaaagagctaacccttctcaagtgcctgtgacgttgatagctaattattagtctgtataatgatcgtttaatcatcagatcggttacatacataatttcgtcgaggatgagatgtgaaagcaattcatcgatcatcgatcgacatt

SEQ ID NO: 16101 - protein, 400 aa, Panicum virgatum
  misc_feature: Ceres CLONE 1787817
  misc_feature (113)..(164): Pfam Name: Myb_DNA-binding Pfam Description: Myb-like DNA-binding domain
  misc_feature: The sequence is a functional homolog of SEQ ID NO 1338 in the 10/374,780 US patent application
  misc_feature: The sequence is a functional homolog of SEQ ID NO 1459 in the 11/479,226 US patent application
  misc_feature: The sequence is a functional homolog of SEQ ID NO 208 in the 10/374,780 US patent application
  misc_feature: The sequence is a functional homolog of SEQ ID NO 590 in the 10/225,066 US patent application
  misc_feature: Useful for making plants with altered alkaloid content
  misc_feature: Useful for making plants with altered lignin content
  misc_feature: The sequence is a functional homolog of SEQ ID NO 2000 in the 11/479,226 US patent application
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
MAATAAATDLSLHISPPGPAADAGRSSGGEACQETQGFFAKPKLLCLGLETATATEQDGQCDLQLQQRLHQPSQIQRFKKSSSSSAALSGGTTTRSGNNGSGGGGKRSSRAPRMRWTTALHAHFVHAVELLGGHERATPKSVLELMNVKDLTLAHVKSHLQMYRTVKGTTADRSCAAGHHVQMRDMGFLQRACELNGFEAFNHSTLNTRMLASSAAGSSSLPAGKQEVAWCLRPPLAHQSELPLPLPCPYLMSAHHNRYLLSQDHHHQGWRRGAQQEAASRVLGHQDDTTARRLHAGRAGDAAIRRSSWSAAGVASRSSSLSATAPLPSTGGTRRSSSTEQACWMMNKQQQQAPSSRAIAAPNLEISLGRQGWQLNLQDQQQRGGEPAAAAKELTLLKCL

SEQ ID NO: 16102 - DNA, 1255 bp, Panicum virgatum
  misc_feature: Ceres CLONE 1787823
  misc_feature: Encodes the peptide sequence at SEQ ID NO. 16103
gaggaggagaaaacgagaagaccgtgcgggcgggcgtgcacgccgagaagccactgagcgaactgaccagccaggaaccgtactgaccccctctcgccggcgctgctcttccctcccccgatggccgccgcgacgatgcgggccgtgcagtacgacgccttcggcgggggcgccggcgcgccgcggacctcaagcttgtggaagttcccgtccctgcggcaaggaagaatgagcttctgttgaagctggaggcggcaagcatcaatccgctggactggaagctacagaaagggatgctacgccctttcctgcctcgcaaactgccttttatcccagtgactgatgtggcaggagttgtgattgatgtcggtccaggagtcaatggattcctggctggagattaagttgttgccatgctgaacatatcttatggaggtggacttgcggagtacgctgtagcatctgaaaatctgaccgtcaagaggcctcctgaggtgtccgctgctgaaggcgcagggctgcccattgctgctgtcactgcgctccaggctctgaggaccattggcgccaagttcgacggaactggcgagcctttaaatgtgctgatcactgcagcatccggtggtgtcgggctctatgccgtgcagcttgcgaagctggcaggtcttcacgtcaccgccacctgtggcgcgcgcaatgtggagctggtgaagagccttggcgcggatgaggtgctcgactacaggaccctggagggcgccagcctgcagagcccgtcagggaagaagtacgacggcgttgtccactgcacagtcgggatcagctggtcgacgttcgagcccgtgcttgccaacaccgggagggttgtcgacatcaccccgaacttcaccgccatcctaaagtcagtgctgcacagggtgacgttcgccaggaagcggctggtgcccctgctcctgtctcccaacaaggctgacctagagttcctggtcgggctgctgaaggacagcaagatgaagatgctgatcgactccaggttctcgctcaacgaagccagcaaggcttgggagaagagcatcgagggccacgccacaggcaagatcatcgtcgagatggaaggctgatcgggtataccgttatagcgttgatggacaagtagtagcaggtgtgtctgggtatggcttcgtcgtacaaaagaatattggtgaggaactaaggatagatgtacataggattgtgcttgtttcgttcttgtttc

SEQ ID NO: 16103 - protein, 235 aa, Panicum virgatum
  misc_feature: Ceres CLONE 1787823
  misc_feature (59)..(196): Pfam Name: ADH_zinc_N Pfam Description: Zinc-binding dehydrogenase
  misc_feature: SWISSPROT Homolog: EC 1.6.5.5 NADPH:quinone reductase
MLNISYGGGLAEYAVASENLTVKRPPEVSAAEGAGLPIAAVTALQALRTIGAKFDGTGEPLNVLITAASGGVGLYAVQLAKLAGLHVTATCGARNVELVKSLGADEVLDYRTLEGASLQSPSGKKYDGVVHCTVGISWSTFEPVLANTGRVVDITPNFTAILKSVLHRVTFARKRLVPLLLSPNKADLEFLVGLLKDSKMKMLIDSRFSLNEASKAWEKSIEGHATGKIIVEMEG

SEQ ID NO: 16104 - DNA, 1274 bp, Panicum virgatum
  misc_feature: Ceres CLONE 1787837
  misc_feature: Encodes the peptide sequence at SEQ ID NO. 16105
accgctcaccaccagtccaccaccgcaagctcgaggggccggcaggggaagcgcgagctcatcggctgagccgcagatggttccgcggctgcgggaggcctagcgtcgatcggcgatcgaggacagcacgcggcgtgccacatgttgagcgcgcagacggcggctagcagcagcagcaccagcagcggcgtcgtcgtcgaccgggagaggagcgtcgtcgtcgagcaggagaggcggcggcagccggtgggggaggacgaggaggaggaggagccggagttcagggacatccacgcgctgagcccgccgccgagccagccgccgtcgtaccgcagggggcgcggggagtcgtgggggtccgccgcgggcgggagcaggcacacgtcgatccgctccgtcgggagcgacaccgcccccagcgagcccttcccgactatgagcagggagttctcggccatggtcgccgcagcagccaccgccaccgccaccgccaacgccgccaacggggccgggagcaacgccgagagggacgtcgacgcgatggggaggatcggggagggcgaggagctggaggagaccaacccgctggccatcgtgccggacagcaaccccatcccgtcaccgcgccggggcccgccgacccccggcgcggacgcggcgctggccggcaccggcgcccacggccagggccaggccggggtgtcggtcgggcaggtgaagaaggaggaggtcgagtccaagatcgccgcgtggcagatcgccgaggtggccaaggtcaacaaccgcttcaagcgcgaggaggtcgtcatcaacggatgggagggcgaccaggtcgagaaggccagcgcctggctcaagaagtacgagaggaagctggaggagaagcgtgccaaggcgatggagaaggcgcagaacgaggtggccaaggcgcggcggaaggcggaggagaagcgcgcgtcggcggaggccaggcggggcaccaaggtggcgcgcgtgctggagctcgccaacttcatgagggccgtcgggagggcgccctccaccaagcgctccttcttctgaatccctcccggcctcgtcgtcttcagtcagaacttcctcagcctggtgctcgtcgccgccggtgcactcgttttgttagattgcatcgttcaccgcttcactacacgggatcagacagagtgatcagtgccgtgctagctgtgtggaacgcttgttttagtgttgtgtccacatgtatgatttgtaatgttatttctctctttttttccccc

SEQ ID NO: 16105 - protein, 306 aa, Panicum virgatum
  misc_feature: Ceres CLONE 1787837
  misc_feature (192)..(304): Pfam Name: Remorin_C Pfam Description: Remorin, C-terminal region
MLSAQTAASSSSTSSGVVVDRERSVVVEQERRRQPVGEDEEEEEPEFRDIHALSPPPSQPPSYRRGRGESWGSAAGGSRHTSIRSVGSDTAPSEPFPTMSREFSAMVAAAATATATANAANGAGSNAERDVDAMGRIGEGEELEETNPLAIVPDSNPIPSPRRGPPTPGADAALAGTGAHGQGQAGVSVGQVKKEEVESKIAAWQIAEVAKVNNRFKREEVVINGWEGDQVEKASAWLKKYERKLEEKRAKAMEKAQNEVAKARRKAEEKRASAEARRGTKVARVLELANFMRAVGRAPSTKRSFF

SEQ ID NO: 16106 - DNA, 2602 bp, Panicum virgatum
  misc_feature: Ceres CLONE 1787845
  misc_feature: Encodes the peptide sequence at SEQ ID NO. 16107
attcccgtcccctcgccgtcctcccaatccacacccacgcacccgcatccctccccctatttcgccgccgccgcagccatgtcgggttgggacgagggcgctgtgttctacagcgaccaggcacaattcccccgcggcggccctggcggcgacccagccgccgacctcagccgccactctgctctccgcaagttcaaggagttcctccgcggcttcaccggccccaccggcgacttcccctaccgtgagagcctggtacacaaccgcgaccatgtcaccgtcgccatcgaggatctcgatgccttcgatgccgagctctccgacaagatccgcaagtcgcccgccgattatcttccattgtttgagacggctgcagccgaggttctcgcaagcctccgttcgaaggtcgccggcgagaccggggagatggaggagcccgtcaccggagatgttcagatcttcctctcctccaaggagaattgcctgtccatgagatctattggggcagattacatgtcgaagctggttaagattgcgggaattgcaattgctgcatccagagtgaaagccaaggccacccatgtaactcttctctgcaagaactgccggagtgtcagaacagtgtcttgcaggccaggcctcggtggggctattgttccacgatcgtgtcatcatgttcctcagcctggagaagaaccttgccccctggacccctggattcctgtcccagataagagcaagtatgtggatctccagaccctcaaattgcaggagaatcccgaggatgttccaactggtgagcttcctagaaatatgcttctgtctgtagataggcaccttgtacagaccattgttccagggactagattaactgttgttggcatctacagcgtctaccaagcatccgcaaaccagaagggcgctgttggtgttaaacagccatacattagagttgttggtttggagcaatctcgagacaataactcaaatggaccctccaatttcactctcgacgaggaaatggaattcaaagaatttgcacagaggccagatgcatatgccaagctttgctcaatgattggcccttcaatttatggtcattctgatgtcaagaaagctattgcatgcttgttatttgggggatctaagaagaggctacctgatggtgtacgtttgagaggggacattcatgtcttgcttctgggtgatccatccacagcaaaatcacagttcctcaaatttgtagagaagacagctcctattgcagtctatacatctggaaaaggttcctctgctgctggtctcacggcatctgtaacgcgggatagtagctcgcgtgagttttatttggaaggaggggccatggttttggctgatggtggagttgtttgtattgatgaatttgacaagatgaggcctgaagaccgagttgcaattcatgaagccatggagcaacagacaatatctattgccaaagctggcattacaacagtactcaattcaaggacttcagttcttgcagctgccaatccaatttcaggacgttatgatgatcttaagactgcacaagataacattgatctgcagacaaccattctttctagatttgatctaatctttattgtaaaagatatcagaatgtatgatcaagataagcgaatagcaagccacattatcaaggtgcatgccagtggtgctgctgcttcatccaagaacacagaggcaagtgaagaagaaaattggctgaaaaggtacattgagtactgccgtgctacttgcaaaccacggctttcagaaaaagccgctgagatgctgcgaaacaaatatgttgagattagacagaaaatgagacagcaagctcacgagacagggagggctgcagcgatacccattactgtgaggcagcttgaagccatcatacgtttgagtgaatctcttgcaaagatgagattgacaagtgtggccacaccagagcatgttgaagaggcattcagactattcaacgtttccaccgttgatgctgcaagatctggaatcaacgagcatttgaacttgtcaccagagattgcaaacgaaatcaagcaagcggaggcacaaataaaaagaagaatgggtattggaagccacatatctgagcgacggctgattgatgagctaactaagatggggatgaatgaatccattatcagaagagcccttctgatcatgcatcaaagggacgaggtcgagtacaagagggagcgccatgtgatcgtccgaaaggcttgatggtgggtgggtggagaatgcgcatcaatgacatggaaggcgtcctctctactgctgtgtgtataccgtcactgaaactgcaacccgttccggggaggaggacgaggcacgcaggctccgcagaaggatgaatgaatgaagttctggcctgcgaggagatggcaagatgtgatcctaattatccagtgtgactgacaatgtaggcgcttagctttggaaccaaggctctgaacctgtactacttactataacaccgttcatggttgcaaagcttgttttctgcatcacaattcacaactcgatgtgttgaagaatcaggccatgctttcccagc

SEQ ID NO: 16107 - protein, 729 aa, Panicum virgatum
  misc_feature: Ceres CLONE 1787845
  misc_feature (313)..(646): Pfam Name: MCM Pfam Description: MCM2/3/5 family
MSGWDEGAVFYSDQAQFPRGGPGGDPAADLSRHSALRKFKEFLRGFTGPTGDFPYRESLVHNRDHVTVAIEDLDAFDAELSDKIRKSPADYLPLFETAAAEVLASLRSKVAGETGEMEEPVTGDVQIFLSSKENCLSMRSIGADYMSKLVKIAGIAIAASRVKAKATHVTLLCKNCRSVRTVSCRPGLGGAIVPRSCHHVPQPGEEPCPLDPWIPVPDKSKYVDLQTLKLQENPEDVPTGELPRNMLLSVDRHLVQTIVPGTRLTVVGIYSVYQASANQKGAVGVKQPYIRVVGLEQSRDNNSNGPSNFTLDEEMEFKEFAQRPDAYAKLCSMIGPSIYGHSDVKKAIACLLFGGSKKRLPDGVRLRGDIHVLLLGDPSTAKSQFLKFVEKTAPIAVYTSGKGSSAAGLTASVTRDSSSREFYLEGGAMVLADGGVVCIDEFDKMRPEDRVAIHEAMEQQTISIAKAGITTVLNSRTSVLAAANPISGRYDDLKTAQDNIDLQTTILSRFDLIFIVKDIRMYDQDKRIASHIIKVHASGAAASSKNTEASEEENWLKRYIEYCRATCKPRLSEKAAEMLRNKYVEIRQKMRQQAHETGRAAAIPITVRQLEAIIRLSESLAKMRLTSVATPEHVEEAFRLFNVSTVDAARSGINEHLNLSPEIANEIKQAEAQIKRRMGIGSHISERRLIDELTKMGMNESIIRRALLIMHQRDEVEYKRERHVIVRKA

SEQ ID NO: 16108 - DNA, 1808 bp, Panicum virgatum
  misc_feature: Ceres CLONE 1787860
  misc_feature: Encodes the peptide sequence at SEQ ID NO. 16109
ctcttctccaccacgttcttccttcctttcgaaagaaaaaaaaaagaaactgttcttcagttgttcgtcggtgacgcaagtgtctgacgactccgatggttctgtccaggttctgatttttttgtcagggccgtcgcgagcagggctatgctatccgatctgatcgtcatctgaagtaacctccgggcgcgcagccgacgatgggtgcgccgagttctttcgtgctcgccgtgttgaccctcctccactctgtttctgccatggccggctgctccgccgcggatctgccggcggcgcagcctagccaccggaggctgctccaggacaccaatctcgctgcgcgtccggaggcaaatattcctgagccggctgctgctcgcgttccttctcaggggagcggctcgtttcgggcaccgaaaaaggtagcgccgccggctgctgctgctgggagttctccgcatcgcccggccccgtccaagtcccattatttgttgacatccatgaggtggctctacttgattgttcttccggcggctggcctgctgttgcttgctggaatagcttgttggcttttgccatgccgcaagagtgcggttgcaaccataggcccttggaagacgggactcagtggccagctgcagaaggcattcgtcacaggagtaccgaaattgcagagatcggagctggaacgtgcctgtgaggacttcagcaacattataacatgttatccacactacactgtctacaagggaacactgtcatctggtgttgagattgctgtggtatccactatgattacatcaagcaaggagtggtcagagcattcagagagctgtttcaggaaaaagatagacacgctgtcgcgaataaaccataaaaacttcatcaacctgcttggcttttgtgaggaggaggaacctttcaccaggatgatggtgcttgaatatgcagcgaatgggacactttatgagagtcttcatgctgaggactttgagtacatcggttggcgaggtaggatgcggattatcatggggctagcatactgcatccaacacatgcatgagctcaatcctccagtggcacaccctgacctgcagtccagttccatactgctctctgaagatggtgctgcaaagattgttgacatgagcgtttggcatgaactgatttccaaagggaaagcgccgacagacggtgagcttggccctcaccatgaacaagtgtctgctgccctggctgggaatgtatatagctttggcgttctacttcttgaaatcatctcggggaagcttcctgaccctgcacacgaccgatccctcgtcagcttggctctggagtgcattaacaacggtgaccggagtttagtctctctgcttgatcctacactaaatgatcacaaggaagatgagctagcgatcatcggcaaggtgatccacgcttgcatccagagcgatccgagaaacaggccgagcatgagggagatcactgacaggctgagggatgccataggcatctcgccggtcgctgcgacgccgaggctgtctccgctctggtgggcagagctggaggtcctttcgaccgcggaagcaggctaataattggcaagagccaagaagggacgatgaccatcgtctgatcagatgtgttctgaagaaagaaaaccactctgcaggctgcgcatgtctcactgctgaaaatgtaaaagagcaaattgtaggaatagtaatcctcatggatgcttggtagtatgtagtagtacctttccctgcatcatcatgtgcctgaacttctgaaggtcatctcatatc

SEQ ID NO: 16109 - protein, 464 aa, Panicum virgatum
  misc_feature: Ceres CLONE 1787860
  misc_feature (180)..(432): Pfam Name: Pkinase_Tyr Pfam Description: Protein tyrosine kinase
  misc_feature: SWISSPROT Homolog: EC 2.7.11.1 Non-specific serine/threonine protein kinase
MGAPSSFVLAVLTLLHSVSAMAGCSAADLPAAQPSHRRLLQDTNLAARPEANIPEPAAARVPSQGSGSFRAPKKVAPPAAAAGSSPHRPAPSKSHYLLTSMRWLYLIVLPAAGLLLLAGIACWLLPCRKSAVATIGPWKTGLSGQLQKAFVTGVPKLQRSELERACEDFSNIITCYPHYTVYKGTLSSGVEIAVVSTMITSSKEWSEHSESCFRKKIDTLSRINHKNFINLLGFCEEEEPFTRMMVLEYAANGTLYESLHAEDFEYIGWRGRMRIIMGLAYCIQHMHELNPPVAHPDLQSSSILLSEDGAAKIVDMSVWHELISKGKAPTDGELGPHHEQVSAALAGNVYSFGVLLLEIISGKLPDPAHDRSLVSLALECINNGDRSLVSLLDPTLNDHKEDELAIIGKVIHACIQSDPRNRPSMREITDRLRDAIGISPVAATPRLSPLWWAELEVLSTAEAG

SEQ ID NO: 16110 - DNA, 701 bp, Panicum virgatum
  misc_feature: Ceres CLONE 1787866
  misc_feature: Encodes the peptide sequence at SEQ ID NO. 16111
acaaaaacatttctcccccttcggccgctgcctcccctttccgccttccttccccctttccccctccctccttctagggtttcccccgccgccgccgctcgatccgaggcagatgccgcccgcagccatggcgccgccgccgccgccccaggcaccgtccaactcaggggatccactctacccggagctctggcgcgcctgtgccggcccgctcgtcaccgtcccgcgccccggtgacctcgtcttctacttcccgcagggccacatcgagcaggtggaggcgtccatgaaccaggtcgccggaaaccagatgcgcctctacgatctgccctccaagctgctctgccgggtgctcaacgtcgagctcaaggcggagacggagaccgacgaggtctacgcgcagatcatgctcatgccagagcccgagcaaaacgaggtgccgtctgagaaggcgagttctggggccgccgccacgccgaggccagccgtcaggtccttctgcaagactctcaccgcgtccgacaccagcacacacggtggcttctctgtgctgcgccgccacgctgacgagtgtctccctcccctggatatgacccagtcacctccaacacaagagcttgtggcgaaggatctgcatggcatggagtggcgcttccgacacatcttttcgtgggcaacctaggaggcatctcttccagagt

SEQ ID NO: 16111 - protein, 189 aa, Panicum virgatum
  misc_feature: Ceres CLONE 1787866
  misc_feature: The sequence is a functional homolog of SEQ ID NO 108 in the 10/225,066 US patent application
  misc_feature: The sequence is a functional homolog of SEQ ID NO 296 in the 10/412,699 US patent application
  misc_feature: The sequence is a functional homolog of SEQ ID NO 692 in the 11/479,226 US patent application
  misc_feature: The sequence is a functional homolog of SEQ ID NO 84 in the 10/374,780 US patent application
  misc_feature: Useful for making plants with modulated seed size
  misc_feature: Useful for making plants with modulated biomass
  misc_feature: The sequence is a functional homolog of SEQ ID NO 298 in the 10/412,699 US patent application
  misc_feature: Useful for biocontainment applications
  misc_feature: Useful for making plants with modulated flowering time
  misc_feature: The sequence is a functional homolog of SEQ ID NO 300 in the 10/412,699 US patent application
  misc_feature: The sequence is a functional homolog of SEQ ID NO 1001 in the 10/666,642 US patent application
  misc_feature: The sequence is a functional homolog of SEQ ID NO 1621 in the 10/374,780 US patent application
  misc_feature: The sequence is a functional homolog of SEQ ID NO 1654 in the 10/412,699 US patent application
  misc_feature: The sequence is a functional homolog of SEQ ID NO 1003 in the 10/666,642 US patent application
  misc_feature: The sequence is a functional homolog of SEQ ID NO 1623 in the 10/374,780 US patent application
  misc_feature: The sequence is a functional homolog of SEQ ID NO 1656 in the 10/412,699 US patent application
  misc_feature: The sequence is a functional homolog of SEQ ID NO 1004 in the 10/666,642 US patent application
  misc_feature: The sequence is a functional homolog of SEQ ID NO 1624 in the 10/374,780 US patent application
  misc_feature: The sequence is a functional homolog of SEQ ID NO 1657 in the 10/412,699 US patent application
  misc_feature: The sequence is a functional homolog of SEQ ID NO 576 in the 10/666,642 US patent application
  misc_feature: The sequence is a functional homolog of SEQ ID NO 696 in the 11/479,226 US patent application
  misc_feature: The sequence is a functional homolog of SEQ ID NO 202 in the 10/225,066 US patent application
  misc_feature: The sequence is a functional homolog of SEQ ID NO 2342 in the 10/374,780 US patent application
  misc_feature: The sequence is a functional homolog of SEQ ID NO 286 in the 10/412,699 US patent application
  misc_feature: The sequence is a functional homolog of SEQ ID NO 224 in the 10/666,642 US patent application
  misc_feature: The sequence is a functional homolog of SEQ ID NO 278 in the 10/374,780 US patent application
  misc_feature: The sequence is a functional homolog of SEQ ID NO 830 in the 10/225,066 US patent application
  misc_feature: The sequence is a functional homolog of SEQ ID NO 894 in the 10/412,699 US patent application
  misc_feature: The sequence is a functional homolog of SEQ ID NO 1424 in the 10/666,642 US patent application
  misc_feature: The sequence is a functional homolog of SEQ ID NO 1826 in the 10/412,699 US patent application
  misc_feature: The sequence is a functional homolog of SEQ ID NO 2070 in the 10/374,780 US patent application
  misc_feature: The sequence is a functional homolog of SEQ ID NO 100 in the 10/666,642 US patent application
  misc_feature: Useful for making plants with modulated light quality sensitivity
MPPAAMAPPPPPQAPSNSGDPLYPELWRACAGPLVTVPRPGDLVFYFPQGHIEQVEASMNQVAGNQMRLYDLPSKLLCRVLNVELKAETETDEVYAQIMLMPEPEQNEVPSEKASSGAAATPRPAVRSFCKTLTASDTSTHGGFSVLRRHADECLPPLDMTQSPPTQELVAKDLHGMEWRFRHIFSWAT

SEQ ID NO: 16112 - DNA, 666 bp, Panicum virgatum
  misc_feature: Ceres CLONE 1787866-R
  misc_feature: Encodes the peptide sequence at SEQ ID NO. 16113
atttgagggtgaattggtatctgctaacaagaattggcagattgtctacactgacaatgagggtgatatgatgcttgtgggagatgacccgtgggaagaattctgcagcatagtgcgcaagatctacatttacacaaaagaggaggtccagaagatgaactcgaaatcatctgccctgagaaaggaagaacctctagcatctggtgaagtatgtgcggccacaaatgaggacttgtagacctgcggcaagcagtttagataactaggtcgtgtgaaggaaggtgacgatgcatgaagaggatcttgcattgtgctggggtacctggccaagtaacacctcaaatcttttgcgtctgttgcaacccatcccatccgtttgggtttagtagggagtgcagacctgtcgatttacttccccgcggtttgctcttggcagaatgtttaagcgccaaggttattatttcgttattgctgatctgctctcccccctttggatgtaaatatttgtcgacccagtccagtagtagcaagcggtagcaagtaccttgtattaaccagctatttgcggcttttaatccctgtaagttagctctgtagcgcgagataaatggcaaacactggtatatgtatgtctgatcttctcactgcatgtcttatcagagtcac

SEQ ID NO: 16113 - protein, 78 aa, Panicum virgatum
  misc_feature: Ceres CLONE 1787866-R
  misc_feature: The sequence is a functional homolog of SEQ ID NO 108 in the 10/225,066 US patent application
  misc_feature: The sequence is a functional homolog of SEQ ID NO 296 in the 10/412,699 US patent application
  misc_feature: The sequence is a functional homolog of SEQ ID NO 692 in the 11/479,226 US patent application
  misc_feature: The sequence is a functional homolog of SEQ ID NO 84 in the 10/374,780 US patent application
  misc_feature: Useful for making plants with modulated seed size
  misc_feature: Useful for making plants with modulated biomass
  misc_feature: The sequence is a functional homolog of SEQ ID NO 300 in the 10/412,699 US patent application
  misc_feature: Useful for biocontainment applications
  misc_feature: Useful for making plants with modulated flowering time
  misc_feature: The sequence is a functional homolog of SEQ ID NO 2380 in the 10/374,780 US patent application
  misc_feature: The sequence is a functional homolog of SEQ ID NO 962 in the 10/225,066 US patent application
FEGELVSANKNWQIVYTDNEGDMMLVGDDPWEEFCSIVRKIYIYTKEEVQKMNSKSSALRKEEPLASGEVCAATNEDL

SEQ ID NO: 16114 - DNA, 1921 bp, Panicum virgatum
  misc_feature: Ceres CLONE 1787876
  misc_feature: Encodes the peptide sequence at SEQ ID NO. 16115
cacgccagccacgcccctcctcaactcgatcaaaccgcgcacggaaaaccccaccgaaattccccaaaaattcagattccaccagcaatctcgaacccccgatgctggcggcctccatcagctccctccccctcgcctccagcgcatgagcttcctccgcgcgctcgcggacaccttctcctcgctgctcttctcgccgggaggcggggcgcccatggacgcggcgggggcggcgccgtcgccggcgtcggtggttggggagcgcgtggcggtgaagctccggggctacttcgagctcgccaaggaggagatcgacaaggccgtgcgcgccgaggagtgggggctccccgacgacgccaccgcgcactatcgcaacgcgctgcgcgtcatgctcgaggccaaggccgcgcgggtccccgacgccgtctcctccagcgagagggggcaggtcagggtgtaccaggagaagatcgccaagtggcaggcgcaggtcgaggagcgactcagagtgcttggccagagaagtggcgaaggagctgctgcttcagcagtgccaaagaaggttgttgcaagtaatcctagtaataggacagcaaaaccagcaccaagtagcatccaaaggtctactttgcagaatagccctaccttcaacagaggtggccaagcatctacacatcagaggattagcagcggaggttccaaacctgttcaaaaggctggtgcaagctatgatgacaagcttgttgaaatgattaatacaaccattgtggacagaagccctgctgttaaatgggatgatgttgctggtctcgataaggctaagcaagcactcatggaaatgattattttgcctactaaacgaagggatttattcaccggacttcggagacctgctagaggtttgcttctctttggtccacctgggaatggaaaaacaatgcttgctaaagctgttgcttcagaatctgaagcaacattttttaatgtttcggcttcttcattgacatcaaagtgggtaggagaagctgaaaagcttgtacggacacttttcatggttgctattgataggcaaccatcagttatttttatggatgagattgatagcgtcatgtctacaaggttagctaacgagaatgacgctagcaggcgcttgaaatctgaattccttatccagtttgatggggtgtcctcgaacccagatgatttggtaattgttataggggctactaataaacctcaagagttggatgatgctgttcttcgaagactggtaaagagaatctatgtgccactacctgatccaaatgtacggaggttacttctgaaaaatcagctcaaaggacaagcatttaaattgtccaattatgattttgaaagacttgctgtggagactgaaggatattctggaagtgacctgagagccttgtgcgaggaagctgcaatgatgccaataagagaacttggtccgcagaatattcttactgttaaagcaaatcagttgcggcctttgaggtatgatgacttcaagaacgccatgactgtgattaggccaagcttgcagaagagcaaatgggacgagctggagaagtggaacgaggagtttggttcgagctgacaatgacgcgcaccgtctggtgatcactcaaaaccccagttcgattgatttgtatatgattccctcgacatgatggctttacacaagtggccactctgcttacccttgcgtgatccgcccacattggatacgacacgatacgactatacaggcacaagtctgttgtctcttgtctgtagctatgtaaatgctgcaagaaaatacagctgctcgatcgggccgagggcagattaaagttgtcatcatggtgtaaaaagaaacaatgatttataactttaaaacaaggcaagaatgaggtttcactgg

SEQ ID NO: 16115 - protein, 489 aa, Panicum virgatum
  misc_feature: Ceres CLONE 1787876
  misc_feature (252)..(437): Pfam Name: AAA Pfam Description: ATPase family associated with various cellular activities (AAA)
  misc_feature (48)..(123): Pfam Name: MIT Pfam Description: MIT (microtubule interacting and transport) domain
  misc_feature: SWISSPROT Homolog: EC 3.6.4.3 Microtubule-severing ATPase
MSFLRALADTFSSLLFSPGGGAPMDAAGAAPSPASVVGERVAVKLRGYFELAKEEIDKAVRAEEWGLPDDATAHYRNALRVMLEAKAARVPDAVSSSERGQVRVYQEKIAKWQAQVEERLRVLGQRSGEGAAASAVPKKVVASNPSNRTAKPAPSSIQRSTLQNSPTFNRGGQASTHQRISSGGSKPVQKAGASYDDKLVEMINTTIVDRSPAVKWDDVAGLDKAKQALMEMIILPTKRRDLFTGLRRPARGLLLFGPPGNGKTMLAKAVASESEATFFNVSASSLTSKWVGEAEKLVRTLFMVAIDRQPSVIFMDEIDSVMSTRLANENDASRRLKSEFLIQFDGVSSNPDDLVIVIGATNKPQELDDAVLRRLVKRIYVPLPDPNVRRLLLKNQLKGQAFKLSNYDFERLAVETEGYSGSDLRALCEEAAMMPIRELGPQNILTVKANQLRPLRYDDFKNAMTVIRPSLQKSKWDELEKWNEEFGSS

SEQ ID NO: 16116 - DNA, 1582 bp, Panicum virgatum
  misc_feature: Ceres CLONE 1787882
  misc_feature: Encodes the peptide sequence at SEQ ID NO. 16117
  misc_feature (267)..(267): n is a, c, t, g, unknown, or other
atctgcagatcccccaccgactgccccctcccccaggccgccgcctccattaatagccgccaccaagaaccctccaaccccctcctgacctccctcccgactcgcctccgtcgccgtccgttccccacgccctctgcctgtacgttcttggtcggcctaaaggaaggaggaagcgaagggtgggggtggggcgaaccggttggggccaggccatcgatgctgagctcggcatcctcggcgggggcggggatgggggtggggggaggntacccgccgccgcagcgcggggcggcggtgttcaccgcggcgcagtgggcggagctggagcagcaggcgctcatatacaagtacctcatggccggcgtcgccgtcccgcccgatctcctcctccccgtccgccccagcccccattccgccgccgccgccttctccttcgccagccccggcgccgccgcgtcacctttctaccatcaccaccacccgtccctgagttactacgcgtactacgggaagaagctggacccggagccgtggcggtgccgccgcaccgacggcaagaagtggcggtgctccaaggaggcgcaccccgactccaagtactgcgagcgccacatgcaccgtggccgcaaccgttcaagaaagcctgtggaatccaagaccgcctcgcctgcgcatccgtcgcagcagccccagttgtccaccgtgacaacgaccacccgcgagaccgcgcccattgactccctcaccgtggggggtaaaactcatggcctgtctctcggtggggctggctcatcgcagcttcacgtcgatgcttcgaatgctcattatcgttatggcagcaagtaccctcttggagctaaagctgatgctggcgaactgagcttcttctccggagcatcaggaaactccaggtgcttcactattgattccccaacagaaaactcatggaactccctgccgtccaatgtgcccccatttacactgtcaaagagtagagattctggtctcctgcctggtacctactcctattcccaactggagccgccacaggagcttggccaggtcaccatcgcctccctgtcccaggagcaggagcgccactctttcagcagcggagctggtgggttgctaggaaatgtgaagcaggagaaccagccgctgaggcccttcttcgatgagtggcctgggacgcgggattcatggtcggagatggacgacgcaaggtccaataggacctctttctcaacgactcagctctcaatctccatcccaatgcccagatgcgattgagaagctcgtgctgcctcaaggtggggttgtgtgacgtgcatcaggcattgtactcgccgttagcgagtcgttcacccggagaatgatcagccatggcgtgcctgcgctcccccgaactatttctttcactgtatcgcactaagagctctttgtaagagcaggctcccttatggatcaatggagcccatagaactcattcttgttttttaaggtattaccacgctttgtattgtatccggacccaggaccgtcagttgtcgattgcagtagatgatgcaagtgtttgtgtgct

SEQ ID NO: 16117 - protein, 357 aa, Panicum virgatum
  misc_feature: Ceres CLONE 1787882
  misc_feature (102)..(147): Pfam Name: WRC Pfam Description: WRC
  misc_feature (26)..(62): Pfam Name: QLQ Pfam Description: QLQ
MLSSASSAGAGMGVGGGYPPPQRGAAVFTAAQWAELEQQALIYKYLMAGVAVPPDLLLPVRPSPHSAAAAFSFASPGAAASPFYHHHHPSLSYYAYYGKKLDPEPWRCRRTDGKKWRCSKEAHPDSKYCERHMHRGRNRSRKPVESKTASPAHPSQQPQLSTVTTTTRETAPIDSLTVGGKTHGLSLGGAGSSQLHVDASNAHYRYGSKYPLGAKADAGELSFFSGASGNSRCFTIDSPTENSWNSLPSNVPPFTLSKSRDSGLLPGTYSYSQLEPPQELGQVTIASLSQEQERHSFSSGAGGLLGNVKQENQPLRPFFDEWPGTRDSWSEMDDARSNRTSFSTTQLSISIPMPRCD

SEQ ID NO: 16118 - DNA, 2785 bp, Panicum virgatum
  misc_feature: Ceres CLONE 1787890
  misc_feature: Encodes the peptide sequence at SEQ ID NO. 16119
atttcctcccccaggtcgcggtctcctccccccacagtggttccccttcccctccctcccttcgctcccttttttccccgtcgccggcggcgacagggttccgttttccttgccccggcgggctgtagatgcttccggccctcaccggcgccccagatccggcggtcgctgcactgctctccgtgcttctggtcctggttcgagtgggaggggaaggggtagtccctttggcggtcgtgggagattccgagacatgcctgcgttctgcgcctacggagatggcgggtgcctcgtctcggcgccggcggagctctccgggctcttcctccgcggcggcgccgtgcagcggcggaagcgcgcgctggtggccgcgtccgcggtcgccgcggcggccgcggagtgcgtgagggccgccaagaaacagaggcagcagctgccgctgccgtcgctcaacgctctccccgacgagtgcctcttcgagatcctgcgccgcgtgcccggcggccgcggccgcggcgcctccgcccgcgtctcccgccgctggctcgcgctcctcggcagcatccgggcctccgaggtcgctcaggctgcggccaccccggctctgcccgaccttaacgaggagttcgtcatggaggaggaggaggacgagacccccgcggctccatgcgccgagagggtgctcgagggcaaggaggccaccgacgtccgcctggccgccatggccgtcgtcgccggatctcgcggcgggctggacaagctcgccgtccgcggcagccacccgacccgtggcgtcacggaccaggggctctcggcggttgcacgcggcagccctaacctcagatcgctcgccctatgggatgtgcctcttgtcagtgatgcggggcttgcggaggtcgctgccgggtgcccctcgctggagcgtctggacatctctcgctgcccccttatcacagacaagggcctcatcgccgtcgcccaggggtgccccaacttggtgtctctgaccatcgaggcatgctccggtgtgggcaacgagggcctcatggcgattggccgctgctgcagcaagctgcaagcggtcaacatcaagaactgcgctgatgttggtgaccagggcatctccagcctggtgtgctctgctactacctcgcttgccaagatccggctccaggggttgaacatcactgatgcttcgcttgctgtgattgggtactacgggaaggctgtcactgaccttacacttgctcgtctcgctactgttggtgagaggggtttctgggtgatggctaatgcagctggtctgcagaatctcaggtgcatgagtgttacctcttgccctgggatcaccgattttgctctctcttctattgccaaattctgcccgagcttgaagcagctttgcctcaggaagtgtggacatgtgtcagatgctggccttacagctttcacagaatcagcaaaggtgtttgagaacttgcagcttgaggaatgcaaccgggttactcttgtcggtattctttctttcctccgcaactgcagccagaagttcagggctatctctttggtgaaatgcatgggaatcaaggatatctgctctgcgcctgcacagcttcctctctgcagatcacttcgtttcctgacaatcaaggattgcccagggttcactgatgcaagcttggctgtggtggggatgatttgccctcagctggagcaggttgacctgagtggtcttggtgaggtcactgacagtgggcttcttcctctgatccagtcttcggaagctggtctgatcaaggttgatttgagtggttgcaagaacatcacagatggtgctgtttcctccctggtgaaggcacatggaaaatctctgaagaaagttagccttgagggttgcagcaagataacagatgttagcctcttcgccatatcagagagctgcactgagctttccgagcttgatctttcaaactgcatggttagtgactatggtgtggccgtcctgtcatccgcaaggcacctcaagcttcgtgttctctcactgtctggatgctctaatgtcactcagaagagtgtgccatacttgggcaacctgggccagtctctagagggcctcaaccttcaattctgcaacatgattggcaaccacaacgttgcatcgctggagaagaagctctggtggtgtgacatccttgcttaggcagacaagatggtccgttgctggaggggctcatgtctgctgagagccgcttccagatgcagatatacgtccgtagcagtagcacaaccaggtgttcttcagttttttggctcgcatgcgagtcatgatggtgggcttccgcattgttcaaggaccggttgttttaggggttgctttctagccgagtgctcgtttttcacagatcacctcacaggaggtcaatctgttttttgagccttggctgccatcactggcaccctgcctctcgatccagacactggtccttgccattatagtaaggttttttaggctgccgtagtgtccaagtcctttttcgttttactgcttcctggttatgaagttgctggcatatccattggcagctctggagtatcaccattccaccagcaatgttgacggaggacatcattttcagagcagagctgccgatgctggagcgtctgtgaactttgtgcagtgtgtttggttatggagtttgagtctgttggagtcttgtgtgttgtgtgctgttctctgtggtttgtaaggtcatgtagggttgcatcttttttacagtctctttgg

SEQ ID NO: 16119 - protein, 648 aa, Panicum virgatum
  misc_feature: Ceres CLONE 1787890
  misc_feature: SWISSPROT Homolog: EC 1.14.11.27 [Histone H3]-lysine-36 demethylase
MPAFCAYGDGGCLVSAPAELSGLFLRGGAVQRRKRALVAASAVAAAAAECVRAAKKQRQQLPLPSLNALPDECLFEILRRVPGGRGRGASARVSRRWLALLGSIRASEVAQAAATPALPDLNEEFVMEEEEDETPAAPCAERVLEGKEATDVRLAAMAVVAGSRGGLDKLAVRGSHPTRGVTDQGLSAVARGSPNLRSLALWDVPLVSDAGLAEVAAGCPSLERLDISRCPLITDKGLIAVAQGCPNLVSLTIEACSGVGNEGLMAIGRCCSKLQAVNIKNCADVGDQGISSLVCSATTSLAKIRLQGLNITDASLAVIGYYGKAVTDLTLARLATVGERGFWVMANAAGLQNLRCMSVTSCPGITDFALSSIAKFCPSLKQLCLRKCGHVSDAGLTAFTESAKVFENLQLEECNRVTLVGILSFLRNCSQKFRAISLVKCMGIKDICSAPAQLPLCRSLRFLTIKDCPGFTDASLAVVGMICPQLEQVDLSGLGEVTDSGLLPLIQSSEAGLIKVDLSGCKNITDGAVSSLVKAHGKSLKKVSLEGCSKITDVSLFAISESCTELSELDLSNCMVSDYGVAVLSSARHLKLRVLSLSGCSNVTQKSVPYLGNLGQSLEGLNLQFCNMIGNHNVASLEKKLWWCDILA

SEQ ID NO: 16120 - DNA, 2343 bp, Panicum virgatum
  misc_feature: Ceres CLONE 1787905
  misc_feature: Encodes the peptide sequence at SEQ ID NO. 16121
accgatcggggtgagaaccaagaaagcaaggggggaaaccgctcggcgcttcggcagcacgcagacacctcccgggcagcatgattgctcccggcccccggcgtctgctcctcctgccggtcgcactcctcctcctcctcgtcgccgccgcgggcggcgccttcctgccgcggtcgccggcggccgcggagggggcgaagaaggtctccctggtgctctactacgagtcgctgtgcccctactgctcgcggttcatcgtgaaccacctcgccgggatcttcgaggacgggctcatcgacgccgtggacctccggctcgtcccctacggcaacgcccgcgtcgggtccaatggcgacatctcttgccaggtaaaaactgaggcccaatccaacgtttctccagtgttttttttcctttttctgaaacttaaaaagccttaatgaatcagtcaactactgctaataacttgtttgtaggctgcagcggtgcagcctatgatcaatttctgctgctagtattaccatgggtaactgggtgtgggtgtttaggttacgtgttgtctgtgtctctgtggggtgggggttactacaggatttgcgcactcggtagtgaatatgctcagttgctcacaaatcaccactcgcggttatggcactaaacactagtacacctgcagtacttagtcaccaatccaatcactagaaacgcaagttagcttgtgggtgggtgggtgcgtatctgaagttatgaacacatcgatgaagacagtagtgtcgccctcttttacacgacaaagcaaaggccactaatcacactcaaccatgaccataaatggaaacggatcgaccgatcgatctaagctgtgcacgcgaagcgcactgcactacttgaggtagggcaagcacgatctgcaaccgccgtctgctaatggcagccgggttccttgacgaatcgcaaagtggtcttgatttcagccccccatgtttcctaaaatgccagcccttgcaaccgtgtgcagcatttctgtgcttgcagtgagcacgaaggttgcaaatgctgctttcttttagctactagacatgccatttgtcacacgccacgctcacactctccgtagttgtcagctcacactcgaccgtacgtttctttcgcttgggctagcttgctacttgctcagtcggtctacgctttgcgcgagcagagctaatttcgtcctggataccgtccatgcaaggattacattaccggcgatacagcatttatcagtgagctccggtaacgataatcggttgaaaatcggtgaaaaatcgccaaaaccgatcggtaaagagacccaaattcaaaaaaacgaaaatcgacaatttatcgtcgataatcgatgcaaaccgaacgatttatcgcttcgcctactaaaaatatgttttgacaatggaaaaaatataaaggtttgatagcatttaattttttaggttatgtattgtattatattagataaattacacatatatgcacaattttgcatttgaagccaatgccaatcttctctccatgttctcaaactaagtcctgattatcagacattcacctgcaagagggaaatcgaaccatgtctgtgtcaaaattatgctacgaataaatgatactcactcttaatttgtaccatttagacatacaatataaagtaaaggcatgcaccttgttttcctatttaacatagcatattgtacaacaataaacttttctcctggactaatatctaaaactgtagcctagattttagatctgtgatacaaccaaccatccaaggaatattgtataccaatgtagtatatttggccaaatcggtgagtagaaatacaaaagaagctggcctgaactgaaaatcatccgatacaaatcgataatcaacgatttacctcgattatcgacgccacgatcacagctccctcgctcccagctgcagcatcatcgataatcgccacatatatatcgattatcggccttaatcgcacgaaaaatattttttccctaagcaaacaattgttgctttcaacatgtgacaacactctagaatcaagagaatgtctagttttttataaaaataagttctttattttttatgaatttttttaaatttttgaattttccatcgaaatccaccgaaattccagttggtttacgttttcagctagcatcggtaatgataaatttcaccgataatcgcgattatcgagcggttttgtgttcatgcgtccatgttcacgagccccaggcccccaacccattgggtcccacggttgctgccgctgggtcccacggcgtcccacgtggcaggctgactcg

SEQ ID NO: 16121 - protein, 119 aa, Panicum virgatum
  misc_feature: Ceres CLONE 1787905
  misc_feature (42)..(118): Pfam Name: GILT Pfam Description: Gamma interferon inducible lysosomal thiol reductase (GILT)
MIAPGPRRLLLLPVALLLLLVAAAGGAFLPRSPAAAEGAKKVSLVLYYESLCPYCSRFIVNHLAGIFEDGLIDAVDLRLVPYGNARVGSNGDISCQVKTEAQSNVSPVFFFLFLKLKKP

SEQ ID NO: 16122 - DNA, 675 bp, Panicum virgatum
  misc_feature: Ceres CLONE 1787905-R
  misc_feature: Encodes the peptide sequence at SEQ ID NO. 16123
acgccggcggcgagatctcgtgccagcatggtccgtacgagtgcctgctcaacaccgtggaagcttgcgccatcgacgcctggccggatttggacgtgcatttccgtttcatctactgcgtggaggacctggtggtgaagcgtcagtacaaggagtgggagtcctgcttccagaagctggggcttgacccaaagcccgtaactgaatgctacaaaagcgaacagggtcacaagcttgagctcaagtacgcgaaccagaccgacgctctcgtgccgccgcaccggtacgtcccgtgggtggtcgtcgacgggcagccactgcttgaggactacgagaacttcgaggcttacgtctgcaaggcctacaagggcagtcctccgaaggtctgcgaggggctggtgcatccgccggtggcgctcgagaccgtggtggcgcgcaacggcgtcacttacaactccggcggcatcgagcttgcgactgctgaagaggagggaagggacagcaagattaggatgcggctcccggacaatgaaaactgatactgcacggtgtgctcgtttgggtcatgtggacataggcagttgcatgttactgtccagattacatactatgggttggctgcactaggtcgtacagaactaacgaattaataacgcactcagctgctttgctgct

SEQ ID NO: 16123 - protein, 178 aa, Panicum virgatum
  misc_feature: Ceres CLONE 1787905-R
  misc_feature (2)..(63): Pfam Name: GILT Pfam Description: Gamma interferon inducible lysosomal thiol reductase (GILT)
AGGEISCQHGPYECLLNTVEACAIDAWPDLDVHFRFIYCVEDLVVKRQYKEWESCFQKLGLDPKPVTECYKSEQGHKLELKYANQTDALVPPHRYVPWVVVDGQPLLEDYENFEAYVCKAYKGSPPKVCEGLVHPPVALETVVARNGVTYNSGGIELATAEEEGRDSKIRMRLPDNEN

SEQ ID NO: 16124 - DNA, 2438 bp, Panicum virgatum
  misc_feature: Ceres CLONE 1787910
  misc_feature: Encodes the peptide sequence at SEQ ID NO. 16125
atcatatcctatggcggcggccgcgagggggagcgtgtgggagatccagcccggtgacgtgggcgccgcggggttcggcgcggccgacgcgggcgcgttcctcgccgcgctccgctccgccgcggccgcggcgggccccggagccgccggggacgccgtgtgggcggcggtggcggccgcgggggtgctgcggccggagcacccgcacgcgctgcaccagctcgtctactactccgtctacgccgggtgggaccgcgccgcccggggcccgccgccgtactggttcccgtcaccgactgacagtagacaaacgaaccttgggaggttcatggaagcaaacgggcccaagctgttagggccagcatacaaggacccgataacaagttttaatctcttttacaagttctccgtagagaaccaagaggtctactggtcaatggtgctaaagcagctcgcagtcaagttccaaaaagaaccaaaatcgattctaagtacatcagatagatcaaagaaaggggggacatggcttcaaggtgcagtgctcaacattgccgagtgttgtctgctcccttgcccttccctgaacaggacagatgacagtacagctattgtttggagggatgaaggccatgatgattacccagtgaaccgtatgtcactgaaagaacttcgcagtcaagtgataactgttgcaaatgccttggataccatgttccacaaaggggatccgatcgcaatagacatgcctatgacatgcaatgcagtcatcatatatttggcgatcatccttggtggctttgttgttgtgtcaatagcagatagttttgcaccacaggagattggtactcgcatgggtgtttcaaaagcaaaggcaatttttactcaggatttcattattagaggagggaagaaagttccactttacagccgtgtcgtgcaagggtcttcatctaaagctgttgtgattcctgcaaccggagactatcttggagttacactgaggaatggtgatatgtcctggaaagattttctttgtcgtgcttctggaaggtcatctatctattctccagtttatcagtctgttgatgcgctaactaatatactattttcttcaggaacaactggggatccaaaagctataccatggacacaactttctcccataagatgtgcagctgatacgtgggcccatattgatgttcgtccacaggacatattttgttggcctactaatctgggctgggttatgggacctatagtcctgtactcatgctttcttaatggtgcaactttggctttatatcatggatctccacttggtcgtgatttctgcaaatttgtacaggatgcaggtgtgactttattaggaagtgtgcctagcttggtgaagtcatggaaagctgggaactgtgttaaagggcttgactggaccaaaatcagggtactaggcaccacaggggaggcttctgatattgatgataatctgtggctaacttcacacacgtcatacaagcccattgttgaatgctgtgggggcacggagttggcatcctcatacattcaaggtagtcttttgcaaccgcaatccttcggtgcttttagtggtgcatcaatgtccactgggtttgtcatacttgatgaacagggaactccatatcctgacgatgtaccttgtgctggagaagtgggtctcttccctctgtattttggcgctacaaattggcttctcaatgctgaccatgacaaggtttactttgatggcatgcccatttacaatggaaggcaactccgacgacatggagatataatccagaggacagtaggtgggtactatattgtacagggcagagcagatgacaccatgaaccttggaggaattaagacaagttcagtggagatagaaagggtatgcaatagagccgatgaaagacttctagaaacagctgcagttagcatcaaacctgctggtgggggaccagaacatctggcaatcttagcagtgctgaaagatagatcggcccaatacgatgtaaatcttctcaagagcaagttccagaaagccatccagaagaacctcaatcctcttttcaaggtgagctatgtcaaagttgttcctgagttcccaagaactgcttcaaacaaacttctgagaagggtcctgcgggaccaactgaagcaggaactctcaaatcacagcaagctctgacctttgagtgggttgactgtcctaccttcggtgaagaataccttttcacatgccacaatattaatatcaaattcacccgttccatttcaataaagcagaatgaataaataggtatcgtacactgaattgtgcggaaggctttaggaattaggatgctcattgtcatttggtactttggaactaagctcagcgcatttcaaaggcttgatagtatagtagatctgctctctct

SEQ ID NO: 16125 - protein, 731 aa, Panicum virgatum
  misc_feature: Ceres CLONE 1787910
  misc_feature (216)..(646): Pfam Name: AMP-binding Pfam Description: AMP-binding enzyme
  misc_feature: SWISSPROT Homolog: EC 6.2.1.1 Acetate--CoA ligase
MAAAARGSVWEIQPGDVGAAGFGAADAGAFLAALRSAAAAAGPGAAGDAVWAAVAAAGVLRPEHPHALHQLVYYSVYAGWDRAARGPPPYWFPSPTDSRQTNLGRFMEANGPKLLGPAYKDPITSFNLFYKFSVENQEVYWSMVLKQLAVKFQKEPKSILSTSDRSKKGGTWLQGAVLNIAECCLLPCPSLNRTDDSTAIVWRDEGHDDYPVNRMSLKELRSQVITVANALDTMFHKGDPIAIDMPMTCNAVIIYLAIILGGFVVVSIADSFAPQEIGTRMGVSKAKAIFTQDFIIRGGKKVPLYSRVVQGSSSKAVVIPATGDYLGVTLRNGDMSWKDFLCRASGRSSIYSPVYQSVDALTNILFSSGTTGDPKAIPWTQLSPIRCAADTWAHIDVRPQDIFCWPTNLGWVMGPIVLYSCFLNGATLALYHGSPLGRDFCKFVQDAGVTLLGSVPSLVKSWKAGNCVKGLDWTKIRVLGTTGEASDIDDNLWLTSHTSYKPIVECCGGTELASSYIQGSLLQPQSFGAFSGASMSTGFVILDEQGTPYPDDVPCAGEVGLFPLYFGATNWLLNADHDKVYFDGMPIYNGRQLRRHGDIIQRTVGGYYIVQGRADDTMNLGGIKTSSVEIERVCNRADERLLETAAVSIKPAGGGPEHLAILAVLKDRSAQYDVNLLKSKFQKAIQKNLNPLFKVSYVKVVPEFPRTASNKLLRRVLRDQLKQELSNHSKL

SEQ ID NO: 16126 - DNA, 1550 bp, Panicum virgatum
  misc_feature: Ceres CLONE 1787918
  misc_feature: Encodes the peptide sequence at SEQ ID NO. 16127
atctccgcctccgccagcagcagatgccgcggccgatctgacgcggccgatccccggcgatgaggcctcgccgaggccgggtcctcttcccggactcggactcggactcgggcccgggcgacggggactgctacgaggggtacggctgcgcgccgccaccgacggttcccagcaccccctccaccggcccggcctcttccccggcgccggcgtcctctccgaccccagcgtgccccccgctcgcctccccgccgtcgcctcctcccgcgcacagcggccagaggaaccagggaggagggatgcaggggtacgggcccccgccgcccggcttcggtggcggcggcggcggcggcgaccaccggtggcactacgtcaggtacgtgctcatcgccgcgggggtcatcgcctttgtctcgctcatcctgctcggggtctcggtcgccgtgcggcgccgccaggtgcggcggcggcggcggcaggcgctcctcgcgcatgccgccgccccgccgccgccggggaacggcggcggcgggggcggggtggtgcaccacgtctggtacatccggaccgtggggctggacgaggcggcgatcaactccatcgccgtgacgccgtaccgcgccggggcggggctcctgggcgcggccgactgctccgtctgcctcggcgagttccacgacggcgagctcgtgcgcctgctgcccaagtgcggccacgcgttccacgtcccctgcatcgacacctggctccgcgcgcacgtcaactgcccgctctgccgctccgacgtgctcgaccccgccgtcacggcgggagaggagaccggctccaaccccccagctgatccggatgcgaacgccaacgtccaagccgagcaacgagcggctgccgcgagcgacgcaataccggatcacgaagaggagagcagcggccaaggggcagcagcttcacccgcgcaggaggaccagcaagaacagcccagctcgccggagccgccgccgccgcctcagcagcagctgttccgtcctccgccgcctcgcaacgtgcggcgcgcggcgtccatggacgcggccatagcgtcagccgcggcagaggcagaccccgcggcactggagcgtttgccggcggcagctcctgaagaggagcagatcggcgccaggcggaagcggtgctgcgcgaaggcatcgggttccggccatcggagcaacctgagcaccgacaggccggctgccggcggcgtccccaggtccttcttctctctgcattcacgtgctcggagctcggtgctgccgctgtgaaccacggcgcggacatccccgagctaaatttttgctcgctgctaataatgttgctcctgtcgttgatccgtggcgcgatctgtattatacttgtaaaacttacgatctcgaaaccgaggttacgagtgaaagcccaacacggtgaatggaagtttgcaatcgagagattgtccctagccataatactggacagctctgttcttctctgcagactgcagtatggattcaggaatcgtctttgggtctttggtgacg

SEQ ID NO: 16127 - protein, 411 aa, Panicum virgatum
  misc_feature: Ceres CLONE 1787918
  misc_feature (198)..(239): Pfam Name: zf-C3HC4 Pfam Description: Zinc finger, C3HC4 type (RING finger)
  misc_feature: SWISSPROT Homolog: EC 6.3.2.19 Ubiquitin--protein ligase
MRPRRGRVLFPDSDSDSGPGDGDCYEGYGCAPPPTVPSTPSTGPASSPAPASSPTPACPPLASPPSPPPAHSGQRNQGGGMQGYGPPPPGFGGGGGGGDHRWHYVRYVLIAAGVIAFVSLILLGVSVAVRRRQVRRRRRQALLAHAAAPPPPGNGGGGGGVVHHVWYIRTVGLDEAAINSIAVTPYRAGAGLLGAADCSVCLGEFHDGELVRLLPKCGHAFHVPCIDTWLRAHVNCPLCRSDVLDPAVTAGEETGSNPPADPDANANVQAEQRAAAASDAIPDHEEESSGQGAAASPAQEDQQEQPSSPEPPPPPQQQLFRPPPPRNVRRAASMDAAIASAAAEADPAALERLPAAAPEEEQIGARRKRCCAKASGSGHRSNLSTDRPAAGGVPRSFFSLHSRARSSVLPL

SEQ ID NO: 16128 - DNA, 2092 bp, Panicum virgatum
  misc_feature: Ceres CLONE 1787926
  misc_feature: Encodes the peptide sequence at SEQ ID NO. 16129
gcctagcccacaaggccacaactcccaacctctcttcttccccggccactaaccaactgcccagcgttgcgcctgcgcaagcgcaattcccccccaaacccagcgtagccaatcctcagcgcctctctcgcgtccgccgcgccccactccgcgatggccgagcagcgcccgcccgccgggatcgacccgcgcagcggcttctgcgccgcgacgcggaccttccacagcctgcgccagtccgccacgctcccgccggactcactcccggccaccgccgccgcctatgccttctccctcctctcctcaccgctccccgaccaacccgccctcgtcgacgccgccaccggcattgccgtctcctacccctccttcctcgccgccgtccgctccctcgcgggggggctctggtccgccctcggcgtccgcccgggcgacgtcgcgctcatcgtctccccgtcccgcctcgaggtccccgtcctggacttcgcgctcttgtccatcggcgccgccgtctcgcccgcgaacccggcgtccaccgcggaggagttcgcgcacatggtcgcgctctccaggccgaccgtcgcgttcgcggtccccgaggtggctgccaagctgccgaggagcctcaggtgtgttgtcatcgggtcggacgagtatacgaggctgtcgtccgccggaggtgcgtcgccgccgcccccggtggcggtgcagcagtccgacacggcggccgtgctgtactcgtcgggcaccacggggcgggtgaaggccgtcgcggtcgcgcaccgcaacctcatcgcgctgatctgcgcgcatagggacaaccgggagaagatggggaaggaggctgccgaggccggcgagcagccgctcccacccacggtgacgctgttcccccttccgctcttccacgtgttcgggttcatgatgctgctccggtccgtggccatgggggagactgccgtcctcatggagcgcttcgatttcggcgccgtgctgcgcgccatcgagcggtaccgtgtcacgctgctgcccgcggcgcccccggtgctggtggccatgatcaagtccgaggaggcgcgccgccgtgacctctcctccctcctcgtcatcggcatcggcggcgcgccactcggtcgcgaagtcgccgagcgcttcgccgccgtcttccccgacatagaactcgttcaggttccgtgcaccctggaatacaaggctcttgtacgcactgcaagttccattctgaatctacgcttctgaatccagggctacggtctgactgagtcgtctggctcggtgtcttcgacggtggggccggaggagaccaaggcgtacggttcggtcgggaagttggcatcgcacatggaggcgaagatcgtcgaccccgccaccggcgaggcgctcgggccggggcagcgcggggagctctgggtccgtggaccagtcatcatgaaaggctatgtgggtgacgacgaggcgactgcagcaacgatggattcagaaggctggttgaaaactggtgatctatgctacttcaatgaagatggtttcctctacattgttgaccgattaaaggaactgataaaatacaagggatatcaggtacctccagctgaactggagcatatcctgaattctcatcctgatatattagatgctgctgttatcccatatccagatgaagatgtcgggcaactaccaatggcgttcatagtgaggaaaccaggttcaaagctcaccgagcaacaagtcatggagcacgtggctaaacaggtggcaccgtacaagaaagtccgcagagtggcctttgtctctgcaataccaaaatcacctgctgggaagatcttgcgccgggagcttatacagcaggccgagttcatgggtgcctccaagctttgaggtttatgctgacttggaaatataggaggaaagttctttgcgtagtaccagactcaggatttgtacatgtgctgctacggttttcaggctgactcgggtattcttagccaacggttgtacctctgaattttgctcatgcttgtttcctgctacaaactgaatgtcacggaaggaatttgtgggggatcggctgtcc

SEQ ID NO: 16129 - protein, 367 aa, Panicum virgatum
  misc_feature: Ceres CLONE 1787926
  misc_feature (69)..(367): Pfam Name: AMP-binding Pfam Description: AMP-binding enzyme
  misc_feature: SWISSPROT Homolog: EC 6.2.1.12 4-coumarate--CoA ligase
MAEQRPPAGIDPRSGFCAATRTFHSLRQSATLPPDSLPATAAAYAFSLLSSPLPDQPALVDAATGIAVSYPSFLAAVRSLAGGLWSALGVRPGDVALIVSPSRLEVPVLDFALLSIGAAVSPANPASTAEEFAHMVALSRPTVAFAVPEVAAKLPRSLRCVVIGSDEYTRLSSAGGASPPPPVAVQQSDTAAVLYSSGTTGRVKAVAVAHRNLIALICAHRDNREKMGKEAAEAGEQPLPPTVTLFPLPLFHVFGFMMLLRSVAMGETAVLMERFDFGAVLRAIERYRVTLLPAAPPVLVAMIKSEEARRRDLSSLLVIGIGGAPLGREVAERFAAVFPDIELVQVPCTLEYKALVRTASSILNLRF

SEQ ID NO: 16130 - DNA, 1824 bp, Panicum virgatum
  misc_feature: Ceres CLONE 1787928
  misc_feature: Encodes the peptide sequence at SEQ ID NO. 16131
accaaaaaaaaaagaaaaaaaatcgcttgccccggttaaccggagtagcagcacatctcctcgccggctcgccgccgcgcccgatccaaccgcgtgtccgtccgcccgtatcaagctcgcccgaatctttcacagcttgacgcctcccatccatgttcgcctgcaggtctctgctcgcaagggatcagtaggtcaaaataagttggcctcatttgtgatggaaggggcacaaggaggatcaagtaatctggcaaaacacaagaaaagaaagtctcctgtgcagagatggaggccaatctcaacagaagcagttccccagaaagatgatgttaatgagacatcaaattctggaagcagacaagttgtagaagattgcataacttctacggataatttggtgttggatggagctactaatgttgttattgaagttaccaccaatgatgcatcattgtcaaaaaataatttaagtttggaatccagttcagctaaagtagctatagaagataattttgaggtatctggctttaataaggatcttgatgggtccaatttctctgagacatattcctcctctattgaggtagatgttcctttgatgtgctttgtgaagggaaagggtgggtctatgcaaaagaagattgaagaggatactggagtgagaattatcttcccatcatcaagggacgagacctctgttgtcctcgaaggtacaagttctgaaagtattagaaaagcatcgcagatgattgcaaatgttcttgaagaggctgtccaaagtcgaatgctggactactcccatttcatatcacttccattggctatccaccccgatcttgttgacaagctcaactacttccagagctcaatacttggggcttctgcttctaatgaagaaagtgatagagatgagagccgaagtgaaggttctattgatgaaatagatcatgaccacaagcaagcagatggctcaagtgtttccgtcaaccttcaagttcaagaaaagtctgtcgaagtgaacatcgatagcaaaggctccggatcagattttggcattgacaagtcaatatttatcaaacccaaaacatttcaccttactgttgtcatgttgaagttgtggaacaaggatcgtatagctaaggcttcggatgtgctccagttaatatctagccaagtaaatgaagctttggaaaaccgccctatctccatacagcttagaggcctgacatgcatgaaaggctctccagctaaggcccgggtggtatatgctccagtgttggaagttggtggggaaggacgcctagcacgtgcttgcaaagtcataattgatgcctttgtcaagtcaggcctagttctcgaaagggatgcaagacaggaattgaagttgcacgcaaccataatgaacgtgcggcacagaaagagcaagaaacggaaccggtggaacgattcatttgacgcccgggatatattcaggaaatacgggaaagaggagtggggcgaataccacattcctgaggtccatctctcacagagattcaaatttgatgaaagcgggtactaccattgctgctcgtcgatccccttgcccgcggagatgcgggcagagtgaggcctgcagttcagcctgttgtaaaaatacacacggaattgaaggaatccctgatgagcgaggcctccttttttttactttgttataaggcaatggccatttaggaccttagttttggtggttttgaatcatggcatgttttgctggacgatgttgtatgagcatggcaacggtagtgtgggccccccctacctgtagagggaggtggatctgtc

SEQ ID NO: 16131 - protein, 463 aa, Panicum virgatum
  misc_feature: Ceres CLONE 1787928
  misc_feature (118)..(178): Pfam Name: KH_1 Pfam Description: KH domain
MEGAQGGSSNLAKHKKRKSPVQRWRPISTEAVPQKDDVNETSNSGSRQVVEDCITSTDNLVLDGATNVVIEVTTNDASLSKNNLSLESSSAKVAIEDNFEVSGFNKDLDGSNFSETYSSSIEVDVPLMCFVKGKGGSMQKKIEEDTGVRIIFPSSRDETSVVLEGTSSESIRKASQMIANVLEEAVQSRMLDYSHFISLPLAIHPDLVDKLNYFQSSILGASASNEESDRDESRSEGSIDEIDHDHKQADGSSVSVNLQVQEKSVEVNIDSKGSGSDFGIDKSIFIKPKTFHLTVVMLKLWNKDRIAKASDVLQLISSQVNEALENRPISIQLRGLTCMKGSPAKARVVYAPVLEVGGEGRLARACKVIIDAFVKSGLVLERDARQELKLHATIMNVRHRKSKKRNRWNDSFDARDIFRKYGKEEWGEYHIPEVHLSQRFKFDESGYYHCCSSIPLPAEMRAE

SEQ ID NO: 16132 - DNA, 1801 bp, Panicum virgatum
  misc_feature: Ceres CLONE 1787936
  misc_feature: Encodes the peptide sequence at SEQ ID NO. 16133
aggacagtcggctcaggtcagtcaaccatgcgtttgcattattgacgacccagatttgtactctctcggattgctaccctcttggaagccatggcggcgagcaccgtcgtcggctccgacggccaggagttccggcgctacggcgggcgtgtcaccacctttgtcgtcctctcctgcatcaccgctggcatgggcggagtcatcttcggttacgatattggaatctccggtggcgtgacgtcaatggacccgttcttgaggaagttcttccctaaggtgtatcggcggatgaagggttcaagcgtcagcaactactgcaagttcgacagccagcttctcaccgccttcacatcctcgctgtatgtcgccgggctcatcaccactttgctcgcgtcctgggtcacctccaggtgcggccgccgcccatccatgatcatcgccggggccgcgtttctcgctggcggggcgatcggaggagcggcagttgatgtgtacatggtgattttcggacgcgtgctccttggtgtcgggctcggctttgggaaccaggcggtaccgctctacctgtcggaaatggcccctcccgtgtaccgaggtgccttcagcaacggcttccagctctgcgtcagcatcggggccgttaccgcgcacctcatcaacttcggcgccgaaaagatcaagggagggtggggttggcgggtgtccctggcgcttgctgccgtgccaggcggattcctcgccctcggtgcgctcttcctgccggagacgcccaacagcctagtgcagcaaggcaaggaccaggaacacgccagggccctgctgaagaggatccgcggcgtcgacgacgtcagcgacgagatggccgacattgtcgccgccacccagcaggccaaggcaggccgcggcctgcaactgatcctgttccagcggcggtaccgcccccagctcgtgatggccgtcatgatacccttcttccagcaggtgacaggtatcaacgcgatttcgttctacgccccggtgctgctgcgcaccattggcttgggggagagcgcgtctctgctgtcggtggtggtgactggcagcatcggcttggtgtccacggccgtctccatgtctctcgtcgacagggccgggcggcggacgctcttcttcgtcggcggtgctcagatgctggtgtgccagctcatgatcggggccatcatggccacgcagctcggtgaccaagggcaggtgagcaaggccgtcgcgctcgtgctcatcgtcctcatagcggcctacgtggccgcgttcgcgctgtcttggggcccgctggggtggctggtgccgagcgaaatcttcccactggaggtgaggtctgctgggcagagcatcgcggtggccgtcaactttctcctcacgacgttcgtggcacagttgttcctggccatgctgtgccgcatgaagtccggcatcttcttcttcttcgcggcctggctggtgatcatgaccacctttgtgtacctgctgctgccggagaccaaggggaagccaatggagcaggtcggagagctatggggacaccattggttctggaaaaggttcgctggcacggaggaagggcggacaaccaacaagctatcatgcaactaaacttcaattcgttgacaaaaaaagaatatatgtaccagtcttgaattttttatatttgttactagtaaatgtgtttgtgtgttgcacatggagttggagtacgtatggttgcacggtcatcttgtcgatcgcatcatgtaccgatgtacgtgcactaattcttcttatgatc

SEQ ID NO: 16133 - protein, 512 aa, Panicum virgatum
  misc_feature: Ceres CLONE 1787936
  misc_feature (28)..(488): Pfam Name: Sugar_tr Pfam Description: Sugar (and other) transporter
  misc_feature (23)..(440): Pfam Name: MFS_1 Pfam Description: Major Facilitator Superfamily
MAASTVVGSDGQEFRRYGGRVTTFVVLSCITAGMGGVIFGYDIGISGGVTSMDPFLRKFFPKVYRRMKGSSVSNYCKFDSQLLTAFTSSLYVAGLITTLLASWVTSRCGRRPSMIIAGAAFLAGGAIGGAAVDVYMVIFGRVLLGVGLGFGNQAVPLYLSEMAPPVYRGAFSNGFQLCVSIGAVTAHLINFGAEKIKGGWGWRVSLALAAVPGGFLALGALFLPETPNSLVQQGKDQEHARALLKRIRGVDDVSDEMADIVAATQQAKAGRGLQLILFQRRYRPQLVMAVMIPFFQQVTGINAISFYAPVLLRTIGLGESASLLSVVVTGSIGLVSTAVSMSLVDRAGRRTLFFVGGAQMLVCQLMIGAIMATQLGDQGQVSKAVALVLIVLIAAYVAAFALSWGPLGWLVPSEIFPLEVRSAGQSIAVAVNFLLTTFVAQLFLAMLCRMKSGIFFFFAAWLVIMTTFVYLLLPETKGKPMEQVGELWGHHWFWKRFAGTEEGRTTNKLSCN

SEQ ID NO: 16134 - DNA, 2405 bp, Panicum virgatum
  misc_feature: Ceres CLONE 1787948
  misc_feature: Encodes the peptide sequence at SEQ ID NO. 16135
atctccccagaagcgcctccacgccgacccgtctaaaaagaaaaaaaaaatcggaggcggcgaaaaccctcaaaccctaatcctctcgctcccccatggccgaccccgacgccgcgccgctgaccccgccgccagaggtagtagcccccgaggagcatccggctgccaccgactccgcggcgcaggaggaggccgcggcgggcgaagtcgatcacaagaggaagcttgaggaggtcggcgccaacgcggaggcgaacggcgacggagaggacgccaagcgaccccgcgtggacggcgagaccgacgcctccggagggactgagcagcagaacgatgggtcctccgtgaatgccgaggagcccgcagctgcggaggacggcaaggttgcccctaccgagggggtggtagatggtgataatggcccggtcgcggcttctgaggttctgccactcgagcccacaccagaagcagcagctggagctccacagcaagaaggtgatgcagcaactgcctcacaggagacatctcggaaaatcgaagtgcccaatagcaaggttggtgtgctgattggaaaagctggtgaaacaatcaggaacttgcaaacgagctcgggtgcaaagatccaaatcaccaaggacatcgatgcagattcgagtgctctgacccggtcggttgaactagttggaacccttgcaagtgttgataaagctgagcagcttattaagagtgttatagctgaggctgaggctggcggttcccctgctttaatagctagaggctttggaagtgggcagtcaggatccgagcagtttgagatgacagttcctgataataaggttggcctgattatcggaaaaggtggcgagacaattaaaggcctgcaaacaagatctggtgctcgtattcagttgataccccaacatcctccagagggtgttacattgactgaacgaactgtacgtgtcactgggaataagaaacagattgaagtcgcaaaggatttgatcaagcaggctatgaatcagaatttctcaaagcatgcgaaccaatctggtggatttggtccgcaaggttaccgccctcagggtcatggtgcagcttcgcagtgggggccacgttctcaaagtcagcctggctatgggtacccaccaagaggtatgcctccacctcagaactacaacccaccctatggtggttacccgcagcagggaccaccaagaggcggcatgggctgggatcaaaggcaggggggccctccgccccatccttcatatcagggtggtggttctgactactacaagcagggatctcaaccatatgatagccagccaccaaactaccctcctggaccagggagctacaacagttatgggcaatctcaggctcctggctatggacaacctccgtatcagcaacatacgcctcaacagaactatggccatgggtatggtgatcctagatacaatgctccgcctccaaaccagtactatgggcagccaccaatggccccccagcaaggctatcctcaacaggcagatccttatgctaggcctccttacagtggaccgggacaatgggcgcccagaggtgctccggctgcagatggctcctaccaggcaccaccgcctgcatcttatgggccaccctcccagcaacctcctgcttatggccaaacatatggcgcggcaactgcacctgatgggtatgctcaacagggctacccacagcagagtgggcaagcaccaactccatatggccagaatgcaccagcagcgccaggttatcctcagcaaggcacacagcaaggtggctatgcacagtacccgcaatcccaaccagcatatggtgatcaagccgctccagccaatgcgaactatggctaccagggagctccagcagatcccaactatggaagtgcctactcacaatcaggatatggacctcctgctccttcagctggtcagcctggttatgcttctgcgccagcagctggccagcctgcagcatatggccaggcagggtacacccaaccacctacaaaccctccaagttatgatcagtctgcagcagcaccagctcaaagcggatacgctgcacctgctgcaaatccacagcctgctccagcaaaggtggtgtcgccacagcctgctgctggatatgccggtgggcagtggacagcatgaacctctctcaaccggcactgacagcagatcttgtttcatacctatcccaatgtttggatcttttggatgtttctggggatgcaatggttagtgtggacttttgttatctgaatgagattgtaaccctccaagttgtaatacttgcattgctgtagtacctagtagtctggttaaggtgacattaaacatcctattcagttttaagagaacctttgttttatc

SEQ ID NO: 16135 - protein, 695 aa, Panicum virgatum
  misc_feature: Ceres CLONE 1787948
  misc_feature (238)..(304): Pfam Name: KH_1 Pfam Description: KH domain
  misc_feature (144)..(209): Pfam Name: KH_1 Pfam Description: KH domain
  misc_feature: SWISSPROT Homolog: EC 2.3.1.48 Histone acetyltransferase
MADPDAAPLTPPPEVVAPEEHPAATDSAAQEEAAAGEVDHKRKLEEVGANAEANGDGEDAKRPRVDGETDASGGTEQQNDGSSVNAEEPAAAEDGKVAPTEGVVDGDNGPVAASEVLPLEPTPEAAAGAPQQEGDAATASQETSRKIEVPNSKVGVLIGKAGETIRNLQTSSGAKIQITKDIDADSSALTRSVELVGTLASVDKAEQLIKSVIAEAEAGGSPALIARGFGSGQSGSEQFEMTVPDNKVGLIIGKGGETIKGLQTRSGARIQLIPQHPPEGVTLTERTVRVTGNKKQIEVAKDLIKQAMNQNFSKHANQSGGFGPQGYRPQGHGAASQWGPRSQSQPGYGYPPRGMPPPQNYNPPYGGYPQQGPPRGGMGWDQRQGGPPPHPSYQGGGSDYYKQGSQPYDSQPPNYPPGPGSYNSYGQSQAPGYGQPPYQQHTPQQNYGHGYGDPRYNAPPPNQYYGQPPMAPQQGYPQQADPYARPPYSGPGQWAPRGAPAADGSYQAPPPASYGPPSQQPPAYGQTYGAATAPDGYAQQGYPQQSGQAPTPYGQNAPAAPGYPQQGTQQGGYAQYPQSQPAYGDQAAPANANYGYQGAPADPNYGSAYSQSGYGPPAPSAGQPGYASAPAAGQPAAYGQAGYTQPPTNPPSYDQSAAAPAQSGYAAPAANPQPAPAKVVSPQPAAGYAGGQWTA

SEQ ID NO: 16136 - DNA, 2368 bp, Panicum virgatum
  misc_feature: Ceres CLONE 1787954
  misc_feature: Encodes the peptide sequence at SEQ ID NO. 16137
gtcccctccaagccgaagcaaccgctgcgtcccccaataagaacaggaccagcccaccctccggaccccacccgctgacagacgccgccgcaccagcgcccaaatctcccaaaaccctaagccgaggggccgagagagagggagagggggagagagggaggcgcgcggcatggcgggtgcgacgtccccggcggcctccgcgaatctggcgggcaagtccggcgtccgcgtcgtcgtgatcggcgaccccggcaccggcaagtccagcatcgtcgtcgcgctcgccaccgagcaattccccgagaacgtgccccgggtcatgccccccactcgcctccccgccgactacttccccgaccgcgtccccatcaccatcatcgacacatcgtccagcccggagcagaagccgaagttgatcgcggagtgccaggcagccgatgcggtggtgctcacgtacgcctgcgaccggcccgccacgctggaacggctcagttcgttctggctccccgagctccggcgactccagttgaagactccagtgattgtggtggggtgcaaactggacttaagggacgagcagcaggttagccttgagcaggttatggcgcccatcatgcagtcattccgcgagattgagacctgcattgagtgctccgctcttcggcagatccaggtgcctgaggtcttctactatgcccagaaggcagtgcttcacccaactgctcctctctttgatcaagaggcccaatcactgaagcctcgctgtgtgagagcgttaaagcggatattcattttatgtgataacgacaaggatggtgctctcagtgatgtggagctcaatgatttccaggttcgatgtttcagtgctcctctccagcatactgaaatttcaggcgtaaagagagttgttcaggagaagttgcctgaaggcgtaaatgacaacggacttaccttgactgggttcctttttctgcatgccttatttattgaaaaaggtcgtcttgaaactacatggactgtattgaggaaatttggttatgacaatgacatcaagcttagggatgatctcattgcgatgccaattaaaagggctcctgatcaaacattggaactgacaagtgaagtggttgatttcttgagagggatattcaacatgtttgacatcgataatgatggtgctctactaccttctgagctggaggaacttttctcaacagcacctgaaaacccatggtcttctgatccgtataaagactctgctgaaaagaatgtcttgggtggtctgtcacttgaagggtttctttctaagtgggctcttatgacacttagagatccggcaaatagttatgccaaccttgtatatgttggctatccaggcgagtttagttcagcatttacggtcacgaggaaaagacgagtggatcgtaagaagcaacagactctaagaaatgtattccagtgttacgtttttggtgccagaggttctggaaagacgtcattgctacaatcattcattggaaggcaaccttctgatgctctgccatctaacagtgaacgttttgcaacaaattctgttgaactgcctgatggaactagaaagacactaatactgagagaaattcctgaaggtgatgtgagatcgttactttctgacagggaatcattggcgccctgtgatgtagcagtgtttttttatgatagctgtgatgaatattcttggcaaagagcaagagacttgcttgtgcaggtggctacacatggagaaaatactggctacgaagttccttgcctgatagtcgctgcgaaagatgatcttgaccaatgtgcgcaagctctacaagagtcaactagagtgagccaaaacatggggattgaaacaccaattccaatcagcgtgaagttgagagatttgaacaacattttctgcagaatagttcatgtagcgcagcagccccatttgagcattccagagactgaagctggcaaaacacgcaggcaatatcgtcaacttctgaaccgttccctcatggttgtctctgttggggctgctgttgcagttgttggaatagctgcttacagggtttatgcagctcggaagaactcatcctcttgaagccctcctggacagtggcgaagttaagtgcttctcacacctcaacttggcaccaacagctggatccatgcttgttgagcttcgctgcttgggcttttatccagtcaggaaccaacgttttgtacagacatgtcatcagctataaattgtgcggcctattggggtttcagattcatgacttcgtctggctccataaaatgctgtatcagataatctgttctggctaaattagctcagctaaatattgctactgct

SEQ ID NO: 16137 - protein, 647 aa, Panicum virgatum
  misc_feature: Ceres CLONE 1787954
  misc_feature (20)..(132): Pfam Name: Miro Pfam Description: Miro-like protein
  misc_feature (430)..(548): Pfam Name: Miro Pfam Description: Miro-like protein
  misc_feature (231)..(320): Pfam Name: EF_assoc_2 Pfam Description: EF hand associated
  misc_feature (354)..(424): Pfam Name: EF_assoc_1 Pfam Description: EF hand associated
MAGATSPAASANLAGKSGVRVVVIGDPGTGKSSIVVALATEQFPENVPRVMPPTRLPADYFPDRVPITIIDTSSSPEQKPKLIAECQAADAVVLTYACDRPATLERLSSFWLPELRRLQLKTPVIVVGCKLDLRDEQQVSLEQVMAPIMQSFREIETCIECSALRQIQVPEVFYYAQKAVLHPTAPLFDQEAQSLKPRCVRALKRIFILCDNDKDGALSDVELNDFQVRCFSAPLQHTEISGVKRVVQEKLPEGVNDNGLTLTGFLFLHALFIEKGRLETTWTVLRKFGYDNDIKLRDDLIAMPIKRAPDQTLELTSEVVDFLRGIFNMFDIDNDGALLPSELEELFSTAPENPWSSDPYKDSAEKNVLGGLSLEGFLSKWALMTLRDPANSYANLVYVGYPGEFSSAFTVTRKRRVDRKKQQTLRNVFQCYVFGARGSGKTSLLQSFIGRQPSDALPSNSERFATNSVELPDGTRKTLILREIPEGDVRSLLSDRESLAPCDVAVFFYDSCDEYSWQRARDLLVQVATHGENTGYEVPCLIVAAKDDLDQCAQALQESTRVSQNMGIETPIPISVKLRDLNNIFCRIVHVAQQPHLSIPETEAGKTRRQYRQLLNRSLMVVSVGAAVAVVGIAAYRVYAARKNSSS

SEQ ID NO: 16138 - DNA, 714 bp, Panicum virgatum
  misc_feature: Ceres CLONE 1787957
  misc_feature: Encodes the peptide sequence at SEQ ID NO. 16139
gcgtcagttcttgctcatcaccccctcccccaagccatcagcgactaattggaaggcccactcagagcagagagagaggagccttacttcttcctcctccccggccgccggcggcgagagatcgacgagcgagcgagatggtgctgtcccacggcgtcggcggcggctccgatgagtcggtgcactcgacgttcgcgtcccgctacgtccgcgcctccctccccaggttccggatgccggagcagtcgatcccgaaggaggcggcgtaccagatcatcaacgacgagctgatgctggacgggaacccgcggctgaacctggcgtccttcgtcaccacgtggatggagcccgagtgcgacaagctcatccaggcctccctcaacaagaactacgtcgacatggacgagtaccccgtcaccaccgagctccagaaccggtgcgtgaacatgatcgcccatctgttcaacgcccctctcggcgattctgaaactgccgtcggggtcggcaccgtcggctcgtccgaggccatcatgctcgccgggctggcgttcaagaagcgttggcagaacaagatgagggccgccggcaagccctgcgacaagcctaacatcgtcaccggcgccaacgtccaagtctgctgggagaagttcgcgcgttatttcgaggtggagctcagggaggtgaagctgagcgaggggtactacgtcatggacc

SEQ ID NO: 16139 - protein, 192 aa, Panicum virgatum
  misc_feature: Ceres CLONE 1787957
  misc_feature (34)..(192): Pfam Name: Pyridoxal_deC Pfam Description: Pyridoxal-dependent decarboxylase conserved domain
  misc_feature: SWISSPROT Homolog: EC 4.1.1.15 Glutamate decarboxylase
  misc_feature: Useful for making plants with modulated nitrogen use efficiency
MVLSHGVGGGSDESVHSTFASRYVRASLPRFRMPEQSIPKEAAYQIINDELMLDGNPRLNLASFVTTWMEPECDKLIQASLNKNYVDMDEYPVTTELQNRCVNMIAHLFNAPLGDSETAVGVGTVGSSEAIMLAGLAFKKRWQNKMRAAGKPCDKPNIVTGANVQVCWEKFARYFEVELREVKLSEGYYVMD

SEQ ID NO: 16140 - DNA, 224 bp, Panicum virgatum
  misc_feature: Ceres CLONE 1787957-R
ctggaagagggccgtcctggccaagaagaagatcaacggcgtctgctaataagcaacgacgcgaccgatgcatgtatatggcctatggggtgcggtgcaggccagttgctgttccaaccgaaattaccctcttttatctttttcttcttcttaatttccggtgaaaattgtcgtgtattgtgttttacccccgatggaggctgcaatttgtcgacgttaatttt

SEQ ID NO: 16141 - DNA, 1683 bp, Panicum virgatum
  misc_feature: Ceres CLONE 1787973
  misc_feature: Encodes the peptide sequence at SEQ ID NO. 16142
gggggtcgtcatcgcgtggtgaccgcgccgctctgttcctccgtccccgccccccacctccggctctcgccgtcacatgtcgtgtggcgcggggggagctctgatccggatggtgcagcgccgcgggatcgcgcacggccatgattgatcgcgaacaagcagaggaaatgcaagttaataatgaggcgccactagggtgcctcaagccaaatatttctcagtataactctccagagcagagaggtggaattgaaggagttcctgagaataatgaaaaaaggagtgatatggttgttgcggaaaaagtctgggaggcgtctcttgttccaactcaaggccttagcagacccttttaccgacaagaattttatgcttggccatatatttattcagattaccaaatggtgcgtcagccactaccttatggattcgagaaccaattttgtcaagtaaatagggaccacagttttcctattgagaacagagttcagtatcttccattcaagatgctcccccaaggtcacccccatgatgcacaacttcaggaatttcaatattttgtggttattgactttgaagcaacctgtgacaaggtgaacaatccatttccacaagagatcattgagtttccatctgtcttggttaacagtgcaactgggaaactggaagaatgctttcaaacgtacgttcggccaacatatcatcaatttttgactgacttctgcaaggagcttactggtatacaacagattcaggtggacagaggtgtgccactaggtgaagccttactcatgcatgataaatggctagaggacaagggcattaagaacacaaactttgctgttgtcacctggtctaattgggactgccggacaatgctggagtcagaatgcagatttaagagaattaggaagcccccttatttcaacaggtggatcaacctgaaggtacctttccaggaagtgtatggggatgtccgttgcaacttaaaggaggcagttcagttggctggccttacatgggagggtcgtgctcactgtggacttgatgatgctcgcaacactgctcgcctcctggcattaatgatgcaccggggcttcaaattctctatcaccaactcacttgtgtggcaacctgccccacaggcagcaacctgcctgctatcccctgaccgctctccagatcctgtccaaccgcagcttaagccgaatgagatgctgggatctcctgtgcaggttaatccatatgccgcctccgcagggaaggacagagcaatgtactgctactgtggtgtgctgagcaggtggagcgttgtgcgcaagccaggacccatgcaaggacgttacttctatggatgcggcaactggaccgccacgaggcgggcgatctgcccatactttgcatgggcatagtagagacgtaatgtgcttccgtccaagatctcaagggcaaaggacctggtgctttaactaagggaggcgctatgttgcggttgcctgctcctccgctgtgcctcccgatccgtatatattatgatataactttgctcataaggcaatggaagttcactaggtagtgtctaacctgtcatgctgacttctgttgatagaagagaatgggctcagatgctgcttaggtgtgatttatccatgaataatctaagtttgtggacgtttttaactt

SEQ ID NO: 16142 - protein, 423 aa, Panicum virgatum
  misc_feature: Ceres CLONE 1787973
  misc_feature (140)..(312): Pfam Name: Exonuc_X-T Pfam Description: Exonuclease
  misc_feature (379)..(423): Pfam Name: zf-GRF Pfam Description: GRF zinc finger
  misc_feature: SWISSPROT Homolog: EC 2.7.7.7 DNA-directed DNA polymerase
MIDREQAEEMQVNNEAPLGCLKPNISQYNSPEQRGGIEGVPENNEKRSDMVVAEKVWEASLVPTQGLSRPFYRQEFYAWPYIYSDYQMVRQPLPYGFENQFCQVNRDHSFPIENRVQYLPFKMLPQGHPHDAQLQEFQYFVVIDFEATCDKVNNPFPQEIIEFPSVLVNSATGKLEECFQTYVRPTYHQFLTDFCKELTGIQQIQVDRGVPLGEALLMHDKWLEDKGIKNTNFAVVTWSNWDCRTMLESECRFKRIRKPPYFNRWINLKVPFQEVYGDVRCNLKEAVQLAGLTWEGRAHCGLDDARNTARLLALMMHRGFKFSITNSLVWQPAPQAATCLLSPDRSPDPVQPQLKPNEMLGSPVQVNPYAASAGKDRAMYCYCGVLSRWSVVRKPGPMQGRYFYGCGNWTATRRAICPYFAWA

SEQ ID NO: 16143 - DNA, 407 bp, Panicum virgatum
  misc_feature: Ceres CLONE 1787983
  misc_feature: Encodes the peptide sequence at SEQ ID NO. 16144
caaccttacttttggaattcctcaactcgatactgtggttgacgattttgctactacggttatacttcctgaaggatcaaaaaatccacaggctgttgttcattttccgacaaagacgagttattcgtacaattatgttgctggaagggcgaaggtggtaataaagaagaaaaatgtagtaggggagcacaatgttccgttccaggtgtactacgaatccaatccgatcttcatgctggcgaacccattaactctctgggaagtgattattgggtttattgttgtcggcattgcatattatgtttggcgctccatttgtctaccacatatgcggctagccgaagcattggcgtgacaaacattggcagaaaccaaatgcaacagacccgccgaaattaaaccggtct

SEQ ID NO: 16144 - protein, 117 aa, Panicum virgatum
  misc_feature: Ceres CLONE 1787983
  misc_feature: SWISSPROT Homolog: EC 2.4.1.119 Dolichyl-diphosphooligosaccharide--protein glycotransferase
NLTFGIPQLDTVVDDFATTVILPEGSKNPQAVVHFPTKTSYSYNYVAGRAKVVIKKKNVVGEHNVPFQVYYESNPIFMLANPLTLWEVIIGFIVVGIAYYVWRSICLPHMRLAEALA

SEQ ID NO: 16145 - DNA, 942 bp, Panicum virgatum
  misc_feature: Ceres CLONE 1787986
  misc_feature: Encodes the peptide sequence at SEQ ID NO. 16146
aatcggatcgcttgcatccaagtcaggattttgatggcggcgggggtgctgtccaacagcgtcgaccgggaggacctcgccgccggggatcacatctactcatggcgggccgcctacctctacgcccaccacgggatctatgttggggacgggatggtcatccatttcaccagagcagccggccacgagattggcacggggaccttcctggattccttcctcttcagctcctcctcgccggcggcggcggcaaccacctgccagcgatgtggccacctggcacaaggacgtgagggggtcgtcatgtcctgcctcgactacttcttgcacggcggcagcctctacctcttccactacgccgtctcgcccgccttcttcctcgccaaggcgcgcggagggacctgcacgctggccgcctccgaccctggccatgtcgtcatccaccgcgcccgctacctcctggacaaggggggattcggcgcctactccctcttcaagaacaactgcgaggacttcgccatctactgcaagacggggctgctcgtcgagaccgctttcagtgttggccgcagcggccagctcgcgtccctcacggccgccttcagcgcggtggcctcgtcgccgctgcgtttcctcaccaccagcgccggcggcctcgccctcgtcaccaccggcatgtactgcgtcggccggtatgtctcggacatcggcgttcgccgggatgtgatcaagatccctgtccagacccttgttgcgcaggctactcctgctgctatggaggcagaggtcgcagcagcaggagcagtcggagcttcctcgcctgcttgctgagagacaccattcccatcctttgcaatgtcatgtattgtgagttccaagctgacgacgagaatctgatctgctgtatcaatttgcactcacttatgcagcaggagtcttatt

SEQ ID NO: 16146 - protein, 265 aa, Panicum virgatum
  misc_feature: Ceres CLONE 1787986
  misc_feature (104)..(175): Pfam Name: NC Pfam Description: NC domain
MAAGVLSNSVDREDLAAGDHIYSWRAAYLYAHHGIYVGDGMVIHFTRAAGHEIGTGTFLDSFLFSSSSPAAAATTCQRCGHLAQGREGVVMSCLDYFLHGGSLYLFHYAVSPAFFLAKARGGTCTLAASDPGHVVIHRARYLLDKGGFGAYSLFKNNCEDFAIYCKTGLLVETAFSVGRSGQLASLTAAFSAVASSPLRFLTTSAGGLALVTTGMYCVGRYVSDIGVRRDVIKIPVQTLVAQATPAAMEAEVAAAGAVGASSPAC

SEQ ID NO: 16147 - DNA, 1584 bp, Panicum virgatum
  misc_feature: Ceres CLONE 1787989
  misc_feature: Encodes the peptide sequence at SEQ ID NO. 16148
atctctctcgtttcctccgctgcctccgcatccgcctccgctgtctgtctgtccccgcagccgcggcagccccgctctgtgaagatcgccgcgccacctcttccggccgcgggggagcggaggcggagcacaggatgggggtgcccagcgacgaggtggtgcaaatctgccacgccgacgccgcctgggaccccgccgtggtcaccgtcagctgccccgacaagacaggcctcggctgcgacctctgccgggtcgtcctcctcttcggcctcagcgtcgtcaagggggacatgagcacggacgggcggtggtgctacatcgtcctctgggtgctgccgcggccggggcggcccgccgtgctcgtgccgtgggacctcctcaaggacaggctgctccagctctgccccgtcgcggcgccgttcgggttcaacaccgccgacctcgccgccgctggcctccaggacgccgcgcctcccgcgccgcggctcttcctgctcaagctgtactacttcgaccggatgggcctcttgcatgatgtaacacgagtgttgtgcgagctagagttcactattcggagggtgaaggtctctaccacgcctgatgggactgtgctggaccttttcttcatcacagacgccagggagcttctgcacacaaagagaagaagagaagaagcgtacaacaaacttgagagtgtcttaggcgactccttggcaagttgtgaaatagatcctgcctctgaagacatgttgtcatgcctccaagcatgtgcatcgttgacgcctgctgtaatggaacagatgtttaacacagatctcatagaggagcaatcaatcagcacaagaggtgacaatgccatctccgtgacaacagacaactctcttagctctgtccacactcttattcagattcagtgtggtgaccataagggcctgctatatgacatcatgaggacagtcaaggactgcaatattcagatttcctacggccgattctatgcgacccaaaatgggcgctgtgatgtggatttgttcgtggtgcaatcagatgggaagaagatccttgatcagcaaaggcagagatcactgtgttgtcgcctaaggatggagctcctccgaccactgcgtgtggcattggtgaaccggggtccagacacagaactgctggtagcaaatcccgttgaggtttctggaaagggtaggccattggtcttctacgacatcaccctggctctcaagaatcttcagaaacgaatcttcttggctgagattgggaggcatgttgtggaagatagggagtgggaagtctacagggtgcactttggtgaggagcatgatctctcgtctgcactgcggagcaagattgtgggaggagtcaccagtatgctgatggggtgggactgatgacactgctgctgtgactctgaaacgttatctttagtgatctgcagaaactaacataatttggcgtagataaaattaacgatcagtgttgcttatgtctaaaatgcagttttttagtaaacccagagattgtattaattaaatccttgatcagtaaagtgtactctatttgttgactggt

SEQ ID NO: 16148 - protein, 422 aa, Panicum virgatum
  misc_feature: Ceres CLONE 1787989
  misc_feature (119)..(183): Pfam Name: ACT Pfam Description: ACT domain
MGVPSDEVVQICHADAAWDPAVVTVSCPDKTGLGCDLCRVVLLFGLSVVKGDMSTDGRWCYIVLWVLPRPGRPAVLVPWDLLKDRLLQLCPVAAPFGFNTADLAAAGLQDAAPPAPRLFLLKLYYFDRMGLLHDVTRVLCELEFTIRRVKVSTTPDGTVLDLFFITDARELLHTKRRREEAYNKLESVLGDSLASCEIDPASEDMLSCLQACASLTPAVMEQMFNTDLIEEQSISTRGDNAISVTTDNSLSSVHTLIQIQCGDHKGLLYDIMRTVKDCNIQISYGRFYATQNGRCDVDLFVVQSDGKKILDQQRQRSLCCRLRMELLRPLRVALVNRGPDTELLVANPVEVSGKGRPLVFYDITLALKNLQKRIFLAEIGRHVVEDREWEVYRVHFGEEHDLSSALRSKIVGGVTSMLMGWD

SEQ ID NO: 16149 - DNA, 1610 bp, Panicum virgatum
  misc_feature: Ceres CLONE 1787992
  misc_feature: Encodes the peptide sequence at SEQ ID NO. 16150
atcatcgatcaacacaaccctgagccctagcaaggctagaacactacagtaaagtcttatcaataattccatactgtttctagcggcgattactatcacagcaggccgcagaggcagctgctagctgcagggagcacagaacacacagaagcaaagcacacacgccaagaaaccaaagcgaggaaattaaagcacacaaagacaccggccaggggagcaccgaattggagctgtagctcatcatggggatggtggtggagagcatcagccccacggcggcggcggcggcggaggcttcctccgcctcctcgcgctcaaccggcgcgtccacggccaccaccgagtccggcgcctcccagcagccgccgcttgccgcggcgccggccggcggggaggtctcgccctcgccggcggacgagcaggccgtcacgtcgcagccgtcggcggcggcggcggtgccgcaggggtcctcgcggtacaagggcgtcgtgccgcagcccaacgggcgctgaggcgcgcagatctacgaacgccacgcgcgggtgtggctcggcaccttccccgacgaggaggccgccgcgcgcgcctacgacgtcgccgcgctccgctaccgcggccgcgaggccgccaccaacttcccggcggccggggcgtcggcgcccgagctcgccttcctgttagcgcactccaaggcggagatcgtcgacatgctccggaagcacacctacgccgacgagctccgccagggcctgcgccgcggccgcggcatgggcgcccgcgcgcagcccacgccggcctgggcgcgcgcgctgctcttcgagaaggccgtcacgcccagcgacgtcggcaagctcaaccgcctcgtcgtgcccaagcagcacgccgagaagcacttcccgctcaagcgctcgccgccgaaggccgccaccggcaagggcgtgctcctcaacttcgaggacggcgagggcaaggtgtggcgcttccggtactcgtactggaacagcagccagagctacgtgctcaccaagggctggagccgcttcgtcagggagaagggcctccgagccggcgacaccatcgtcttctcccactccacatacggcccggagcagcagctcttcatcgactgcaagaagaccaataagacggcggagaaaccaaaggaagccgccgcccgtgtagtcaggctcttcggcgtggacatcgccggagacgggtgccagaagagagcacggccgccggtggagatggcgttcgagcaaggccatcaggagttgttcttgaagaagcaatgcgtggctcatcaccgctctcctgccctaggtgccttcttgttatagcagcgatcatatatatgcatagtattctagttcttcccctccttctaatttcttcgcctgtttcatctccaatccaagttctagtgtctgttcttcgtcttttgcccaaagaacaacttgttatgtcagactgcgtctgcggcaagacgagttgcatgtacaccattgggaagtctaatctttgagatggtatgtagtagtaatcatcctacaagatcatgcaagtttgtgccatcatcgagtacagcaataataagttgattattcgac

SEQ ID NO: 16150 - protein, 210 aa, Panicum virgatum
  misc_feature: Ceres CLONE 1787992
  misc_feature (36)..(144): Pfam Name: B3 Pfam Description: B3 DNA binding domain
  misc_feature: The sequence is a functional homolog of SEQ ID NO 1176 in the 10/374,780 US patent application
  misc_feature: The sequence is a functional homolog of SEQ ID NO 1372 in the 10/412,699 US patent application
  misc_feature: The sequence is a functional homolog of SEQ ID NO 30 in the 10/838,616 US patent application
  misc_feature: The sequence is a functional homolog of SEQ ID NO 732 in the 11/435,388 US patent application
  misc_feature: The sequence is a functional homolog of SEQ ID NO 20 in the 10/838,616 US patent application
  misc_feature: The sequence is a functional homolog of SEQ ID NO 1177 in the 10/374,780 US patent application
  misc_feature: The sequence is a functional homolog of SEQ ID NO 1373 in the 10/412,699 US patent application
  misc_feature: The sequence is a functional homolog of SEQ ID NO 32 in the 10/838,616 US patent application
  misc_feature: The sequence is a functional homolog of SEQ ID NO 734 in the 11/435,388 US patent application
  misc_feature: Useful for making plants with altered lignin content
  misc_feature: The sequence is a functional homolog of SEQ ID NO 1186 in the 10/374,780 US patent application
  misc_feature: The sequence is a functional homolog of SEQ ID NO 38 in the 10/838,616 US patent application
  misc_feature: The sequence is a functional homolog of SEQ ID NO 740 in the 11/435,388 US patent application
  misc_feature: Useful for making plants with altered alkaloid content
  misc_feature: The sequence is a functional homolog of SEQ ID NO 1183 in the 10/374,780 US patent application
  misc_feature: The sequence is a functional homolog of SEQ ID NO 22 in the 10/838,616 US patent application
  misc_feature: The sequence is a functional homolog of SEQ ID NO 756 in the 11/435,388 US patent application
  misc_feature: The sequence is a functional homolog of SEQ ID NO 1178 in the 10/374,780 US patent application
  misc_feature: The sequence is a functional homolog of SEQ ID NO 1374 in the 10/412,699 US patent application
  misc_feature: The sequence is a functional homolog of SEQ ID NO 53 in the 10/838,616 US patent application
  misc_feature: The sequence is a functional homolog of SEQ ID NO 1179 in the 10/374,780 US patent application
  misc_feature: The sequence is a functional homolog of SEQ ID NO 34 in the 10/838,616 US patent application
  misc_feature: The sequence is a functional homolog of SEQ ID NO 52 in the 10/838,616 US patent application
  misc_feature: The sequence is a functional homolog of SEQ ID NO 736 in the 11/435,388 US patent application
  misc_feature: The sequence is a functional homolog of SEQ ID NO 1184 in the 10/374,780 US patent application
  misc_feature: The sequence is a functional homolog of SEQ ID NO 24 in the 10/838,616 US patent application
  misc_feature: The sequence is a functional homolog of SEQ ID NO 758 in the 11/435,388 US patent application
  misc_feature: Useful for making plants with modulated water use efficiency
  misc_feature: The sequence is a functional homolog of SEQ ID NO 1258 in the 11/479,226 US patent application
  misc_feature: The sequence is a functional homolog of SEQ ID NO 138 in the 10/225,068 US patent application
  misc_feature: The sequence is a functional homolog of SEQ ID NO 170 in the 10/374,780 US patent application
  misc_feature: The sequence is a functional homolog of SEQ ID NO 2 in the 10/838,616 US patent application
  misc_feature: The sequence is a functional homolog of SEQ ID NO 208 in the 11/375,241 US patent application
  misc_feature: The sequence is a functional homolog of SEQ ID NO 580 in the 10/412,699 US patent application
  misc_feature: The sequence is a functional homolog of SEQ ID NO 630 in the 11/435,388 US patent application
  misc_feature: The sequence is a functional homolog of SEQ ID NO 796 in the 10/225,066 US patent application
  misc_feature: Useful for making plants with altered protein content
  misc_feature: Useful for making plants with altered terpenoid content
  misc_feature: The sequence is a functional homolog of SEQ ID NO 48 in the 10/838,616 US patent application
  misc_feature: The sequence is a functional homolog of SEQ ID NO 36 in the 10/838,616 US patent application
  misc_feature: The sequence is a functional homolog of SEQ ID NO 738 in the 11/435,388 US patent application
  misc_feature: The sequence is a functional homolog of SEQ ID NO 1182 in the 10/374,780 US patent application
  misc_feature: The sequence is a functional homolog of SEQ ID NO 18 in the 10/838,616 US patent application
  misc_feature: The sequence is a functional homolog of SEQ ID NO 754 in the 11/435,388 US patent application
  misc_feature: The sequence is a functional homolog of SEQ ID NO 26 in the 10/838,616 US patent application
  misc_feature: The sequence is a functional homolog of SEQ ID NO 760 in the 11/435,388 US patent application
  misc_feature: The sequence is a functional homolog of SEQ ID NO 1892 in the 10/412,699 US patent application
  misc_feature: The sequence is a functional homolog of SEQ ID NO 32 in the 11/375,241 US patent application
  misc_feature: The sequence is a functional homolog of SEQ ID NO 370 in the 10/374,780 US patent application
  misc_feature: The sequence is a functional homolog of SEQ ID NO 420 in the 10/225,066 US patent application
  misc_feature: The sequence is a functional homolog of SEQ ID NO 550 in the 11/435,388 US patent application
  misc_feature: The sequence is a functional homolog of SEQ ID NO 78 in the 10/225,068 US patent application
  misc_feature: The sequence is a functional homolog of SEQ ID NO 8 in the 10/838,616 US patent application
  misc_feature: The sequence is a functional homolog of SEQ ID NO 44 in the 10/838,616 US patent application
  misc_feature: Useful for making plants with modulated flowering time
  misc_feature: The sequence is a functional homolog of SEQ ID NO 46 in the 10/838,616 US patent application
  misc_feature: The sequence is a functional homolog of SEQ ID NO 50 in the 10/838,616 US patent application
  misc_feature: The sequence is a functional homolog of SEQ ID NO 42 in the 10/838,616 US patent application
  misc_feature: The sequence is a functional homolog of SEQ ID NO 1181 in the 10/374,780 US patent application
  misc_feature: Useful for making plants with modulated biomass
  misc_feature: The sequence is a functional homolog of SEQ ID NO 396 in the 10/666,642 US patent application
  misc_feature: The sequence is a functional homolog of SEQ ID NO 14 in the 10/838,616 US patent application
  misc_feature: The sequence is a functional homolog of SEQ ID NO 244 in the 10/225,066 US patent application
  misc_feature: The sequence is a functional homolog of SEQ ID NO 2498 in the 10/374,780 US patent application
  misc_feature: Useful for biocontainment applications
  misc_feature: Useful for making plants with modulated time to senescence
  misc_feature: The sequence is a functional homolog of SEQ ID NO 1180 in the 10/374,780 US patent application
MLRKHTYADELRQGLRRGRGMGARAQPTPAWARALLFEKAVTPSDVGKLNRLVVPKQHAEKHFPLKRSPPKAATGKGVLLNFEDGEGKVWRFRYSYWNSSQSYVLTKGWSRFVREKGLRAGDTIVFSHSTYGPEQQLFIDCKKTNKTAEKPKEAAARVVRLFGVDIAGDGCQKRARPPVEMAFEQGHQELFLKKQCVAHHRSPALGAFLL

SEQ ID NO: 16151 - DNA, 724 bp, Panicum virgatum
  misc_feature: Ceres CLONE 1788007
  misc_feature: Encodes the peptide sequence at SEQ ID NO. 16152
gccgctctcatggcggcggcggcgctgctcgcgctgtggctcctcgcgtggcggccgcgcgcggtggcccgggcgttcgcgcggcagggggtccgtggcccgccctacacgttcctggccgggtccctgccggagatgaagcggctgctggtggccggccgggtcggggtggcgcccctcgacgccacctgccacgacatcatgccagtcctgctgccgcagttccacagatgggtcgccgactatgggaaaacatttctgttctggatcggtcccattcccgccctcttctctactgatctccagctggttaagcaagtgctcgcggacaggacgggcctgtaccagaaggacttcctggtccccgtgctcaactccctcttcggcaacggggtcgtgttcatcaatggagacgactggaaacggcaccggaaggtggttcttccggccttcacccatgacaagatcaagagcatgtcggcggtggcggcggaggtcacgaagcagatgatgcagcaatggcgcgagcaggcccgccaaagcggcggcaagggagcggcggccgagatagacatgatcgtcgccttcaacgacctgacctccaggatcaacggccgcgtcgccttcggcaccagccaccaggacgtcgaggaggtcgtcgccttcatgcgggagatgcagaagctcgccacagcggccacgctggatcctccaatcctcgggt

SEQ ID NO: 16152 - protein, 241 aa, Panicum virgatum
  misc_feature: Ceres CLONE 1788007
  misc_feature: SWISSPROT Homolog: EC 1.3.3.9 Secologanin synthase
AALMAAAALLALWLLAWRPRAVARAFARQGVRGPPYTFLAGSLPEMKRLLVAGRVGVAPLDATCHDIMPVLLPQFHRWVADYGKTFLFWIGPIPALFSTDLQLVKQVLADRTGLYQKDFLVPVLNSLFGNGVVFINGDDWKRHRKVVLPAFTHDKIKSMSAVAAEVTKQMMQQWREQARQSGGKGAAAEIDMIVAFNDLTSRINGRVAFGTSHQDVEEVVAFMREMQKLATAATLDPPILG

SEQ ID NO: 16153 - DNA, 727 bp, Panicum virgatum
  misc_feature: Ceres CLONE 1788011
  misc_feature: Encodes the peptide sequence at SEQ ID NO. 16154
atccgcaccacctcctctccctcttccccttcctcctccttcccagcctctgctcgtgccgccgccggccatggcctgcctcaccgacctcgtcaacctcaacctctccgacaccacggagaagatcatcgccgagtacatatggatcggtggatctggcatggatctcaggagcaaggccagggtaagataaaagattccaagcgctaggaccccgggaggccgggacactgtttgttgtgactcatcccttatcacttatctctgaagtcatccgatgagctgttccttggcttatatatcggagctcagctcactaccatagcttctttttttccttttttattttttaaaccattattaacctttttttggacacattaaaactcatgttgatctggttggcgctgcgcagaccctctccggcccggtgacggatcccagcaagctgcccaagtggaactacgacggctccagcaccggccaggcccccggcgaggacagcgaggtcatcctgtacccgcaggctatcttcaaggacccattcaggaagggcaacaacattctcgtcatgtgcgattgctacaccccagctggcgagccaattcccaccaacaagaggcacagcgccgccaagatcttcagcaaccctgaggttgccgctgaggagccctggtatggtattgagcaggagtacaccctccttcagaaggacaccaactggccc

SEQ ID NO: 16154 - protein, 40 aa, Panicum virgatum
  misc_feature: Ceres CLONE 1788011
  misc_feature: SWISSPROT Homolog: EC 6.3.1.2 Glutamate--ammonia ligase
  misc_feature: Useful for making plants with modulated water use efficiency
MACLTDLVNLNLSDTTEKIIAEYIWIGGSGMDLRSKARVR

SEQ ID NO: 16155 - DNA, 1899 bp, Panicum virgatum
  misc_feature: Ceres CLONE 1788013
  misc_feature: Encodes the peptide sequence at SEQ ID NO. 16156
ctggaggccacaacacacgcaaccaagcaccggtagccacccacctcgcaccgagacaacagctgtgctcaccgccgggcatggactcaccgctgagcaggcctgcgctgctcgcgctatccttgctcctcctcgcgctctacctcgcccgccggcacctcgcccgcggcaagaaccggacgtacccgccggtggccggcaccgtgctgcaccaggtgctcaacttcggccgcctggtggagtaccaaaccgagctctcccgcaggtaccccaccttccgcatgctcaccccgacctgcaactacgtctacaccgtcgagcccgccaacgtggagtacatcctcaagaccaacttcgccaactacggcaagggggtgatgacgcacgacgtgatggaggacctcctcggcgacggcatcttcaacgtggacggcgccaagtggcggcaccagcggaaggtcgccagccacgagttctccacccgggtgctgcgcgactacagcagcgccgtgttccgcgacacggccgcggagctcgcgggcatcgtggccgccgcggcgcggggagccggggagaggctggacatttcggacctcctgatgcgctcgacgctggactccatcttcgagatcggtttcggcgtcaaccttggctccctgaccggatccagcgaagagggcgcggcgttcgccagggcgttcgacgacgccagcgagcaggtgctgtaccgcttcttcgacctgttctggaaggtgaagcggttcttcagcatcgcgtcggaggcggccatgaagcgctcggtccgcaccatcgacggtttcgtctacgccgtcatcgacaggaagatcgagcagatgggcagaaaccatcaggaattcgccaagaaagaggacatcctgtcgaggttcctgctcgagcgggagcgagaccccggctgcttcgacaacaagtacctgcgggacatcatcctcaacttcgtgatcgccggccgcgacaccacggcggggaccctggcctggttcctctacgagctctgcaggaaccagcgcgtccaggaaaagatcgcggaggaggtgcgcgccgccaccgccacgggcgaccgcgacgtcggcgcgcaggagctcgtggcgtgcctgaccgaggacgccatcggcaagatgcagtacctgcacgccgcgctggcggagacgctgcggctctacccggccgtgcccatggatgtgaagtactgcttctcggacgacacgttgccggacggctacgcagtgaaccaaggggacatggtgaactaccagccgtaccccatgggcaggatgaagttcctgtggggcgcggacgccgaggagttcaggccggagaggtggctcaacgacgacggtgtgttcgtccccgagagccccttcaagttcacggctttccaggcggggcctcgcatctgcttggggaaggagttcgcgtacaggcagatgaagatctttgcggccgtgctgctccacctcttcagactcgagatgtgggatgctgatgccacggtgggctaccgccctatgctgacgctcaaaatggacggcccgctcttcgtgcgcgcgtcgctccggaagccatgagatgggggtgaagccttgtgccaaaaggtcaaccgcgcatgtcccatggtctggccgtcgagtcggacttaaaaatacgatctttccatctgttagtgtcatttatcgataacgtgggggttcagcagccgtgcatcagtgcataccgtttaaatttagcaccgaagctatatagtattgggacctataaaaataaatgggcagcgctactcatatgtcctgtctattcaggctactagtactacgcaggagtgtacttcagcagcatccataaataaatatattgctgttt

SEQ ID NO: 16156 - protein, 508 aa, Panicum virgatum
  misc_feature: Ceres CLONE 1788013
  misc_feature (36)..(502): Pfam Name: p450 Pfam Description: Cytochrome P450
  misc_feature: SWISSPROT Homolog: EC 1.14.14.1 Unspecific monooxygenase
MDSPLSRPALLALSLLLLALYLARRHLARGKNRTYPPVAGTVLHQVLNFGRLVEYQTELSRRYPTFRMLTPTCNYVYTVEPANVEYILKTNFANYGKGVMTHDVMEDLLGDGIFNVDGAKWRHQRKVASHEFSTRVLRDYSSAVFRDTAAELAGIVAAAARGAGERLDISDLLMRSTLDSIFEIGFGVNLGSLTGSSEEGAAFARAFDDASEQVLYRFFDLFWKVKRFFSIASEAAMKRSVRTIDGFVYAVIDRKIEQMGRNHQEFAKKEDILSRFLLERERDPGCFDNKYLRDIILNFVIAGRDTTAGTLAWFLYELCRNQRVQEKIAEEVRAATATGDRDVGAQELVACLTEDAIGKMQYLHAALAETLRLYPAVPMDVKYCFSDDTLPDGYAVNQGDMVNYQPYPMGRMKFLWGADAEEFRPERWLNDDGVFVPESPFKFTAFQAGPRICLGKEFAYRQMKIFAAVLLHLFRLEMWDADATVGYRPMLTLKMDGPLFVRASLRKP

SEQ ID NO: 16157 - DNA, 2032 bp, Panicum virgatum
  misc_feature: Ceres CLONE 1788018
  misc_feature: Encodes the peptide sequence at SEQ ID NO. 16158
atcaattcatctcatccagattccagaggcaaaatggggagaggaggggtttaagcgcgcgaggaaggagaggttctccgcagctcagcctcagctcgctcccactcccccgctgcagccgataaggctccccgctccaatggaggcggcggcgattgggtcccagtccccgctctccttcccctccagcctctgcaaagcaaaagtgtcctccggtttaccaatatgcaatgtgaagatcagcagcaatcgcaggcttgaggtggtttgccatgggatgttggcaaccagaaagtttatgcaacggaaaaggaaagaggaagtcttcaaggatgctgctgatgaggctgagcagaagaattggaggagaatgatgagggagatagaggagagagagtcggctgtatccattctgaagactcagcgaagcgggaaagagccacttccaagggatgttattcttggaacactcatgcggttcaagcaactgaaaaaatggaatattgtcagcgagattctcgaatggctcaggacacagcattggtgggacttcactgagatggacttcctgatgcttatgacagcttatggaaagttgggagattttagcagggcagaaagagtcctaaaatacatgaacaagaaaggttaccagcccagtgtgatatctcagactggtctaatggaggcgtatggaagaggcaagcagtaccgtaaggcggaagcagtattccgtaggatgcaggcatcaggccctgaaccatcacctgttacatatcaaatcattttgaaatctttagtggagggtgacaaatataaggaagctgaagctatatttgaggaccttcttaatgaaaaaagagcttcatttaagccagaccagaagatgtttcatatgatgatttacatgtacaagaaatctggtgactatgcccaggctcgtaagctatttgcacagatgtccgacagaggaattaaactatctacagttacttttaacagtttgatgtcatttgaaacagactacaaggaagtttcaagtatttatgatcagatgcaaagagcagggctgaaaccagatgttgtgagctattccctgctcatcaaagcttatgggaaagccaggagggaagaagaagcattggcagtttttgaagagatgcttgatgctggagtcaggccgacacgcaaatcatataacatcttgcttgatgcatttgcaatatctggattggtagatgaggctaatacagttttcaaggcaatgagaagacacagggttgagcctgatctttgctcttatacaactatggtattagcttatgtaaatgcttctgacatgaatggagctgagaaatttttccgtaggattaaagaggatggtttgaagcccaatgttgtggtttatggaactctgatgaaaggctattcaaagttaaataatgttgagaaagttatgcgggtgtatgagagaatgaggatccagggtgttgaacccaaccagaccatctatactactatcatggatgtacatggcaggaactcagattttggaaatgccgtgatttggttcaaagaaatggaagctcgtggatacccaccagaccagaaagcaaaaaacattctactttcacttgccaaaacacccgaagaacagcaagaagcgaatgaattggtagggaatggtgcagtccagctggaagtgaaaccctataatgaagaggtcgatgatgctgatgagcatgaaattacacaaactgattctggaaatcaccgttcgttagatgacatgcctgcaaaaaaccatgtaaatggtaggatcaggactggtaattatgcttttgatgaggatgaggatgacgacgatgattatgaggaagaggatggtgaagaattcaattttgtttctttcaaagataagagagaactaaattttgctagttgatgtcataaacgttggtgtatatttttttcgacaaactcatgatcagatgatggcatttcgtatacaaaagaaccaacttgaaatgtc

SEQ ID NO: 16158 - protein, 601 aa, Panicum virgatum
  misc_feature: Ceres CLONE 1788018
  misc_feature (316)..(350): Pfam Name: PPR Pfam Description: PPR repeat
  misc_feature (421)..(455): Pfam Name: PPR Pfam Description: PPR repeat
  misc_feature (351)..(385): Pfam Name: PPR Pfam Description: PPR repeat
  misc_feature (386)..(420): Pfam Name: PPR Pfam Description: PPR repeat
  misc_feature (456)..(490): Pfam Name: PPR Pfam Description: PPR repeat
  misc_feature (141)..(175): Pfam Name: PPR Pfam Description: PPR repeat
MEAAAIGSQSPLSFPSSLCKAKVSSGLPICNVKISSNRRLEVVCHGMLATRKFMQRKRKEEVFKDAADEAEQKNWRRMMREIEERESAVSILKTQRSGKEPLPRDVILGTLMRFKQLKKWNIVSEILEWLRTQHWWDFTEMDFLMLMTAYGKLGDFSRAERVLKYMNKKGYQPSVISQTGLMEAYGRGKQYRKAEAVFRRMQASGPEPSPVTYQIILKSLVEGDKYKEAEAIFEDLLNEKRASFKPDQKMFHMMIYMYKKSGDYAQARKLFAQMSDRGIKLSTVTFNSLMSFETDYKEVSSIYDQMQRAGLKPDVVSYSLLIKAYGKARREEEALAVFEEMLDAGVRPTRKSYNILLDAFAISGLVDEANTVFKAMRRHRVEPDLCSYTTMVLAYVNASDMNGAEKFFRRIKEDGLKPNVVVYGTLMKGYSKLNNVEKVMRVYERMRIQGVEPNQTIYTTIMDVHGRNSDFGNAVIWFKEMEARGYPPDQKAKNILLSLAKTPEEQQEANELVGNGAVQLEVKPYNEEVDDADEHEITQTDSGNHRSLDDMPAKNHVNGRIRTGNYAFDEDEDDDDDYEEEDGEEFNFVSFKDKRELNFAS

SEQ ID NO: 16159 - DNA, 1806 bp, Panicum virgatum
  misc_feature: Ceres CLONE 1788021
  misc_feature: Encodes the peptide sequence at SEQ ID NO. 16160
agtgcagaggcttccgtggcgggacggtacatccgcgagcgggggaagaaatcgagcagcgcgaacgggcggcgcggcctcatcgtctgaccttgccaaactgtccccgcccttgggggtccccgggccgctcgcgtcgcgtctaccccttgaggaccgaggtcccatccaatcccttcgcttccacgcaccaatcttgtcccggcgcctgccgagtccaggaacagtcgggcgagcagcggagcggaggcactagctagcggccagcaagcaagcgccaatggcggtttcttccggagcgtcgtcgccctccgcgcgcctcctcctgctgctgctctccctgctcggcttctgcgtcgcgctgagcagccaggagtcgtcgtcgtcgtcgacggactcgtgcggcgcggcgaagctcgcggtcgccagcctcgtgcccttcgacaccgcgggattccggtgcgccgccaactggaagcagcaggacttcgtcctcaggtacaagatcacggggccgagcgagtggagcttcgtcctgtctgcgccggacaagggctcgtacgtggcggtcggcttctcggggaagggcgccatggtcgggagcagcgccgtcgccgggtgggcgtccgacggcaggggcaccgtcaagcagtactacctcgccgggaagagccccgacgaggtcgcccccaacaggggcctcctcaagctcgtcaggaacaagtccgccgtcgtctcccactcgggccgcctctacctcgccttccagctcagcaccgactacccgcagccgtacctgatctacgccgtcgggccggacggcaacctgccgccgtccagcaccctgcagctgccgatgcaccagagcatggcctcccgcgccttcaactacacctccgggatgtcctccggcggcggctccggcgacgggacgttcccgccggagcggaggcacgggctgctggccatgatggggtggggcgtgctgatgcccatcggcatgatcaccgcgcgctacttccggcagctggacccgtgctggttctacacccacctggccatccaggtgtccggctacgccatcggcatcgcggccgtcgtcctcggcttccgcctcagcgaggacgggctcaagaacgtggacgtgcacaaggcgctcggcgtcgccatcctcgccatggcgtcgctccaggttctggcgatcctggcgcggccggacaagacgtccaaggtgcggcggttctggaactggtaccaccacaacatcgggcgcgcggcgatcctggtggccgtcggcaacgtcttcctgggcctctccatcgcgcaggagaccaacgcctacatcgtctcctacggcgtcttcgtcgccgtctgggtggtcgccgtcgccgccttcgaggtcaagcgctgctacgccgacgacgactgatccgccggccggctcgaccacctggcaggcaggcaggcagcgataccgtacggcagagtcgttctggacaaactggccatgggacgaaactgacggacggacgcaggatgaagcgttcacgaccagtgacgtgacacacatacacacacctgttcttgttccttagctcacaactggacagtgcatttgggaaagttcttggtcggctaaaatttgaatttttttatttttgttttgggtataggatttgaagcaagggccggactgctgctgtagcctagctggccggacgctctgattcatatttgtacattggtacatggtcgtgtttgtgctgtacttgtatccttttggacgatagtttttgttgtttgccc

SEQ ID NO: 16160 - protein, 382 aa, Panicum virgatum
  misc_feature: Ceres CLONE 1788021
  misc_feature (68)..(178): Pfam Name: DOMON Pfam Description: DOMON domain
MAVSSGASSPSARLLLLLLSLLGFCVALSSQESSSSSTDSCGAAKLAVASLVPFDTAGFRCAANWKQQDFVLRYKITGPSEWSFVLSAPDKGSYVAVGFSGKGAMVGSSAVAGWASDGRGTVKQYYLAGKSPDEVAPNRGLLKLVRNKSAVVSHSGRLYLAFQLSTDYPQPYLIYAVGPDGNLPPSSTLQLPMHQSMASRAFNYTSGMSSGGGSGDGTFPPERRHGLLAMMGWGVLMPIGMITARYFRQLDPCWFYTHLAIQVSGYAIGIAAVVLGFRLSEDGLKNVDVHKALGVAILAMASLQVLAILARPDKTSKVRRFWNWYHHNIGRAAILVAVGNVFLGLSIAQETNAYIVSYGVFVAVWVVAVAAFEVKRCYADDD

SEQ ID NO: 16161 - DNA, 1428 bp, Panicum virgatum
  misc_feature: Ceres CLONE 1788022
  misc_feature: Encodes the peptide sequence at SEQ ID NO. 16162
acagccccaacgcaccgatccccccagcggccaagggtagttcgctgtcgtcgtcggggcacgagagagagagagagccaggcaagcatcgtcgatcttctacttcctgatcgcggcgatcgacgcggcgacgcgatggccggcggggagagcaagctggtgagcccgctgctgcggggcccggcggcggggagccgcgggggggaggacgcgagcgggcagctggagggcatcctcggcgacgcggcgctgccgtggcggcggcggatggccgcggcgacggtggtggagatgcgcctgctggtgcgcctggcggcgcccgccgtgctcgtctacatgatcaactacctcatgtccatgtccacgcagatcttctcgggccacctcggcacgctcgagctcgccgccgcctccctcggcaacaccggcatccaggtcttcgcctacggcctcatgctggggatggggagcgcggtggagacgctgtgcgggcaggcgtacggcgcgcacaagtacgacatgctgggcgtgtacctgcagcgctccacggtgctgctcatggccacgggggtgccgctcgccgccctctacgccttctcccgcccgatcctcgtcctcctcggcgagtccccggacatcgccgccgccgccgccgtcttcgtctacggcctcatcccgcagatcttcgcctacgccgccaacttccccatccagaagttcatgcaggcgcagagcatcatggcgcccagcgcctacatctccaccgccacgctcgccgcccacctcgtcctcagctacctcgtcgtctaccgcctcggactgggcctcctcggggcctcgctcacgctcagcctcagctggtgggtcatcgtcgccgcccagttcgtctacatcgccaccagccggcgatgcaggctcacctggacggggttctcctggcaggccttctccggcctccccagcttcttcaagctctccatcgcctccgccgtcatgctctgcctcgagacctggtacttccagatactcgtgctcatcgccggcctcctcaaggaccctgagcttgcactggcctcactctctgtctgcatgacgatttcagggtgggtcttcatgatctcggttgggttcaatgcagctgccagtgtccgggtgagcaatgagctcggcgccggcaaccccaagtcggcggcgttctccgtcgtggtggtgacggtgctgtccttcatcctgtcggtgctcatctcggtggtcatcctcctgtgccgggactacatcagctacatcttcaccgagggcgaggacgtgtcgcaggccgtgtcccagctgacgccgctgctggcgctcaccctcatcctcaacggcatccagcccgtcctctccggggtggccgtgggctgcggatggcaagcgttcgtcgcgtacgtc

SEQ ID NO: 16162 - protein, 430 aa, Panicum virgatum
  misc_feature: Ceres CLONE 1788022
  misc_feature (62)..(222): Pfam Name: MatE Pfam Description: MatE
  misc_feature (283)..(430): Pfam Name: MatE Pfam Description: MatE
MAGGESKLVSPLLRGPAAGSRGGEDASGQLEGILGDAALPWRRRMAAATVVEMRLLVRLAAPAVLVYMINYLMSMSTQIFSGHLGTLELAAASLGNTGIQVFAYGLMLGMGSAVETLCGQAYGAHKYDMLGVYLQRSTVLLMATGVPLAALYAFSRPILVLLGESPDIAAAAAVFVYGLIPQIFAYAANFPIQKFMQAQSIMAPSAYISTATLAAHLVLSYLVVYRLGLGLLGASLTLSLSWWVIVAAQFVYIATSRRCRLTWTGFSWQAFSGLPSFFKLSIASAVMLCLETWYFQILVLIAGLLKDPELALASLSVCMTISGWVFMISVGFNAAASVRVSNELGAGNPKSAAFSVVVVTVLSFILSVLISVVILLCRDYISYIFTEGEDVSQAVSQLTPLLALTLILNGIQPVLSGVAVGCGWQAFVAY

SEQ ID NO: 16163 - DNA, 552 bp, Panicum virgatum
  misc_feature: Ceres CLONE 1788022-R
ggagcggcatgatcgggggcacactgatgcagaccttgatcctggtgtgggtgacattcaggaccaactgggagaaagaggtggaagaagcgcagaaacgattgaacaagtgggaagataaaactcctcaattgttggagtaagagtggaatgaaatcttcctcatctattgccacccgaagaatgggacttggatggggtcctctactattgggccagcagttgaagccgggataagaactgtacggttgcgccgttgatctgctcagcaaagaaggaattttgatgtgcctccaggcgttgaggaccttgtggccagcgattctcctgcgtctaatgcttaatggaagtagctgttccgttcgagaaaatcaatgttaagtactatcgattcatttagctttatgttgttcccatctgttgttcagcgatgtgattgtgtacgaaccattgaatcagtacaacaacaacatagtcttttttttttccaaataaattggggtaggctgaaccactgaatcagtattaattaattttgttgtcgagctttgt

SEQ ID NO: 16164 - DNA, 697 bp, Panicum virgatum
  misc_feature: Ceres CLONE 1788030
  misc_feature: Encodes the peptide sequence at SEQ ID NO. 16165
aagcagcagctagcatcacaagtaatccggccacacacaatcatcatccgatcctattgtcactctcgcacttgaaggttaagttccatccatggcggaggagaagcaccaccaccacctcttccaccacaagaggaacgaggaggagcagcccgccggcgggtacggcggcgaggccgccaccaccgagtacacggagaccaccgtgacggaggtggtgtccaccggcgaagacgagtacgagaagtacaagaaggaggagaaggagcacaagcacaagcagcacctcggcgaggcaggcgccatcgccaccggcgccttcgcgctgtacgagaagcacgaggcgaagaaggaccccgagcacgcgcaccggcacaagatcgaggaggagatcgcggcggcggcggccgtgggctccggcggctacgccttccacgagcaccacgagaagaagaaggaccacaaggacgccgaggaggccggcggcgagaagaagcaccaccacctcttcggctgatgtgtccagtcgtcgactcagtacatacgtgtgcggcggccccaccacatgtatatgatgatctgtctatatacgtatatatgctgcgcatcttaattaatttctccgtgtgctactgctacgtacgcgtgtactgtaagagtgagaggctgagaggtggccccgcgcgccagctgtgtg

SEQ ID NO: 16165 - protein, 141 aa, Panicum virgatum
  misc_feature: Ceres CLONE 1788030
  misc_feature (51)..(130): Pfam Name: ABA_WDS Pfam Description: ABA/WDS induced protein
MAEEKHHHHLFHHKRNEEEQPAGGYGGEAATTEYTETTVTEVVSTGEDEYEKYKKEEKEHKHKQHLGEAGAIATGAFALYEKHEAKKDPEHAHRHKIEEEIAAAAAVGSGGYAFHEHHEKKKDHKDAEEAGGEKKHHHLFG

SEQ ID NO: 16166 - DNA, 684 bp, Panicum virgatum
  misc_feature: Ceres CLONE 1788030-R
  misc_feature: Encodes the peptide sequence at SEQ ID NO. 16167
gtcctccaactcctcctccaccttcttcggcgcggtggtggccatcgacgacccgctcaccacggggccgacccgcgccgcggggaccgaggtcgggcgcgcccagggcacctacacgttcgcggaccagagcacgttcgggctcctgatggtgatgaacttcgtgttcaccgccggcgagcacaagggcagcagcctctcgatcctgggccggaaccaggtgctcgccgacgtccgcgagatgagcgtcgtcggcggcagcggcaagttccggatggcgcgcgggtacgtgcaggcgcacaccatcgactccggcgccacctccggggagaccgtcgtggagtacaccgtcaacgtcaaggcgtagccgccgccgccgccgtcgtctcgctctccggcggctgctgctgctgctgccgcctgagatgggtttcagtctttgtactttagcttgttgttcttcattctgattgctgatatccgtgagagagttcattcagcaagatggattcttgttgcgagagcagtagttagttgaacgggggggttcggatttggagagatatgcacgaaattcttggagaatttgcagggtcgggtcgaaatgtctgaagaagggaggttaatcgggttgggaacttgggatttctttccggacgaatcgaatctcggcagtaaaaagcc

SEQ ID NO: 16167 - protein, 121 aa, Panicum virgatum
  misc_feature: Ceres CLONE 1788030-R
  misc_feature (1)..(121): Pfam Name: Dirigent Pfam Description: Dirigent-like protein
SSNSSSTFFGAVVAIDDPLTTGPTRAAGTEVGRAQGTYTFADQSTFGLLMVMNFVFTAGEHKGSSLSILGRNQVLADVREMSVVGGSGKFRMARGYVQAHTIDSGATSGETVVEYTVNVKA

SEQ ID NO: 16168 - DNA, 2038 bp, Panicum virgatum
  misc_feature: Ceres CLONE 1788033
  misc_feature: Encodes the peptide sequence at SEQ ID NO. 16169
actcaaacggctcttccgtcgtataaacctccgcaccaactcccatggcgaaaattctcgccctccctcaccttccccatcctcctcgtcccgcctccgcggaacccgagccccccgcgtcccgccccaccgattgagcccaaccgccgtgccctaggtcgcgagatctcggggagcggaaccccgcggcctccgggaacagggaccgcggcgcgatggtggagacgggcggcgggaggctccaccagcgccggggcgcggccgccttcgtcgcggccaacaggacgctgctcgccgccgcgtgggtcgtcgggttcgcgctggtattcctgtggcagagcgcctcgatatcgctgaggagcgggggcggcggcagcgggggcgtgctcctcgggctcctgtcggggcctctcccgccgccgcgccccgcgccgcggctgcgccccgcggcctacaacctcacagacttcggcggcgtcggggacgggcgggcgctcaacaccggggcgttcgagcgcgccgtcgaggccatcgcggcgctcgcggagcgcggcggtgggcagctcaatgtgcccccaggccggtggctcacggccccgttcaacctgactagccacatgacgctgtttctcgccgaaggcgctgagatccttggcattccggacgagaagtactggccgttgatgccagcgttgccatcctacgggtatgggcgggagcgcaaagggcctcgctttggaagtctaattcatggacagaatttgagagatgttgtaattacagggcacaatggtagcataaatggccaaggtgaagtttggtggatgaagcatcacagaagaatgctgaatagcacgagacctcctcttgtgcagctgatgtggtccaaggacattattgttgcaaacataacactgcggaattcacctttctggcactttcatccatatgattgcacaaacgtaaccgtttcaaatgttactatcttatctcctgtttctggcgctccaaacacagatggcatagatccagattcttgtcaggatgtgctcattgagaattgctatatatctgttggtgatgatgcaatagctgtaaagagcggttgggatcaatatggaattgcatacggacgcccatcttcaaacatttcaatccgcaatgtaactgcccgttctcttgtgagtgctggaatttcaattggtagtgagatgtctggtggtgttgcaaatgttactgtggagaatgtccgcatctgggaatcaaggagaggtgtgaggataaagactgctacaggaagaggcggctacatccgtaacatctcctaccgaaacataaccttcgacaatgtccgtgctgggattgtgataaaggttgactacaatgagcatgctgatgatggatatgatcggaatgccttccctgacatcacgagcatatcattcaaggaaatccatgggcggggtgttcgggtgcctgttcgtgctcatggcagcgacgttatccccgtaaaggatatcagcttccaggacatgtcagtaggcatcagctacaagaagaagcacatcttccagtgctcctatgtggaggggcgtgtcatcgggtccgtgttcccgaaaccatgtgagaacctggacgtctataatgagcaagggcagcttgtcaagcgggcagtatccctgaacagcacagagcttgactatgatatctgaggcacatactacagcgatgataaggagtggtggaaatgggtgctctctaccctgtgaaatcaattctctccgctttctaaattttccacgttttttctttagaattgtaaatagcaaatacagaggagattctcctcgtcatagatttgctgcttgcagtggctgattgtatctcaccagtgatttagccatcaacattttgcattggcagaacagaactcgcctggagacaaatctatgctgtcaatgtagtttacacatgaaggctatagtatatatgtcaagcttaaatcatgtcaacaaggaaagaagaaccgtgtgatctc

SEQ ID NO: 16169 - protein, 498 aa, Panicum virgatum
  misc_feature: Ceres CLONE 1788033
  misc_feature (110)..(470): Pfam Name: Glyco_hydro_28 Pfam Description: Glycosyl hydrolases family 28
  misc_feature: SWISSPROT Homolog: EC 3.2.1.15 Polygalacturonase
  misc_feature: Useful for making plants with altered carbohydrate content
  misc_feature: Useful for making plants with altered cell wall content and/or composition
MVETGGGRLHQRRGAAAFVAANRTLLAAAWVVGFALVFLWQSASISLRSGGGGSGGVLLGLLSGPLPPPRPAPRLRPAAYNLTDFGGVGDGRALNTGAFERAVEAIAALAERGGGQLNVPPGRWLTAPFNLTSHMTLFLAEGAEILGIPDEKYWPLMPALPSYGYGRERKGPRFGSLIHGQNLRDVVITGHNGSINGQGEVWWMKHHRRMLNSTRPPLVQLMWSKDIIVANITLRNSPFWHFHPYDCTNVTVSNVTILSPVSGAPNTDGIDPDSCQDVLIENCYISVGDDAIAVKSGWDQYGIAYGRPSSNISIRNVTARSLVSAGISIGSEMSGGVANVTVENVRIWESRRGVRIKTATGRGGYIRNISYRNITFDNVRAGIVIKVDYNEHADDGYDRNAFPDITSISFKEIHGRGVRVPVRAHGSDVIPVKDISFQDMSVGISYKKKHIFQCSYVEGRVIGSVFPKPCENLDVYNEQGQLVKRAVSLNSTELDYDI

SEQ ID NO: 16170 - DNA, 1092 bp, Panicum virgatum
  misc_feature: Ceres CLONE 1788034
  misc_feature: Encodes the peptide sequence at SEQ ID NO. 16171
attccaccaccatttcagaaacacagccaaagcagctcagcgcgttggtggtagcactcactgcaccatggctcctctgctcttcagggacatgaagggcctctcgtgctcgtcgccggcgtccaccgcgatatgccccagcctggagcggcagccgatggtccggtcacacaaggccattgccagtgccggtgccagccctctgtctcaggttcccacggagcccaggatacacaagcatgacggcaagaaagggcagcagcacaaggctgtcgtcgtcgcaaacggcggtggcatcgtcagccccgccggctcgtccaggtaccttctgagcggccgtgtcccggcgtccgcatccatcgaggagatccaggaggtggatgctgccccggccgttgatgccaagctggaggaagcaagtgaagtagctgatccgaagagcagacaggcgcaggaacaggtggttgtgctgaaggtatccctgcactgcaaagcatgcgctgggaaagtgaagaagcacctctccaagatggaaggtgtgacatcgttcgacatcgacttcacggcgaagaaggtgacggtggtcggcgacgtgacgcccctgggggtgctgaacagcgtgtccaaggtgaagaacgcccagctctgggcggcgccggcgatagcggcctgaagaacgaaaaggccaaaagggtgtctgaaaaagccaaagctagcgtagcctaggatccgttgccgttggccgtgtctggtaggggagtgcggacctggagccgtgcgcgtacgcgtgtgggggcgccgggcgctggctgccacggccggccagcgcgctgggactgtgagagcctgtgctggtgtgtctcctcgaccagcatgcgtccaccatggccctggccgcccttgaatgcagctttggtttcatcctgtggtcgtcttgtgatcctccatcctcccttgttttgctgtggttggtgccatgcgacatgggaggctaggatgcttccttgtggtacgggcgggtgactctgcttcttcttgtttctttttcccctcttgctgtaagcatgtaatataagaatgccattgccttgc

SEQ ID NO: 16171 - protein, 201 aa, Panicum virgatum
  misc_feature: Ceres CLONE 1788034
  misc_feature (133)..(193): Pfam Name: HMA Pfam Description: Heavy-metal-associated domain
MAPLLFRDMKGLSCSSPASTAICPSLERQPMVRSHKAIASAGASPLSQVPTEPRIHKHDGKKGQQHKAVVVANGGGIVSPAGSSRYLLSGRVPASASIEEIQEVDAAPAVDAKLEEASEVADPKSRQAQEQVVVLKVSLHCKACAGKVKKHLSKMEGVTSFDIDFTAKKVTVVGDVTPLGVLNSVSKVKNAQLWAAPAIAA

SEQ ID NO: 16172 - DNA, 2683 bp, Panicum virgatum
  misc_feature: Ceres CLONE 1788037
  misc_feature: Encodes the peptide sequence at SEQ ID NO. 16173
atcaatcaagctattcaatccccgtttccagccggcccggcctccacccccggccggctgccaccgccgcctcctcccgtgatcccgtcagcggcgcacccccgaccgcgcggccgcatccgcaaggtgagctccgcaccggatggcaggagcgacgccgccccggaaggcaagagcgacgccgtcgggccaccctctgctccgcacctcgtggcgtcggaggaggcccgcacttgccaatctcgatcgaggaggcttcctcgtcgcaccgagacggcggtcttgcccacatccagatctcgcgaccgtgcgtcccgccggcgactcgagcccgcctcgcgctgtcccggtgaggctctgcgccgccggctctcgtgccgccctatgtcgaccgctcccgtgcctccctgcgccgcctgctccgatcttgcgaccctgcgtaccgccggcgatacgagccccgcctcgcgtcgtctcggtgtgcctctgcgccgccggctctcatgccgccctgcgccgaccgctctcgtgcctccctgcgcggctgcgccaccggatcccgtcccgctctgcgcctctagctccagtgactccctgcgccgccggcgaccgtgccaccccgagttgctgcagcgcctgctccccaacttctccgctttggtggtgcggaggtgcggctccggtgagctcgcgtgacatccgttgcagcctccggcaagcttctcgcgcggcagcccctgcagctttgccgagctcttagcacctcccgagcttgaacggcctcctcctctgcagcacatacctccacaggaacgtcgtcggagatagcccaatcctcatccccaaagttggattggtgtccgccagccgatctgtgcaatctgttctgagattgcctccgccatgcctgcaggagttcctggtgatttgatgaatcgccccctcatctaaaccagcggagaagaacatactgagctgtggtgatcaataaccaaaggattatacatggtcaatcgattggatcttgggtaaaaattttctttaaccatgattgctcgcagtttaaaggtggttgtttatgaagtgaatctccctcgattctaagagctcaactttcattatgccaaaaaaaaaggaaaatgttcactagcagctcaatatataaattcactctcaagtagtctaccatgtcatcagcttgatcagattacagaagcatgggggctgttcttttccttcctgtgatctttctgtatttcctttccatatactaaactgtgtcaggtttccatatactattgatcatctttctgttttcacatgttgcccatcccttactacatggcaagaatgaaacgagtctgatgaaaattgcagcagttgctggacgtgctgctacctaaccagtgggtgtaggctgggaacgagtgattcagtgcacaagtgttgtgattagctggttgcttggcatttgtatgcccgggtaagttgcaatgattatttcaatgcatggcgaggcatgtagcaaggtccctgagatggtaaagacccctcctattttttctaggtccttaatgttttgttaacatgattgcgatacgatttggctcaaacctctgctccttttaatttttaatgaatatggtcactatattttggattgttggtctttaaattaatcagcaccataccctcttatcaaaatggtatccttcagacttgtcaaacttgacatcatgctgacgtgccgttgatggagaaaaccaaggacacgaaactatcacaataatgaaggaggggagtcccgtcctaacgtaatcgaccaaggagtactatttgatacgagaacaagaatagaaattgagatgtgcttgcctaaaaatgtcaccatgaatcagtgaccagagctatgttctaggcctatttttcttgtcatgtaggtcagggacaacccggttggctcacacgctctatctccgtatcaaaatttgcctatctcacaaagaccagcaaactgaacaagtgctagaatttgaggaagcaaagaagcaacaaaatagctttataattcaaattgtaaactaaagctctattcgaattgtatgcaaagaagcgaacagaggaaaagcatgtgtactctgctgctccgattgctagctcgatgagtttatctgaagatattggggaagatgtggtctctatccttcaggatgatggtgtaggcaatggggttgatagggagcttcgagcaccaatatgttgtatccttgggcacgtggatgctggaaagacaaagctgcttgattgcatccggcgaagcaatgttcagggtggagaggctgggggaatcactcagcagattggtgccacctacttaccagttgagaatatcagggaggggtcctccctgaaagctgaggtcaccatcaaagttcctggtttgcttgtaattgagacccctggccaccagtcactcagtaacatgcgcttgaggggatcaagtttgtgtgacattgttgtagtggttgttgatattacgcgtgggcttgagaagcagatgattgagtccctttaatcttttgaaacaccgcaatgtgaggtttattgttgtcttgaacaaggttgcgatatgtgtttttttaattgtattacagtataattacaatttattttattttaatcg

SEQ ID NO: 16173 - protein, 137 aa, Panicum virgatum
  misc_feature: Ceres CLONE 1788037
  misc_feature (28)..(136): Pfam Name: GTP_EFTU Pfam Description: Elongation factor Tu GTP binding domain
MSLSEDIGEDVVSILQDDGVGNGVDRELRAPICCILGHVDAGKTKLLDCIRRSNVQGGEAGGITQQIGATYLPVENIREGSSLKAEVTIKVPGLLVIETPGHQSLSNMRLRGSSLCDIVVVVVDITRGLEKQMIESL

SEQ ID NO: 16174 - DNA, 2045 bp, Panicum virgatum
  misc_feature: Ceres CLONE 1788038
  misc_feature: Encodes the peptide sequence at SEQ ID NO. 16175
agcacagaggccggccacctctcacccacgtattagcgcaatagcgcctccaccctcccccgcacgcacgggcgtgcgggagctgcggccaggaccagcagaagagcatggagctgaggccgccctgccgccgccttcaccgcgccctctaggcatccggccggccggccgacccagcctcgtcagcttccgccatggcagccaccgtcctcgtcccgccggcgcactgccatcaccgcgcaacggcggcgacgacgagccggagaggagggggaggaggcgccatctcgcattgcgccctctctcacgcgcgccggcgccggggatcgcgcgccgtgagggcggccgcgcctcccgagcagagtagcgtgtccctcgcgggagcctccgggcacgggagcgcgggcgatgccaaggccgcgctgcgccgagctctggaaggcgtggacagagggatattcgggacgacgtccgcccagcggtcgcaggtccaccgcctggtggagctgctcgaggcccggaatcccacgccggagcccaccgccgagctgcgggagaaggtggacgggtgctggaagctcatctacagcaccatctccatcctggggaagaagaggaccaagctggggctcagggatttcatcagcctaggggacttcctccagataattgacgtcaaagaggtcagtgaaggctaccgtacctgtggaatcgtcatgctgacagttctgtaattatgtgtagtatatctatgacgtgctactttgttatgatcaccctgattggctgtgggttaccatttgatcagctcaacttttatactccatccctttttttaaatatatgtcttcatacattaaaaaaacggagggagtaccttgattaggtagccttttttaatatttaaatttaaatatagtagcatagatcctgcacactgcattgcatatcatagcatttggaataggtagtaacattccaacatccaaataattgtatcttaactgagagttacctagactatacatgcaaattggatttgggttattcaaggagattctaattgcaaaccaagtaagttttgatttttgctatcacttgaaataaatggagatttagcgtcacttatctacacccaaaaggaaaaggcggtaaatgtgataaaattcagcgcgagagcactgaagatattgtcggggaagctcactgtcgaagcttcgtacagtgtcactagtaaaacggtatgggcttctttctgctgttgattatcctgattttggttagagattatatatattgtagtatcactgtcctgttgctgatcctgattgctacaagcctgtaacttcctcacaacttgtagcttcttgtttcagagagtggatatcaaacttgagagttcaactatcaccccagaacagctaatgaatatatttcagaagaactacgacatgctcctggccatattcaacccagagggttagctagagataacatatgtcgacgaaaccttgcggatcggaagagacgacaaggaaaacatctttgttctagagagagctgatccatcagaggtttaatataacaaaccagcgacgcttattcgtaactttctgacaaggagcatggcacttcctagaggattactgcctgcacatcctacggcggcacacacacacacacacacacacatggttattaccagctcagtgcagaagtcagaggctgcacaacgttcttgccgaattttgatgagaatagaacagcatatccatccgttctctgagaaacagttgtgcaagctgggcatcttctatgttcctctacatagagacttgcgaaatggtcagccttacaggaggcagacagtacagctgctggataaattgtttcctcttctttgtcaatcctatactcctacaccctagttcaagtattcttccttgtaacatcgcacaaaaaacaatagaaccattcttccttgcaacacacaatgtaatgagtgtacagctcgaaaacacacattaatcaagtacgtttttggc

SEQ ID NO: 16175 - protein, 179 aa, Panicum virgatum
  misc_feature: Ceres CLONE 1788038
  misc_feature (71)..(178): Pfam Name: PAP_fibrillin Pfam Description: PAP_fibrillin
MAATVLVPPAHCHHRATAATTSRRGGGGGAISHCALSHARRRRGSRAVRAAAPPEQSSVSLAGASGHGSAGDAKAALRRALEGVDRGIFGTTSAQRSQVHRLVELLEARNPTPEPTAELREKVDGCWKLIYSTISILGKKRTKLGLRDFISLGDFLQIIDVKEVSEGYRTCGIVMLTVL

SEQ ID NO: 16176 - DNA, 644 bp, Panicum virgatum
  misc_feature: Ceres CLONE 1788043-R
  misc_feature: Encodes the peptide sequence at SEQ ID NO. 16177
tcattttgcaatgtttgctcatgttctttttcttgaagttggagattgatttattgcaccaccctcactactaaaattaacagatgagctccattgcatgaagttgagctctgatgattatatttttgtgcagggctggtgaactgaccccagatgagcttgagcgcctcatgactgtgattgccaacccccgccagttcaaggtccctgactggttcctcaacaggaagaaggattacaaggatggtaggttctcccaggtcgtttctaacgctctcgacatgaagctcagggatgaccttgagaggctgaagaagatcaggaaccaccgtggtctgcgtcactactggggccttcgtgtccgtggccagcacaccaagaccaccggaaggcgtggaaagactgttggtgtgtcgaagaagagataagccccatgttgatgcgccttgtattggcttggcctagtttgtgtcgagtacgcggacctttgtgctgtgttttgctggaggatatgtttatctctaggatagatggtgagctgtttgggttcatgaatacttgtagcgactcctttggtgcctatgttcgaagcacggattgaatttcagtgttctgtgaaaaacaatgaagttttgcctgttcag

SEQ ID NO: 16177 - protein, 104 aa, Panicum virgatum
  misc_feature: Ceres CLONE 1788043-R
  misc_feature (1)..(94): Pfam Name: Ribosomal_S13 Pfam Description: Ribosomal protein S13/S18
MIIFLCRAGELTPDELERLMTVIANPRQFKVPDWFLNRKKDYKDGRFSQVVSNALDMKLRDDLERLKKIRNHRGLRHYWGLRVRGQHTKTTGRRGKTVGVSKKR

SEQ ID NO: 16178 - DNA, 729 bp, Panicum virgatum
  misc_feature: Ceres CLONE 1788043
gaggagaaaccctaccccgcgcagccgccgcccgtcgccgccgccgccgccgcttcgtcgaactccggcgcgtgcccgagcctcgccaatcgctgccgccatgtcgctgatcgcgggggaggacttccagcacatcctgcgtctgctcaacaccaacgtggatggcaagcagaagatcatgttcgcgctcacctccatcaagggtgtcggccgccgcttctccaacatcgtctgcaagaaggccgatatcgacatgaacaagcggtgagttgtaaatggagttttggcgttggttcatgtagtgtatttgaatcatgtcggtaatggggggctgtggatgagtcgtagttgatttgtggctggttcgtcgggagttaggggaagatcgccctccatttattcatcgattcgagaaagctagggagcagctgcagatttgagtttagaggctactcttctcttttggatgccaggcttcgataatgaggttgtctagatcctgcttgatgtgtaataaacgaggaatgattggtgctatgtaatggatttaatgttcgctgatggtaagatggatttacataggctgatgatttagtgttaaaggataattttcctgttcgtgcctgtcttagatttacctgtaaattgttagttagcacactggcaactgctgtacatggaagggtaggtcgtggtgtagtagcagtaaaagctgttcgtttctaactt

SEQ ID NO: 16179 - DNA, 3356 bp, Panicum virgatum
  misc_feature: Ceres CLONE 1788058
  misc_feature: Encodes the peptide sequence at SEQ ID NO. 16180
agctcgcgatcggattcgctccctcctcgccgcgccacaccacacccgtcggcgctggggatctctagggtttagcccagtcgcccggctcgaccccgcgccgtcctcgccgtcgccaccatgccgctcaggttggagatcaagcggaagttcgcgcaacggtcagagagggtcaagtcggtggatcttcaccccacggagccatggattctgtcgagcctctactcggggagtgtctgcatctgggattaccgggcacaggctatggtgaaatcatttgaagtttcagaactgccagtgcggtcggcaaaatttgtatcaagaaaacaatgggttgtagctggtgcagatgacatgtccattcgtgtctacaactacaataccatggacaaagttaaagttttcgaggcccatactgattacatcagatgtgttgctgtccatccaactctaccatatgtgctgtcatcatctgatgacatgttgataaaactgtgggactgggataaagggtggatatgcactcaaatctttgagggacattcacactatgtgatgcaggttactttcaatccaaaggataccaacaccttcgcaagtgcatctcttgaccgcactacaaagatatggagtttgggttctccagatccaaactttacactagatggacatcaaaagggtgttaattgtgttgactacttcactggtggtgacaggccctatttgattactggttctgatgactccactgcaaaggtctgggattaccaaacaaagagctgtgttcagacactcgaagggcatacacataacatctctgctgtctgtttccatcctgagcttcctataatcatcactggatcggaagatggcacagttcgtatatggcattcgacaacttatagactcgagaacacactaaactatggccttgagagagtttgggctgttggatacatgaagggatcaagaaggatggtgattggttatgatgagggaactattatgattaaaatgggccgtgaagtacctgtagcaagtatggacaccagtgggaaaatcatttgggcgaaacataatgaaatacaaactgtaaatattaagactgttggtgcaggctttgaggtcacagatggagaaagattacccctggctgtaaaagagttaggaagctgcgatctatacccacagagtttgaagcataaccctaatggccgattcgtcgttgtatgtggagatggcgaatacataatttatactgcattggcttggaggaatagatcgtttggatctgcattggaatttgtttggtcatcagaaggagaatatgcaatcagggaaagtacatcaagaatcaaaattttcaataaatcatttcaggagaagaaaagtatccggcctacattttcagcggagcgtatttttggtggggtattgttggcaatgtgttctagtgacttcatttgcttttatgactgggttgattgcagactaatacgccgaattgatgtcactgttaagaacctttactgggctgatagcggtgatctagttgcaatagcaagtgatacatcattctacatcctcaagtacaatagagatgttgttgcttcttatctagaaggtggaaagcctgtcgacgaggaaggtgttgaagatgcttttgagctgcttcatgaggtcaatgagcgagtgcgtactgggatttgggttggagactgcttcatatataacaattcatcttggcgcctaaattattgtgttggtggtgaggtcaccacaatgtatcacttggatcgccctatgtatttgttgggatatcttgcgaaccaaagtcgagtttatctaatcgacaaggagtttaacgtcattgggtacacattacttctcagtttgattgagtacaaaacccttgtgatgcgtggggatttggaacgcgcaaacgaaattttaccatccataccaaaggcacaatataatagtgtcgctcatttcttggagtctagaggtatgttggaagaggctcttgagatagccactgatgctgactataaattcgatctagctgtgcagcttggaaaattagatgttgcaaaggctatcgccatagaagcacaaagtgaatctaaatggaagcagttgggagaactcgccatgtctacaggcaagctagagatggcggaagaatgccttcaccaagcgaaggatttaagtggcttattgttattatactcgtcccttggagatgctgaaggaatcaaaaagcttgcttctttatcaaaaggacatgggaaaaacaacgttgcttacctctgcctttttatgcttggtaaattggaagattgcatacagttgctcatagacagcaatcgtatacctgaagctgcattaatggcgcgttcatatcttcctagcaaagtctcagagatagtagcaatttggagaaatgacctcagtaaagttaatccaaaagctgcagagtctcttgcagatccttctgaatatccaaatttgtttgatgattggcaggttgtactaactgtagaaaaaagtgttgcttctcagaggggcctctaccctcctgctggcgattacttgaaccatgctgagaagtcagattctactcttgtggaggctttcaaaaggatgcaggtcattgaggacgtggaacctgtagacccagatgaggaaaatggagagcctgatcaagaggtgttggaagagaatgaaatggagaacacggatgaagctgtcccagttggtgccgatgaacatgaagagggcgaggaacagtcgagtacgaacaatgaaggagctgcgtcagcctgaaagaatagtttcacaaatgtgaaaagtcccagtgctagctcaacatgaatagggcagagggatgcacagctcattgattgcacatgttcgttctgagggtgccagatgctgacatgcgtccgaagtgttattctgaagcactggaattggtggtgctggtgccatcagagccaccttttgcttgtcaaatccttcaaatgaacaccaaacttgacaaatggaagcatgctagaactgatgccagtctagccatcctgggaatgcttctcttggcaacaacttgcaacatttacacacccaattttcacgctcagaaatcaacgaattgggtggtcaagcagttgtaatgaatagcggtttgaataattgttatagagatatatgtagcatatgccaggttaccatagtcatggcgccttctagaagatcacagttttttgctagccacccagtgtaatttgatgctattcgataaggttacatgtagtatatgattgtgggctgaaagcttgcccatgtatgattcc

SEQ ID NO: 16180 - protein, 902 aa, Panicum virgatum
  misc_feature: Ceres CLONE 1788058
  misc_feature (319)..(779): Pfam Name: Coatomer_WDAD Pfam Description: Coatomer WD associated region
  misc_feature (219)..(257): Pfam Name: WD40 Pfam Description: WD domain, G-beta repeat
  misc_feature (89)..(127): Pfam Name: WD40 Pfam Description: WD domain, G-beta repeat
  misc_feature (132)..(171): Pfam Name: WD40 Pfam Description: WD domain, G-beta repeat
  misc_feature (175)..(215): Pfam Name: WD40 Pfam Description: WD domain, G-beta repeat
  misc_feature: SWISSPROT Homolog: EC 2.7.11.7 [Myosin heavy-chain] kinase
MPLRLEIKRKFAQRSERVKSVDLHPTEPWILSSLYSGSVCIWDYRAQAMVKSFEVSELPVRSAKFVSRKQWVVAGADDMSIRVYNYNTMDKVKVFEAHTDYIRCVAVHPTLPYVLSSSDDMLIKLWDWDKGWICTQIFEGHSHYVMQVTFNPKDTNTFASASLDRTTKIWSLGSPDPNFTLDGHQKGVNCVDYFTGGDRPYLITGSDDSTAKVWDYQTKSCVQTLEGHTHNISAVCFHPELPIIITGSEDGTVRIWHSTTYRLENTLNYGLERVWAVGYMKGSRRMVIGYDEGTIMIKMGREVPVASMDTSGKIIWAKHNEIQTVNIKTVGAGFEVTDGERLPLAVKELGSCDLYPQSLKHNPNGRFVVVCGDGEYIIYTALAWRNRSFGSALEFVWSSEGEYAIRESTSRIKIFNKSFQEKKSIRPTFSAERIFGGVLLAMCSSDFICFYDWVDCRLIRRIDVTVKNLYWADSGDLVAIASDTSFYILKYNRDVVASYLEGGKPVDEEGVEDAFELLHEVNERVRTGIWVGDCFIYNNSSWRLNYCVGGEVTTMYHLDRPMYLLGYLANQSRVYLIDKEFNVIGYTLLLSLIEYKTLVMRGDLERANEILPSIPKAQYNSVAHFLESRGMLEEALEIATDADYKFDLAVQLGKLDVAKAIAIEAQSESKWKQLGELAMSTGKLEMAEECLHQAKDLSGLLLLYSSLGDAEGIKKLASLSKGHGKNNVAYLCLFMLGKLEDCIQLLIDSNRIPEAALMARSYLPSKVSEIVAIWRNDLSKVNPKAAESLADPSEYPNLFDDWQVVLTVEKSVASQRGLYPPAGDYLNHAEKSDSTLVEAFKRMQVIEDVEPVDPDEENGEPDQEVLEENEMENTDEAVPVGADEHEEGEEQSSTNNEGAASA

SEQ ID NO: 16181 - DNA, 692 bp, Panicum virgatum
  misc_feature: Ceres CLONE 1788063
  misc_feature: Encodes the peptide sequence at SEQ ID NO. 16182
atgttgctgcgctgggagaggggtgagagggggtcgcgcgctgcgcttctacccgaccagtcgcgggataacgcggttgcaagtttttctctccattcagttgtggagcatccaccagcaccagggcgagaccgccgagacgtatcctctccgtgctgctcgagctcgcggcgtgcgatcatggtgggcgccatctccagtccggcgaacactagcagggtcgccgtggtcaccggcgggaacaaagggatcgggctggaggtgtgccggcagctcgccggcgccggcgtcaccgtcgtcttgacggccagggacgaggcgaggggcgcggcggccgttgagaagctcagggagctggggctccccgacgtccttttccatcaactggacatcaccgatgctccgagcatcgctcgactggctgatttcctggagacccgttttgggaagctggacatcctggtaaataatgcagcacttggtgcggttgagtatgttcatgacacggactatggatcagtaacgagcaaggaaaaggaaaagctcagggacacggacatggatatggatcagaggctgggatggttgtgggaaaacagccgggagacttacgacactgcaaggaaaggtctgcagacaaactactacggcacaaagcaagtgatcgaggcctgtctgcctctgctgaaagc

SEQ ID NO: 16182 - protein, 170 aa, Panicum virgatum
  misc_feature: Ceres CLONE 1788063
  misc_feature (13)..(122): Pfam Name: adh_short Pfam Description: short chain dehydrogenase
  misc_feature: SWISSPROT Homolog: EC 1.1.1.184 Carbonyl reductase (NADPH)
MVGAISSPANTSRVAVVTGGNKGIGLEVCRQLAGAGVTVVLTARDEARGAAAVEKLRELGLPDVLFHQLDITDAPSIARLADFLETRFGKLDILVNNAALGAVEYVHDTDYGSVTSKEKEKLRDTDMDMDQRLGWLWENSRETYDTARKGLQTNYYGTKQVIEACLPLLK

SEQ ID NO: 16183 - DNA, 401 bp, Panicum virgatum
  misc_feature: Ceres CLONE 1788071
  misc_feature: Encodes the peptide sequence at SEQ ID NO. 16184
ttcacgctagaggtacagtactagtactaggccagcactggcaccactcgtagcccagatcaaacgacccacgtagccaacgggagcccgagagaaaaaaatcgaatccaaccaagcggtggtgaaaagcttgggagagaagaggggagaggagaggagctcggcacaaatgccgagccccaaatcgcagaccctagcggcttccgatctgcaatgcggagggtgtgagtgagcgagggtggggggatgaggcgggtggcgcccgccatgatcgccgtcggcggcgctggcggccgcgaggagaccgccgagggggccgtgctggagaagacgctgcacaacggcgacgtctaccgcggcggcttctcccagggcccgccgcacggcaagggcacgtacgt

SEQ ID NO: 16184 - protein, 51 aa, Panicum virgatum
  misc_feature: Ceres CLONE 1788071
  misc_feature: SWISSPROT Homolog: EC 2.7.1.68 1-phosphatidylinositol-4-phosphate 5-kinase
MRRVAPAMIAVGGAGGREETAEGAVLEKTLHNGDVYRGGFSQGPPHGKGTY

SEQ ID NO: 16185 - DNA, 2045 bp, Panicum virgatum
  misc_feature: Ceres CLONE 1788072
  misc_feature: Encodes the peptide sequence at SEQ ID NO. 16186
cccggtggagtcagtcggccaactccagtggatctctttctcaaaaaaaaaactccagtggatctcgacccgcgttgagccctccccctccgttttccctcccgatcacctcctcccccctcccctcgcggcgacgactgggcgagcggcgccgcccttcctccgtcgggaccttcgccggcgaggtgcataatttgtgggcttggtgattgatagatcgagtgatcaacaaagcgattgaaaatggtggtccttgctgcttccatcgtttcaaagtcgggaaaagcacttgtgtcaagacagtttgttgacatgtctcgcataagaatcgaaggattactcgctgcattcccgaaactggttggaactgggaagcagcacacttatgttgaaacagaaaatgtgcgttatgtttatcaacctattgaaggtttatatcttctacttatcacaaacaagcagagcaacattcttgaagatctggacactttgaggctgctttccaagcttgtacctgaatactccccttccttggatgaggagggtgtctgtaaaacagcatttgagcttatatttgctttcgacgaagccatatctcttggaaataaggaaaatgttacggtgcaacaagtaaaacaatattgtgagatggagagccatgaagagaaggcacacaagctgatgatgcaagccaaaatcaatgaaaccaaggatgtcatgaagaagaaggctaatgagcttgacaaaatgaggatggaaagaggtaaacttgacaaaggaggatactcttcaatatctggtccacgtgtgattgaaaaaactttcaatgatatgagcatcagtggttctcgatttggtagtggttctggattaggtggactgagcactgacatggactcatttgctagcaagcccaaaggccgtccgtctcaacctgctactgcacctggtaaaggttttggcatgaaattgggcaagacacagaagacaaatcaattcctcgaatcattgaaagctgaaggtgaagtcattttggaggatgtacaaccaagtacagttccttcaagatcgtctgctctcccgccaagtgatcctgtcacagtgactatagaagagaagctcaatgttgttgttaaaagagatggaggtattaataacttcgatgttcaaggaacccttgctcttcaggttcttaatgatgctgatggtttcatccaattgcagattgaaaaccaagatattcctggacttagcttcaaaacacacccaaatatcaacaaggatttgtttaacagtcagcaaattttgggagcaaaagatccaaacaggcccttcccaagtggtcagaatgaaactcctctggtgaaatggagaatccaggggatggacgagtcatctttgcctctatcagtcaattgctggccgtcggtatctggaaatgaaacctatgtcaacattgaatatgaagcttctgagatatttgatctgaacaatgttatcatatctatacctctgccagcacttcgggaggctccaagtgttagacagatagatggagagtggaagtttgactcaagaaactctgtgttggaatggtctattctccttattgatcagtcgaatcgcagtggttccatggaatttgtcgtccccccagctgatccatcatcatttttccccatctctgttgggttttctgcatccagtacgttcagtgatttgaaggttactggaatccatcctctgaaggaaggcaaccctcccaagttttcacagcgggctcgtctgctcactgctaactaccaagtggtttaatgctcttatcaaggtcgagtgttgtatcacttaaaatacttccaacatctcatgatagtgacataatgtattttgccatgaacttctgtgagccatggcagggaggatcactttgcatttggagaatattctttttggttcctttcgtttttagcatgttgcacaaattgatgttctgatgtattgctacttaagaaataagtgtgagttcttgcgttttgattgcccgc

SEQ ID NO: 16186 - protein, 523 aa, Panicum virgatum
  misc_feature: Ceres CLONE 1788072
  misc_feature (272)..(513): Pfam Name: Adap_comp_sub Pfam Description: Adaptor complexes medium subunit family
MVVLAASIVSKSGKALVSRQFVDMSRIRIEGLLAAFPKLVGTGKQHTYVETENVRYVYQPIEGLYLLLITNKQSNILEDLDTLRLLSKLVPEYSPSLDEEGVCKTAFELIFAFDEAISLGNKENVTVQQVKQYCEMESHEEKAHKLMMQAKINETKDVMKKKANELDKMRMERGKLDKGGYSSISGPRVIEKTFNDMSISGSRFGSGSGLGGLSTDMDSFASKPKGRPSQPATAPGKGFGMKLGKTQKTNQFLESLKAEGEVILEDVQPSTVPSRSSALPPSDPVTVTIEEKLNVVVKRDGGINNFDVQGTLALQVLNDADGFIQLQIENQDIPGLSFKTHPNINKDLFNSQQILGAKDPNRPFPSGQNETPLVKWRIQGMDESSLPLSVNCWPSVSGNETYVNIEYEASEIFDLNNVIISIPLPALREAPSVRQIDGEWKFDSRNSVLEWSILLIDQSNRSGSMEFVVPPADPSSFFPISVGFSASSTFSDLKVTGIHPLKEGNPPKFSQRARLLTANYQVV

SEQ ID NO: 16187 - DNA, 688 bp, Panicum virgatum
  misc_feature: Ceres CLONE 1788081
  misc_feature: Encodes the peptide sequence at SEQ ID NO. 16188
ctgtccctctgctggtctcctaccggcccctctgaattcctccattgttgacgactgcgtgacgccgaggaggcagcccgaacgccggccatggggacgcagccgccggagaaccactccactgcaaaggatgagaggagcgcaagggagaaggcgatcgacgactggctcccgatcacctcatcaaggaatgccaagtggtggtactctgcctttcacaatgtcactgccatggttggtgctggtgtgctcagccttccatatgccatgtcagagcttggctggggtcctggcatcgcagtgctgatcatatcatgggtcgtcactctgtacacgctttggcagatggtggagatgcacgagatggtgccaggcaagcggttcgatcggtaccatgagcttggtcagcatgcatttggcgagaagctggggctctggattgttgtgccgcagcagctcatcgtcgaggtgggcgtcaacatcgtgtacatggtcactggaggcaaatccctgaagaagttccacgatgtgatctgcgatggcaagtgcaaagacatcaaactcacctacttcatcatgatctttgcctctgtccacttcgtgctatcccagctccccaactttaattccatctccggtgtctccctcgctgctgccgtcatgtcgctcagttactcaacaattggct

SEQ ID NO: 16188 - protein, 199 aa, Panicum virgatum
  misc_feature: Ceres CLONE 1788081
  misc_feature: Useful for making plants with altered oil content
MGTQPPENHSTAKDERSAREKAIDDWLPITSSRNAKWWYSAFHNVTAMVGAGVLSLPYAMSELGWGPGIAVLIISWVVTLYTLWQMVEMHEMVPGKRFDRYHELGQHAFGEKLGLWIVVPQQLIVEVGVNIVYMVTGGKSLKKFHDVICDGKCKDIKLTYFIMIFASVHFVLSQLPNFNSISGVSLAAAVMSLSYSTIG

SEQ ID NO: 16189 - DNA, 700 bp, Panicum virgatum
  misc_feature: Ceres CLONE 1788081-R
  misc_feature: Encodes the peptide sequence at SEQ ID NO. 16190
gtatcgggagctaccagatatatgcgatgccggtgtttgatatgatagagactgtgctggtgaagaagctgggtttccctcctggcctgacactacgtttgatttcccggactgtttatgttgctttgacaatgttcatagccatcaccttccccttctttggtggattgctcggtttctttggtggattcgccttcgcgccgacaacatattttcttccctgcgtcatgtggcttgcaatctacaagcccaaaacgttcagtctctcatggttcaccaactggatctgcattattcttggggtgcttctgatgattctatcgccaattggaggactccggcaaataataatggatgctaaaacatacaaattctactcgtaaacaactagcagtcatcgtcgtccgacttgtaaacagcatcgacgagtttttgttgcgtcaaacagaaaaggtcctgggaagagtacctgaagttggttacaatgttaggttattagttatatatacatacttgtttctgaacattccaagggtgaacgttgtgtgtgtctgtgcataagagaattaatgctggtggttgttctagatgttggcggtttaattcactgtggtttgtagtttggactttgaaagtggctagagtatgatgcttggtgaactctaaaaagcataatatttggaatttgagcggttcattc

SEQ ID NO: 16190 - protein, 126 aa, Panicum virgatum
  misc_feature: Ceres CLONE 1788081-R
  misc_feature: Useful for making plants with altered oil content
IGSYQIYAMPVFDMIETVLVKKLGFPPGLTLRLISRTVYVALTMFIAITFPFFGGLLGFFGGFAFAPTTYFLPCVMWLAIYKPKTFSLSWFTNWICIILGVLLMILSPIGGLRQIIMDAKTYKFYS

SEQ ID NO: 16191 - DNA, 706 bp, Panicum virgatum
  misc_feature: Ceres CLONE 1788093-R
  misc_feature: Encodes the peptide sequence at SEQ ID NO. 16192
tcaaaaaaaaaatttgctcgtggtcgggttgtgtaattgtatagccacccgttgtttttgcgacagtaaaggttactgatccatgacagtggtagactggtagtgtattagctcttcatttttgtcttgaatatcatgatagtggcatatgcgcgcatttggtgcgtctttttagaaggtggcatgcgtaccttgatgttgacgttactactacgatcgagctacacaacccgcacccgcgccgccgccgccccgcgccccgtcgccgcagacgactccgccccgtcgccgcgatgacgaagcgcaccaagaaggccggaatcgtcggcaaatatggaactaggtatggtgctagcttgcgtaagcaaatcaagaagatggaggtgtctcagcactccaagtacttctgcgagttctgtggaaagtttgctgtgaaaaggaaagcagttggaatctggggatgcaaggactgcgggaaggttaaggctggtggtgcttacaccatgaacactgctagtgcagtcaccgtcaggagcacaatccgtcgcttgagggagcagactgaagcataatcggagctcttctctgcagtagtcctgtgctttttgtaccgtctaagacatatggctgtttggcctaagaacattcatgaatattctggttatgcttaaggatatcaaaaattatggtgctaaaatttgtactc

SEQ ID NO: 16192 - protein, 92 aa, Panicum virgatum; identical to SEQ ID NO: 2636
  misc_feature: Ceres CLONE 1788093-R
  misc_feature (2)..(91): Pfam Name: Ribosomal_L37ae Pfam Description: Ribosomal L37ae protein family
  misc_feature: Useful for making plants with modulated cold sensitivity

SEQ ID NO: 16193 - DNA, 929 bp, Panicum virgatum
  misc_feature: Ceres CLONE 1788093
aatctcagtagctactcagaaaaatgagcccgccctaaccatccagatcacacgggcacacacaggctgggcagtggtggcgggcacgagatgggagcgcggcagtacctcgggtctcggcccggcggaagctggggcggctgcgccagggccgcgtgatgtggcggtggaggtggcggcggcagcggcggcggagttggagaaggttctcgagagggtttggagcggaggcggcggcacagtcggagacttcgcgcaggccctggcgaggacgcgggactccgccgcggcgttccgggatgcggcggcggcggagatgcggcaggtggccgcgcgccaccgcgacatggcttgcttccgctcgcgcctcgaaagcccctccccggcgattcggcggacggcggctgcgcgggggcggatgggtaatggctcaccacccagggaagcgtggtcacgcgacgcggggtccaccagcagatgcgacgcggcgcgcttcgctcactggcacgtggggcctcccggcgtctcgtccgcagcctcggcctgcggctgggcgcggtccacctcggccggtgagccgagcgcccgcgcacaggggcacggcgcacgcagctggaacggaacggttcaacgggctggggtcctcgtacgggaggcgagcccaaaacccaaaacccaaacccaatcccgccgatcagcttatcccccttttttttttgggaacaatcagcttatccccttgcgcagcacacgacgaacggcaagaggagggagaaggcagaggcgaagcgagccaattggggaggagatggagccgatgccctcctcccgctccgtgctctcctcctgcaatcggatggttgttcttgctccgtccgggagggtatccgcgagtgcgaagcggaaggagaagggagtagtatgttttg

SEQ ID NO: 16194 - DNA, 1214 bp, Panicum virgatum
  misc_feature: Ceres CLONE 1788096
  misc_feature: Encodes the peptide sequence at SEQ ID NO. 16195
gtctaaatagcgctaaaacacttcccccctcccgtcgcgcaccgacgtcaacggggacttgtcaccggcggcggtgagaagaccccagaacccgccctctagattttccttccctccctccggccgcaatggatctctggacgagggcgcgggcgttcgccggcgaggcggcgaagcggtcgcaggagctgtccgcggaggcggccaagcgctcctcggcgctggtctcggagacggcgaaaaagtccaaggagatcttctccgagaccgcctccaagtccctggagatcgccgcggaggccaccaagcaggccgacctcctcgccggccagatcaagcacctcgcctccgacctccccgtgccctcgatcccgcccatccccgcgatcccgcccatcccctccggcgccgcgtcggagcccgacgctgcggagctcgagcgatacgggatcaccgaagacctccgcgacttcgtcaagggcatgaccataagcactttccgcgactttcccctgcaagatgagccggagatgtcagatgtgcccacagtgtcgaatgtgcgtcaggatctgaacgagtggcaggccaagcacgccacactagtcctctcggcagtcaaggaaatatcaaagttcagatatgaactatgtccaagatacatgaaagaacgcaaattctggcgggtgtattttttgctagtaaacagctacacagccccctttgagaataaatattttgaggagctgaaagtgaaagcagaggaagaaaaaaaggattcccagaaggaagcatcccagtcccaggcctcacaagctacaactgcagaacagaaagacacaaaagccccaagcaaaacatctacgtcaacgaatccagaacatgatctagatgtatttctgctgggagatctgggcagtgacgatgagggccctgatgttggtgatgatgggctagatgatgactttgataagattgatgctacctcaggattggaaagtgacgacgatgacaaaaacccagcagcaggaaaggcagaagatgcaaagtagttgccggagacaagttggattgtacgcgatggtttcacggttcaagagatgtgacgatgatagcgaacttttagaattccaaatgatattgtacactagttggtcgcacgccatctgttcatttgttatctcccaatgaagcaatgccatcctattgaaactttc

SEQ ID NO: 16195 - protein, 306 aa, Panicum virgatum
  misc_feature: Ceres CLONE 1788096
  misc_feature (136)..(201): Pfam Name: BSD Pfam Description: BSD domain
MDLWTRARAFAGEAAKRSQELSAEAAKRSSALVSETAKKSKEIFSETASKSLEIAAEATKQADLLAGQIKHLASDLPVPSIPPIPAIPPIPSGAASEPDAAELERYGITEDLRDFVKGMTISTFRDFPLQDEPEMSDVPTVSNVRQDLNEWQAKHATLVLSAVKEISKFRYELCPRYMKERKFWRVYFLLVNSYTAPFENKYFEELKVKAEEEKKDSQKEASQSQASQATTAEQKDTKAPSKTSTSTNPEHDLDVFLLGDLGSDDEGPDVGDDGLDDDFDKIDATSGLESDDDDKNPAAGKAEDAK

SEQ ID NO: 16196 - DNA, 331 bp, Panicum virgatum
  misc_feature: Ceres CLONE 1788103
  misc_feature: Encodes the peptide sequence at SEQ ID NO. 16197
tcttcttccaagatgtcttgcagctgcagatcaagctgcaactgcagatccagctgcaactgcggcaagatgtaccctgaccctgaagagaagaccagcggtggtgctccggccaccgtcctcctccgcctggccccggaaaacaatgccggccacttcgaggctgcggcggagtccggtgagaccgcccacgcctgcaaatgcggcagacacgctgcacctgccacccctgcaactgctgatttgcatggcgaacctacacacctgggtggccgctagctactgcctactctgcttctgcgtcacctcacccaacaacaataacgacgac

SEQ ID NO: 16197 - protein, 88 aa, Panicum virgatum
  misc_feature: Ceres CLONE 1788103
  misc_feature (1)..(73): Pfam Name: Metallothio_2 Pfam Description: Metallothionein
MSCSCRSSCNCRSSCNCGKMYPDPEEKTSGGAPATVLLRLAPENNAGHFEAAAESGETAHACKCGRHAAPATPATADLHGEPTHLGGR

SEQ ID NO: 16198 - DNA, 869 bp, Panicum virgatum
  misc_feature: Ceres CLONE 1788114
  misc_feature: Encodes the peptide sequence at SEQ ID NO. 16199
gttcctccctaattcttcctccccttccttcgcttccgcttctcgcagcgcggcgaatcccaaatccgcgccgatccgactcgaatcaaccgagaggcgagctccctggattccccccgcggatcccccacaggccacagtcccagggggcactattcgaatcgagacgagcaccatgaacccgagaggctaccgaagcaacagaacttctctcttcgatggcattgaggagggtggaatccgagcaacatcctattcttcccatgagatagatgaacatgaaaatgatcgagctattgatggactgcaggatcgtgtcagcattcttaagcggctgtcaggtgacatccatgaggaggtggagactcataacagaatgctagaccgaatggggaatgatatggatacatcaaggggttttctctctggaactgtggacaaattcaagatggtgttcgagaccaaatcaagtcggaggatgggaaccctggtcgcatcattcgttgcgctttttctgctggtttattacttgaccaggtagaagcatccccgaggaaaccgtatgttggcttggtgtgttgaagaacatgctggaaattgatgtaccggtcgacttacgatgcagtatattatacctttgtgaactcactttcctgaatgcaaagtatgttgatcctggtgtcgcgaattctgcactgtataacgatcacacagcgtgtgttggatggactctttgcactgttgcattgtattgttgtctgttgctctgtcatgctgttcgtatggtataagcagttggttgccttgtagctggacttgtttaataataattgtatagaacgaagcttgtttggggacctgtgaggtcg

SEQ ID NO: 16199 - protein, 121 aa, Panicum virgatum; identical to SEQ ID NO: 14863
  misc_feature: Ceres CLONE 1788114
  misc_feature (36)..(98): Pfam Name: SNARE Pfam Description: SNARE domain

SEQ ID NO: 16200 - DNA, 1580 bp, Panicum virgatum
  misc_feature: Ceres CLONE 1788124
  misc_feature: Encodes the peptide sequence at SEQ ID NO. 16201
aggccaccgccaccgccaccgacatcgcctggtaacccgtcgtccccgaatccacccacccacattccccgaaccccacgccgcattctccccgatccaaccgcgccgccgcaccaggaggggaaggaagaagaaaggagacggaccatgtcgtcgccgcccgcccgcatggatctggacggcaaccccgtcgcgcccctcaccatctgcatgatcggcgcaggtggcttcatcggctcccacctctgcgagaagctcatggccgagaccgcacacgtcgtcctcgccgtcgacgtctactgcgacaagatccgccacctcgtcgaccccgcgccgccgcacctcgctggacgaatctccttccaccgcctcaacatcaagaacgactccaggctcgagggactcatcaagatggccgatctgacgataaacctggcggccatctgcacgcccgccgactacaacacgcggcccctcgacaccatctacagcaacttcatcgacgccctcccagtggtcaagtactgctccgagaacaacaagcgtctcatccacttctccacgtgcgaggtctacggcaagaccatcggcagcttcctccccaaagaccaccctctccgcaaggaacctgaattttatgttctaaaagaagatgagtcgccctgcatttttggtccaatcgtgaaacagcgatggtcctatgcatgtgcaaagcaacttatcgagaggcttatttttgctgaaggcgcggaaaatggacttgagttcacaattgtgagacctttcaattggattggaccaaggatggacttcattcctggtgttgatggccctagtgagggtgtaccgcgggttttggcctgcttcagtaataatctgctccgccgagagcccttgaagcttgttgatgggggccagtcccaaagaacttttgtctacattaaggatgccatcgaagctgttgttttgatgattgaaaatcctgctcgagctaatggtcacatcttcaatgttgggaatcctaacaatgaagttactgttagggagttggcccaaatgatgacagaggtctatgcaaacgtctcaggagaggcaccactagatgaacccatgattgacgtgagttcgagtcagttctacggtgaaggatatgatgatagtgacaagagaatccctgacataactataatcaacaagcagctaggttggaatccaaagacgcctctcaaggatttgctggagacaacattgacatatcagcacaagacatacaaggaagctgtcaaaaggcaaatgtcacaggcttcagcgtcgagttagatagggaaaggtggtggcgggctctcatttagagcgcagtcacaggtgctatggtgttttggaagtcaggatacatatatgctagtaatcgtttttgatgctctagtcgctccctagatgacatcttgttatcagggaagggatgttatccgattccgtgctgctatcaagggaagggatgttatccgtatggcagagttgatgtattctatccattgtactttgattgctcctctgtgctgtgtcaagtcattctttgg

SEQ ID NO: 16201 - protein, 390 aa, Panicum virgatum
  misc_feature: Ceres CLONE 1788124
  misc_feature (20)..(290): Pfam Name: Epimerase Pfam Description: NAD dependent epimerase/dehydratase family
  misc_feature (20)..(190): SWISSPROT Homolog: EC 4.1.1.35 UDP-glucuronate decarboxylase
  misc_feature (185)..(375): SWISSPROT Homolog: EC 5.1.3.2 UDP-glucose 4-epimerase
  misc_feature: Useful for making plants with altered carbohydrate content
  misc_feature: Useful for making plants with altered cell wall content and/or composition
  misc_feature: Useful for making plants with altered lignin content
MSSPPARMDLDGNPVAPLTICMIGAGGFIGSHLCEKLMAETAHVVLAVDVYCDKIRHLVDPAPPHLAGRISFHRLNIKNDSRLEGLIKMADLTINLAAICTPADYNTRPLDTIYSNFIDALPVVKYCSENNKRLIHFSTCEVYGKTIGSFLPKDHPLRKEPEFYVLKEDESPCIFGPIVKQRWSYACAKQLIERLIFAEGAENGLEFTIVRPFNWIGPRMDFIPGVDGPSEGVPRVLACFSNNLLRREPLKLVDGGQSQRTFVYIKDAIEAVVLMIENPARANGHIFNVGNPNNEVTVRELAQMMTEVYANVSGEAPLDEPMIDVSSSQFYGEGYDDSDKRIPDITIINKQLGWNPKTPLKDLLETTLTYQHKTYKEAVKRQMSQASASS

SEQ ID NO: 16202 - DNA, 1971 bp, Panicum virgatum
  misc_feature: Ceres CLONE 1788125
  misc_feature: Encodes the peptide sequence at SEQ ID NO. 16203
ggcagcagcacagcacagagcacacaccgcagccgctcgcagggggatcgcatcaacctcgggcggcgctctgctgccagttcgctctcggctctcgtgcagcctgccttgccttacctgggtcgagtaccagccggcggggtgcgggagcagcggccgcgaaatgcccggcggcgccttcctcctcaacagcggcggcatggcggcggaccacggcggcgggctcaccgtccccgtcgtggtgacctgcctcatggcggcctccggcggcctcatcttcggctacgacattggcatctcaggaggtgtgtcggagatggagtctttcctggagaagttcttcccggggctgctcaagacggcggcgcacgccaacaaggacgtgtactgcatctacaacaaccaggcgctcacggccttcacctcgtcgctctacgcgttcggcatggtggggacgctgctggcgagccgcgtcacccgccggctcggccgccaggccatcatgctcatcggcggcaccctgttcctggccggcgccctcgtcaacgccgccgcggcgaacatcgccatgctcatcgtcgggaggatgctgctcggcctggggctcgggttctccggccaggccacgccggtgtacctcgccgaggtggcgcccccgcgctggcgcggcgggttcatctcggccttcccactgttcatcagcgtcgggtacctcgtcgccaacctgatcaactacggcacgtcgcggatcccgggctggggctggcgcctgtcgctcggcctcgcggccgtcccggccgccgtcatggtggcgggcgccgcgttcatcccggacacccccagcagcctcgtcctgcgcgggaagcacgacgacgcccgcgccgccctgcagcgggtgcgcggcaagagcgtggacatcggcgccgagttcgccgacatactcgccgccgcggagcacgcccggcggaacgaggagggcgcgttccggcggatcctgcggcgggagtaccggccgtacctggtgatggccgtggcgttcccggtgttcctgaacctcaccggggtggccgtgaccgccttcttctcgccgatcctgttccgcaccgtcgggttcgagagcgacgccgcgctgatgggcgccgtcatcctgggcgtcatgaacatcggcggcatcctcgcgtcgggcttcgccatggaccgctacggccggaagctgctcttcgtgatcggcggcgcgctcatgttcacgtgccaggtgaccatggcgagcataatcggctcgcagctcggcaacgggagcaagatgcccaaggggtacgcggtggcggtgctgatcgcgacgttcgtcttctcggcgagcttcagctggtcgtggggcgcgctgtactggaccatccccggcgagatctacccggtggaggtgcgggcggcggggcagggcgccgccgtggcgctcaacctggggctcaacttcctgcaggcgcagttcttcctggcgatgctgtgctgcttcaagtacggcgccttcctcttctacgcgtcgtggctggtggtgatgaccgccttcgccgtggcgctggtgccggagaccaagggcgtgccgctcgagtccatgggccacgtcttcgcgcgccactggtactggggcaggttcgtcaaggatcagaataataagtttggcgacgagtccacctaatagctgctgtaataattcagaatcagcgtgtgattggtgtatagcgccggtagataatttacaaggtaattacatatcctgtgtgtgtcagtgtgtgcatgccttggtgatgactgaatgatctaagaagctcatccatgcagtacatttcgagatttgaaatataatatgtacttagtgcatataagagtcttctacaatgtagcttttgtcttgtcagtaaattgaattgctcgcaagctaccctccaattcagatactttagattgtcttct

SEQ ID NO: 16203 - protein, 510 aa, Panicum virgatum
  misc_feature: Ceres CLONE 1788125
  misc_feature (28)..(488): Pfam Name: Sugar_tr Pfam Description: Sugar (and other) transporter
MPGGAFLLNSGGMAADHGGGLTVPVVVTCLMAASGGLIFGYDIGISGGVSEMESFLEKFFPGLLKTAAHANKDVYCIYNNQALTAFTSSLYAFGMVGTLLASRVTRRLGRQAIMLIGGTLFLAGALVNAAAANIAMLIVGRMLLGLGLGFSGQATPVYLAEVAPPRWRGGFISAFPLFISVGYLVANLINYGTSRIPGWGWRLSLGLAAVPAAVMVAGAAFIPDTPSSLVLRGKHDDARAALQRVRGKSVDIGAEFADILAAAEHARRNEEGAFRRILRREYRPYLVMAVAFPVFLNLTGVAVTAFFSPILFRTVGFESDAALMGAVILGVMNIGGILASGFAMDRYGRKLLFVIGGALMFTCQVTMASIIGSQLGNGSKMPKGYAVAVLIATFVFSASFSWSWGALYWTIPGEIYPVEVRAAGQGAAVALNLGLNFLQAQFFLAMLCCFKYGAFLFYASWLVVMTAFAVALVPETKGVPLESMGHVFARHWYWGRFVKDQNNKFGDEST

SEQ ID NO: 16204 - DNA, 2132 bp, Panicum virgatum
  misc_feature: Ceres CLONE 1788135
  misc_feature: Encodes the peptide sequence at SEQ ID NO. 16205
ggggacgggacgggacgggacggacgccatggacgcctgggaggccaccaaggtggtgttcgaccgggtgcgcgcgctggacccggagaacgcctccaagatcatgggcctgctcctcatccaggacaacagcgtcaaggacctgatccgcctcgccttcggccccgagcacctgctcctcgccgtcgtcgcccgcgcgcgcgccgacctcgccgccaagcccgcgtccccgccgtcgcccgagctcggccagccgtgggggctcccgagccctagaggaggaggcgaccacctggcgccgttcggcgccgaccaggcggcgttcgacggcggcgccgacgcgttctaccctgaggagtacgagtgctggtcgccggcggccggcggccaccgccgcagcttctcgctgagcgacgacgaagtggccgcggccggcgcgtggaggccctgcatgtacttcgcacgcgggttctgcaagaacggctcctcctgccggttcttgcacggcctgcctgacgacgacgcggtggccgcggagcgggagatggtcgtcatgcgcgccaaggccttggccgccgccgccgcgcggccgcagcagctcatggcgtccgctttccccttctcgccgtcgccgcccaaaggcttcggcctcaactccctgctccagcagcagaacgagccccaaagggcggcggcggcggcggccgccatgttgcttggcggcggcgaggacatgcacaggttcccggcgcgctcgcctcggatggaccgcggcgacctcatctccagccccgccgcgcggcagatctacctcaccttcccggccgactccaccttcagcgaggaggacgtctccaactacttcagcttgtacggaccagtgcaggacgtgcgcatcccgtaccagcagaagcgcatgttcggcttcgtcaccttcgtctatgcagagacggtgaggatcatcctgagcaaggggaacccgcacttcgtgtgcgacgcgcgcgtgctcgtcaagccctacaaggagaagggcaaggtccccgacaggttcaggaagttgcagaacccgcaccatggcgacttcaccggctgcacgtcgcccaccggattgctcgattccagggaccccttcgacctggctcagccgcagattggaccaagggtgatgtacgggaacattgctaaccacgaggcgtttgtgaggaggaagctcgaagagcagcagcaggcggccgagctgcagcacgccattgagctggagggccgccggttcatggggctgcagctcctcgacctcacgagcaggggtcaccatctcggctcccctgctagctcacccatgtccctgggacaagctgacggcagagggagcggcaacgggaatggcaatgccatcattgtggaggacgtcaccgtccaagataacaagatgaacagcagtagccttgcaatgagtgcgcctgcagcagcagctgctacctctgcaactggtgcggaaggcgagcacgaggagcggcaggaaggggatggggatggtggtggcagtcccgagcaggcagtcaaccctggggaagaggagaagagggaatctgttcctgtgacagcaatacccaatgttgcgtgtggattccaagaaagagggataatcaatgaatcctcggtgctgcggaatgggtaggttacatcattccagacacacctcttgccataaccgaaggattcatgaacaagctattagaagtctggctgatatagcttactagattataacaaggaactactgaagcatatgccgtcactataaaggctggctgatataagcatattaaaagaaccgagggagtgtcaatgacagtcattgttgatagttgctctcccttttctttactagaaatgacgtggaagtcaatagggaacacctaagttgtagttctcaggtactaatctcatagttatcctttgatgttgcacctttgttgcaactgatcctagatctaccgaaaacttcttttgccaacattctagtgtcgaaaagataccccagctaatttgtactttaggaaaaatatgtgaacctagcctcattaacaaatgtttgagggttgagcagtacagtattgttcttgttccct

SEQ ID NO: 16205 - protein, 549 aa, Panicum virgatum
  misc_feature: Ceres CLONE 1788135
  misc_feature (136)..(161): Pfam Name: zf-CCCH Pfam Description: Zinc finger C-x8-C-x5-C-x3-H type (and similar)
MDAWEATKVVFDRVRALDPENASKIMGLLLIQDNSVKDLIRLAFGPEHLLLAVVARARADLAAKPASPPSPELGQPWGLPSPRGGGDHLAPFGADQAAFDGGADAFYPEEYECWSPAAGGHRRSFSLSDDEVAAAGAWRPCMYFARGFCKNGSSCRFLHGLPDDDAVAAEREMVVMRAKALAAAAARPQQLMASAFPFSPSPPKGFGLNSLLQQQNEPQRAAAAAAAMLLGGGEDMHRFPARSPRMDRGDLISSPAARQIYLTFPADSTFSEEDVSNYFSLYGPVQDVRIPYQQKRMFGFVTFVYAETVRIILSKGNPHFVCDARVLVKPYKEKGKVPDRFRKLQNPHHGDFTGCTSPTGLLDSRDPFDLAQPQIGPRVMYGNIANHEAFVRRKLEEQQQAAELQHAIELEGRRFMGLQLLDLTSRGHHLGSPASSPMSLGQADGRGSGNGNGNAIIVEDVTVQDNKMNSSSLAMSAPAAAAATSATGAEGEHEERQEGDGDGGGSPEQAVNPGEEEKRESVPVTAIPNVACGFQERGIINESSVLRNG

SEQ ID NO: 16206 - DNA, 697 bp, Panicum virgatum
  misc_feature: Ceres CLONE 1788136
  misc_feature: Encodes the peptide sequence at SEQ ID NO. 16207
gcctccctaatctcccctcccgccgctgccgcaacgccgccggccgctgcgagcgaaagaaagagggagggagggagggagggagagagatgaagggcgctggtgtcggcgcggcggcgccgggggacaacgtctacttcaagtccatcgtccctctccacaagatctccattgggccaaaactgtggaggtactatgactttgggcctaaggttgtgcctcctcttgtctgcatcccaggaattgcagggacagctgatgtatactataaacagatcatgtccctctgtatgaagggttatcgagtgatatctatcgacgttcctcaagtttggaatcaccatgaatggattcattcatttgaaaaattcttggactccatgaacatccatcatgttcacatttatggtacatctcttggtggatttttggcacaaatatttgctcagcaccgtccaaggagagtgaaatccttgatcctatcaaatacttttcttgagacacacaagtttgcagctgccatgccatggtctccagttgttaattggaccccttcttttttgctgaagcgatacctcttgacaggaatccgagatggtccccatgaaccattcatcgcggactcagtagattttgttgtgggtcaggtcgagtcattgtcaagagatgacctttcgtcaaggttgatgttaaatgt

SEQ ID NO: 16207 - protein, 202 aa, Panicum virgatum
  misc_feature: Ceres CLONE 1788136
  misc_feature: SWISSPROT Homolog: EC 3.4.11.5 Prolyl aminopeptidase
MKGAGVGAAAPGDNVYFKSIVPLHKISIGPKLWRYYDFGPKVVPPLVCIPGIAGTADVYYKQIMSLCMKGYRVISIDVPQVWNHHEWIHSFEKFLDSMNIHHVHIYGTSLGGFLAQIFAQHRPRRVKSLILSNTFLETHKFAAAMPWSPVVNWTPSFLLKRYLLTGIRDGPHEPFIADSVDFVVGQVESLSRDDLSSRLMLN

SEQ ID NO: 16208 - DNA, 674 bp, Panicum virgatum
  misc_feature: Ceres CLONE 1788136-R
cttccctgtcacgtccagatgaggttaatctgtaccttcagctacatttggggcgagttggtgtagaaccaaagccagatcgggtccaaggtttcacaagaaatggcactgctgggagttcaaacaatcagaaagttggaggggacagctttggtgatagccctgaagacagtggccaccttggttcaggtggcagtgatcatgatgcgcggcatcatcgatcgaaatcacaagattctgatgagccgataccaacaagcacaatgtactaggtttgctcggcccaatcctgtaagcttcactatgatgtgtcacaggtgttccatgacaaatataaaatcatattaacaatgtactaatgtcgttgcattttatgtttcattgtttcgtcaagatagttccatatgtgcagaagtgggtccgttgaaaatcatggaagcgcatgtcgcacctgcattggagtcagtgttgccactgggaaagccgaaacagcgcctctgcaggtggaaaggcacttttgtttgtgtgtataatatgcttgctttctgtatttaaacgattttctgtatatcaggcctgtaaattggattccatcccgtacattatatgattgtgatcacctaattttctgggtaccatacattaatgatttattctgcaatttcttaccattt

SEQ ID NO: 16209 - DNA, 1440 bp, Panicum virgatum
  misc_feature: Ceres CLONE 1788145
  misc_feature: Encodes the peptide sequence at SEQ ID NO. 16210
atccctccgctgtccgctccctcttatctgctccgcctccccgctctccccccacctccaccaccaccaccatggccacagccgcggcggcggccgccgcctcctcgctcctcgcgccggcggccagcacggcgccggccgcgcccaacgcgctgctgttcccctcctccgtgccgacgctgcgcgcctacccgcggctgctcctcgcgttccgccgccccgcggccgccgccgtcgccgacccgcagggggccgtgctcgaggcggaggaggtcgaggccgaccagcgcggccggtacgacgacgaggacgaggacggcgggtacgagggcggccgcggccccgcgttcacgccccccacgcggccgcgcaccggcaaggccgccctgccgctcaagcgcgaccgcacgaggtccaagaggttcctcgagatacagaagctgagggagagcaagaaggagtacgacgtgcccaccgccatctcgctgatgaagcagatggccagcgcgaaatttaaagagtcggccgaggcgcacttccgtatgaacctcgaccccaagtacaacgaccagcagctccgcgccacggtgaatttgcccaagggaacaggccagccggtgaagattgcggtcctcacacaaggcgagaagatagatgaagctagagctgcaggagctgatatagttggtggagatgaattgatcgaacaaataaaaggagggtttatggagtttgacaaattgattgcgtcacctgatatgatgcctaaggttgctggcttgggtaagattctaggacccagaggactgatgcctaacccaaaagctggcactgtttctccaaacatttctcaggctatcgaagagttcaagaaggggaaagtcgaatacagagttgacaaaacaggaatcgtccatattctgttcggcaaggttgacttccctgaagaagatcttatctctaacttcatggctgttgtgcgctctgttgagaggaacaagccatctggtgctaaggggatatactggaaaacggcatacttgtgctcatccatgggaccttcaatcaagctaaacataaaagaaatgcttgactatggcacggaatcatcttagatgtcaccacaggcaccagttaagtcatctggcatttgggaccacctccacagttttaaccatccgtccctgctacagatgagcacagaaacaatggtcggggggtaatcgggtatgatggcaggtaggtgcttagatatataattttttttcagtttgacgagcacccatcatcagagcagttaaactatgcccagattgacaaagaggtgatctcgttgatcatgtatttaagagcaaatcatgcatggattcatagatgtctttctctgagatgtttgttgtaatcttcaataatttgtcaatagtcatccttgatctcacc

SEQ ID NO: 16210 - protein, 347 aa, Panicum virgatum
  misc_feature: Ceres CLONE 1788145
  misc_feature (126)..(331): Pfam Name: Ribosomal_L1 Pfam Description: Ribosomal protein L1p/L10e family
MATAAAAAAASSLLAPAASTAPAAPNALLFPSSVPTLRAYPRLLLAFRRPAAAAVADPQGAVLEAEEVEADQRGRYDDEDEDGGYEGGRGPAFTPPTRPRTGKAALPLKRDRTRSKRFLEIQKLRESKKEYDVPTAISLMKQMASAKFKESAEAHFRMNLDPKYNDQQLRATVNLPKGTGQPVKIAVLTQGEKIDEARAAGADIVGGDELIEQIKGGFMEFDKLIASPDMMPKVAGLGKILGPRGLMPNPKAGTVSPNISQAIEEFKKGKVEYRVDKTGIVHILFGKVDFPEEDLISNFMAVVRSVERNKPSGAKGIYWKTAYLCSSMGPSIKLNIKEMLDYGTESS

SEQ ID NO: 16211 - DNA, 732 bp, Panicum virgatum
  misc_feature: Ceres CLONE 1788148
  misc_feature: Encodes the peptide sequence at SEQ ID NO. 16212
aacgcctcgtacagtttcttcgtgacagcaagtaaaagccataccaaaactaccacaagaaaagtttttgtagcagctagctgttgcaaatggcgtcgacggtggcgagcctcaccaccccggcgaccttcgcggccgccgacgtggtcccgaggagaaaggtcgtcgccggccgcgtctggttccccgtggcgcgccgcggcggcttcgccgtgatgaggtcgagcgggccggcgacgccgccggggatctccgacaaggtgtcggagagcatcaagaaggcggaggagacgtgcgcggaggagacggcctccggggagtgcgcggcggcgtgggacgaggtggaggagctcagcgccgcggcgagccacgcccgggacaagctcaaggagaacagcgacccgctggagaactactgcaaggagaaccccgaggccgacgagtgccgcacctacgacaactagagcgcgcatgtatatatgctaaatttgccgcacacgatcgaaggatagcgaagtgaagaagtggctatgtaagctggtgaatttgcacgaagcttcatatttctccgcctgtattatcctgcatattacttgcttgcgtgttgcaaattatatacatatagttataattttaaaagtaaaatacactatcggtccttggattaaaaaaccaattctctctcttcctctctctctcgctctcttctcagcagtcagctaacgacatcct

SEQ ID NO: 16212 - protein, 124 aa, Panicum virgatum; identical to SEQ ID NO: 12230
  misc_feature: Ceres CLONE 1788148
  misc_feature (54)..(124): Pfam Name: CP12 Pfam Description: CP12 domain

SEQ ID NO: 16213 - DNA, 730 bp, Panicum virgatum
  misc_feature: Ceres CLONE 1788149
  misc_feature: Encodes the peptide sequence at SEQ ID NO. 16214
ctcggctggctcctcgctcccgcatctcgcctcgccgtgcgggcctggatcgcacgcgacctccaaatgcgaccgcatctcctccgacgcctcctcctcctcgccgccgccacgctaccgccgccggccgattgccgccagggcggccaccacgcggcccctccgccgccgaaacaccacgacaagagcggcgcgctcaccgtcgcgctcgccgtcgccgcgtcgctcctcgcgctggtcctgctctacctctgcgcggccatcgccgtccgccgcttccgctcccgcggcgcggtggggaggggaccggcctcctcctcctcctcctcctcctctgcggcgtcccgcgccgcggcgtttcttcgccggaacgggctccagcaccaccgcccggccttcacctacgagcagctccgcgccgccaccgcgggcttcgacgcgggccgcaagctcggcgacggcgggttcgggacggtgttcctcgcgtacctcccgcccgccggccgccccgccgccgtcaagcgcctccacgttccgccatccccgtcgccgtccttcccttccgccgccgccaccatcaccaagtccttctgcaacgaggtgctcatcctctctgcgctccgccacccgcacctcgtccgcctccacggcttctgcgccgacccccgcgcgctcctcctcgtctacgacttcgtccccaacggcacgctctcgcacacctccaccgccg

SEQ ID NO: 16214 - protein, 221 aa, Panicum virgatum
  misc_feature: Ceres CLONE 1788149
  misc_feature: SWISSPROT Homolog: EC 2.7.11.1 Non-specific serine/threonine protein kinase
MRPHLLRRLLLLAAATLPPPADCRQGGHHAAPPPPKHHDKSGALTVALAVAASLLALVLLYLCAAIAVRRFRSRGAVGRGPASSSSSSSSAASRAAAFLRRNGLQHHRPAFTYEQLRAATAGFDAGRKLGDGGFGTVFLAYLPPAGRPAAVKRLHVPPSPSPSFPSAAATITKSFCNEVLILSALRHPHLVRLHGFCADPRALLLVYDFVPNGTLSHTSTA

SEQ ID NO: 16215 - DNA, 1987 bp, Panicum virgatum
  misc_feature: Ceres CLONE 1788150
  misc_feature: Encodes the peptide sequence at SEQ ID NO. 16216
agttctcctgcctgccctgccgctcgtcctcgcgcgccgtctagggtttcgccgccgcaaccggatccactccaccgccgcgtcccgcgccgccgccatggacttcgacgagtacgagtacctggagaaggcggtggagcccgccgccccgcgggccaacggctccggcgccggcgagaaggaccgcggttcgcgccgccgcgagggcggcgaggaccgcgtatcgaagcgctcccgctccggggaggaccgcgaccgggagcgggagcgggagcggcaccgcagcagccgcgagcaccgcgaacgggaccgggaccgggatgacggcaaggataaggagaagagccgcgacagccgcgggaaggacagggaccgtgagggaagggaccgggagaaggagagaggggacaggcaccgacccagggagagggaagtggaacgggagcggaggagccggagccgttcggagcggcagcgcgccgaggaggagatggtgagggagctggagcgggagcgggagcgcagcgagcgccaccactaccgcgaccgtgatgtcaggcgtaggaaagatgatggtgcagagccagaagttgatccagaaagggaccagaggactgtatttgccttccagctatcattgaaggcggacgaaagagatgtttatgagttcttctcaagggctggaaaggttcgtgatgttcgccttattatggatcgaaactcacggcgttctaaaggagttgggtacattgagttttacgacgttatgtctgttcccatggcaatcgctctgtctgatcaaccgcttcttgggcaagcagtgatggttaagccatccgaggccgaaaagaacttagttcagtccaacgcgacatctggtggtgcagcttctggtggagcaagaaagttgtatgttggcaatcttcactctaatatcactgaagaccaattgagacaggtatttgaaccatttgggcaagtggagcttgtacagctgcccctagatccaatgactggactttgcaaaggttatggtttcattcagtttgcacggcttgaaaacgcaaaagctgctcagagcttgaatgggcagcttgatattgctggcagagttattaaggtttcagctgttaccgatcatgtgggagtccaagttagtggagcaactactggagatttagatgatgatgaaggtggaggcttggcattaaatgcaagctccagagctgctcttatgctcaaattggacaggagtggcactgcaacaagcttaactggtggtattggtgctgctggagtggctataccaaggccagctgcatcagttgttggggctccagcagttgcttctcttgtaccacctacaattcctgctgttggatcagttcctggggcacctgtgcttcctatcactactcaatctgcggtcatgtctacgcctacagaattcttattgcttaagaacatgtttgaccctgcagtggagacagatcctgattttgatttggatataagagatgatgtgcaagatgaatgttccaagtttggtgcagtgaggcacatttttgttgacaaaaatactgcaggctttgtgtacctgcatttggatagtgtgacggcagcagcaaaggcccaacaagcactccatggaagatggttcgctgggaaaatgattacagcaacatttatgtccgcacaggaatacaatgcgaagttcccaaacttgtgaacagcttatgcgggcaagatttggcaatacccgcttagatcgttttgagtgacagcaagtgttgtatttttggaggttagacgaatacctttgtacggaatagttgtgaatctggcgtcagttccaatgtttgatgatgtactatagggcttcacatggtgaccaagcctttaatcctagtatacagcatgcttgatttacgtgttgattcatttggttttcacgctgaaatgagcagaacggggaagtttgtggcag

SEQ ID NO: 16216 - protein, 543 aa, Panicum virgatum
  misc_feature: Ceres CLONE 1788150
  misc_feature (271)..(342): Pfam Name: RRM_1 Pfam Description: RNA recognition motif. (a.k.a. RRM, RBD, or RNP domain)
  misc_feature (174)..(244): Pfam Name: RRM_1 Pfam Description: RNA recognition motif. (a.k.a. RRM, RBD, or RNP domain)
  misc_feature (429)..(536): SWISSPROT Homolog: EC 2.7.11.1 Non-specific serine/threonine protein kinase
  misc_feature (269)..(343): SWISSPROT Homolog: EC 5.2.1.8 Peptidylprolyl isomerase
MDFDEYEYLEKAVEPAAPRANGSGAGEKDRGSRRREGGEDRVSKRSRSGEDRDRERERERHRSSREHRERDRDRDDGKDKEKSRDSRGKDRDREGRDREKERGDRHRPREREVERERRSRSRSERQRAEEEMVRELERERERSERHHYRDRDVRRRKDDGAEPEVDPERDQRTVFAFQLSLKADERDVYEFFSRAGKVRDVRLIMDRNSRRSKGVGYIEFYDVMSVPMAIALSDQPLLGQAVMVKPSEAEKNLVQSNATSGGAASGGARKLYVGNLHSNITEDQLRQVFEPFGQVELVQLPLDPMTGLCKGYGFIQFARLENAKAAQSLNGQLDIAGRVIKVSAVTDHVGVQVSGATTGDLDDDEGGGLALNASSRAALMLKLDRSGTATSLTGGIGAAGVAIPRPAASVVGAPAVASLVPPTIPAVGSVPGAPVLPITTQSAVMSTPTEFLLLKNMFDPAVETDPDFDLDIRDDVQDECSKFGAVRHIFVDKNTAGFVYLHLDSVTAAAKAQQALHGRWFAGKMITATFMSAQEYNAKFPNL

SEQ ID NO: 16217 - DNA, 1656 bp, Panicum virgatum
  misc_feature: Ceres CLONE 1788160
  misc_feature: Encodes the peptide sequence at SEQ ID NO. 16218
aaggctcgttgacaaaactcctctgtcgccctctctcctccgtcctccgttgctcttcctttcccggcggcgccgactgggggagcggcggcgccatttgtcacgtcttcgcccagcccttagccggcgacgagcgtcctccaggtccgcccctgatgcggattcttttgctgaccagtagagcatgatcctgcggtgagcgcagatagctcgtgcaagctgctggcttgggggttctcttggtaatctgctccagagaaatcctgaggcaatagagtgaaatggatgcgagcccggatgttgctgatgcttttggtgcaaagagcattgacaatggggcgatggggaagttgccgcctggtgatgttatagaggggcatggagaagaacacgatgtgctggctgatggagctcattcgggtgagagtgaggttatcaacccatctgaagaggtggaaggggaagccacctcaccatcgcaggacgtgaagcctcgtgttcctgcggacagtcaaagccattcgccaaaggttgttagatctcagcgacagagccctcgtggcggagataagagtcaagctaggaaaagctctcctagtccttatcccaaggcacccatcgcacgagtttctgatccggatcttgttgatagctcttcaagcaatggtgatgctagtgtcagtaaaaaaaaggctgaaaagagcagttttcgcccagttgccaaggagagctcatcacttgaggactctaaagagaagaagaaaactcagaagccatcaaaccaacgttctgttaaaaaggatattgaagaagaatcaaatgaaagtataaaacctcaaagggttggcagcactccttcttatggctttagttttaagtgtgatgagagagctgaaaaaagaagagagttctactcgaagcttgaggagaagattcatgcacaggaactagagaaaagcaacttgcaggcaaaatcaaaggaagctgaagaagctgaactcaaaatgcttagaaaaagtttaaatttcaaggcagcacccatgcctagcttttacaaggaaccacctcctcccaaggttgagttaaagaagatccctacaacaagacctagatcaccaaagcttgggcgctccaagaacacaacctccacaggcacagaaggaaagacaaatcctccagtccgttcagctcgtctgagcctcgatgaaagggcatccttaaatggtgtcaagcaagcacccactgcaaatgcagtgaagaagccccaacgcaaatctttccctaaattgccatcggagcaaacggctaaagttcatgtcgcagcacctctttcatccggagaagagctagaaaacaagtcatcgacagatcttgttcgagagccaatccgtgctcaagttactcctgatgaacctggactccctggctaaatgaaacctatcaagtccgactccaatgaaatgggagggctgtaccccagcttcctttatcacattttgctatttctgcagtacactgctggctggtattatgtgctaaaattagtctcatccccacgagtttgtagaatggcaagtgaccccctgtattgtttgtcttagtttccgttcacatacgaggcatttgtagttggcaataatttcatatgattgtccc

SEQ ID NO: 16218 - protein, 382 aa, Panicum virgatum
  misc_feature: Ceres CLONE 1788160
  misc_feature (198)..(254): Pfam Name: TPX2 Pfam Description: Targeting protein for Xklp2 (TPX2)
MDASPDVADAFGAKSIDNGAMGKLPPGDVIEGHGEEHDVLADGAHSGESEVINPSEEVEGEATSPSQDVKPRVPADSQSHSPKVVRSQRQSPRGGDKSQARKSSPSPYPKAPIARVSDPDLVDSSSSNGDASVSKKKAEKSSFRPVAKESSSLEDSKEKKKTQKPSNQRSVKKDIEEESNESIKPQRVGSTPSYGFSFKCDERAEKRREFYSKLEEKIHAQELEKSNLQAKSKEAEEAELKMLRKSLNFKAAPMPSFYKEPPPPKVELKKIPTTRPRSPKLGRSKNTTSTGTEGKTNPPVRSARLSLDERASLNGVKQAPTANAVKKPQRKSFPKLPSEQTAKVHVAAPLSSGEELENKSSTDLVREPIRAQVTPDEPGLPG

SEQ ID NO: 16219 - DNA, 735 bp, Panicum virgatum
  misc_feature: Ceres CLONE 1788169
  misc_feature: Encodes the peptide sequence at SEQ ID NO. 16220
gcctatagcctgctccctctccctctccctctctctctagtctagtccaccaccaaccattatggcctccctctcctctgccgccgtcaccgccccttccttcgcggcttcccggcccgcccgcgccgctgccaggcgctctgctgccttcaccgtgcgcgcctcgctcggcaaggccgccggcaccgccgccgtggccgtggccgccagcgccctgctcgccggcggcgccatggcccaggaagtgctgctcggcgccaacggaggcgtcctcgtcttcgagcccagcgagttcaccgtcaaggccggcgaggccatcaccttcaagaacaacgccgggtaccctcacaacgtggtcttcgacgaggacgaggtgcccagcggcgtcgacgccgccaagatctcgcaggaggagtacctcaacgcgccgggcgagacctactccgtcacgctcaccgtgccgggaacctacggattctactgcgagccgcaccaaggagccgggatggtcggcaaggtcaccgtcaactgatgcgatgccatgccatgccatgatcgagtatatatattcaagcgtatctgcgtatgtacgtaccaggctataggctagctagctagagagcttagcttgccactcagatcagtcatcatctccatcttgtaccaagtggcatgcatgcatgcatgcatgctattacttcatcatatttaaagagacctcttctaccatttttg

SEQ ID NO: 16220 - protein, 156 aa, Panicum virgatum; identical to SEQ ID NO: 13903
  misc_feature: Ceres CLONE 1788169
  misc_feature (60)..(156): Pfam Name: Copper-bind Pfam Description: Copper binding proteins, plastocyanin/azurin family
  misc_feature: Useful for making plants with modulated nitrogen use efficiency

SEQ ID NO: 16221 - DNA, 1255 bp, Panicum virgatum
  misc_feature: Ceres CLONE 1788178
  misc_feature: Encodes the peptide sequence at SEQ ID NO. 16222
atcctagctcgcgccgccgccgccgccgctctccccacctctaccctcgcagccccaacctcctcggcgaccatggccggcgcgcaggaatcgctctccctggtgggcacgatgcgcggccacaacggggaggtgacggcgatcgcgaccccgatcgacaactcgccgttcatcgtctcgtcctcccgcgacaaatccgtgctggtgtgggacctgaccaacccggtccactccaccccggactccggcgccgccgctgactacggcgtccccttccgccgcctcaccggccactcccacttcgtccaggacgtcgtcctcagctccgacggccagttcgcgctgtccggctcctgggacggcgagctccgcctctgggatctctccaccggtgtcaccacccgccgcttcgtcggccacgagaaggacgtcatctccgtcgccttctccgttgacaaccgccagatcgtctccgcttcccgcgacaagaccatcaagctctggaacaccctcggtgagtgcaagtacaccattggcggtgaccacggcggcggcgagggacacaacgggtgggtctcctgcgtcaagttctcccccaacaccttccagcccactattgtctccggttcctgggaccgcactgtcaaggtctggaaccttaccaactgcaagctgcgctgcacgctcgccggccacggcggctatgtcaacgccgtcgccgtgagccccgacggttcgctgtgcgcctccggcgggaaggacggctttactctgctgtgggatttgtctgaggggaagaggctgtactcgctggacgcgggttccatcatccactcgctctgcttctcgcccaaccgctactggctgtgtgctgcgacgcaggactccgtcaagatctgggaccttgagtcgaagcacgtcgtgcaggacctcaagcctgacatccagatctccaagaaccagatcctgtactgcacaagcttgagctggagtgcggatggaagcaccctctacactggctacacggatggatctatcagggtctggaagatctctggattcggctacgcaggctagatggtaaaagccttttggaaggtctaggaagtctttgttcggcaaaacaatgtagtgttccgtcaatattttgactatcgtgagctatatagtctgtttggtacttttcagtcgcccaactatttatgcttagctttgttaatgagctaatcgtactatgaagaatctattttgcacc

SEQ ID NO: 16222 - protein, 334 aa, Panicum virgatum
  misc_feature: Ceres CLONE 1788178
  misc_feature (107)..(145): Pfam Name: WD40 Pfam Description: WD domain, G-beta repeat
  misc_feature (155)..(195): Pfam Name: WD40 Pfam Description: WD domain, G-beta repeat
  misc_feature (199)..(237): Pfam Name: WD40 Pfam Description: WD domain, G-beta repeat
  misc_feature (65)..(103): Pfam Name: WD40 Pfam Description: WD domain, G-beta repeat
  misc_feature (8)..(47): Pfam Name: WD40 Pfam Description: WD domain, G-beta repeat
  misc_feature (288)..(326): Pfam Name: WD40 Pfam Description: WD domain, G-beta repeat
  misc_feature: SWISSPROT Homolog: EC 2.7.11.7 [Myosin heavy-chain] kinase
MAGAQESLSLVGTMRGHNGEVTAIATPIDNSPFIVSSSRDKSVLVWDLTNPVHSTPDSGAAADYGVPFRRLTGHSHFVQDVVLSSDGQFALSGSWDGELRLWDLSTGVTTRRFVGHEKDVISVAFSVDNRQIVSASRDKTIKLWNTLGECKYTIGGDHGGGEGHNGWVSCVKFSPNTFQPTIVSGSWDRTVKVWNLTNCKLRCTLAGHGGYVNAVAVSPDGSLCASGGKDGFTLLWDLSEGKRLYSLDAGSIIHSLCFSPNRYWLCAATQDSVKIWDLESKHVVQDLKPDIQISKNQILYCTSLSWSADGSTLYTGYTDGSIRVWKISGFGYAG

SEQ ID NO: 16223 - DNA, 1555 bp, Panicum virgatum
  misc_feature: Ceres CLONE 1788179
  misc_feature: Encodes the peptide sequence at SEQ ID NO. 16224
ataaaaaatcctgcagttcttccccgtcccccgcccgcagccaccgcaacgcgcctccctccgccgtgccgaagccggagagctcggcagccgcctgccgcggtgccgcccagccagcgaacagccggttccgccgtgcgcgtcgcgacaaagcacgggaaacagcggccggcaccgcgaatatacccagcccgcggccactccccgtctccctccctccctcccctttccgctttgttcacttccgcgccgctcgctgccgtgccgtgccgtcccgccctcccgcgccgcacggctcacatcccatttccactcacccgacctcccaaaacccacacggactcgcgggcgccagcatggcggtggcctccgcctcgcccctcccggcggcgttgtccgccaagcccggccccgcccgctcgccgccgcggcccgctcccggcttcctcccgctccgcgccggcggagccccgcacctcggccccgtcgccgcgtggagggggaggaggtggttccgcgcggaggcgataaagacgcagcaggacaagcagcagacggaggcgcccgtcgaggagtccttccccgtgagggaggccgcgccgctggacggagcggacgacccgatggttccctcggacgagagctgggtggtcaagctcgagcagtcggtcaacattttcctcacggagtcggtgatcatggtactggatggtgtttaccgtgatcggaactacgccagattttttgtgcttgagacgattgctagggtgccgtattttgcatttatatcggtgcttcacatgtatgaaacctttggctggtggaggagagctgattatataaaggttcactttgccgaaagctggaatgagttccatcacctcctaatcatggaagaattgggtggcaacgctttatggattgatcgtttccttgctcggttcatggcattcttttactacttcatgactgttgggatgtacatgctgagcccaagaatggcatatcatttttctgaatgtgtggagaggcatgcatattcaacttatgacaagtttctcaagctccatgaagaggagttgaaaagactaccagctccagaggcagctctaaactattacctgaatgaggacctttatttatttgatgagtttcagacagcaagagttccatgttctagaaggcctaaaatagataacttgtatgatgtattagtcaatatacgagacgatgaggcagagcactgcaagacaatgaaggcctgccaaacgcatggaaatcttcgctctcctcactcagcacacaactgctcggaagcagatatggaatgtgtaatacccgaaaatgattgtgaaggtatcgtggatcgtgtgaaaaagtcacttacaaagtaaagtccgagacatctatcttttgtgttttcagtcattatagtatacaaaattttgatgatattccttttgtttttcattttcccataaaattaggaaatagtcgtcctacagttatttttttattttgtgccatatattacagaagtcagtgtagatgcagc

SEQ ID NO: 16224 - protein, 345 aa, Panicum virgatum
  misc_feature: Ceres CLONE 1788179
  misc_feature (39)..(326): Pfam Name: AOX Pfam Description: Alternative oxidase
MAVASASPLPAALSAKPGPARSPPRPAPGFLPLRAGGAPHLGPVAAWRGRRWFRAEAIKTQQDKQQTEAPVEESFPVREAAPLDGADDPMVPSDESWVVKLEQSVNIFLTESVIMVLDGVYRDRNYARFFVLETIARVPYFAFISVLHMYETFGWWRRADYIKVHFAESWNEFHHLLIMEELGGNALWIDRFLARFMAFFYYFMTVGMYMLSPRMAYHFSECVERHAYSTYDKFLKLHEEELKRLPAPEAALNYYLNEDLYLFDEFQTARVPCSRRPKIDNLYDVLVNIRDDEAEHCKTMKACQTHGNLRSPHSAHNCSEADMECVIPENDCEGIVDRVKKSLTK

SEQ ID NO: 16225 - DNA, 2292 bp, Panicum virgatum
  misc_feature: Ceres CLONE 1788183
  misc_feature: Encodes the peptide sequence at SEQ ID NO. 16226
agacccttaccaatgcaatcctgacgtgcttcacttacccgcctgtttttttttatttcccgattaaaacacttttctttcccaaaagattacgtgcgaagaccgaagaggggagctaggaaaaggaaaagaaaagaaagagagagagagagaagaagaaaatgggggtagaagaaggcggtgtgatgtgaggggaaattacgtactagggtataagccaaatccattgatttctctgggctgcatgagctgagttgtttgagtggtctgcgaggactcctgagctgccagtgtgcaagctttgcttcttgcctattttcttgtgttttctctctattttttcctagtgctttcctatttctggagatttcttggaagaattgtgtgcttcattctcagacggagatctctaatttgtctgctttatttgccaaatcctgaccatccccattattttcaatttttatttactctgctttaccccttcttcctgccgttttcgtttcccatttcctcctcgtttctcccccgccattccaagctgctgccacccaccaccctacgctgtaaaatctgtgctgctctgctcgtcgccgaaaattttggctttgagcagcgctggttttttttttccagctcctacctcactccgccgctcgtaagatttggcccttgcagcagagaagctgcaacctttggagcgagaaatcgtcggagggagctgttgattcgtagctctctgctgctcacttgctcagtgtggaatgatggaggtgaggccgtcttcggagcaaggggtgattccggggagggagccgttcgggctgccgaaaagcccgccgacgccgccgtcctccggcggcccgcagagcctgcgcatggcgttcaccacggacggcacccccgtcttcgccccggtgagctccgcgccgccggcgacggcgacgtaccagcccttgggcggcggggccgctccgagcttggctgccgcaggaggcaatggcagagcggcggtgcacccggctcccgctggcgctggcgagccggtggccaagaagaagcgtggccggccaaggaagtacggccccgacggctccatgtcgctggcattggtgcccgcgtccatggctgcggcgccggggcccgcggctcccggcgcctccgggcctttctcgcctgaaggcaccaagacgccgagcactgcgccgtcagcgtcgccggagggggcgaagaagcggggccgaccgaagggctccaccaacaagaagcacgtgcctgctcttggctcagcaggggctggatttacacctcatgtcattttcgttaaaaccggcgaggacgtatcagcaaagatcatgtcgttctctcagcacgggacgcgcgcggtctgcatcctctcagcaaatggcgccatatcaaatgtgacgcttcggcagtctgctacctctggtggaacagtgacatacgaggtttgtagtttgttttactgtcagagatcgaagtctccgggccggttcgagatactgtccctgtccgggtcgttccttctgtcggagaacggcggccatcgcagtcgaaccggtgggctcagcgtttcgctagcaggccctgacggccgtgtcctgggcggcagtgtcgccggacttctcacagctgcttcgccagtacagatcgtagcggggagcttcaacccccatggaaagaaggaaccgccgaagcagcagcagcaacagctgcttgccccgtcaccgtcggacgcgtcaccgacgccgctaaaggtcgcgccggcggcgccgagcagcccgccgtccaggggcacgatgagcctgagcgagtcatccggcggggccccgagccccccgccgcacgcaggcggcggcagccacgggcaacagcaccagtcggcagggggtttctccggcgcgtcctggaaatgacctccgatcccccgcgccatcggtgaccggagcaggctccgtctctctcaccgtcgtaggactctggcagaacgaaggacgtccggtggccgtcgaggaaccagaagctcttttgtgtagggtgacgcactgatgcgttggagggacgacgagaagctttgtagccttgtaggtggtgtgcgtgtcgtcagactctgcagctctcgctttaggtgttgacgtgtgtgtgtctcgatcgtgcagcggtagtgctggtagggcgggctgctgcttatcgtcgtccgggtgccgtgtactgaatctttaccgttatgctgtgcgattatgcggcatgttcgatgctgcgtgcgtttcg

SEQ ID NO: 16226 - protein, 389 aa, Panicum virgatum
  misc_feature: Ceres CLONE 1788183
  misc_feature: The sequence is a functional homolog of SEQ ID NO 1012 in the 10/225,066 US patent application
  misc_feature: The sequence is a functional homolog of SEQ ID NO 124 in the 10/374,780 US patent application
MEVRPSSEQGVIPGREPFGLPKSPPTPPSSGGPQSLRMAFTTDGTPVFAPVSSAPPATATYQPLGGGAAPSLAAAGGNGRAAVHPAPAGAGEPVAKKKRGRPRKYGPDGSMSLALVPASMAAAPGPAAPGASGPFSPEGTKTPSTAPSASPEGAKKRGRPKGSTNKKHVPALGSAGAGFTPHVIFVKTGEDVSAKIMSFSQHGTRAVCILSANGAISNVTLRQSATSGGTVTYEVCSLFYCQRSKSPGRFEILSLSGSFLLSENGGHRSRTGGLSVSLAGPDGRVLGGSVAGLLTAASPVQIVAGSFNPHGKKEPPKQQQQQLLAPSPSDASPTPLKVAPAAPSSPPSRGTMSLSESSGGAPSPPPHAGGGSHGQQHQSAGGFSGASWK

SEQ ID NO: 16227 - DNA, 362 bp, Panicum virgatum
  misc_feature: Ceres CLONE 1788213
  misc_feature: Encodes the peptide sequence at SEQ ID NO. 16228
gctcgttctagggatcgtcatccagcttctctgcagctacagcaccctgcctctgtatgcaattgtaacccagatggggagctactacaagaaggagatcttcaacgagcacgtgcagcagggcgtcctgggctgggcggagaaggccaagaagaaatcagggctgggctcgcatcatgtatagttttcctgcgttgtaaggcatagacgtgacataattttctcatacagcttcactcacagcagccataaatggtgctgatctatctgtaatctcacaagtagtcatcggcatcaaaatttactcagatgatcctgaacctgatacttttgatgatgatgcctcatttttagtttgttgc

SEQ ID NO: 16228 - protein, 60 aa, Panicum virgatum
  misc_feature: Ceres CLONE 1788213
  misc_feature: Useful for making plants with modulated biotic stress sensitivity
LVLGIVIQLLCSYSTLPLYAIVTQMGSYYKKEIFNEHVQQGVLGWAEKAKKKSGLGSHHV

SEQ ID NO: 16229 - DNA, 1875 bp, Panicum virgatum
  misc_feature: Ceres CLONE 1788216
  misc_feature: Encodes the peptide sequence at SEQ ID NO. 16230
acacatcccacccgccgattcactccgctcgcgccttccaccccgcgcccccaatcccctcgcgccgcagggaggaggaggaggcgggggtcgcggcggcgaaggttccatccggttcctctccccccaggcctgccgatccgtgttcacgatggctctgcagcagcagcagcagcacgcggggtcggcgtccgggtcggcgtcggcgtcgagctccagctcggggctgcacccgctcgcgtcgccctcgtccttcgcggacaccacccacaccaaggtcttcgtcggcgggctcgcctgggagaccaacagcgacaggctccgccacttctacgagcgctgcggggacatcctcgaggccgtcgtcatcaccgaccgccactccggccgctccaagggctacggattcgtgacgttccgtgaacccgagtcggcgaggaaggcctgcgaggaccccacgccggtgatcgacggcaggcgggccaattgtaacctggcgtcgcttggtcgagcccagcatcccgtgcccttgggcggccaagatcagctgggtcctactttggtgtctcggttccaaggggcttttatctagggggttatggccagcaccgaccgcttccacttgggtactgccaaggattcccagttccccagtacagttacacttcatatggggccgaatacatctatccacagggtacattgaacccatacgccggtcagcaaaatcttccgatatacggagtctcagctgcagcaaatgcatccaaccaaccatttagccaattgggtccatccatttctggtgggggcaatggttatttgtcagttcagggttacaacatgcctggaaatcaatatgtgcagctcactggatcgaacttcagcaatgcatcgccaactgctcggccttctattcagactccctttttagtagcagcacctattcccgcacacccacatctaatcattccagcccactctcctcagtttacacaagctagtgtttctgaccaaagagcaagctgaactgtgcacccaaacatttgtaccttgaggtacccttagattgcagcaggactaaaaagagcagtgttgccctactcgtagcatatgctcttacctggcaagaaatcatccttgcattcataaggttgtcgttatcatggtcaacagatgtacctggaaatcatgaggttgtccctatgggtgggggcaaatggttcaagagcgagggctgctcttgcagtttcgctcggtttacatcctatgtagaaatgtgtccgtgatcgtgatggagcatgaaacgacggatgcagccatgttgatcctgtatctgacgtctcatggtcatggagatatagcatatgctggaatggagtccagcatctgtaagatggattaatccattggggattagccatcatggccttcatatgactattcatctgagacatcaagtttgtgtgtcccaagtcaccacgcacttgcccaagtgtatccagtcctgtatcagtctgcagtcatcgtcgactcatcgtgttgtctgcattcaccagcctttggaacaaactctggaggacctagctgtggtgctttcctgagagcttcctccgtttcgtcactcgtctgtaccaaatttctagtgttgtatgtcccaggtcagaaggtgtggtttagttatgtactgctctctgctctgtgctgggtggtgccgagtgtagagccctcttccaaaataaaatcaccggatgagaatcccatgatgttagcggaactaatgcgtgctacactgttaatgtgcgccagtgttttgtggaacactcctgttctttttggaccaagcagtggtaatataatgcaacagggtccgtg

SEQ ID NO: 16230 - protein, 146 aa, Panicum virgatum
  misc_feature: Ceres CLONE 1788216
  misc_feature (43)..(113): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with modulated biomass
MALQQQQQHAGSASGSASASSSSSGLHPLASPSSFADTTHTKVFVGGLAWETNSDRLRHFYERCGDILEAVVITDRHSGRSKGYGFVTFREPESARKACEDPTPVIDGRRANCNLASLGRAQHPVPLGGQDQLGPTLVSRFQGAFI

SEQ ID NO: 16231 - DNA, 731 bp, Panicum virgatum
  misc_feature: Ceres CLONE 1788228
  misc_feature: Encodes the peptide sequence at SEQ ID NO. 16232
accgagtgacacacagagaaacagcagatttgcgttgcctcccgtgcagccgagtggttcagtgctagctagcttagctagctgttgggacctgggctgggcgcccctgaccgggaaggacgccactccctctcttccacctctgttcgcctccatttgggtttcaggccaagagaggctaagttcatagcttgagggtgctgaattcaagcggactgcgccgagatggagcacattgcgaggttcttcttcggagtttccgggaatgtcattgcgctcttcctcttcctgtcgcctgtcgtcaccttctggaggatcatcaagaagcgctcgacggaggacttctccggcgtgccctacaacatgacgctgctcaactgcctcctatcggcttggtacgggctgccgttcgtgtccccgaacaacatcctggtgacgacgatcaacgggacggggtcgctgatcgaggccatatacgtggtgatcttcctcatcttcgcggagcggcggatccggctgcggatgctgggcctgctgggcgtcgtcacctccatcttcgccgcggtggtgctcatctcgctgctggccctccacggcaacgcccgcaagatcttctgcggcctggccgccaccatcttctccatctgcatgtacgcctcgccgctctccatcatgaggctggtgatcaagacgaagagcgtggagttcatgccgttcctgctctccctgtc

SEQ ID NO: 16232 - protein, 168 aa, Panicum virgatum
  misc_feature: Ceres CLONE 1788228
  misc_feature (7)..(96): Pfam Name: MtN3_slv Pfam Description: MtN3/saliva family
MEHIARFFFGVSGNVIALFLFLSPVVTFWRIIKKRSTEDFSGVPYNMTLLNCLLSAWYGLPFVSPNNILVTTINGTGSLIEAIYVVIFLIFAERRIRLRMLGLLGVVTSIFAAVVLISLLALHGNARKIFCGLAATIFSICMYASPLSIMRLVIKTKSVEFMPFLLSL

SEQ ID NO: 16233 - DNA, 531 bp, Panicum virgatum
  misc_feature: Ceres CLONE 1788228-R
ctgacgcagctgatcctgtacgcaatctaccggaacaacaagggcaccgccgcgccggccggcaagggggaggccgccgcggaggtggaggacgcgaagaaggtggccgccgcggtggagctggccgacgccacgaccaacaaggtcgccagccaggtgtaggctgcggcctctgtacccgaggcttgctggtgcctggtgggagatggtggtggtgcagtggtggtgtcaggcagcctgaaaagctaggccgcctaatgacgaattagtttgctgatgatgaagcagattgttgttgctttcttggccttgcgctgtcactctgatctcgatcgctccctaaaaatgtaccttcagggagaggtatgacacagggttatcaagtcgtgtctctgcaagtgtgaagttttctgtttgtttttcctgatttctctcttccgctgtttctctgaaagaaaatgtactgatcattttataagaaactgagctgcccaagggctggggccgtttagttcccaaaaattttcaccc

SEQ ID NO: 16234 - DNA, 2072 bp, Panicum virgatum
  misc_feature: Ceres CLONE 1788230
  misc_feature: Encodes the peptide sequence at SEQ ID NO. 16235
aacagcaggggcagaggcagctcggcggctctccctcccctcccggtctccgcctccctccctccgcccaatccccttcgccgccggacgccacgccgcagccagccggcatccatacaccaccaccaccacctccggcatctgcccacggacctcccctcagcgccgggccccgctccctccccggccccgcgccgcgacggcgccgccagcggcggatgctgcgccgccccgccgccggcgaccgccgctgagcatggccgccgcgcccccgggcgcccagaaccgctgcgtcttcgttggcaatataccgtacgatgcgacggaggagcagctcgtgcagatttgcgaggaggtcggcccggtcgtctccttcagattggttattgacaaggaaactggaaagccgaagggttatggcttttgcgagtacaaggatgaggagaccgctctaagtgcacgccggaacctccagggttatgagattaatggtcgtcagttacgtgttgattttgctgaaaatgggaggaatactgacagaaatagagaaaagggtcgcggaggaccagggatggcatctggtgctgatagtcaaaaacagttagctgggacttctgttgttggagatacaagtcttcatcagcctgttggtctcccaccggcaatacatgctgcgtctgtgatggctggcgtccttggtggagctcaaactgcaattgttcaaaacggtttacctgtccagtatggacttggaaacgacccccttacccattatttggccagaatgtcaaggcatcagttgcatgaaatcatggctgaattgaaggccctaactactcaaaataaggagctttccaaaaaattactacaagtaattccacacctgccaaaggccctatttcaggcacaaataatgctcggaatggtgacgccacagatgatgcagatggcaaagaaccaacaacccttgagctccttggctcaatcttcatctcacatcaatgagccatctccagctaacatgccaccaaacccaacaatcctgcaggaacaaatgggtacaccacataattttcctcagtatcagcatgcatctcagcctccagtcaaaagttttctgcatggacatcagtctggattggccacacatcctccaatgctacctcagcccctcggggtttccagtattcctactcaaccccttgtggcctcagtaggcttaatgtcgcaagttcagcacccatttatgccacagcaccctagaccacctgttatgcaaacaagtgtacaatcagtacctttgacccactctcattctcaggtagctgctgtaccagagacactaccgaatgaaataagggtgggtgatcaagcaagtcacttggcggagtatgcccatccttcaaagttgagaaaattggaggatggaacctcagtacttgtaatggtaaacagcagccatgcttcttatgcagctccacctcaagcagtgggccctagtggaccatccgggagctatagtgctggtgctgctagctttcagcgaccagggaacgaagcgcagctcacacctgatgtggagtcggctcttctgcagcaagtattgcagttgacacccgagcagctgagttcgttgccaccagagcagcagcagcaggtgattgaactccagaaaatgcttgcagctggtaaatagtaccaactgaactggcgaagcgactggttaagctactagcacagcataacatggcaacaggtggattcaattttctagttgccacgcctgtgatctgtcaacgttgtcggcatcttgatgccatcaattttgcttatagttatgcatgcatctggcattcttcggatcaggataaaagaaaatgtgattggagaagatagcgtgaagagagggatacacattatccatcaccgttgtatcattataggaaaaagaataatatgtatccatataagggaggtgctttttcagcttttcccaagtgtgttgtagcatcatacatttttgtcctctgaattttctcacattagtctcagataggtattggactttgtgc

SEQ ID NO: 16235 - protein, 479 aa, Panicum virgatum
  misc_feature: Ceres CLONE 1788230
  misc_feature (13)..(84): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAAAPPGAQNRCVFVGNIPYDATEEQLVQICEEVGPVVSFRLVIDKETGKPKGYGFCEYKDEETALSARRNLQGYEINGRQLRVDFAENGRNTDRNREKGRGGPGMASGADSQKQLAGTSVVGDTSLHQPVGLPPAIHAASVMAGVLGGAQTAIVQNGLPVQYGLGNDPLTHYLARMSRHQLHEIMAELKALTTQNKELSKKLLQVIPHLPKALFQAQIMLGMVTPQMMQMAKNQQPLSSLAQSSSHINEPSPANMPPNPTILQEQMGTPHNFPQYQHASQPPVKSFLHGHQSGLATHPPMLPQPLGVSSIPTQPLVASVGLMSQVQHPFMPQHPRPPVMQTSVQSVPLTHSHSQVAAVPETLPNEIRVGDQASHLAEYAHPSKLRKLEDGTSVLVMVNSSHASYAAPPQAVGPSGPSGSYSAGAASFQRPGNEAQLTPDVESALLQQVLQLTPEQLSSLPPEQQQQVIELQKMLAAGK

SEQ ID NO: 16236 - DNA, 1658 bp, Panicum virgatum
  misc_feature: Ceres CLONE 1788238
  misc_feature: Encodes the peptide sequence at SEQ ID NO. 16237
gtgtgcaagcgcgcgccgtctcccacgaccccgtccttcccggctggctacgtactcggcgcgttccgtcctcgagtgccgggatggcggacgcgtcctccccgccggcgcctgctcccctcgccgcggaggacctcgcggacgcgcgcctcgcgccgtggccggcctccccgtggccggcgccccgccgggacggcggcggcgggcgggtgaaccccctgttcaccatactgcccgtctcggcgctggcgataggcctcgtgctgctcgtcgccgtggcggtcatcctggtggcgacccgccgcgagaggccgcggaaggcggacgccggtgggagctgcaacggtgacggcaagccgggcgcgcccacgtccagctgcagcagccacaacaccaggtgcggctacgccgccgccgccgccggcgtcgggtgcgtctacgccgggcggctggggttcgcggcgccgccggcgcggagccggggcgcgcaggtgttcacgtgccgggagctggagcgcgcgacggacggcttcagcgagggcaacgtggtggggaggggcgcctccggcgacgtcttccgcggccggctcgccgacggcacccccgccgccatcaagcggctgcggctggaccagcggcgccagggcgagcgcgagttccgcatcgaggtggacctgctgagccggatggactcgccgtacctggtggggctgctgggctactgcgccgaccagagccaccggctgctggtgttcgagttcatgcccaacggcagcctccggagccacctccacccgccggccggagccgccgccggcgccggcgccggcgcgcggcagccgccgttgggctgggcgacgcggctgggtatcgcgctggactgcgcgcgcgcgctcgagttcctgcacgagcacagcacccccgccgtgatccaccgcgacttcaactgcagcaacgtcctgctcgaccacaacctccgcgcccgcgtctccgacttcgccacggccaagctcggctccaacaaggccgacggccaggtggtcacccgtgtgctcggcaccacgggctacctcgcgcccgagtacgtgtccacggggaagctcacgaccaagtccgacgtgtacagctacggggtcgtgctcctggagctgctcaccggccgggtgcccgtcgacacgcggcgcccgcccgggcagcacgtcctcgtctcatgggccctcccgcggctgacgagccgccagaagctcgtggagatggtggaccctgccctgcaaggccagttcgccctcaaggatctcattcaggtggccgccatcgcggcgatgtgcgtccagacgaaggcggagtaccggccgctgatgacggacgtggtgcagtcgctgatcccgatcgccaagcccaccccggccatgtcctgctcctccacgccggtcagggcggccctggagcacgtcatcttcatgggctcatccaagtgcggcggcaagacctcctcctagatctggctgtcgcgttacagggttgttctcgttccttgattggtatatagagctctcccctcttcctcaggcggaagcgtcagggtgtactgtttttttttgtacgagctggtactttacaagataagatgaaaatagaaataaaaatgtttccctccg

SEQ ID NO: 16237 - protein, 471 aa, Panicum virgatum
  misc_feature: Ceres CLONE 1788238
  misc_feature (150)..(433): Pfam Name: Pkinase_Tyr Pfam Description: Protein tyrosine kinase
  misc_feature: SWISSPROT Homolog: EC 2.7.11.1 Non-specific serine/threonine protein kinase
MADASSPPAPAPLAAEDLADARLAPWPASPWPAPRRDGGGGRVNPLFTILPVSALAIGLVLLVAVAVILVATRRERPRKADAGGSCNGDGKPGAPTSSCSSHNTRCGYAAAAAGVGCVYAGRLGFAAPPARSRGAQVFTCRELERATDGFSEGNVVGRGASGDVFRGRLADGTPAAIKRLRLDQRRQGEREFRIEVDLLSRMDSPYLVGLLGYCADQSHRLLVFEFMPNGSLRSHLHPPAGAAAGAGAGARQPPLGWATRLGIALDCARALEFLHEHSTPAVIHRDFNCSNVLLDHNLRARVSDFATAKLGSNKADGQVVTRVLGTTGYLAPEYVSTGKLTTKSDVYSYGVVLLELLTGRVPVDTRRPPGQHVLVSWALPRLTSRQKLVEMVDPALQGQFALKDLIQVAAIAAMCVQTKAEYRPLMTDVVQSLIPIAKPTPAMSCSSTPVRAALEHVIFMGSSKCGGKTSS

SEQ ID NO: 16238 - DNA, 1025 bp, Panicum virgatum
  misc_feature: Ceres CLONE 1788249
  misc_feature: Encodes the peptide sequence at SEQ ID NO. 16239
aagaaccattcccaaacagccacacacacacacacacacacacacacacacacacacacacacacacacacacacacacacacacacacacacacccagctcacagcctgctccaccagcacatcacccagcccgtcagccatgagcaaggactgcggcaaccacggcgacgacgacttcaagcagagcctccggcgcctgctgggcgtcctcctggtgctcgccctcctcgtcggcctcatcgcgctcatcgtctacctggtcctgcgccccacgcacccgcgcttcatcctccaggacgccgcgctccgccagctcgacctctccaacggctcggcgccgctgctctccacggcggtccaggtcaccgtcgcctcccgcaaccccaacggccgcgtcggcgtgcactacgaccgcctcgacgtctacgcctcctacaagtaccagcaggtcacgctcgcgtccaggctcccgccgctgtaccagggccacggcgacgtcgacgtctggtcgccggtgctaatcggcccgaacgtgcccttcgcgccgttcctcgccgacgccatgaggaaggacatcgccaccgggtacctcatcatggaggtcaggatcgacggccgcgtccggtggaaggtcggcagctggacgtccggccactaccacatcttcgtcacctgcccggcctacttcatcggcagcggcacatccagcgtcgtcggtgcgcacgggctcaggttccagacggccacctactgccgcgtcgaggtctagcctgcctctgctctgctcctctgcttccgatcctctgctccggcgaggtaggccgccagcttgttactcctacttgtgtcttgcgtgtgcatactggaaacaagggtggtaaattgtaataaagcaagggtggtactccggggaggtatatatatttatacggaggtaaaaaagttgaggtaatttagagagtgggttaacttgtcttggttcatatatgatatatactactatgtttttttgggttgggttgc

SEQ ID NO: 16239 - protein, 209 aa, Panicum virgatum
  misc_feature: Ceres CLONE 1788249
  misc_feature (39)..(179): Pfam Name: Hin1 Pfam Description: Harpin-induced protein 1 (Hin1)
MSKDCGNHGDDDFKQSLRRLLGVLLVLALLVGLIALIVYLVLRPTHPRFILQDAALRQLDLSNGSAPLLSTAVQVTVASRNPNGRVGVHYDRLDVYASYKYQQVTLASRLPPLYQGHGDVDVWSPVLIGPNVPFAPFLADAMRKDIATGYLIMEVRIDGRVRWKVGSWTSGHYHIFVTCPAYFIGSGTSSVVGAHGLRFQTATYCRVEV

SEQ ID NO: 16240 - DNA, 743 bp, Panicum virgatum
  misc_feature: Ceres CLONE 1788260
  misc_feature: Encodes the peptide sequence at SEQ ID NO. 16241
agaactctgagcagctaggcagctcttctcttccacacgtgccagtgtccaagcttctcccatggagactgcaaccagttgcaatggtgcacccgaagctggtcttgttgcgcaccaaagcgtacctgttcttgtgctcatatcctttgtgtctctgttcagcgcatttctgatatacttctatgcacccttctggcgtgtgaggagagttccgggtccaccaaccaggttcccagtaggccatcttcatcttcttgccaagagtggacctgatgtctttcgtgcgattgcaaaggagtatggtccaatcttcaggtttcacatgggaaggcagccactggtgattgtcgccaatgccgagctgtgcaaggaagttggcatcaagaagttcaaggacatccgcaacaggagcaccccgccgccgaccatcggctccctgcaccaggacgccctctttctcaccagggactcgacatggtcggcgatgaggaacatggtgatcccgctctaccaaccggcacggcttgccaggctcgtcccggtgatgcagtcttacgtggatgcgctggtggcaaacatcgccggctgcccggaccaggactgcatccccttctgccagctctcgctgcggatggccatcgacatcatcggcaagacggccttcggcgtcgagttcggcctgtcaaagaattccgtggacagctgttgcggcagcgagaccggcgagggggacgacgatgtca

SEQ ID NO: 16241 - protein, 227 aa, Panicum virgatum
  misc_feature: Ceres CLONE 1788260
  misc_feature: SWISSPROT Homolog: EC 1.14.14.1 Unspecific monooxygenase
  misc_feature: Useful for biocontainment applications
  misc_feature: Useful for making plants with modulated biomass
METATSCNGAPEAGLVAHQSVPVLVLISFVSLFSAFLIYFYAPFWRVRRVPGPPTRFPVGHLHLLAKSGPDVFRAIAKEYGPIFRFHMGRQPLVIVANAELCKEVGIKKFKDIRNRSTPPPTIGSLHQDALFLTRDSTWSAMRNMVIPLYQPARLARLVPVMQSYVDALVANIAGCPDQDCIPFCQLSLRMAIDIIGKTAFGVEFGLSKNSVDSCCGSETGEGDDDV

SEQ ID NO: 16242 - DNA, 1845 bp, Panicum virgatum
  misc_feature: Ceres CLONE 1788274
  misc_feature: Encodes the peptide sequence at SEQ ID NO. 16243
aaaccctcgcacccccaccgagcagcagcagcagcggcggcgccggcgcgacgagatggccgacgaccccaccgccgccgccggggaccgcgtcgaggacgtcgtcgtccgcgccgagggagacacgcttccgcgtgatgatggctcgtcaaaatccaaggacagggacaaagatagagaaaaggacaaggacagggatcgtcgcagggaccgtgacagagaccgagggagagacagggatcgggatagggacaaggatagagacagagacagagatagagatcgggatcgggatcgccaaagtaggcatcaccgtgaaagaagggaacagagagaccgtccggatgatcacagaggccgtgattctgaaaggagaagagatcgtgatagagatgggcaccgcaggcatcgttctcgctcacggtctcgttcaaggggcagagatcggagatcacgttcaagaagcaaaagagttagtggattcgatgcaccacccccacaagcaatgggttcagcatttccagttattccaacgccaagccagttaccgggttcttctcttcccagcattggtggcatgtttccgaacatgctaccttttggtgttgctgggcagttcaacccccttgtcatccagccacaagcaatgactcaacaggctactcgtcacgctcggcgtgtttatgtcggtgggctccctccctctgctaacgaacagacagtggcagtttacttcaatcaagtcatggctgctattggaggaaacactgctggtccaggtgatgctgttcttaatgtctacataaatcatgacaagaaatttgcttttgtggaaatgagatctgttgaggaagcaagcaatgctatggccctggatggcattttgtttgaaggggcgccagtgaaggttagaaggccaacagattataacccttccctggcagctgccctgggcccaagccagccaagccccaatctgaatcttgctgcagttggcctaacagcaggatctgctgggggtttagaaggtccagaccgtatttttgtgggtggccttccctattacttcactgaagcgcaagttcgggagttgcttgagtcattcggacctctccgaggatttgatcttgtgaaggatagggaaactggtaactcaaagggctatgcattctgtgtgtaccaggatctcactgtcactgacattgcttgtgctgctctaaatggtatcaagatgggagacaaaacccttactgtcagacgagcaaaccaggggggatctcagcccagaccagagcaggaaaatatcctattgcaggcacagcaacaggtgcagctacagaaacttgtgtatcaagttggagcgttccctacaaaggttgtttgcctcacccaggttgtaagtgctgatgaattgaaagacgatgaagagtatgaggacattatggaagacatgaggctagaagcaggcaaatatggtaatttggtgaaagttgtcatcccacgtcctgaccccagtggccagccagtcgctggagttggaaaggtgttcttggaatatgcagatatcgatggcgctaccaaagcaaagatggcattgcatggaaggaaattcggtgggaacccagttgttgcggtctgctatgcggaggacaagtttgccaatggggaatatgacggataaatattacacctcaacctatatctgtagtcactactagttagtccttttgctacttgtttgtttaatcgcaacaaagatgaacggtttctcatatcagccaaacctggctttgaatgaacattgtaagaatagatggtgaaaagttggtcgaatcgtcagcctcc

SEQ ID NO: 16243 - protein, 541 aa, Panicum virgatum
  misc_feature: Ceres CLONE 1788274
  misc_feature (329)..(400): Pfam Name: RRM_1 Pfam Description: RNA recognition motif. (a.k.a. RRM, RBD, or RNP domain)
  misc_feature (209)..(285): Pfam Name: RRM_1 Pfam Description: RNA recognition motif. (a.k.a. RRM, RBD, or RNP domain)
  misc_feature: SWISSPROT Homolog: EC 2.7.11.1 Non-specific serine/threonine protein kinase
MADDPTAAAGDRVEDVVVRAEGDTLPRDDGSSKSKDRDKDREKDKDRDRRRDRDRDRGRDRDRDRDKDRDRDRDRDRDRDRQSRHHRERREQRDRPDDHRGRDSERRRDRDRDGHRRHRSRSRSRSRGRDRRSRSRSKRVSGFDAPPPQAMGSAFPVIPTPSQLPGSSLPSIGGMFPNMLPFGVAGQFNPLVIQPQAMTQQATRHARRVYVGGLPPSANEQTVAVYFNQVMAAIGGNTAGPGDAVLNVYINHDKKFAFVEMRSVEEASNAMALDGILFEGAPVKVRRPTDYNPSLAAALGPSQPSPNLNLAAVGLTAGSAGGLEGPDRIFVGGLPYYFTEAQVRELLESFGPLRGFDLVKDRETGNSKGYAFCVYQDLTVTDIACAALNGIKMGDKTLTVRRANQGGSQPRPEQENILLQAQQQVQLQKLVYQVGAFPTKVVCLTQVVSADELKDDEEYEDIMEDMRLEAGKYGNLVKVVIPRPDPSGQPVAGVGKVFLEYADIDGATKAKMALHGRKFGGNPVVAVCYAEDKFANGEYDG

SEQ ID NO: 16244 - DNA, 2169 bp, Panicum virgatum
  misc_feature: Ceres CLONE 1788277
  misc_feature: Encodes the peptide sequence at SEQ ID NO. 16245
aaaagaaaacaaagggggagagatatttcagcttgctcttcttgcagcttctgccgttcgcaactctctctggaacgaccacagctcaagcaaagcttgaaagctcaccaatttccctcgctgttcagcaggtccgcactctgttgcctaccaagagcgctggtggacttccgcaccctgtgtgctcatgttaagggttgaggctccagcgtactacttgattacaagacctaggtggaaactatatgcgtgtagaaacgtattgcaagaagctgcctcacatgatgcaaaggtgaattcctatagctatagtgagaggaggaaccggaaaaaggagggtgcttacattgacaaagatggtgtagcaagaaccttcgatcgaaagaaaatatccagaaagagagggggtgctatcaaaggccgaggttggaagtacggctctgggtttgttgatggagttttcccagtgctcagtccaatggcacaggatatcctagaatttgtgcagaaagggaccgacgttgccaaagtatgggagtcactggacaacattcctcgtgcacacgatctttgggatgacattgtcaatgtcgctgtccagctccgtctgaatcgacaatgggaacccatcatcacatgcctgtaggtttgtgagtggattctgtaccggagttcgttccggcctgacatcatctgctacaacctgctcatagatgcatatggccgaaagcgtgagctgagcaaggcagaatccatttacatggctcttctggaggccaattgtgtgcctacagaggacacctatgctcttctcttgcgtgcttactgcaatgctggacaactgcaccgagcagagggcgtgatttcagagatgcaggagaatgggattcctccaagtacaactgtatataatgcctaccttgacggcctactgaaagcaaggtgtactgaaaaggcggtcgaagtgtaccaaaggatgaagaaggagcgctgcagaactaacaccgagacttacacgctgatgatcaatgtatacggaaaggcaaagcaaccaatgtcatcgttaaaagtcttcagcgagatgaaggcgatcgggtgcaagcccaacatctgcacctacactgcgctggtgaacgcgttcgctagggaaggcctctgcgagaaggcagaggaggtgtttgaggagatgcagcaggctgggcatgaacctgacgtgtacgcctacaacgccctgatggaagcttacagtcgagcggggttcccgcaaggcgcatccgagatcttctctttgatggagcacatggggtgtgagcctgacagagcctcatacaacatcttggtggatgcttatggaagagctggtcttcatcaagaggcggaagctgcgttccaagaactgaagcaggtgggcatgcggccgacgatgaagtcgcacatgctgctcctgtccgcgcacgccaargccggcaacgtgtccaggtgcgaggaggtgatggcgcagctgcacaagtccgggctgcggccggacaccttcgccctcaacgccatgctcaacgcgtacggcagggccgggcggctcgacgacatggagcggctcgtcgcggccatggaggggcttgacggcggcggcggcgccgccccggacatcagcacgtacaacgtgctggtgaacgtgtacgggcgcgcggggtacctggacaggatggaggcggcgttcggcgcggcggcggccaggggcctcgccgccgacgtggtgacgtggacgtcgcgcatcggcgcgtacgcaaggaagaagaagtacgggcggtgcctggagatcttcgaggagatggtggacgccgggtgctacccggacgccggcacggcgaaggtgctcctcgcggcgtgctccgacgagcggcaggtggagcaggtcacggccatcgtcaggtccatgcacaaggacgccaagatgctcttcaaactatgagatcaaaactagctgatgcatgtcattattatgttgtacacataacctaacctcttgtgaacaagtgactagagtagtggaagtctagtgtttggataataagtactcgcccacttacaaattggaacatataactggtatcacaatatttgttgtaattttgctatactttacattcaagattaataattccttgatcc

SEQ ID NO: 16245 - protein, 402 aa, Panicum virgatum
  misc_feature: Ceres CLONE 1788277
  misc_feature (118)..(152): Pfam Name: PPR Pfam Description: PPR repeat
  misc_feature (83)..(117): Pfam Name: PPR Pfam Description: PPR repeat
  misc_feature (332)..(366): Pfam Name: PPR Pfam Description: PPR repeat
  misc_feature (153)..(187): Pfam Name: PPR Pfam Description: PPR repeat
  misc_feature (188)..(222): Pfam Name: PPR Pfam Description: PPR repeat
  misc_feature (13)..(47): Pfam Name: PPR Pfam Description: PPR repeat
  misc_feature (48)..(82): Pfam Name: PPR Pfam Description: PPR repeat
MALLEANCVPTEDTYALLLRAYCNAGQLHRAEGVISEMQENGIPPSTTVYNAYLDGLLKARCTEKAVEVYQRMKKERCRTNTETYTLMINVYGKAKQPMSSLKVFSEMKAIGCKPNICTYTALVNAFAREGLCEKAEEVFEEMQQAGHEPDVYAYNALMEAYSRAGFPQGASEIFSLMEHMGCEPDRASYNILVDAYGRAGLHQEAEAAFQELKQVGMRPTMKSHMLLLSAHAKAGNVSRCEEVMAQLHKSGLRPDTFALNAMLNAYGRAGRLDDMERLVAAMEGLDGGGGAAPDISTYNVLVNVYGRAGYLDRMEAAFGAAAARGLAADVVTWTSRIGAYARKKKYGRCLEIFEEMVDAGCYPDAGTAKVLLAACSDERQVEQVTAIVRSMHKDAKMLFKL

SEQ ID NO: 16246 - DNA, 692 bp, Panicum virgatum
  misc_feature: Ceres CLONE 1788279
  misc_feature: Encodes the peptide sequence at SEQ ID NO. 16247
atctcattccgctttgagcttgcttgcagctccagctcccctcgtctcttggtggctacgccatggccaccgtagtcctgatgagctgcagcctccgcgcgccggcctgcagcggcttatctggcgtccgcgccgccccggcaccggccatcgtcgccatgcccgccgccaagcagcaggttgttggccgcggcgccaggctgcgcgcgcaggccacctacaacgtgaagctcatcacgcccgacggcgaggtagagctgcaggtgcccgacgacgtgtacatcctggaccaggccgaggaggaagggatcgacctgccctactcgtgccgcgcggggtcctgctcctcctgcgccggcaaggtcgtctccggcagcgtcgaccagtccgaccagagcttcctcgaagacgaccaggtcgccggcggctgggtgctcacctgcgccgcctaccccacctccgacgtcgtcatcgagacgcacaaggaggaggagctcacctcctcttcgtaatccgatccagtatatgcggctttcattgcttattaattatctcagctcccttgattatatatatatatatatatatatatatatatatatatatatatatatatatatatatatatatatatatatatatatatatatatatatatattaatatataaaaaaatataaatgtatatatta

SEQ ID NO: 16247 - protein, 149 aa, Panicum virgatum; identical to SEQ ID NO: 10105
  misc_feature: Ceres CLONE 1788279
  misc_feature (58)..(133): Pfam Name: Fer2 Pfam Description: 2Fe-2S iron-sulfur cluster binding domain

SEQ ID NO: 16248 - DNA, 2183 bp, Panicum virgatum
  misc_feature: Ceres CLONE 1788299
  misc_feature: Encodes the peptide sequence at SEQ ID NO. 16249
gttgcggtgccatcgccatttgcggatttctttggaggaaaaggcaagcaagccaagcgggcgccgaaatactccacagataccactcacctaccgctcctccaatccgtccatccaccggccggaaagcttatctccctccccgcgtttccctttctcccctccctcgccgcacagcgccaggacaggccgccaccgggaggtgtgtctccgctggatcctccggcgtctcgccgtcttctggagcggagatccggcctctcgggcgtcggctgggctctagttctgctggagcaggaagctggcatcctgccatgtcgtcacctacggcctcccctactctgaaggatcatctctctgcgcccacaggccccttgcatctcaaagtatgggaagtcgtatgcattgccctgggagttttcatggtggtcgtcttctttgtcgctgtgtggcttacaatccggagtaagaaaagggtaagacgggcctccgcgaatatcccaatcacccaaattccggccatttcaaaggaaatcaaggaggtgagggtggagcaagtgccagcgagcgactttgcaccccatgatggggtcctcatgacgatccaagacaagtctagcgaccgggattcagacaaggttatggcccatctgggtgttagcaaatcgaggcgtggtgatgagagccactcagggtcgttccgctacatggacaaggatgcagggttccaatcagctgaggaaggagactcagggacgtttcgtcaggcttcagctcatgcaataaccgccccttcacctctggttggtctgccggagttctcataccttggttggggtcattggttcacactgagggatctggaacttgctaccaatcgcttttcaaaggacaacattatcggcgagggtggatatggtgtagtttatcgtggccagctaatcaatggttctcctgtcgctgtcaaaaagcttctcaataacctaggtcaagctgagaaggaattcagagtagaagttgaggctattggtcatgttcgccacaagaatttggtccggcttctgggttattgtgtggagggtactcaaaggatgcttgtctatgagtatgtgaacaatggtaacctagagcaatggcttcatggagctatgagtcagcgtggctcccttacatgggaggcccgaataaagattcttcttggaactgctaaagcgcttgcttacttgcatgaggcgattgaacctaaagttgtgcaccgtgatatcaaatccagcaatattttgattgatgatgagtttgagtccaaagtatcagattttggtttagccaagcttctcggtgctggaaagagtcatgtcaccactagggttatgggaacctttgggtacgtggcgccagagtatgcaaatactggactcctgaacgagaagagtgacatttacagcttcggagtagttctcctagaagcgattacaggaagggatcctgttgactatggtcgcccagcaaatgaggtgaatctggttgactggctaaaaatgatggttgctagcaggcggtcagaggaggtagttgatcccaccatagagacacggccttcgacgagagctctcaaacgtgcactgttgaccgctctgaggtgtgtggatccagattcagagaagaggccgaagatgggtcaagttgtccggatgttggaatcagatgatccaattcctcgaggggacagaagatctaagcaccaccgtggagggagcacagaaatggattcacaaagggacaacaactccgacacggagaagagtgatccagattccaaaccaagcaagagcagagcatcatcgtcaaaatgagcatgcttgcatttctcgtattacattctttggtacattgcatggatcagactacttccattttacattgctgacgaattggtaactgaaggctctgaagcttgaatacacaagagctcaagaaagaagatctacctttctttttttttcttttttttttgctgtaacggtttatcatttatttgtagagaaggtattttttttcttatcgatttatatgtacttaccagtgatcttgacaattgctgctgtaagtttttaacagtgtgtacaggcttagtatcatgaatactggcggaaaccccgtaatatttgtaatgataatgtttc

SEQ ID NO: 16249 - protein, 512 aa, Panicum virgatum
  misc_feature: Ceres CLONE 1788299
  misc_feature (190)..(461): Pfam Name: Pkinase Pfam Description: Protein kinase domain
  misc_feature: SWISSPROT Homolog: EC 2.7.11.1 Non-specific serine/threonine protein kinase
MSSPTASPTLKDHLSAPTGPLHLKVWEVVCIALGVFMVVVFFVAVWLTIRSKKRVRRASANIPITQIPAISKEIKEVRVEQVPASDFAPHDGVLMTIQDKSSDRDSDKVMAHLGVSKSRRGDESHSGSFRYMDKDAGFQSAEEGDSGTFRQASAHAITAPSPLVGLPEFSYLGWGHWFTLRDLELATNRFSKDNIIGEGGYGVVYRGQLINGSPVAVKKLLNNLGQAEKEFRVEVEAIGHVRHKNLVRLLGYCVEGTQRMLVYEYVNNGNLEQWLHGAMSQRGSLTWEARIKILLGTAKALAYLHEAIEPKVVHRDIKSSNILIDDEFESKVSDFGLAKLLGAGKSHVTTRVMGTFGYVAPEYANTGLLNEKSDIYSFGVVLLEAITGRDPVDYGRPANEVNLVDWLKMMVASRRSEEVVDPTIETRPSTRALKRALLTALRCVDPDSEKRPKMGQVVRMLESDDPIPRGDRRSKHHRGGSTEMDSQRDNNSDTEKSDPDSKPSKSRASSSK

SEQ ID NO: 16250 - DNA, 1740 bp, Panicum virgatum
  misc_feature: Ceres CLONE 1788304
  misc_feature: Encodes the peptide sequence at SEQ ID NO. 16251
actcgagccgttggagatccacattttcctcgatctctcgggctgcgccccctctctctccaccgatcgctctccgcccaccggacgatccgatcgacgccgccgatcgccgccatggacgtcgagtacgacgtcgtcgtgctggggacggggctcaaggagtgcatcctcagcggcctcctctccgtcgaccgcctcaaggtgctgcacatggacaggaatgactactacggtggagattccacatcgctcaacctcaatcagctctggaaaaggttcaagggtgatgaaacaccccctgcggagataggagctagcagagactacaatgtcgacatggttcctaagtttatgatggcaaatggtgctctggttcgggtactcattcacactggtgtcaccaagtacttgtccttcaaagctgtggatggaagctatgtcttcaacaagggaaagattcacaaggttccttctactgatatggaagctctcaagtctccacttatgggattgtttgagaagcgacgagcagggaaattcttcctttatgtccaagattataaggaaaatgacccaagcactcataagggttatgaccttacaaaactaactactaaacaacttatctcaaaatacggtttggatgataacacgatagacttcatcggtcatgctgtggctcttcatagagatgatagctacctttcagaacctgcacttgacactgtaaagcggatgaagctttatgcagaatcagtggctcgttttcaaggaggatcaccatatatttatcccttgtatggcttaggagagcttccacagggttttgctcgactgagtgctgtctatgggggcacctatatgctgaataaaccagagtgcaaggtcgaatttgactctgaaggtaaagtctgtggtgttacatcagaaggagagactgccaaatgcaaaaaggttgtctgtgatccatcctacctacctgacaaggtcaaaaaagttggaaaagtttttcgggcaattgctatcatgagtcatcccattccaaatactgctgaatcgcactcagttcagattatactaccacagaagcagcttggccgtaaatcagacatgtatgttttctgttgctcctactctcataacgtcgcatcaaaggggaagttcattgcattcgtgtccgctcaagcagagactgataatctacagacagaactgaagcctgggatcgatcttcttgggccagtggatgagttatttgttgacacatatgacagatatggagctactaatgactcatcatcagacaattgttacatctcaacaagttatgatgccacaacacactttgaatccactgttatggatgtgctttccctttatacaaagataactggaaagatggttgatcttagcgtggatctaagcgctgcaagtgcttctgaagatgatatgtgatgcttgttagactgttatctggtgcaatgtagcaaaatattcaattaagctttggttttgcaattcttattaattagacacaggaccctttatttttcagttatgttagttgtttttttctgagaagattgtatgctgtatattccaaggttaatttcttttgatattgataaggcagtgtaccatgttaagctatttaagatattgtcatttatgttgtccaggtgatactgcaggttaaaatattcattactatgtccacgtatggatccaatgtttgcatac

SEQ ID NO: 16251 - protein, 446 aa, Panicum virgatum
  misc_feature: Ceres CLONE 1788304
  misc_feature (1)..(438): Pfam Name: GDI Pfam Description: GDP dissociation inhibitor
MDVEYDVVVLGTGLKECILSGLLSVDRLKVLHMDRNDYYGGDSTSLNLNQLWKRFKGDETPPAEIGASRDYNVDMVPKFMMANGALVRVLIHTGVTKYLSFKAVDGSYVFNKGKIHKVPSTDMEALKSPLMGLFEKRRAGKFFLYVQDYKENDPSTHKGYDLTKLTTKQLISKYGLDDNTIDFIGHAVALHRDDSYLSEPALDTVKRMKLYAESVARFQGGSPYIYPLYGLGELPQGFARLSAVYGGTYMLNKPECKVEFDSEGKVCGVTSEGETAKCKKVVCDPSYLPDKVKKVGKVFRAIAIMSHPIPNTAESHSVQIILPQKQLGRKSDMYVFCCSYSHNVASKGKFIAFVSAQAETDNLQTELKPGIDLLGPVDELFVDTYDRYGATNDSSSDNCYISTSYDATTHFESTVMDVLSLYTKITGKMVDLSVDLSAASASEDDM

SEQ ID NO: 16252 - DNA, 589 bp, Panicum virgatum
  misc_feature: Ceres CLONE 1788329
  misc_feature: Encodes the peptide sequence at SEQ ID NO. 16253
aattctactgctacacctaacacctacacatcgcctccttcctgttgtactacaaccccaaagcacgcgagccagtcctccagccatggaaaacgcaatcgactggcagcgggtcctcctcgcccacctcgtcccctcctcctcgtcctcgcggccgcagctggaggcgtcggcgtgcgcggccggggacagcgccgcgtaccagaggacctcctccttcggagatgatgttgtcgtcgtcgctgcataccggaccccgatatgcaaggccaagcgagggggtttcaaggacacctacccagaggacctccttactgttgttctcaaggctgttctggacaacactaaaatcaatccaggtgacattggtgacattgtggttgggacggtgctacgtccaggttcgcagcgagcaaatgagtgcagaatggctgctttctatgctggattccctgaaactgttcctgtgagaactgtcaacccacaatgctcatctgggttacaggcagtagctgatgtcgccaccgctataaaggctggtttctatgacatagggattggtgctggtttggaatccatgtccataaat

SEQ ID NO: 16253 - protein, 167 aa, Panicum virgatum
  misc_feature: Ceres CLONE 1788329
  misc_feature (46)..(167): Pfam Name: Thiolase_N Pfam Description: Thiolase, N-terminal domain
  misc_feature: SWISSPROT Homolog: EC 2.3.1.16 Acetyl-CoA C-acyltransferase
MENAIDWQRVLLAHLVPSSSSSRPQLEASACAAGDSAAYQRTSSFGDDVVVVAAYRTPICKAKRGGFKDTYPEDLLTVVLKAVLDNTKINPGDIGDIVVGTVLRPGSQRANECRMAAFYAGFPETVPVRTVNPQCSSGLQAVADVATAIKAGFYDIGIGAGLESMSI

SEQ ID NO: 16254 - DNA, 1540 bp, Panicum virgatum
  misc_feature: Ceres CLONE 1788334
  misc_feature: Encodes the peptide sequence at SEQ ID NO. 16255
  misc_feature (1421)..(1421): n is a, c, t, g, unknown, or other
aaacgcgcgcgcccccgggcacacaagcagctacccagccaggcagccaccaccgggcacgcgcagctgccatggcggcgtccggcggcgcgtacgcggcgcagctcccggcggtgccggagtggctgaacaagggcgacaacgcgtggcagctgacggcggcgacgctggtgggcatccagtccatgccggggctggtggtgctgtacggcagcatcgtgaagaagaagtgggccgtgaactcggccttcatggcgctctacgcctacgcctcgtcgctgctggtgtgggtgctggtcggcttccgcatggcgttcggggagcgcctactcccgttctggggcaaggccggggtggcgctctcccaggattacctggtccgccgcgccgcgctctcggccacggcgcacggggacacgccgcgcaccgagcccttctacccggagaccacgctggtgctgttccagttcgagttcgccgccatcacgctggtgctcctggccggctccgtcctgggccgcatgaacatcaaggcctggatggccttcaccccgctctggctcctcttctcctacaccgtcggcgccttcagcctctggggcggcggcttcctctaccactggggcgtcatcgactactccggcggatacgtcatccacctgtcctccggcgtcgccggcttcaccgccgcctactgggtgggcccgcggctgaagagcgaccgggagcgcttctccccgaacaacatcctgctgatgatcgccggcggcgggctgctgtggatgggctgggccgggttcaacggcggcgcgccctacgccgccaacatcgccgcgtccgtggccgtgctcaacaccaacgtctccgccgccaccagcctcctcacctggacctgcctcgacgtcatcttcttcggcaagccgtccgtcatcggcgccgtgcagggcatgatgacggggctcgtctgcatcacccccggagcaggtaattccataaaaacccatctcacccgttcatcctggatagcgtcccgtagcaagggcgtacgtacggcctcttcgctctccgtacatctcagaagcttcgacgacctcacctggcgagacggcgagaccgagacgacacgccggtcgttggagcatccggcgtttggctgcatccacaaaaggtttcgttttcaacgtcaagtgatcggaaattcggaacggaggacaaaacctaatccacagtcaaaagaggacggtggaaaaacacgcggcaggtagccaatcgcgcgggcggcaggctcgctcgaacgacgtaactgggttttcccccctttaatctgctctgcgcgatggctacgttttcctactccaagtagccgcgtgcactagtcgacgtgtcaatactttacgcgacacaattaggcgccttaatgncagctcagcattgttaattaatactcaattagctgatgtaaacatgatctgaatctgacgagtagtagttgtagtagtcaaacggtgcagtaggagtagtagctttcacttttataact

SEQ ID NO: 16255 - protein, 397 aa, Panicum virgatum
  misc_feature: Ceres CLONE 1788334
  misc_feature (25)..(360): Pfam Name: Ammonium_transp Pfam Description: Ammonium Transporter Family
MAASGGAYAAQLPAVPEWLNKGDNAWQLTAATLVGIQSMPGLVVLYGSIVKKKWAVNSAFMALYAYASSLLVWVLVGFRMAFGERLLPFWGKAGVALSQDYLVRRAALSATAHGDTPRTEPFYPETTLVLFQFEFAAITLVLLAGSVLGRMNIKAWMAFTPLWLLFSYTVGAFSLWGGGFLYHWGVIDYSGGYVIHLSSGVAGFTAAYWVGPRLKSDRERFSPNNILLMIAGGGLLWMGWAGFNGGAPYAANIAASVAVLNTNVSAATSLLTWTCLDVIFFGKPSVIGAVQGMMTGLVCITPGAGNSIKTHLTRSSWIASRSKGVRTASSLSVHLRSFDDLTWRDGETETTRRSLEHPAFGCIHKRFRFQRQVIGNSERRTKPNPQSKEDGGKTRGR

SEQ ID NO: 16256 - DNA, 649 bp, Panicum virgatum
  misc_feature: Ceres CLONE 1788334-R
cgtgttcgcgggcagcgtgccatggttcaccatgatgatcctgcacaagaagtcggcgctgctgatgcgggtggacgacacgctggcggtgttccacacgcacgccgtcgcgggcctgctgggcggcctcctcacggggctgctggccacgccggggctcctggagatcgagtcccccgtgccgggcctccgcggcgccttctacggcggcggcatccggcaggtcgggaagcagctggcgggcgccgcgttcgtggtggcgtggaacgtcgtggtcacctcgctcatcctgctcgccatcggcctggtggtgccgctgcggatccccgacgagcagctcatgatcggcgacgacgccgcgcacggggaggaggcctacgcgctctggggcgacggggagaagttcgacgccacgcggcacgacgtgtccagggttggcggcggcggcatggagagggaagggtcggtggagcagcggctgtctggcatgggagccaggggcgtcaccatccagctgtaggaagggatcgtaaggggggagggtgactaggttttgatgttttctcctgttgggaggatggatcgatgttggccatcggtcttcaatctactggtgattgcgactgtatcctaggcaggccattttctc

SEQ ID NO: 16257 - DNA, 497 bp, Panicum virgatum
  misc_feature: Ceres CLONE 1788340
  misc_feature: Encodes the peptide sequence at SEQ ID NO. 16258
ggagtgagaaaagatcgcgggttaggcggactggtcggcgatcggcatcgccctctgtaccccatattcgtgcgtcggcgtgtggcccccccacctcgtccagatcatcgccaacgaccagcggaaccgccccaccccctcgtacgtcgccttccccgactccgagcgcctcatcggagatgccgccaagacccaactccccatgaaccccatcaacaccgtccttgatgccaagcgtctcatcggcatgaggctcactgctgcttctgtctttactgatatcaagctctggccattcacggtcatttctggacctggtgagaagcccttgattgtcgccccccccaagggtgaggagaagcattttgccgctgaggatatctcatccctggttctgatcaagatgcgtgacattgctcatgcttaccttggcactactatcaagaacgttgtggtctcagttcccgcctacttcaatgactcccataggcatgtta

SEQ ID NO: 16258 - protein, 98 aa, Panicum virgatum
  misc_feature: Ceres CLONE 1788340
  misc_feature: Useful for making plants with modulated drought sensitivity
  misc_feature: Useful for making plants with modulated heat sensitivity
MNPINTVLDAKRLIGMRLTAASVFTDIKLWPFTVISGPGEKPLIVAPPKGEEKHFAAEDISSLVLIKMRDIAHAYLGTTIKNVVVSVPAYFNDSHRHV

SEQ ID NO: 16259 - DNA, 608 bp, Panicum virgatum
  misc_feature: Ceres CLONE 1788340-R
  misc_feature: Encodes the peptide sequence at SEQ ID NO. 16260
gactgggcaagaccctgcctgcgcgacaagcgccatctgtaccgcgtcatggactttaagctaggcggacaatacccgaagaaaggcgcacacgcagtggcaagcattgccctgcagtgcatgggcaatgaggccaaggcgcggcgggcaaggtctgaggtccttgagaaattagagcagctgcaggaccccaagtacaacgtcacagcaccacgggtggacccaaagtggacatcttcgtcaggctctgtccccaggtggcccatgaaggggcagccctcgccaggacgcctgtcgggttctggttccccgttgccggcagtggcaggctccccgcggccagcgtgtaggcccacgcgggtgcattgggtgcgcgactgatggatgaaagtgacgagtttgggttgttgtagatgttgcttgtaggtgtatatttcgctgtgtggttcccgagcagggtagtttttggtttgtgaggtgtagtttttttgtttggggtgtcggggaaccagattgttgtgaggtgcggaatagggagaatcaacatcctttgattggacggatgtttaaattgtttctcagtttggagtgaagatgatattcttctc

SEQ ID NO: 16260 - protein, 126 aa, Panicum virgatum
  misc_feature: Ceres CLONE 1788340-R
  misc_feature: SWISSPROT Homolog: EC 2.7.11.1 Non-specific serine/threonine protein kinase
DWARPCLRDKRHLYRVMDFKLGGQYPKKGAHAVASIALQCMGNEAKARRARSEVLEKLEQLQDPKYNVTAPRVDPKWTSSSGSVPRWPMKGQPSPGRLSGSGSPLPAVAGSPRPACRPTRVHWVRD

SEQ ID NO: 16261 - DNA, 1810 bp, Panicum virgatum
  misc_feature: Ceres CLONE 1788341
  misc_feature: Encodes the peptide sequence at SEQ ID NO. 16262
aatctcgaatacaacgtgaggaccgcttctcccagaagcctcgcccgactttcccccaactgcccttctctccccgatagtccttcctcccccgacacctcccctgcgccccgttccccgccggcccctgccctgccgcggttccgccctccgctccggcgagcgccagcaaccggaatcgcgccggccgtcctccgtgagcccggatctgtgacggcatgccctgaagcggccgctaggcctgcagatcgtcgacgccgccgccccccaaggtgcaccggctgccctccgctccggcgagcgccaccgaacggattcgcgccggccgtcctccgtgaccccgggttcgcgctggccatcctccatcctccgtgtccgccgccggcccccaccccaaggtgcgccgccgccttattctttcgattggagtagcgccgccggccctgactgaagcacgaagcctccacaacgtgttgcacccaccgtggacacgaacaagagtcttatgcttctcgtcttccactccacgcctcctccacatcaccgccggagatcatggcgcggctcctctcctcccctccgtgcggcgaggcgctgagcgcgtccacgattgtggcggaggccgtgaccgggtcgcacgtcctcaagatcgaggggtactccctgaccaagggactcggcaatggcgagttcatctgctccagcacattcagcgtgggtggccatcgctggtgcatcaggtactaccctgatggcgatggcttagacagtgccgattggatatccatctatctgcagcacgatgatacctgtaatgctatggacgccaaggcacaatccagtttcagcgtcctcgacgagatcggtgaaccagtgccaaagttcaccaagaagggccggtcggcggataccttctccgccaaaactcggtcctggggtttcccgaaattcgtcgaaaggaaggccttggaggaatcggcctgcctgaaagatgatacccttcgagtcaggtgcgatttcaccgtcgccaaggacatccgcaccgaggccaccgagcagttcgtcgtggtgccgccgtccaacatgcacctgcaattcggccgtctcctccaggccggagaaggggcggatgtcaccttcgaggtcgccggggagacgttcgccgcgcacaggtgcgtgctggccgcaaggtcgccggtgttcatggccgagctcttgggccccatgaaggagaaggccacgagccgcgtacgcgtcgacgacatggagccgagagtgttcgaggccatgctccacttcatctacactgacaccatggcagcaggtactgataagggagacgacgcgtcggcggccgctcagcatttgcttgtggcggcggacagatatgatctggagaggctgaagctgatgtgcgaggagaagctgtgcagctacattggcacgagcacggtggcgacgacgctggcgctggcagagcagcatggctgccatgggctcaagaaggcatgttttgattttctcaggacgccgagccatctcaaggaagccatggctagtgagggctttgaccatctgctgagtagctgcccatctgtgatcaaggagctgctggccaaggctgctccctgtccctgatggctagctgcaaaatcagggacaaggtgcctattttttcgtatgtgtcaatcatcgatcagtgtgatgaaaggctggaacactttcctatcttaaacaaatattactatttttctttacgtggttgtaatgtggaatagtaatgctaatgcatggtttgacggttgagtcg

SEQ ID NO: 16262 - protein, 360 aa, Panicum virgatum
  misc_feature: Ceres CLONE 1788341
  misc_feature (181)..(295): Pfam Name: BTB Pfam Description: BTB/POZ domain
  misc_feature: SWISSPROT Homolog: EC 3.1.2.15 Ubiquitin thiolesterase
MARLLSSPPCGEALSASTIVAEAVTGSHVLKIEGYSLTKGLGNGEFICSSTFSVGGHRWCIRYYPDGDGLDSADWISIYLQHDDTCNAMDAKAQSSFSVLDEIGEPVPKFTKKGRSADTFSAKTRSWGFPKFVERKALEESACLKDDTLRVRCDFTVAKDIRTEATEQFVVVPPSNMHLQFGRLLQAGEGADVTFEVAGETFAAHRCVLAARSPVFMAELLGPMKEKATSRVRVDDMEPRVFEAMLHFIYTDTMAAGTDKGDDASAAAQHLLVAADRYDLERLKLMCEEKLCSYIGTSTVATTLALAEQHGCHGLKKACFDFLRTPSHLKEAMASEGFDHLLSSCPSVIKELLAKAAPCP

SEQ ID NO: 16263 - DNA, 1591 bp, Panicum virgatum
  misc_feature: Ceres CLONE 1788342
  misc_feature: Encodes the peptide sequence at SEQ ID NO. 16264
gaagtgcttgcgtttgcgtggggaggggttggaccccgtctactccggaacaggggacgctgcccttttccacgcgccactctgctccgaacccatcctgctccgactagccctctccctgctccgactagccgaggagaaagcaacagaggaaagagagaggatttccacccggtcgtcccctcgatccgttctccgctgcagttccttgaagcaaggtgctggagatcgactccgtctccgtcgaccggaattccacggcgtcgaggagcaggaggaggctaggacagcccggcaccgagaggcgcgcggtccgtgctccccagcgtggcctcgcgcggcatgctcgttgcctcgccgggggagggatggtcgatcgaacgagggccgcgctcatcggggtcaccgccggcgtcgcggctgcggtgcttgcggcggcgtgcgtgctcctcgccatctggctgcaccgccggcgggccagcgtcgccgcccggacgcggtccatggagtcgccctcagcgacgctgcgggccgacggcgaccgctgcgccagcctcgactccagcgtctccgtctcggtggtctccgagagcgtcgccgactggggccacccgccgccggcaaagcgcgccgcgttctgggcctggagaggcggcgccggccataatggcagggagccgccgccgctgaccgtttccgggatcccaaaataccactacaaggatctgcagaaggctaccagcaactttaccacaattctggggcaaggatcgttcggtcctgtgtacaaggctgtaatggccactggtgaagtggtagctgtaaaagtgctcgcgagtgattcaaggcaaggggaaagagagttccagactgaggtagctttgcttagcaggctgcatcatagaaaccttgttaatttggttgggtattgcgtggaaaaaggtcagcgcattctgatttacgagtacatgagcaatgggagtttggcaagacttttgtacggcgacaataaacggagtttgagctggcaagaaaggctgcaaattgcccatgatatctctcatgggatcgagtatctgcatgaaggggctgttccacctgttattcacagagatctaaagtctgataatatacttttggaccattcaatgagggccaaggttgcagactttggtttatcaaaggaggaagtatatgatggaagaaagtcgggcctcaagggcacctatggatatatggatcctgactacatgtccacaaataagttaacaaagaagagcgacgtgtatagttttggtattatactttttgaactgataacagccataaatccacagcaaggtctaatggactacattaatctggtaagtcattttaacgttactgaaagtacataaatcttgtagtttgtcgtctagaagagtcctctctagttaggccttcccgcgcgttcatcggttgtatccttgtgccgtatagtcctctagagaaaactcaaggtgtgcgtgcgcccctcatggcccgcgttgtaaaggaaaccactctttttccttcttaatgcaatgataagcagctctcctgcgtattatcg

SEQ ID NO: 16264 - protein, 342 aa, Panicum virgatum
  misc_feature: Ceres CLONE 1788342
  misc_feature (125)..(336): Pfam Name: Pkinase Pfam Description: Protein kinase domain
  misc_feature: SWISSPROT Homolog: EC 2.7.11.1 Non-specific serine/threonine protein kinase
MVDRTRAALIGVTAGVAAAVLAAACVLLAIWLHRRRASVAARTRSMESPSATLRADGDRCASLDSSVSVSVVSESVADWGHPPPAKRAAFWAWRGGAGHNGREPPPLTVSGIPKYHYKDLQKATSNFTTILGQGSFGPVYKAVMATGEVVAVKVLASDSRQGEREFQTEVALLSRLHHRNLVNLVGYCVEKGQRILIYEYMSNGSLARLLYGDNKRSLSWQERLQIAHDISHGIEYLHEGAVPPVIHRDLKSDNILLDHSMRAKVADFGLSKEEVYDGRKSGLKGTYGYMDPDYMSTNKLTKKSDVYSFGIILFELITAINPQQGLMDYINLVSHFNVTEST

SEQ ID NO: 16265 - DNA, 2005 bp, Panicum virgatum
  misc_feature: Ceres CLONE 1788343
  misc_feature: Encodes the peptide sequence at SEQ ID NO. 16266
aagcagataggcccgccgcgacaggcgatagcttacagacagccccgccgccgccgccgcctagttgccgatggcggctgccgcggccgcccggctcctccgtctggccccgcgccggctccaggttaagacctccccgctcgccgcactctcgttccccctcccgcgtacggcgccgctcgccgccgcctcggggcggcggcagagcttctgcgccgcggcgcaggcctccgctgacgcccccgctgccgctgtggccgcggcgaccgggccggtgggggaggccgtgggagagttcaggaagcggctgcgggtggcggacgtcaagggcggggaggacgagggcgccgcgttggtgggcaaggagctcgccgtgcgcgggtgggtgcgcacttgccgcgcccagaggaccgtcaccttcgttgaggtcaatgatggctcttgcttgtccaatatgcaatgtgtattgactcctgatacagaaggttatgaccagatagactcagtgactaccggagcatctgtactagttgagggagttgttgcaagcagccaaggtggtaagcaaaaagtggagttgaaggtttcaaagatcactgtgattgggaaaagtgatcccacatcttttcctatacagaagaaacgggcatcaagagaatttcttagaactgtagcccatctccgtcctcggacaaacacttttggtgcagtgacaagagtgagaaacgctctggcatatgcaactcataaattcttccaagacaatggatttgtttgggtatcaagccctattattactgcctcggattgtgaaggagctggggagcagttttatgtgactactttgctttcaaacagcgctgaaggtggttccttactcaaagatattcctgctactaaggatggaagagttgattggtcacaggatttcttctgcaaacctgcatttctgacggtatctggacagcttaatggcgaaacatatgcttcggctctatctgatatttacacatttggtccaacatttagggctgaaaattcaaacacggcaagacatctggctgagttttggatgattgaacctgagcttgcgtttgccgatctgaatgatgacatggcttgtgcaactgcatatctccagtatgtagtaaagtatattctagagaactgcaaagaagatatggatttcttcaatacatgggttgagaaaggcataatagatcgattaaatgatgtagtagagaagaaatttgttcacttgtcatacactgatgctgttgagctacttcttgggtccaagaagaaatttgagttcccggtaaaatgggggttagatcttcaaagtgagcatgagagatacatcacagaagttgcttttggtggccgcccagttataattagagattacccaaaggaaatcaaggctttctatatgcggcaaaatgatgatgggaagacagttgctgcaatggatttgttggttcctcgggttggtgaacttattggaggaagccagagggaagagcgccttgatcacctcgaagcccggttggatgagcaaaatctgaacaaggagagctactggtggtatttggatctacggcgatatggatcagttccccatgctggttttggtcttggatttgaacggcttgtacagtttgcaactggaattgacaacattagagatgccatcccgtttccccgagttcctggctctgccgagttttagcgatgtgaaggtgtttgcaaatatatactttacgaaattattgcctggggattctttcctgggagttgaaggaaaacacacccacattgcccattagtatgcattgtacagagttgaactgacacgttgctaagctgaagcaaagctataccgtggcatatttcattgtttggtgtaattgacgtatatttcatcgtgatagtgatgggtgtcagatttttattattattttgtaatctgaacaccaattattttgtcaaaggcgattttgtt

SEQ ID NO: 16266 - protein, 553 aa, Panicum virgatum
  misc_feature: Ceres CLONE 1788343
  misc_feature (194)..(549): Pfam Name: tRNA-synt_2 Pfam Description: tRNA synthetases class II (D, K and N)
  misc_feature (100)..(178): Pfam Name: tRNA_anti Pfam Description: OB-fold nucleic acid binding domain
  misc_feature: SWISSPROT Homolog: EC 6.1.1.22 Asparagine--tRNA ligase
  misc_feature: Useful for making plants with modulated biomass
MAAAAAARLLRLAPRRLQVKTSPLAALSFPLPRTAPLAAASGRRQSFCAAAQASADAPAAAVAAATGPVGEAVGEFRKRLRVADVKGGEDEGAALVGKELAVRGWVRTCRAQRTVTFVEVNDGSCLSNMQCVLTPDTEGYDQIDSVTTGASVLVEGVVASSQGGKQKVELKVSKITVIGKSDPTSFPIQKKRASREFLRTVAHLRPRTNTFGAVTRVRNALAYATHKFFQDNGFVWVSSPIITASDCEGAGEQFYVTTLLSNSAEGGSLLKDIPATKDGRVDWSQDFFCKPAFLTVSGQLNGETYASALSDIYTFGPTFRAENSNTARHLAEFWMIEPELAFADLNDDMACATAYLQYVVKYILENCKEDMDFFNTWVEKGIIDRLNDVVEKKFVHLSYTDAVELLLGSKKKFEFPVKWGLDLQSEHERYITEVAFGGRPVIIRDYPKEIKAFYMRQNDDGKTVAAMDLLVPRVGELIGGSQREERLDHLEARLDEQNLNKESYWWYLDLRRYGSVPHAGFGLGFERLVQFATGIDNIRDAIPFPRVPGSAEF

SEQ ID NO: 16267 - DNA, 1921 bp, Panicum virgatum
  misc_feature: Ceres CLONE 1788359
  misc_feature: Encodes the peptide sequence at SEQ ID NO. 16268
gcgccaccttgaagcaagcgcccgtgcgattggctggtcggagttggatatggtggcggcggcgctggacgcaatggcggggacgcggtgggggcggtggctgggcctggtgacggcggtgtgggtgcagtgcatctccggcaacaactacaccttctccaactactcggacgcgctcaagacgctcatgggcctcacccagctgcagctcaacggcctctccgtcgccaaggacgtcggcaaggcgttcggcctcctcgcggggctcgcctccgaccgcgtcccgacctggctcctcctcgccatcggctccctcgagggcctcctcagctacggcgcgcagtggatggtcgtgtccaggaccgtcgcgccgctcccctactggcagatgtgcgtcttcctctgcctcggcggcaacagcaccacctggatgaacaccgccgtgctcgtcacctgcatccgcaacttccgccgcagcaggggccccgtgtccggcctgctcaagggatacgtcggcctcagcaccgccatcttcaccgacatctgctccgcgctgttcgccgacaacccggcctcgttcctcgtcatgctcgccgtcgtgccggccgcggtctgcgcgctcgccatggtgttcctccgcgagggccccgccggcggcgccgcgggcgcgaccgcggacgaggcggaagacgggcgctgcttcgccgcgatcaactcgctcgccgtggccatcgctctgtacctcctcgccgcggacctcacgggcatcggcagcggcggcggggtcgtctcggccgtcttcgtggccgtgctcctggtcctcctcgcgtcccccggcgccgtgccggcgctcctggcgtggaaatcgtggatgaaggctcgcaaggccacgaacgccgacctcgaggaggcggagtccctggacgccgcggccgcgccgctcctcgtcgcggcgaaggcggcggggatgagcgaagaggacaaggcgcgggcgcccggcgagcggccgcggctcggggaggagcacacgatcgcgcaggcgctgacgtcgctggacttctggctgatgttcgcgtcgttcctgatgggcgtgggcacggggctggccgtgatgaacaacctggggcagatgggcgtggccatgggctacgacgacgtctccctcttcgtctccatgaccagcatctggggattcttcggccgcatcgcatccggcaccatctccgagcacttcatcaggacaagggcgataccacgcccgctgtggaacgcggcctcgcaggtcctcatggtcgtgggctacatcgtgatggccctggccatgccgggctccctcttcatcggctcggtggtcgtcggcgcctgctacggcgtccgggtggcggtcacggtgccgacggcgtccgagctgttcgggctcaagtactacggcctcatctacaacatcctcatcctcaacctgcccctgggctccttcctcttctcgggcctgctggcgggcctcctctacgacgcggaggccaccgcggtgccgggcggcggcaacacctgcgtcggcgcgcactgctaccgcctcgtgttcctcatcatggccgtcgcctgcgtagtcggattcggcctcgacgtcctgctctccgtcaggacgaagcgggtgtacgccaagatccacgagagcaagagggcgagcaggtcggccgcggcgcagagggtgagctagcctcgctgcttccgtgaaaaaaaaaaactagacctgcgggggagaccgcccccacgacattatactaagaagaagattttttcatgcaagtctagaaaacctccgaactcctgccccacccatatatagcggcctgttacccgtgagaaaggccggaccccaactatgctttagacatgaaaccagtgaggaagtttttttcct

SEQ ID NO: 16268 - protein, 555 aa, Panicum virgatum
  misc_feature: Ceres CLONE 1788359
  misc_feature (16)..(267): Pfam Name: Nodulin-like Pfam Description: Nodulin-like
MVAAALDAMAGTRWGRWLGLVTAVWVQCISGNNYTFSNYSDALKTLMGLTQLQLNGLSVAKDVGKAFGLLAGLASDRVPTWLLLAIGSLEGLLSYGAQWMVVSRTVAPLPYWQMCVFLCLGGNSTTWMNTAVLVTCIRNFRRSRGPVSGLLKGYVGLSTAIFTDICSALFADNPASFLVMLAVVPAAVCALAMVFLREGPAGGAAGATADEAEDGRCFAAINSLAVAIALYLLAADLTGIGSGGGVVSAVFVAVLLVLLASPGAVPALLAWKSWMKARKATNADLEEAESLDAAAAPLLVAAKAAGMSEEDKARAPGERPRLGEEHTIAQALTSLDFWLMFASFLMGVGTGLAVMNNLGQMGVAMGYDDVSLFVSMTSIWGFFGRIASGTISEHFIRTRAIPRPLWNAASQVLMVVGYIVMALAMPGSLFIGSVVVGACYGVRVAVTVPTASELFGLKYYGLIYNILILNLPLGSFLFSGLLAGLLYDAEATAVPGGGNTCVGAHCYRLVFLIMAVACVVGFGLDVLLSVRTKRVYAKIHESKRASRSAAAQRVS

SEQ ID NO: 16269 - DNA, 2012 bp, Panicum virgatum
  misc_feature: Ceres CLONE 1788365
  misc_feature: Encodes the peptide sequence at SEQ ID NO. 16270
acccttaaaccctccagtctgaaacccggcaggaaccctaaccttccccccccgagccgccgccagaccaccccgccgcttctccttccacctcttctcgcgccggcgtccgtatctcctgcgctcgagcttagctgagctattatgggcaagtcgggcaagaaatccgttgttgcggttgcacctgctgctgtctcggtcccagagggcaagtctgcaaagaaggggaagagaaatgcggaagatgagattgagaaggcagtcagtgcgaagaagcaaaagactgtacctgtaaaggttgagccagtgaagaagcagccccctcccaaaaaagttgagagcagtagctctgaggaagattctgaagattctgaagatgaggttaaggtccagccaaagatggcctcagatgatgatagcagtgacagtgatgagagcagcgacgagagctcctcagatgataagcctgctgctcagctaaagaagccgtcagttgccaccgtgcaaaagaaaacccaagagtctgatagctctgacagcgattccgatgatgaatcagatgaggatttgcctgttaaagctccagtagtagccaagaaaaaggaagagtcgagtgagagttctgaatctgaatctgagtccgaggatgaggataacaatgctaaaacagtgaagcctgcaaaggctgctgctcctaagaagaaagaggaatctagtgatagctcagaatctgactctgagtcagattcggattctgatgaacctgaaaaacctactgatgctgcaaaaatgcctctagcaacagataagaagaacagacaatccagtgatgaatctgatgatagttctgatgagagttctgatgaaagtgatgaggagcctcctcaaaagaagccaaaggctgtcactgaggtttcaaagaaagaaagcagcagtgatgaagaagaagatagtgaagaggaaagtgacgaacaggctaaaactcccaacacaaaatcggcacagaaagaagccaaaactcctgccaaaaaccatagtcagtctgctggatcgaagacgatttttgttgggaatttatcctacagtgtagatcgtgaacaagttaagcaattttttgaggaggctggtgaggttgtagacgttcgtttgcctactttcgaggatgggcgcatgagaggctatggtcatgttgaatttgctacagctgaagctgctcagaaggcacttgaatttgctaatcatgacctgatggggcggcctgtgagggttgacattgccgttgagaggggcgcgtacactcctggcagcgggagggacaatggttctttccacaaatctgctccaaggtcaggcaatactgtatttattaaaggctttaacacatctagtggagaggatgagatccgaagcgctcttgaagaacattttggttcttgtggagagattgttcggatttcaattccaaaggattacgaaactggtgcacccaaagggatggcgtacatggacttcaaggatccggattccttgaataaagcatatgagctgaatggaaccgaccttcatggctacaacttgtatgttgatgagacaaagcctaggcctgataacaacagagatggtggcttcagtggtggcaggcgtggaagtttcagtggaggaagagggagaagtgacaggggccgaggtggccgtggacgtgacggaggacgtggacgtggatttggtggaaggggtggaaggggtgacagaggccgtggaggtcggggcactccatacaagcagagcgctggtacagctagtacaggaaagaagacaacattcggtgatgacgagtgaagctttggcatgcggctatagtgaaatgcgaacaccttttgtcttgtaccctgaaacttatgttatatgttcgcctatttcgtgctgtgatgctgcatgctttgcaattttgacattttctgaacctattcagacattagttatgaaagtatctcgtggacgtgtgatctgtc

SEQ ID NO: 16270 - protein, 564 aa, Panicum virgatum
  misc_feature: Ceres CLONE 1788365
  misc_feature (306)..(375): Pfam Name: RRM_1 Pfam Description: RNA recognition motif. (a.k.a. RRM, RBD, or RNP domain)
  misc_feature (406)..(480): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MGKSGKKSVVAVAPAAVSVPEGKSAKKGKRNAEDEIEKAVSAKKQKTVPVKVEPVKKQPPPKKVESSSSEEDSEDSEDEVKVQPKMASDDDSSDSDESSDESSSDDKPAAQLKKPSVATVQKKTQESDSSDSDSDDESDEDLPVKAPVVAKKKEESSESSESESESEDEDNNAKTVKPAKAAAPKKKEESSDSSESDSESDSDSDEPEKPTDAAKMPLATDKKNRQSSDESDDSSDESSDESDEEPPQKKPKAVTEVSKKESSSDEEEDSEEESDEQAKTPNTKSAQKEAKTPAKNHSQSAGSKTIFVGNLSYSVDREQVKQFFEEAGEVVDVRLPTFEDGRMRGYGHVEFATAEAAQKALEFANHDLMGRPVRVDIAVERGAYTPGSGRDNGSFHKSAPRSGNTVFIKGFNTSSGEDEIRSALEEHFGSCGEIVRISIPKDYETGAPKGMAYMDFKDPDSLNKAYELNGTDLHGYNLYVDETKPRPDNNRDGGFSGGRRGSFSGGRGRSDRGRGGRGRDGGRGRGFGGRGGRGDRGRGGRGTPYKQSAGTASTGKKTTFGDDE

SEQ ID NO: 16271 - DNA, 1998 bp, Panicum virgatum
  misc_feature: Ceres CLONE 1788391
  misc_feature: Encodes the peptide sequence at SEQ ID NO. 16272
atccttctcgcctccgactgccccccccccccctccccctcgaaccttctggaacaagcgagcgagctggcgggcgcgcgagactcctgtcagcgaggcgaggctaagggagagggcgggggcggcgatgcggggcaggtgacgtgcagcgcggcgtaggaggcggggatggtggctgcggcgacggcggcggagggtgggctcggcgggggcgtcgaggagggcgttggggagagctcgtccccgccccgcgacgcggcccctgttcctgccggctccggtggaagcggtggcgggggaggtgcccgcgacatctgcggccaggtgcttgagcaactcatcgccgacggccacgcggatgcgtccaactccgagttccgagacaagctcgtggcccatttcgggcggcttccgcacagctatcagctggatatcaatgttgacaaagcaaccgatgtcttggtccaccagaacgtcttagcagaagcaaaggatcctgacaggcgccccgcattccatgtccgtttcttgaggattgaagatatcgatcaagcatatgactccgatgcaactgaagaaggggatgatgatggagatgatctctctgtaaggcaagacacacaatatactcacattcatgagattgttttctccacaattgacaagccaaagctactcagtcagctctctgcgttgctgtctgacattggactgaacatcagagaagcacacgttttctcaactcatgatggctattctcttgatgtttttgtggttgatggttggcctattgaggacactgatggtttgaacaaagcactggaagcatccattttaagaaatgagggttcatggtctggttcatctcattcctcagcagctgaaagaacactgcccttccaacttaaaggtggtgaatgggaaattgacaaacgacttcttaagatgggtgggatgattgcttctggttcttgtggggacttgtatcatgggacttaccttggtgaggatgtagctgttaaagttctaagggccgagcatttgaataagaatgtttggaatgagttcatgcaggaagtatatattctaagagaagttcaacatacaaatgttgtgcggttcattggtgcatgcacaaaaccaccgcaattttgcataattacagaatacatgtctggaggaagcctgtatgactttgtgcacaagcagcataatgttctaaacctcacaactctcttgaagttcgcagttgatgtatgccaagggatgtgctacttgcacgaaaggggtatcatccatagagatttaaagactgccaaccttctaatggacaaagatcgagttgttaaagtggctgatttcggtgtggctcggttccaggatcaaggaggtatcatgacagctgaaactggaacttacagatggatggcacccgaggttataaatcatcaaccctatgataacaaagcagatgtgttcagctttgctattgttctttgggagctgataacgtctaagatcccatatgatacaatgaccccgctccaggcggctgtaggtgttagacagggattgcgcccaggactccccaaaaaggcacatccaaagctgttggacttaatgcagagatgttgggaagccgatccatctaaacggcctgctttcccagacatcctagccgaactagaggatcttctgtcacatgttcagggagcttcaggaaagacggtccaagatccagctaatgactcgaacaaaagaagattgactccccctgcacatacctgacatttttctcaattcggagatttggcgtatttaggattcgggtcactaattatgaggaatgtaggcttgtagcatatcattttttcggttggtttttgcgttggtgtacatttgaacaagcatcttggggcctattttttttggtctcattgttcttatatagaggaaattggctcgccaacctgcttataatgggactggatgtttcgg

SEQ ID NO: 16272 - protein, 539 aa, Panicum virgatum
  misc_feature: Ceres CLONE 1788391
  misc_feature (258)..(506): Pfam Name: Pkinase_Tyr Pfam Description: Protein tyrosine kinase
  misc_feature (157)..(220): Pfam Name: ACT Pfam Description: ACT domain
  misc_feature: SWISSPROT Homolog: EC 2.7.11.1 Non-specific serine/threonine protein kinase
MVAAATAAEGGLGGGVEEGVGESSSPPRDAAPVPAGSGGSGGGGGARDICGQVLEQLIADGHADASNSEFRDKLVAHFGRLPHSYQLDINVDKATDVLVHQNVLAEAKDPDRRPAFHVRFLRIEDIDQAYDSDATEEGDDDGDDLSVRQDTQYTHIHEIVFSTIDKPKLLSQLSALLSDIGLNIREAHVFSTHDGYSLDVFVVDGWPIEDTDGLNKALEASILRNEGSWSGSSHSSAAERTLPFQLKGGEWEIDKRLLKMGGMIASGSCGDLYHGTYLGEDVAVKVLRAEHLNKNVWNEFMQEVYILREVQHTNVVRFIGACTKPPQFCIITEYMSGGSLYDFVHKQHNVLNLTTLLKFAVDVCQGMCYLHERGIIHRDLKTANLLMDKDRVVKVADFGVARFQDQGGIMTAETGTYRWMAPEVINHQPYDNKADVFSFAIVLWELITSKIPYDTMTPLQAAVGVRQGLRPGLPKKAHPKLLDLMQRCWEADPSKRPAFPDILAELEDLLSHVQGASGKTVQDPANDSNKRRLTPPAHT

SEQ ID NO: 16273 - DNA, 1973 bp, Panicum virgatum
  misc_feature: Ceres CLONE 1788400
  misc_feature: Encodes the peptide sequence at SEQ ID NO. 16274
atcagatgaagcaacgctagcagcatcgtgactgaattcaaacctcccgttatatatagcgagctaccccgctagacacgccgaggagcgcatcagcatcgccactccccagttccagagtagaattgtaagggccaagccggcacaacgaacgaacttgagaaagggagcagcagctcagctccttcctgcgccgtgacctcttgttgcctctgcgtatctgaagctgttgatgcgagtgagggcgccatctccatggctctcctggcggcggcggcggcgaggatggacgaccacgacgagtacgccaagctcgtcagggggatgaacccgcccagggtcgtgatcgataacgatgcctccgacgacgcgacggtgatccgggtggacagcgtgaacagccacggcacgctgctcgccgtcgtccaggtcatcgccgacctcaacctcgtcatccgcaaggcctacttctcctccgacggcaactggttcatggacgtgttcaatgtcaccgaccgtgacggcaacaaggttgttgacgcctcaaccatcgcctacatccagaagacgctggaggcggacgactggtactacccagagacgcgcaacacggtgggcatcgtgccgtcagaggagtacacctccatcgagttgacgggcaccgaccggccgggcctgctctccgaggtgtgcgcggtgcttgtcgtcatgggttgcgcggtccagagcgccaagctgtggacgcacaacacgcgcgtcgccgccgtcgtgcacgtcaccgacgccgagtccggcggcgccatcgaggacgccggctgcatcgccgacatcagcgcgcgcctcggcaacctgctgcgcgggcagagcgacgtgcgcgccggcggcggcgcgggcaccccggcgcagcacaaggagcggcggctgcaccagatgatgttcgacgaccggggcgggcacgccgacgccgcggccggcgccgacgccgccggcccggcgcggacggaggtgtccgtgacggcgtgcgcggagcgcgggtacacggcggtggtggtccggtgccgcgaccggcccaagctgctgttcgacaccgtgtgcaccatcacggacatggagtacgtggtgcaccacggcaccgtgagcgcggagcccgccggcggcgcgtaccaggaatactacatccggcacgtcggcgggcacgccgtccggtgcgaggccgagcggcggcgcctggtgcggtgcctggaggccgccatcgagcggcacaccgccgagggcctggagctggaggtgcgcacgggggaccgcgccggcctgctctccgacatcacccgcatcttccgggagaacgggctcaccatccggcgcgccgagatctcgtccgccggcggcgaggccgtggacacgttctacctgtccgacccgcagggccaccccgtggaggccaagaccatcgaggccatccgcgcgcagatcggcgaggccacgctgagggtgaagaacaacccgttcgccgccggggacggcgcggcgagcaaggacgccggcgtcgcgggcgccggcgccggtgccggcacgacggcgttcatcttcgggaacctgttcaagttctaccggccgttccagagcttcagcctcgtcaagctctactcgtagactacctggttgatttctcaatcgcaggttctgtacatagatttcggttgattattggtctttcaggcatcactgtacatatggttatggccagttatgggtgtagattaagattcaaaagtagaaatttaggggagaaaatattggctcagctcccaaaagatttgtagcaaataggaagtaagcaaagcagatggttactgtgtattactccttaggatttagggttaaagtactggggtgtgcaactgtctctgtaaatactcgtcttgtacatgtgctcatcacctcatgcatattcttgaggggagtaaatacag

SEQ ID NO: 16274 - protein, 465 aa, Panicum virgatum
  misc_feature: Ceres CLONE 1788400
  misc_feature (341)..(407): Pfam Name: ACT Pfam Description: ACT domain
  misc_feature (129)..(194): Pfam Name: ACT Pfam Description: ACT domain
  misc_feature: SWISSPROT Homolog: EC 2.7.7.59 [Protein-PII] uridylyltransferase
MALLAAAAARMDDHDEYAKLVRGMNPPRVVIDNDASDDATVIRVDSVNSHGTLLAVVQVIADLNLVIRKAYFSSDGNWFMDVFNVTDRDGNKVVDASTIAYIQKTLEADDWYYPETRNTVGIVPSEEYTSIELTGTDRPGLLSEVCAVLVVMGCAVQSAKLWTHNTRVAAVVHVTDAESGGAIEDAGCIADISARLGNLLRGQSDVRAGGGAGTPAQHKERRLHQMMFDDRGGHADAAAGADAAGPARTEVSVTACAERGYTAVVVRCRDRPKLLFDTVCTITDMEYVVHHGTVSAEPAGGAYQEYYIRHVGGHAVRCEAERRRLVRCLEAAIERHTAEGLELEVRTGDRAGLLSDITRIFRENGLTIRRAEISSAGGEAVDTFYLSDPQGHPVEAKTIEAIRAQIGEATLRVKNNPFAAGDGAASKDAGVAGAGAGAGTTAFIFGNLFKFYRPFQSFSLVKLYS

SEQ ID NO: 16275 - DNA, 1424 bp, Panicum virgatum
  misc_feature: Ceres CLONE 1788411
  misc_feature: Encodes the peptide sequence at SEQ ID NO. 16276
aaatagcccgtactgcctacggcgccgtccggtccccgtcatccggagccgcgccgcgacgaccgaagaaggaagaagcatccggaggcgcacgacctgcctctccttcctcccatggcgccgcccctctccgccgccgccgtggccgtatcctcctcgtcgcccctcttctcgccctcttcatcccaccccctcatccgccgccatgcgcctccgagatatgtctccatgcggacgcgtggccgttcgcagcccgcggcggcggcggccgagtcctccggcagcccgcttctcgaggtgcgaggtctcaccgcatccgtgaaggagaccggtcagcagatcctcgccggcgtcgacctcaccatccgcgagggcgagattcatgcgatcatgaggaagaacggctccggcaagagcaccctcacaaaggttcttgttggccatccgcattatgaggtaactggtggcaccattctcttcaagggtgaggacttgattgacatggagccagaggaaagatctctcgcaggcctttttatgagtttccaagcacctattgagattcctggcgtgagcaattttgattttctgctcatggcagtcaatgctcgcagagaaaagagtggtctaccagcattgggtccaattgagttttattcggttgtatcacccaaagttgatgccttgaagatggatccgaagttccttgatcgcaatgtgaatgaaggttttagtggtggtgaaaggaagcgcaacgagatattgcaactttcagttattggagcagatttagctcttcttgatgagatagattcaggattagatgttgatgcacttgaagatgtagctattgcggtgaatgggcttttgacaccccaaaactctgttctgatgattacgcattaccaacgtcttttagatctcattaaacccagctatgttcatatcatggaaaatggcaagataatcaagactggtgacagttctattgccactcaaattaatgaaggtggcttcaaatcaattgcccttgtatagctttaaagtcaaacacttgaaggtggaggagcctatttgtcaacaaaacttttgagtttgtgtaccccattcaaccaggcatgttatcttttgaaggtggagagttggatcgaccacctcctctgtaagaatttttggatcaagttgttgacaactagtcgtaccgaaggaaagcatcttactacacgatccacaaattttatatatttgagtatgactcgttggcttggcccttgggcatctggtcatcaagattgttttgcatgtatctttttgtaaacattttaacacttgtaacaaatttgcaggcctagaaagttacttagatgtctccacacgggagaagatctggtgcgatcatcaattcacatgtgtgcaggttctct

SEQ ID NO: 16276 - protein, 269 aa, Panicum virgatum
  misc_feature: Ceres CLONE 1788411
  misc_feature (49)..(244): Pfam Name: ABC_tran Pfam Description: ABC transporter
  misc_feature: SWISSPROT Homolog: EC 3.6.3.31 Polyamine-transporting ATPase
MRTRGRSQPAAAAAESSGSPLLEVRGLTASVKETGQQILAGVDLTIREGEIHAIMRKNGSGKSTLTKVLVGHPHYEVTGGTILFKGEDLIDMEPEERSLAGLFMSFQAPIEIPGVSNFDFLLMAVNARREKSGLPALGPIEFYSVVSPKVDALKMDPKFLDRNVNEGFSGGERKRNEILQLSVIGADLALLDEIDSGLDVDALEDVAIAVNGLLTPQNSVLMITHYQRLLDLIKPSYVHIMENGKIIKTGDSSIATQINEGGFKSIALV

SEQ ID NO: 16277 - DNA, 737 bp, Panicum virgatum
  misc_feature: Ceres CLONE 1788416
  misc_feature: Encodes the peptide sequence at SEQ ID NO. 16278
aaatccgccttccccaatctctcgccctccttcccccgtgcgccgcagctagaaagctagggtttcgcctgcgatccgatccgtcgagtccaccctccccacccgatcgatggcggccgagggcgagaagaagatgatcacgctcaagagctccgacggcgaggagttcgaggtggaggaggcggtcgccatggagtcgcagaccatccgtcacatgatcgaggacgactgcgccgacaacggcatcccgctccccaacgtcaactccaagatcctctccaaggtcatcgagtactgcaacaagcacgtccacgccgcagccgccgcggccgccgcgtccaaggcaggctccgacgacgcgggggctgccgccgccaacagcaacgccgcctccggcgaagacctcaagaactgggacgccgacttcgtcaaggtcgatcaggccacgctgttcgacctcatcttggtaaaggctccgcctccctcctccctcctctgtccatgcctatatggtgaaatttagatctgggattggttagggttcatatttatccatttagatctggattggtttgtttgttggtggaagctagctgtctttacctgcgcgggttgcggggattttgttgctgctgtcaatcgaatgcatcatcataatactgcctgctagttaattggatttgcattgtcacaaatgtattattgtcctatcgaggaacttctatttatatagatat

SEQ ID NO: 16278 - protein, 137 aa, Panicum virgatum
  misc_feature: Ceres CLONE 1788416
  misc_feature (8)..(68): Pfam Name: Skp1_POZ Pfam Description: Skp1 family, tetramerisation domain
MAAEGEKKMITLKSSDGEEFEVEEAVAMESQTIRHMIEDDCADNGIPLPNVNSKILSKVIEYCNKHVHAAAAAAAASKAGSDDAGAAAANSNAASGEDLKNWDADFVKVDQATLFDLILVKAPPPSSLLCPCLYGEI

SEQ ID NO: 16279 - DNA, 660 bp, Panicum virgatum
  misc_feature: Ceres CLONE 1788416-R
atctcctgataaatcattaaaaagggcttgcccggtactgtaggcttcccgcactgcgcggtgtctgtggaagggttgttttaatctcataagcttatttctgctatgaatcctctgaagttgtctgattgctccttgataatgcagtgaagtttgttttctgatttacgagtagtgcatattcttagataaaacattttcgcctatctatttatattctctgagtatgaactttttcttcctggtttctgacaccctcttttctgtcaggctgcaaactatctcaacatcaaggggctgctggacctgacctgccagactgttgccgacatgatcaagggtaagactcctgaggagatccgcaagaccttcaacatcaagaacgacttcacccctgaggaggaagaggagatccgcagagagaaccagtgggccttcgagtagagaggtgcttgagctcctgatctcttgatgcctagactttgtcgtacctatgcaatgcctgcttttatgtgtcgtcggaatggttgtaagtattttgggagttgctgcggtgttgggtaaaactggtcagttattctaaacaaatgtatctctagtatatcatgacaagactaagtggctgctgccctaagaggtttagttcgatttgccatggcg

SEQ ID NO: 16280 - DNA, 1925 bp, Panicum virgatum
  misc_feature: Ceres CLONE 1788419
  misc_feature: Encodes the peptide sequence at SEQ ID NO. 16281
agctacaagctcgctggctccgagcatagctgtcccgtccgcgtcgtctagctacccgtcgagctctccatcggggtcccagacggacgcgaggaggaggagtagcggaggacaatcgccgcaatgccgccgtcggggatcaccgcggtggacgcggcggccaaggggatgaaactggagcggtacgcgagcgggggcgcgctgctgctgcggcgcgccaccagcgccaagctcgtgtcggcgtcgtcgcacctgctcttccgcgccaccgtgctcgccacgctcgcgctcgtcttcctcttcacgctgcactacccgtccctcctgtcccgctccttccacctctccgccggcggcgacgccgcgcacccctcgtccgcctcgcaccggagcctgctcatgtcctcctcctcctcggcggcggcgtcgtacgggggtgccgcgtgggagaaggagatgcggcggagcgccaggccgagccgcgacggcgggatctccgtgctggtcaccggcgccgccgggttcgtgggcacgcactgctcgctcgcgctcaaggcccgcggcgacggcgtcgtcgggctcgacaacttcaactcctactacgacccgtcgctgaagcgcgcgcggcaggcgctcctggccagccggggcgttgtggtgctcgacgccgacatcaacgacggcctgctgctggagaagctcttcgacgtggccgcgttcacgcacgtgctgcacctggcggcgcaggccggcgtgcgctacgcgatggaggcgccgcagacgtacgtggcctccaacgtggccgggctcgtcagcgtgttcgaggtggcggccaagcacgccgacccgcagccggcgatcgtctgggcgtcgtcgtcgtccgtgtacgggctcaacaccgacgcgcccttctccgaggaccaccgcaccgaccgcccggcgtcgctctacgcggccaccaagaaggccggcgaggccatcgcgcacacctacaaccacatctacggcctctccatcaccggcctccgcttcttcacagtctacggcccgtggggccgccccgacatggcctacttcttcttcgcccgcagcatcgtcgccggcgagcccatcacgctcttccgcgccgccgacggctccgacgcgcgccgcgacttcacctacatcgacgacgtcgtcaagggctgcctcggcgcgctcgacaccgccggcaagagcaccggctccaaatccggcaagaagagcgggcccgcgccgctccgcgtttataacctcggcaacacctcccccgtgcccgttacccggatggtcgccatcctcgagaagctgctcgggaagaagtccaacaagcgcatcgtcaccatgcccagcaatggcgatgtgcccttcacccacgccaatgtcagccacgccgcccacgacttcggctaccgccccaccacctccctcgaggccggcctccggcacttcgtcgactggttcgtggagtactacaaactcgacaccaagatcgtcaagggcgcccgcagcagcgccgccgccaagcccgcgaagaagaagaaggccgcggcggcgtcttcgtgatcgatcaagcacatgcacagcacacagagacagagcaccaacaccacaaccacaagtgtgtattctctactagctagttcttggaggcttttgtctgtaaccatgtattgtttaagcccttgctagttgcttcttcttcgtcatcttcttctccttctaatcctacttatgctgatagggattagtaggaataagtgatgcaaataactgttgcatgcatagtggtagataaagattgggaaggggtatagatgatgataagatcaaacagaggagccaggacggatgaaagatgaagtcactggctccctatcaatcaaattgttctcttgcacagcgtc

SEQ ID NO: 16281 - protein, 486 aa, Panicum virgatum
  misc_feature: Ceres CLONE 1788419
  misc_feature (126)..(385): Pfam Name: Epimerase Pfam Description: NAD dependent epimerase/dehydratase family
  misc_feature: SWISSPROT Homolog: EC 5.1.3.6 UDP-glucuronate 4-epimerase
  misc_feature: Useful for making plants with altered carbohydrate content
  misc_feature: Useful for making plants with altered cell wall content and/or composition
MPPSGITAVDAAAKGMKLERYASGGALLLRRATSAKLVSASSHLLFRATVLATLALVFLFTLHYPSLLSRSFHLSAGGDAAHPSSASHRSLLMSSSSSAAASYGGAAWEKEMRRSARPSRDGGISVLVTGAAGFVGTHCSLALKARGDGVVGLDNFNSYYDPSLKRARQALLASRGVVVLDADINDGLLLEKLFDVAAFTHVLHLAAQAGVRYAMEAPQTYVASNVAGLVSVFEVAAKHADPQPAIVWASSSSVYGLNTDAPFSEDHRTDRPASLYAATKKAGEAIAHTYNHIYGLSITGLRFFTVYGPWGRPDMAYFFFARSIVAGEPITLFRAADGSDARRDFTYIDDVVKGCLGALDTAGKSTGSKSGKKSGPAPLRVYNLGNTSPVPVTRMVAILEKLLGKKSNKRIVTMPSNGDVPFTHANVSHAAHDFGYRPTTSLEAGLRHFVDWFVEYYKLDTKIVKGARSSAAAKPAKKKKAAAASS

SEQ ID NO: 16282 - DNA, 1725 bp, Panicum virgatum
  misc_feature: Ceres CLONE 1788444
  misc_feature: Encodes the peptide sequence at SEQ ID NO. 16283
atcatctctcgctctacactacactacttcggcgagctacacagactacacggccggcgcagagtagagcaggctgtgtactagctagcgagttaaagcagctagcaggctgatcattaagcggcgccagcgatggcgaaggtcgccgcggaggccgcgggccggcaggcggcgtccttcgtgctcggctgcgtcgccgcgctgacagtggtcgtgctcatcctgcagcgccgccccgaggagctcacccgccccagggaaccggtgcaattcttcgccggctccaggtcggagtcgtcaccatcatcaggacgacgcggcggggcatcatcttccggatcctcgtcgtcgtcgacgccggcaggtcagacgacggcaatcgtcgcagctgatgatggccaaccgcaggcagccgttcccgtgcaggccaacgccacaaagctgaagcctgcagctgctggcgcaggcggcgctaccactgctgctgcggccgccgatgatctacgccgcgttccggccactcccgcacatcgccaacaagagggcgaggccgcggacgacgacgccgagttcccgggcctggccgccgtggtggcgcgcgcggcgacggcggacgaccggacggtgatcatcacgtgcgtgaaccacgcgtgggcggcgccggggtcgctgctggacctcttcctggagagcttccgcgtgggcgacggcatcgcggagctgctgggccacgtcctcatcgtggccatggacccgacggccatggcccgctgccgcgccctgcacccgcactgctacctctacaccatgcccggcgtcgacttcgcctccgccaagttcttcctctccaaggagtacctcgagctcgtctggagcaagctcaagctccagcgccgggtgctccagctcggatacaacttcctcttcaccgacgttgacatcctgtggttccggaacccgttcaagcacgtgacggcgtacgcggacatgagcatctccagcgacgtcttcttcggcgacccggacaacatcgacaacttccccaacactggcttcttccacgtgcggcccaacaaccggacgatcgccatgaccagggcgtggcacgaggcgagggagaggtacccgggcaggaacgagcagccggtgttcaacgccatcaagaaggagctcgtcagggacctccggctgcgggtgcagtacatggacccggccttcatgggcggcttctgcagctacggcaaggacctccgcaggatctgcaccatgcacgccaactgctgcgtcgggctggccaacaaactcagggacctcgggaccctgctccaagactggaggaactacaccgccatgccgcactgggccaagcaacacgccaagtggacagtcccgggagcctgcatccactgatgatcatgcacaccggggcttttggattattgatggattatttgttttagttttgtttcggatagatttgcactgttggatatataccaaaagagttattttgctgccctttataattactttgtataataaccaccaaaatacatacccgtacacttactatactgctagtactgtgtcttggatactagatatataccagacattcagacaaggtggcaaagtcgggtttgttggataccagaagagtagtcagtcctttactactgtatatcagaaaaatatatatctgtaaacttatatattactcttatg

SEQ ID NO: 16283 - protein, 425 aa, Panicum virgatum
  misc_feature: Ceres CLONE 1788444
  misc_feature: Useful for making plants with altered carbohydrate content
MAKVAAEAAGRQAASFVLGCVAALTVVVLILQRRPEELTRPREPVQFFAGSRSESSPSSGRRGGASSSGSSSSSTPAGQTTAIVAADDGQPQAAVPVQANATKLKPAAAGAGGATTAAAAADDLRRVPATPAHRQQEGEAADDDAEFPGLAAVVARAATADDRTVIITCVNHAWAAPGSLLDLFLESFRVGDGIAELLGHVLIVAMDPTAMARCRALHPHCYLYTMPGVDFASAKFFLSKEYLELVWSKLKLQRRVLQLGYNFLFTDVDILWFRNPFKHVTAYADMSISSDVFFGDPDNIDNFPNTGFFHVRPNNRTIAMTRAWHEARERYPGRNEQPVFNAIKKELVRDLRLRVQYMDPAFMGGFCSYGKDLRRICTMHANCCVGLANKLRDLGTLLQDWRNYTAMPHWAKQHAKWTVPGACIH

SEQ ID NO: 16284 - DNA, 657 bp, Panicum virgatum
  misc_feature: Ceres CLONE 1788446-R
  misc_feature: Encodes the peptide sequence at SEQ ID NO. 16285
aaaggaaaagggtgtctcccttatgttgccaactgatgttgtcattgctgataagtttgcccctgatgctaacagccagattgttccagcatcttcaattcctgatggttggatggggctggacattggcccagattctattgcttcattcaatgcagccctggacacaacccagacaatcatctggaatgggcccatgggtgtttttgaattcgacaagttcgctgtaggaactgaggctgttgcgaagaagttggcagagcttagcggcaagggtgtcacaaccatcattggaggtggagactctgttgcagctgttgagaaggtgggagttgctgatgttatgagccacatttcaacgggaggtggtgccagcttggaattgttggaaggaaaggagcttcctggagttgttgcgttggatgaagccgtccctgtgactgtatgagttttcaatttgtttctccttcatcttcgtgtaccatgtaaacttgctacactcttgctcgctccttgtcagccgctcgaaatgcaagatcaatgctttatagagctactggaaattgtttgaataactacacagaataatatgtgtttacctgagtcataactcataaaaacccataaagggcactgtagcctatttggctatagatt

SEQ ID NO: 16285 - protein, 148 aa, Panicum virgatum
  misc_feature: Ceres CLONE 1788446-R
  misc_feature (1)..(140): Pfam Name: PGK Pfam Description: Phosphoglycerate kinase
  misc_feature: SWISSPROT Homolog: EC 2.7.2.3 Phosphoglycerate kinase
KEKGVSLMLPTDVVIADKFAPDANSQIVPASSIPDGWMGLDIGPDSIASFNAALDTTQTIIWNGPMGVFEFDKFAVGTEAVAKKLAELSGKGVTTIIGGGDSVAAVEKVGVADVMSHISTGGGASLELLEGKELPGVVALDEAVPVTV

SEQ ID NO: 16286 - DNA, 147 bp, Panicum virgatum
  misc_feature: Ceres CLONE 1788446
gtcgctcgcttacacggccggcgacgtgcagcgcgctgatgaagtcgatgaggggtgccgtttgggttcagcgccgcgcgtgatcctgctctgggccgccgtggtgaggctggacgtgtgggaccttgctgatgtggaccgccaggg

SEQ ID NO: 16287 - DNA, 2063 bp, Panicum virgatum
  misc_feature: Ceres CLONE 1788455
  misc_feature: Encodes the peptide sequence at SEQ ID NO. 16288
aggctcgcacggctacgatataccgatacctacctatagctagctacgagttgtagctggtgatatgcatcaccctggccttctcctccattctttcagagagagagagagagattggttcatccctcagttcagttcataccggatcgagctagctagaagcagagagatggcgtcgagcggcggcgacaacaacggaggaggagacgagtggctgatcagggaggcgctgctggctccggcaggcaacggcaacggcaacggcaacggcagcggcggcaaggtggaggtggcggacctggaggagatccggagcgtgcgggcgttcatgcggcacgcggcggaggagaaccggcggctctggtacctggcgggccccgccatcttcacgtccatcgcgcagtactcgctcggcgccgtcacgctcgtcttcgccggccacctcaccacgctcgagctcgacgccgtctccaccgagaacaacgtcgtcgccgggctcgccttcggcatcatgcttgggatgggtagcgcgctggagacgctgtgcgggcaggcatacggcgcgaagcagctgcacatgctgggcgtgtacctgcagcgctcgtggatcatcctcgccgccatggccgtgctcatgctccccatctacctcttcgccaccccgatcctgggcttcttccaccaggacgccgagatcgccgccctcgcgggccggctcgcgctctacatgatcccgcagctcttcgcctacgccttcaacttccccatccagaagttcctgcaggcgcagagcaaggtcatggccatggccgccgtctccgccgtcgggctcgcgttccacgtcgcgctcagctggctcctcgtggggcccatgcggatggggctcgccggcctcgccctcgctctcaacgcgtcctggtggctcgtcgtgctcggccagctcgcatacatcctcatgggctactgccccggcgcgtggaacggattcgactggctcgccttctccgacctcgtcggcttcgcgcgcctctccctcggatccgccgtcatgctctgcctcgagttctggttctacatgttcctcatcgtcatcatcggcaacctggagaacgctcaggtcgccgttgcggcagtctccatctgcaccaaccttttcggatggcagatcatggtgttcttcgggttcaacgccgccatcagcgtgcgggtgtccaacgagctgggcgccgggcggccccgcgccgccaagttcgccatcctggtggtgctcatgtcgtcggtggccatcgggctggcattcttcgccgccgtgctggcgctccgcgacgtctacggcgcgcccttcacggagagccccgccgtggtgcgcgccgtggcgagcctcggcgtcgtgttcgccttcacgctgctgctcaacagcgtgcagccggtgctgtcgggcgtcgccgtcggcgtcgggtggcagtggttggtggcctacatcaacctcggctgctactacctcgtcggcatccccgtcgggtacctcatcgccttcccgctgcgcggcggggtgcggggcatgtggggcggcatgctcgccggcgtcggcctgcagaccgtgatcctggtggccatgatgctgcgcaccgactggggcaaggaggccagggaggccgtgtccaggatacggaaatggggcgggtcggccgccgccaaggctccggatcatcactgaggaagatgggcggctcttcctcttcatcttgtgtgtgcttgtgaggtcctcctcctccggcgccgcctccccgttgattggattgtgtgcctcctgcacctagctgcaggtcgtgtttgtgctgctctgcttatattggattattattggaggtgtatgttactagtatttttgttcataggaaaacatattagttacaagcattgtttttcataagcacgcctggggggcaacccgatgatgcctctctcattattcccaataccattaaggtcccatttggcatggattcaaatttctcaagaaaaaaaattaattttgagataaactgattctggttttcctg

SEQ ID NO: 16288 - protein, 515 aa, Panicum virgatum
  misc_feature: Ceres CLONE 1788455
  misc_feature (70)..(230): Pfam Name: MatE Pfam Description: MatE
  misc_feature (290)..(453): Pfam Name: MatE Pfam Description: MatE
MASSGGDNNGGGDEWLIREALLAPAGNGNGNGNGSGGKVEVADLEEIRSVRAFMRHAAEENRRLWYLAGPAIFTSIAQYSLGAVTLVFAGHLTTLELDAVSTENNVVAGLAFGIMLGMGSALETLCGQAYGAKQLHMLGVYLQRSWIILAAMAVLMLPIYLFATPILGFFHQDAEIAALAGRLALYMIPQLFAYAFNFPIQKFLQAQSKVMAMAAVSAVGLAFHVALSWLLVGPMRMGLAGLALALNASWWLVVLGQLAYILMGYCPGAWNGFDWLAFSDLVGFARLSLGSAVMLCLEFWFYMFLIVIIGNLENAQVAVAAVSICTNLFGWQIMVFFGFNAAISVRVSNELGAGRPRAAKFAILVVLMSSVAIGLAFFAAVLALRDVYGAPFTESPAVVRAVASLGVVFAFTLLLNSVQPVLSGVAVGVGWQWLVAYINLGCYYLVGIPVGYLIAFPLRGGVRGMWGGMLAGVGLQTVILVAMMLRTDWGKEAREAVSRIRKWGGSAAAKAPDHH

SEQ ID NO: 16289 - DNA, 479 bp, Panicum virgatum
  misc_feature: Ceres CLONE 1788475
  misc_feature: Encodes the peptide sequence at SEQ ID NO. 16290
atctcgctctcaattccgcaagcaacttctccccttccctctcaatctgcccttgccgaaaaggtatctgcttgttccctctgtatcaaaatctttcgctagacgcacacattatacaccggcacattgatcgttcaatggtgggagaccattttcttggcgcgggcgacaatccggaagaggggcgggaggcctccgcagccacaacgactaatcgtcgctggcaggaagattgaagaagtggagcacccaaagagaatgcacgtgaaggaggagtacgccctccacctggtgctccgcctgcaaaggtggtggaagatatttgtgaataccctcactggtaacaccatctgcttggaggtggagtcttccaacaccatctacaacgctaacgcgaacatccaggacaaggacggcatcacctcggaacaacagcgtctgatcttcgccggcaatcagttagaagatggacgcacccg

SEQ ID NO: 16290 - protein, 73 aa, Panicum virgatum
  misc_feature: Ceres CLONE 1788475
  misc_feature: Useful for making plants with modulated nitrogen use efficiency
  misc_feature: Useful for making plants with modulated cold sensitivity
MHVKEEYALHLVLRLQRWWKIFVNTLTGNTICLEVESSNTIYNANANIQDKDGITSEQQRLIFAGNQLEDGRT

SEQ ID NO: 16291 - DNA, 2472 bp, Panicum virgatum
  misc_feature: Ceres CLONE 1788485
  misc_feature: Encodes the peptide sequence at SEQ ID NO. 16292
atccagccacccactccgtcctcctccgccgccatgtgctcctcctacgaccgctccccgtcccgcggcgccgtcgccgacgacctctcgttctacctcgacctgcctcccaccccgctgcagtgccaccagcccaactgccgggccgcggagtcgccggaggacatggtgctccccttcatctcccgcatgctcatggaggaggacatcgacgacaagttcttctacgagtaccccgaccacccggcgctgctgcaggcgcagcagcccttcctcgacatcctctccgacgacgcctcctcgtccccgtccgcggccggcagcggcgccagcgtcacccacccctccacctcctcccccaacgccgccgacgcgcccctccaccccgccgccgccgtcgactgcgacgcccagttcaacggcttcgacctcgacccggccgccttcttcagcggcggggccaactccgacctcatgagctccgccttcctcaaggggatggaggaggccaacaggttcctccccagccaggacaagctcgtcatcgaccccgacccgcccgacgacgccaagaggttcaggttcctccgccccgcggagaacaagcagctcgcggcatccgggttcgacgccgccgctcccgctgccgcggtggccgtggaggtggaggaggctgtcgtggcggcgcctggaggcggcgtcgggggccgcggtcggaagaacaggttcgacgacgacgaggacgacctggagatgcaccgccggagcagcaagcagagcgcgctgcagggggacggcgacgtcttcgacaagcagcacatgatcacctcccagcagatgtgcgtcctcgtcgagcagatggagaagctgcggatccccacgcaggaggaggccgccgccaagaaggcggcggccgcgggcggcaaggccaaggccaagggaggaggaggccgccgcgtcgggagggaggtggtggacctgcgcacgctgctcctccactgcgcccaggcagtcgccaccgacgaccgccgcggcgccaccgagctgctcaagcagatcgagcggcacgccagcgctcacggggacgccatgcagcgactcgcccgctgcttcgccgagggcctgcaggcgcggctcgccggcacgggcagcagcaccagcacgccgccgctgatgcccaagcagcgcacgcccgtggtcgacatgctccaggcgtaccagctgtacatggccgccatctgcttcaagaaggccttctacctcttctccaaccagaccatccacgccgcgtccctgggcaagaagaagatccacatcgtcgactacgggatccactacggcctccagtggccgtgcttcctgcggcggatggcgtgccgggagggcgggccgccggaggtgaggatcaccggcatcgaccttccccagccagggttccgccccgcccagcgcgtcgaggagacagggcgccggctcagcagctacgcccaggagttcggcgtgccgttcaggtaccaggtgctcgcggcgtcgaggatggagaccatccgcgccgaggatctcaacctggacccggaggaggtgctcatcgtgaactgcatcttccagttcgagaacctgatggacgagagcgtctccatggaaagcccgagcccgagggatgttgcgctcaagagcatcgggaggatgcggcctcacgcgttcatccatggcgtcgtgaacggctccttcagcgcgccgttcttcgcgacgaggttccgggaggctctgttccattactcggccctgttcgacgtgctggacgagaccaccccgagagatagcacacatcggatgctgatcgaggagaacatcttcgagaggactgccctgaatgtcatcgcgtgcgaggggacggatcgtgtggagcgccccgagacgtacaggcagtggcaggtgcggaaccagcgagcggggctgaagcagctgccgttgaaccctactactgtgcaggttgtccgggacaaggtcaaggggtgctaccacaaggactttgtgattgatgtggatcaccattggctcttgcaggggtggaagggccgcatcctctatgccatctcgacatgggtggcaaatgatgctgctgctgctgctggttcttgttgtttttagctgttttgtttttgactcgaggtatgcctaatcagaattcaacatggttaacagaagatgggagggatgagaaggcagcagaaggcatgcagaaatccgtgctttgatgtaatgtgaaatagatgtttattacgcagtcgtgtttctgcttagtgctatttagtagtcgaatttagacttagaggtcctggtctggatcatgttggctgcagcatgacttgcgagttgtgatcaatccagtcagttgatcaggttgtaatggcagtccggtgcttactgcaccggcattgtatgataaagcgctgaaacctgtgtttgtct

SEQ ID NO: 16292 - protein, 705 aa, Panicum virgatum
  misc_feature: Ceres CLONE 1788485
  misc_feature (290)..(601): Pfam Name: GRAS Pfam Description: GRAS family transcription factor
MCSSYDRSPSRGAVADDLSFYLDLPPTPLQCHQPNCRAAESPEDMVLPFISRMLMEEDIDDKFFYEYPDHPALLQAQQPFLDILSDDASSSPSAAGSGASVTHPSTSSPNAADAPLHPAAAVDCDAQFNGFDLDPAAFFSGGANSDLMSSAFLKGMEEANRFLPSQDKLVIDPDPPDDAKRFRFLRPAENKQLAASGFDAAAPAAAVAVEVEEAVVAAPGGGVGGRGRKNRFDDDEDDLEMHRRSSKQSALQGDGDVFDKQHMITSQQMCVLVEQMEKLRIPTQEEAAAKKAAAAGGKAKAKGGGGRRVGREVVDLRTLLLHCAQAVATDDRRGATELLKQIERHASAHGDAMQRLARCFAEGLQARLAGTGSSTSTPPLMPKQRTPVVDMLQAYQLYMAAICFKKAFYLFSNQTIHAASLGKKKIHIVDYGIHYGLQWPCFLRRMACREGGPPEVRITGIDLPQPGFRPAQRVEETGRRLSSYAQEFGVPFRYQVLAASRMETIRAEDLNLDPEEVLIVNCIFQFENLMDESVSMESPSPRDVALKSIGRMRPHAFIHGVVNGSFSAPFFATRFREALFHYSALFDVLDETTPRDSTHRMLIEENIFERTALNVIACEGTDRVERPETYRQWQVRNQRAGLKQLPLNPTTVQVVRDKVKGCYHKDFVIDVDHHWLLQGWKGRILYAISTWVANDAAAAAGSCCF

SEQ ID NO: 16293 - DNA, 2081 bp, Panicum virgatum
  misc_feature: Ceres CLONE 1788486
  misc_feature: Encodes the peptide sequence at SEQ ID NO. 16294
gtgaaaccaaatctcccccaccctttccgtcttcctccccaatcctccggcccccctaccaggctaccaagaaacgcctccgcggtttctcgccgcaatcctcctccctgaaaaatctttgcgagaggtttcgacgcccagggcccgccccgcgagtgcatggcagtgagcctcctggccaatgaggtgtcggacctgtgcatcggcaagccggccgtgaggtcgctcccgctctccgccgccgtcggcgagctcgccgccgcgctccggagggtggcccgctctggcgccgcaggctgcgtcgcggtgaccggaccagcgcgcgccgtcgtcggccgggccggcctcgcggacgtgctctgcttcctctgcaccgagcccgaggctctcgcccgccccgccgccgcgctcgccaagccggtctccgcgatcctgcccaaggacggcgccggagaggttcgccgcgtcgatccccgctcgaggtaaggttcaattcccgcgtctttcttggtgctttaacaaatgacgcgtgagattcgttcaatattggaacttgctgaatttggtcaaatccctacaaaaattgcgaaaaaattgattggaagacagcctggtaaaatagcgcccgttagcttcattatttatttattttgccccctaaaagtacctgaagagtcttatctctgcttgcctgcttggaatatgcgacgacattcgaacaaatggctgtcacgcggtgaagaaaaaacctcattcaccgagacagtcttgttgtgtggttcggtgtggccgtgtgggttccccggagattgagacatgcacccctgtgtccttgcaagattcttgataggatcagccgcttccggcttcgcaattagggacccgaaaattgtgccgtttgatctagtatacacttgggaatagaagcggcatcttggcatgtggttcgaaaattgcgcgttttaatcgaatctttcttgaaaaaatggcgatttaatcgaatctttcttgaaaaattggcgattcttatgggatctcgtccatggcttgctcgtcttgcccatttttaatcaatccgtagattcagtcgttttgagctgaccaatgtggtttttctttttttgcagtatcttggaggcccttgatgcgatcctgaacggagcgcaggtgctcgccgtcccgctccgcgctggcggccgcaagaagcagctcggcggcggcggcgccgccgccggcgacttctgctggctcacacaggaggacctcgtgcgctacttcctcaactccatcggcctcttctaccatgtcgccgcgcgctccgtgtcctccctcggcctcgtgcgcaccgacttcctctcggtgcgccccggcgagtcggccctgtccgccgtgcccctcatccgccgcgccgtcgccacggaaaccgcggtcgccgcggtcaccgaggacggccacctcgtcggcgagatctccccggccctcctcgcggcgtgcgacgagacggcggccgcggccatcgccacgctctcggtggcggacctcatggcctacgccgactacttcgggtcgccgccagagcatatcctgcgcgcggttaaggccgggctgaaggacaagggcctcgacgccatgcttgatctgatcgaggacgagtcgctgtcgtcgttctcctccctctccgcctcctcgtcctccgacgaggagaccggccgggcgcagctgaggcgcccgtcggggagcttcggtcgccggtcagccgaggagcctgtggtgtgcagccccgcgagctcgctggtggccgtgatggtgcaggcgctcgcccaccgggtgagctacgtctgggtgctcgacgaggacgacgactgccgcctcgccgggatagtcacgttcgcggacgtgctgagggtgttccgggagcagctgcagtgagcggccgagaagctccgagttttgcagagatctgaagagggcctgctgttccctcgttagcatcttgtggtgaactgaagtgggatgaacttgaactgttgtctctgtatcaagtgccttagtttctgaaaacactcgttggcttgaagttg

SEQ ID NO: 16294 - protein, 274 aa, Panicum virgatum
  misc_feature: Ceres CLONE 1788486
  misc_feature (77)..(270): Pfam Name: CBS Pfam Description: CBS domain pair
MWFFFFCSILEALDAILNGAQVLAVPLRAGGRKKQLGGGGAAAGDFCWLTQEDLVRYFLNSIGLFYHVAARSVSSLGLVRTDFLSVRPGESALSAVPLIRRAVATETAVAAVTEDGHLVGEISPALLAACDETAAAAIATLSVADLMAYADYFGSPPEHILRAVKAGLKDKGLDAMLDLIEDESLSSFSSLSASSSSDEETGRAQLRRPSGSFGRRSAEEPVVCSPASSLVAVMVQALAHRVSYVWVLDEDDDCRLAGIVTFADVLRVFREQLQ

SEQ ID NO: 16295 - DNA, 2181 bp, Panicum virgatum
  misc_feature: Ceres CLONE 1788489
  misc_feature: Encodes the peptide sequence at SEQ ID NO. 16296
cctttcttcctcctccccccagcagctgccattccccccacatccccctctatctctctcttcataatctctctctccttccaaggatccaagaagtactgttgcagcttctttcttcatccatccccaatcccaacacagcttctctgctcagcgaaggaaattcccctgctcctgctcttgtgttcttgctggccctctgctctgcttcttcacctcttcttgccaccgagaagaggagtccagccgttgcaaagacagaatctttacacttcatcctcccaaagtgttgttggtgtcccaggtggaggcaaagtgtgaatttatactagtttttgctcttgattaggttaggaatttcttgctcctgtgttcttgggttgatggttgtagaatcaatccaagaatatctggagctgttcatttcaccttccctgaaggcgagggcgaagtgatcgttttgagcagtagttgttgttgttgttgaggcgttgcaatgtcgtcttcctgcataccaaccggcctgcggctggacctggacatggtgaaggcggcgacgtcgcctgtcgcgcactcgtcgccgttgcggccggtgcactcgtcgccgtcgtcgacgctgtcggaggcgtcgaacgcgtcgtcatcggcgacgtcggtgtcgctgaagcgggcgcgcccgccgcggaagcggccgaaccaggcgtacaacgagaccgccgcgctgctcgcgtccatccacccctccgtcttccccgtcaagaagagccccaagacggcgacgcgcccgccggcgcgacagctctccggcctcgccgcggcgttcgacccctcctccgacctcctcccgccgctccccgtcctcgcggactcggcattcctgctccgggacatgcccgcgccgtcgccgtcgccgtcgccgcagccgcagagcccgtcaggcgccaagaactgctcatcgccggccccggtgagcagcgtgttccgggacttccgcgacccggcgccgtcaccggcgagccccgacaccgtcgacgtcgacgagcttggcgaaatcgacttcgatgacgacggcttcgacgccgagtcgattctcgacgtcgacgaggccaccgccggcgcggccgagggcctcgacggcatcatgggcagcctcaccgtggagagcaacacggccaccacgtccgatgactccatcctgtcaagctccggcatacacccctacctcaggagcctcatggtggtcggcctcgccggcaggttcgagctcggcctcgggttccggcacggcgctcggcccaacctcaaccgcgcactgaagcggcgggacgacgacggcgcctggtggatgtggccggcagtgccggtgaaggacttaacggtggcaccgccgacaccgccggcaccggctgcgccggacactgcaatgacgcaggtgccggcggcgccagagaagaagaaaagcaagaagaagaaggtggtgaagatggagaaggttatggccaaggggaaggaggagctgaccagcgcgaaatgcaaggaggaagctgacggctcggtcgaggctgctaatggcgatggcgacgctgacagcacgccgacgacgaaggcgccaaagaccgggttggggctgaagctggacgccgacgaggtgctcaaggcgtggtccgacaaagggtcgatgttcaccgatggcggcgggccggagtcgccgacgtcggccgccgacgtgcgggcaaaacttgcagacattgatctgttcccagagaatggagctggtggcggcatcagagaagccagtgtgttgaggtacaaggagaagaggcgcacccggctgttctcgaagaagatccggtaccaagtgcggaagatgaacgctgactgccggcctcggatgaagggaaggtttgttaggagcccatctcttcttcagcaagccctggaggaagagagctagacagtgatacttgctagccttttttatcagcatctttttgtcccttttagtttatcattagctaagagatgtgagtgaggattttccccggggttttttcggagttttgctctggagagaataggatgcctttagagtggattgtcatggtgtggtggtgaaatagtttgtctcaggtttacaatgtgaggtaaaggaaggaaataaagtgatgttagaatatagtc

SEQ ID NO: 16296 - protein, 485 aa, Panicum virgatum
  misc_feature: Ceres CLONE 1788489
  misc_feature (431)..(475): Pfam Name: CCT Pfam Description: CCT motif
MSSSCIPTGLRLDLDMVKAATSPVAHSSPLRPVHSSPSSTLSEASNASSSATSVSLKRARPPRKRPNQAYNETAALLASIHPSVFPVKKSPKTATRPPARQLSGLAAAFDPSSDLLPPLPVLADSAFLLRDMPAPSPSPSPQPQSPSGAKNCSSPAPVSSVFRDFRDPAPSPASPDTVDVDELGEIDFDDDGFDAESILDVDEATAGAAEGLDGIMGSLTVESNTATTSDDSILSSSGIHPYLRSLMVVGLAGRFELGLGFRHGARPNLNRALKRRDDDGAWWMWPAVPVKDLTVAPPTPPAPAAPDTAMTQVPAAPEKKKSKKKKVVKMEKVMAKGKEELTSAKCKEEADGSVEAANGDGDADSTPTTKAPKTGLGLKLDADEVLKAWSDKGSMFTDGGGPESPTSAADVRAKLADIDLFPENGAGGGIREASVLRYKEKRRTRLFSKKIRYQVRKMNADCRPRMKGRFVRSPSLLQQALEEES

SEQ ID NO: 16297 - DNA, 1103 bp, Panicum virgatum
  misc_feature: Ceres CLONE 1788492
  misc_feature: Encodes the peptide sequence at SEQ ID NO. 16298
tactgcggcccattcataggcataggctggtgatcatatcacagctccacgtctccagttccagtctactcagccccctgcatagagtgctcctccttaatttgaaggaacaagcaagaaaaggagagaaagatgaccagcgtttggaagaccaaggttctgccccgcctcaacaagatctttgacaaggatggcaagaaggcggcggcggccgagttcctaaagtccttcaacaaggaggagattggcaaggagattgaggacaagaagacagagctggagcccaaggttgtggaggcttatgaagcatctcctcctgaagttaaggctctgttcaaggacaagaaaccagtcaagatcagcaagaagaactcggctgcagctaccaagttgctcgacgagctggctaagattgagttccctggagcaaagctggtgagcgacgcggtggccaagtccggcaccacgcccctctccccggcgatcaccttcgtcttcgacaaggttgcgccattcatccccaaggaggagcccaaggccgagccggaggccacctcccgggaagtcgccgtcgaggagaagaaggaggaggccgagcccccggccgctgcggcgacggaggaggctgcgccggcaccggcggaggcgtcggaggcggtagaggagaagaaggctgaggaggagaagccgacggaagccgcagccgaggccgcggcggcgccaccagctgaggagaagaagtgatcgccacgccagtcgacactgaatgaagaagctaagcaagcaaattaagctacgtagctagctccgatcctcctcgttgctggtaaattgaagttaccttaccgtgagatttaaattaaattactccctctccttcttgtcaaccacgtcgtcgtatatatatatatagtagctagctgctgcacaaattaatttgcatatatataagggtggtggatgcatgaacatttgttattcttttgtgtcacctcgatcgatggatggaccttctgtaaatttgtaatgggttttgcctttcttgttttttttttcttgattttggggtgattaaacatgcacgtgtaattatttgtattgac

SEQ ID NO: 16298 - protein, 203 aa, Panicum virgatum
  misc_feature: Ceres CLONE 1788492
  misc_feature (2)..(203): Pfam Name: DREPP Pfam Description: DREPP plasma membrane polypeptide
MTSVWKTKVLPRLNKIFDKDGKKAAAAEFLKSFNKEEIGKEIEDKKTELEPKVVEAYEASPPEVKALFKDKKPVKISKKNSAAATKLLDELAKIEFPGAKLVSDAVAKSGTTPLSPAITFVFDKVAPFIPKEEPKAEPEATSREVAVEEKKEEAEPPAAAATEEAAPAPAEASEAVEEKKAEEEKPTEAAAEAAAAPPAEEKK

SEQ ID NO: 16299 - DNA, 1148 bp, Panicum virgatum
  misc_feature: Ceres CLONE 1788495
  misc_feature: Encodes the peptide sequence at SEQ ID NO. 16300
atcctcccgttgcagccacggagttctctagttctgccgttgagtgctagtagccgccttgaaaccttcagatctgcgccgcctagttccagttcctcgacacaaagccgtccagatggacaccatgtcgcccgctgccgccaccggagccatccacgccggcgccggcgacgccgtcatcttggagaagccgctcggcgccgacgtcgccgaggatcctacctatcgtatgcctgatttcaaaatgagcggaaagaagagtgacgagctcgaacccactgatgctggtgatgaagatgacggtggtgacgatgatgacgaagatggtgactttggggagggtgaagaggacatctcacaaggagtacattcctgaccccgaggacaagaagccagagggctatgatggcattcccaaggaaattcctgaccctgatgctaagaagcctgaggactgggatgatgaggaagatggtgaatggactgcccctaccattcccaacccagaatacaagggaccatggaagcaaaagaaaatcaagaacccgaactaccagggtaaatggaaggcacctatgattgacaacccagatttcaaggatgatccgtacatttatgcttttgacagcctcaagtacattggcattgagctgtggcaggttaaatcaggtactttgtttgacaacatcatcatcaccgacgaccctgcattggctaagaaatttgcagaggatacctggggcaagcacaaggaggctgagaaggctgcttttgatgaggctgagaagatgaaggaagaggaggaagctgccaaggccggtgaggacgatgatgaactagaggatgaggaagatgatgagaaggtagatgaggacaaagctgactctgatgctgaggatggcaaagattctgatgatgagaagcacgacgagctctagatggcgaggatgaaggggtggccgccaaccttggagccgttggccaggatttaccagttctcccatttttcgtgatcagaagctttgacgcgtgtagaaactttgctaagaagctgagggacaatttgggtcgctgtagcactttgtagtttgccatttttccccagaaagaaaaaactgatagcactgaacaaggaagatcttcactag

SEQ ID NO: 16300 - protein, 218 aa, Panicum virgatum
  misc_feature: Ceres CLONE 1788495
  misc_feature (3)..(138): Pfam Name: Calreticulin Pfam Description: Calreticulin family
MLVMKMTVVTMMTKMVTLGRVKRTSHKEYIPDPEDKKPEGYDGIPKEIPDPDAKKPEDWDDEEDGEWTAPTIPNPEYKGPWKQKKIKNPNYQGKWKAPMIDNPDFKDDPYIYAFDSLKYIGIELWQVKSGTLFDNIIITDDPALAKKFAEDTWGKHKEAEKAAFDEAEKMKEEEEAAKAGEDDDELEDEEDDEKVDEDKADSDAEDGKDSDDEKHDEL

SEQ ID NO: 16301 - DNA, 2314 bp, Panicum virgatum
  misc_feature: Ceres CLONE 1788509
  misc_feature: Encodes the peptide sequence at SEQ ID NO. 16302
ttctccacgaagccttttcaaaatccaaatcaaactccccgcagacgcccccaaagaccaccgccgctgcctgcgcaccacccaggcctcagctcgagcccaacgaccggcgcctagacgcggctgggcggtcggcctcacctcacctccccccgcgcctcccttcttcctccgtctcgatctcgcctccccgccacccggccagatctcgccctcccggcgctgcggccatggagaacctgatctccctcgtcaacaagctgcagcgggcctgcacggccctcggcgaccacggcgaggagagcgccctcccaacgctctgggactcgctgccggccatcgccgtcgttggaggccagagttctggcaaatcttcggtgttggagagcgtggttgggaaggatttcctaccgaggggttcaggcattgtcactcggcgtccactggtgctgcagctccacagaattgacggagacagggaatatgccgagtttatgcaccaacccaggaagagatatacagattttgctgctgtgaggaaggagatagctgatgaaactgacagagaaactggtcgctcaaagcaaatatcacctgtccctatccatttaagcatctattctccatatgttgtgaatctgactcttattgatcttcctgggcttactaaagtagctgttgagggtcaaccagacagtattgttcaggacattgaaaacatggttcgatcatacattgaaaagccaaattgtatcattctggccgtttccccagctaatcaggatcttgcaacttctgatgcaatcaagatttcacgagaagttgatcccaaaggagaaagaaccttcggtgtgctcacgaaaattgatctgatggacaagggtactgatgctgttgatatactggaaggaagatcttaccggctccaacatccatgggttggtgttgttaatcgatcccagcaagatatcaacaaaaatgtggacatgattgctgctaggcgtagagagcgtgattatttttccagtacaccagaatataagcaccttgcccctaggatgggttctgaatatttagccaagatgctctcaaagcatttggagcaagtgattaaatcaaggattccgggcatccaatctcttataacaaagacaattgcagagctggagactgaactcaatcgacttggaaagcccattgctaatgatgctgggggcaagttgtacacaattatggaaatatgccgtatgtttgacggcatttacaaagagcatctggatggagtgcgccctgggggtgagaaagtttaccatgtcttcgacaatcaatttcctgtagcaattaaacggttgcagttcgataaacaactctcaatggaaaatgtgagaaagcttattacagaagctgatggataccagcctcacttgatagctccagagcaaggatatcgacgcctaatagaatcttgccttgttagtataagaggtcctgctgaggcagctgttgacgcggtccatgctatcctgaaggaccttgtccgcaaggctatcagcgaaacacatgagctgaagcagttccccactcttcgcgtggaagtaagcaatgcagcttttgagtcattggataaaatgagagatgaaagcaagaagaatacattaaagctggttgatatggaatgcagctacttgactgtggatttcttcaggaagcttcctcaggatgttgagaagggtggaaatccaagccactctatttttgacagatataatgactcttatcttagacgaattggacaaactgttctatcatatgtcaatatggtgtgcgcaacattgagaaactccataccgaaatctattgtgtattgtcaagtccgtgaggcaaagcgctcactcctcgaccactttttcactgaactaggagcaagagagatgaagcaactttccaagcttcttgatgaagaccctgcagtcatggaacgaagaactaacctcgccaaaaggctggaactgtaccggagcgcccaagcagaaatcgatgcagttgcgtggtccaaataattttgctggcctacctaccctgttcttgcatgctctctactccttgtttggtgattctcccctattctgggggcatatatagctgatttttttcctgttgtaggtaaggtcatttatacatcaccgcagctgtacggtgtcctttggtttgtgcttttgttccttgtgcttgaggatctaggggacaccaggctgctgtacttctgtatcacgacaagttcatatattgtgcttctattaccgtgtattctttc

SEQ ID NO: 16302 - protein, 609 aa, Panicum virgatum
  misc_feature: Ceres CLONE 1788509
  misc_feature (221)..(507): Pfam Name: Dynamin_M Pfam Description: Dynamin central region
  misc_feature (37)..(212): Pfam Name: Dynamin_N Pfam Description: Dynamin family
  misc_feature (512)..(605): Pfam Name: GED Pfam Description: Dynamin GTPase effector domain
  misc_feature: SWISSPROT Homolog: EC 3.6.5.5 Dynamin GTPase
MENLISLVNKLQRACTALGDHGEESALPTLWDSLPAIAVVGGQSSGKSSVLESVVGKDFLPRGSGIVTRRPLVLQLHRIDGDREYAEFMHQPRKRYTDFAAVRKEIADETDRETGRSKQISPVPIHLSIYSPYVVNLTLIDLPGLTKVAVEGQPDSIVQDIENMVRSYIEKPNCIILAVSPANQDLATSDAIKISREVDPKGERTFGVLTKIDLMDKGTDAVDILEGRSYRLQHPWVGVVNRSQQDINKNVDMIAARRRERDYFSSTPEYKHLAPRMGSEYLAKMLSKHLEQVIKSRIPGIQSLITKTIAELETELNRLGKPIANDAGGKLYTIMEICRMFDGIYKEHLDGVRPGGEKVYHVFDNQFPVAIKRLQFDKQLSMENVRKLITEADGYQPHLIAPEQGYRRLIESCLVSIRGPAEAAVDAVHAILKDLVRKAISETHELKQFPTLRVEVSNAAFESLDKMRDESKKNTLKLVDMECSYLTVDFFRKLPQDVEKGGNPSHSIFDRYNDSYLRRIGQTVLSYVNMVCATLRNSIPKSIVYCQVREAKRSLLDHFFTELGAREMKQLSKLLDEDPAVMERRTNLAKRLELYRSAQAEIDAVAWSK

SEQ ID NO: 16303 - DNA, 668 bp, Panicum virgatum
  misc_feature: Ceres CLONE 1788525-R
  misc_feature: Encodes the peptide sequence at SEQ ID NO. 16304
gggatggaggtgctcgccgacggcatccaggacgactccggcaacgtcactcgcttcgtgatgctggccagggagcccatcgtgccgcgcaccgaccgccccttcaagaccagcatcgtcttcgcgcacgacaaggagggcacctccgtcctcttcaaggtgctctcggccttcgcgttccgggacatctcgctcaccaagatcgagagccgcccgcaccgccaccggcccatccgcctcgtcgacgacgccaatgtcggcaccgccaagcacttcgagtacatgttctacatcgacttccaggcgtccatggccgagccccgcgcgcagaacgcgctggccgaggtccaggagtacacctccttcctccgggtgctcgggagctaccccatggacatgacccccatgaccgccggctcctcctccgatacctcgccgtcgtcctgattactgctcctgcagccccccgaggaggagaagccgtcgagcgagtagggacgttggtttctggtcatgtcgtcctactcgatcgtccctcgccgctgcgctgcccgggagcaattaattttgatttttttacctttatttatttatctatcgtggtaatacgtgtaattgttccaagttcatctcgatagcggtgaatacaagtacctgtcagataggcg

SEQ ID NO: 16304 - protein, 148 aa, Panicum virgatum
  misc_feature: Ceres CLONE 1788525-R
  misc_feature: SWISSPROT Homolog: EC 4.2.1.51 Prephenate dehydratase
  misc_feature: Useful for making plants with altered lignin content
GMEVLADGIQDDSGNVTRFVMLAREPIVPRTDRPFKTSIVFAHDKEGTSVLFKVLSAFAFRDISLTKIESRPHRHRPIRLVDDANVGTAKHFEYMFYIDFQASMAEPRAQNALAEVQEYTSFLRVLGSYPMDMTPMTAGSSSDTSPSS

SEQ ID NO: 16305 - DNA, 123 bp, Panicum virgatum
  misc_feature: Ceres CLONE 1788525
tacgctgctcttcccctagctctctggcccgacgtgagggtcatgctccctcaccgcgaccgccacggtgctgcccatctcgctctcgaggatggagatactcgccgtctccgcccccgcggg

SEQ ID NO: 16306 - DNA, 1888 bp, Panicum virgatum
  misc_feature: Ceres CLONE 1788544
  misc_feature: Encodes the peptide sequence at SEQ ID NO. 16307
agaccagccccaaccccaaccccaacccacctgcctgccccccttccgcctcgccgccggcgatcgccgcagatgtcatggctcgcccgctccctcgccacatccctcaacatccctgacgattccagcgccgacgatgaccccgacgccgacgccgcggcctaccccaccccttccccctccgcgcgcatcccgccgccgccgccgctacctcctcacccgccgcattcggcggcagcggatggcgtcaaggaggacctcacggagctgtccaaaaccctaacccgccaattctggggcgtcgccaacttcctcgcgccaccgccgggagagacctcgccgtcgccgtcgccctcccctcagtcggcggggggtcaacccggcgatgtggggacgccgcctgagatcgccgggatccggaacgacttcgcggagattggcgggaggttcaggagcgggatctcccggatctcgagtcacaaggccgtgactgggttctctaagatggcctccaatttcttcgctcctgaagacgacgaggacagcgagtgggaggaagagcggagacgaccgattagttatgaggtgggagaggaggccgtaaggcatgatgtggagggcgacgaggagtggcatcagtgggaggaaagggtaagacttgaggtggaggatgaccggttagggcatgagttgaagatggagagagtaaatcatgaagaagatggcgaattggaggtgcagagagtgaggcatgaggagggtggtgaattcggggagcaaagagtaaggcatgaggagggtggtgaattggaggagcagagagcaaggcacgaggaggacgaggactgggatgttattgggatcactgaggaggtgcttgcattcgccaaaaacattgccaggcacccagaaacttggcttgacttccccctgctgcctgatgatgatgagtctgatggactattctcatattttgacatgtctaacactcaacaagaacatgccttcgctattgagcatcttgctcccagattagcagctttgcggattgaactttgcccgattcatatgagtgaagaatgtttttggaaaatctactttgttcttctacatcctaggttgaacaagcatgatgccgaacttctttctacaccgcagattgtggaagctagagcaatgcttatgcaacacttgcagtaccagtcaaaacttgaaagtgagcagctaggtcatcataaggatgaccttggagttcagtttcgacgagaggacaccttgaaagatggtaaagaggcattcccatttgtgcggcaggaaactgcttcttacatgcccatagcagaaattgagattgagaagcaccccatccaagtaactgaagttgcagttgtggacaaatcggtcatcaaagaagagttacccaaggatcgttcagagacctcaaatattttgcaagatgcctttgacgacgacatagatgattggtttgacgaagaggccgatctggctgggcatccaactatccacataggtgacgaggaagatgtgtcttttagtgacttggaagaggatgatgcgaaatgatttatttgcaagagaaccttttgtattggactcaagaaaacctgtgtattggaaactggacttctctgatgtacaagaaaatggagtggtgaaagttgcctgtgaaaagtatagggtgtacgatgaaaagtgagctgctttgttttgcttccaagctgccggggtgaacgcactgtcgccttactgctcgtgatatggcggtttgccagcattacggtttgtaattttatttatactctttgtacataagcattcgttatgctacaagttcagaacaataaaaaagttccatttgttggttgtt

SEQ ID NO: 16307 - protein, 503 aa, Panicum virgatum
  misc_feature: Ceres CLONE 1788544
  misc_feature (290)..(356): Pfam Name: BSD Pfam Description: BSD domain
MSWLARSLATSLNIPDDSSADDDPDADAAAYPTPSPSARIPPPPPLPPHPPHSAAADGVKEDLTELSKTLTRQFWGVANFLAPPPGETSPSPSPSPQSAGGQPGDVGTPPEIAGIRNDFAEIGGRFRSGISRISSHKAVTGFSKMASNFFAPEDDEDSEWEEERRRPISYEVGEEAVRHDVEGDEEWHQWEERVRLEVEDDRLGHELKMERVNHEEDGELEVQRVRHEEGGEFGEQRVRHEEGGELEEQRARHEEDEDWDVIGITEEVLAFAKNIARHPETWLDFPLLPDDDESDGLFSYFDMSNTQQEHAFAIEHLAPRLAALRIELCPIHMSEECFWKIYFVLLHPRLNKHDAELLSTPQIVEARAMLMQHLQYQSKLESEQLGHHKDDLGVQFRREDTLKDGKEAFPFVRQETASYMPIAEIEIEKHPIQVTEVAVVDKSVIKEELPKDRSETSNILQDAFDDDIDDWFDEEADLAGHPTIHIGDEEDVSFSDLEEDDAK

SEQ ID NO: 16308 - DNA, 2648 bp, Panicum virgatum
  misc_feature: Ceres CLONE 1788559
  misc_feature: Encodes the peptide sequence at SEQ ID NO. 16309
gcctctggacgcctccctctatctatcccctctcctctcatcagatcacgagccacagacaggtgtgggatcccgatccggtcgctagatccgccggcctccgcgccgatccgggcgtccttccaccgctcctcctccccctcctatcgcagtataggcgcgccctccctggagcggagcggagatccctcccagccccgaccgatcggctccttccttgttattgccggctccatggacaagcaggagccaatagctgatgtcgaacaaaagattggtctcactgagaagcctaaagagcagcctgttcccagtaaggatgagaaagcaactttgcccccaatttcagttgattcaaatgttatcaatataccatgtgaaggccaaacccaagctggcacgtccaacatagatggggaccataatgctgcatatccacacaacttttatgcttctcaggcgcagccattctattaccaaggctcaggatatgaaaaccctccacaagaatgggacacatatcctccttacatgagtgtcgaaggattggaagtgggtccaacagttgtgtacaatgaggacccttcattgatgttccatggtggctatggatatgacccatatgctcattattctcctattacaacacctgtaccgactgctgttagtggagatggtcagctctactcccctcagcagttctccttctcggctccttactaccagcagtcagtaccacctggcatgccatatttaagctctcctactccaatatcacagggtgagacaatgatgccgattgacccaacacaaggaggttttattgctgatactcatactctgagtccgaacagcttcctttttggcccaagacctgaatggttcagatcttcagaaggaactggctcatttccatcacctgcagcttcacctcaacctgctggtggtgtttcaggagcctttggccaaagcaactttccaatggcttcaggaatgccatcatctcaccagaagcccttttacggtttcggatccccagctgactcctacggacggggtttctctcatggtgggatgttcccacaggccagtaattgtgggggatccttccctggctttggagttaatggtagaagttccatctacatcgagaaagggcgcagaagaggaaggggtaatgcccttatttgcagctgcaatggcccgctcgactttctcaatgagcagagtcggggtccgcgcgctactaagcctaagaagcaaccagagggtgacagtaaggatgagaagccttctacaggagttggtcgtgagttgtacaataggcctgactttgttacagagtacacaaatgccagatttttcatcataaagtcgtacagtgaagataatgtgcacaagagtgtcaaatatggtgtttgggctagcaccacaaatggaaacaagaaactggactcagcttattgtgaagctaaggagaaggaagagcactgccccatttttctgttgttttcggtgaatgctagtgcacaattctgtggtgttgctgagatgatcggtccagtggactttgagaagagtgtggattactggcagcaagataagtggactggtcagtttcctgttaagtggcacatagtgaaggatgtccccaataatctcttccgccatataattcttgaaaacaatgacaataaacctgtaacgaatagccgagacacacaggaggtgaaactagagcaaggactggagatgctgaagatctttaagaaccatgatgatggtgcgtcaatccttgatgattttgacttttatgaggagcgtgagaaagcgctgcagaaaaataaggcacggctgcatcagcaacatatatccacttctattgctgttgaacccaagaagcccttgactgtgcctactgaccttgtggggcatatcaccaagagttttgctcaggctgtgcggcttggtgagtccaagaccgtaagcccttcgtctgagaaagcatctggggttgatccgtctatttctgcaaagccagtcgaaattaagcagagtggtttgtcatagggactcttgatcgatgcggttgggctgcactcgaaatatcatccatatgcttcctgatcaaaatgttgggggctgcacatacagggatgttggtgctgaaaactaagacattggtgaagatggcttcatgcacttttggtcaagcaatcatgtacactaggatagatctttgccaaccatggatggaagcttagtttcttcaattgtttctccttcccccctccttaccaactgtttctcaccttctctttgcatcatatgatgattccttagtggctagccttaaggagagctgcagtttttgtgcaagcctctctaagttccctgtccaatcgcatatgaataaggccattttgcttattattaagtaaaatccctcgtttatctactgttctattactgttttatctttcttttttttccttgggtaatgtctgagcaggacacctctgtcagttcctatgtaagcaaacataaacgctatccaagtgacctggttgtgataactaccgtagtaatgattgaataagcaagcatatatgcatgttagctggggggggggggggggatttgttgtc

SEQ ID NO: 16309 - protein, 611 aa, Panicum virgatum
  misc_feature: Ceres CLONE 1788559
  misc_feature (424)..(514): Pfam Name: YTH Pfam Description: YT521-B-like family
MDKQEPIADVEQKIGLTEKPKEQPVPSKDEKATLPPISVDSNVINIPCEGQTQAGTSNIDGDHNAAYPHNFYASQAQPFYYQGSGYENPPQEWDTYPPYMSVEGLEVGPTVVYNEDPSLMFHGGYGYDPYAHYSPITTPVPTAVSGDGQLYSPQQFSFSAPYYQQSVPPGMPYLSSPTPISQGETMMPIDPTQGGFIADTHTLSPNSFLFGPRPEWFRSSEGTGSFPSPAASPQPAGGVSGAFGQSNFPMASGMPSSHQKPFYGFGSPADSYGRGFSHGGMFPQASNCGGSFPGFGVNGRSSIYIEKGRRRGRGNALICSCNGPLDFLNEQSRGPRATKPKKQPEGDSKDEKPSTGVGRELYNRPDFVTEYTNARFFIIKSYSEDNVHKSVKYGVWASTTNGNKKLDSAYCEAKEKEEHCPIFLLFSVNASAQFCGVAEMIGPVDFEKSVDYWQQDKWTGQFPVKWHIVKDVPNNLFRHIILENNDNKPVTNSRDTQEVKLEQGLEMLKIFKNHDDGASILDDFDFYEEREKALQKNKARLHQQHISTSIAVEPKKPLTVPTDLVGHITKSFAQAVRLGESKTVSPSSEKASGVDPSISAKPVEIKQSGLS

SEQ ID NO: 16310 - DNA, 841 bp, Panicum virgatum
  misc_feature: Ceres CLONE 1788564
  misc_feature: Encodes the peptide sequence at SEQ ID NO. 16311
ctgagtcctgacatctcccttctcaactccggtaagaccgatgctgccgatgaggtccgccgccgccgcgccgtgctcgctggcagcgctgctgctccgccgcctctcctcccactcgtcctcttctgtctattccgtcagccgccacgccccctctgccttatcctctcagccctccgccacctacctcaccaccagccccccttgccccctttccagcagccgcaggaccaggggattcgcggcctgggcctcggcgccggggccggcggggcccgccgaatcccccgccacgaaggcgctagaggccaagatcaaggagcagctggaagccgacgcggtcacggtcgtcgatacctccggggacggccgccacgtctgcatagatgtggtttccaaggcattcgagggaaaatctgcagtaaataggcagagaatggtttacaaggctatatgggaggagcttcatagcactgtgcatgccgtggaccaaatgactaccaagacgccagacgaagctgctgcgaacaagtaattcaatatcatgcctgtggaggcagttatgctctcctttgaagatcaggcccctgccttcaccaagtttctgttttttttcctgaatgatcaataattcgcgatgtgattagtgtgtattcaaaaagaaatatatgtcattcaatttgcctccacaaacaaattgtatgctatgtgcaagcgtctgtggctgctaattagctgtgtaagggctaaatataagtcatgctgagtataaagtgggtagacaggtgtaaactccagcacgccgatgcatcaaaaaagaaaacttgcgtttttggcctac

SEQ ID NO: 16311 - protein, 164 aa, Panicum virgatum
  misc_feature: Ceres CLONE 1788564
  misc_feature (83)..(160): Pfam Name: BolA Pfam Description: BolA-like protein
MLPMRSAAAAPCSLAALLLRRLSSHSSSSVYSVSRHAPSALSSQPSATYLTTSPPCPLSSSRRTRGFAAWASAPGPAGPAESPATKALEAKIKEQLEADAVTVVDTSGDGRHVCIDVVSKAFEGKSAVNRQRMVYKAIWEELHSTVHAVDQMTTKTPDEAAANK

SEQ ID NO: 16312 - DNA, 723 bp, Panicum virgatum
  misc_feature: Ceres CLONE 1788569
  misc_feature: Encodes the peptide sequence at SEQ ID NO. 16313
cgcgaaaaccctagccgcacggtgcttcccttcgctctccaacccctcgaggtattccattcgcagtcggccaggtcctcggagcgcgggagatggcggatcaggagacccctgttgcggttgaggcacctacccctgttcttggggagccgatggacttgatgactgccctgcagctcgtcatgaagaagtccagtgcgcatgatgggcttgtgaagggccttcgtgaggctgccaaagccattgagaagcatgctgctcagctttgcgtgcttgctgatgactgtgaccagcctgattatgtcaaactggtgaaggcactgtgctctgagcacaatgttcatctggttaccgtgcctagtgccaaaactcttggcgagtgggctgggctttgcaagattgactctgagggcaaggcaaggaaggttgtaggctgctcctgtgtcgtcatcaaggactatggtgaagaatctgagggccttaacatagtgcaggagtacgtcaaatcccactaaacgtgatgcacttaggtgcctggatctttatgttcaacattttggacctcggtttgaaatttacgcttggtaactgggcttgctaggatattagtgcaattttcaagtgtgagccaaggagagatgtgaacgatttggacatctgaactctagtttgaagagccgtattgtctgcttttaatacaaatcatgatgaagagctggcatt

SEQ ID NO: 16313 - protein, 140 aa, Panicum virgatum
  misc_feature: Ceres CLONE 1788569
  misc_feature (25)..(120): Pfam Name: Ribosomal_L7Ae Pfam Description: Ribosomal protein L7Ae/L30e/S12e/Gadd45 family
MADQETPVAVEAPTPVLGEPMDLMTALQLVMKKSSAHDGLVKGLREAAKAIEKHAAQLCVLADDCDQPDYVKLVKALCSEHNVHLVTVPSAKTLGEWAGLCKIDSEGKARKVVGCSCVVIKDYGEESEGLNIVQEYVKSH

SEQ ID NO: 16314 - DNA, 1812 bp, Panicum virgatum
  misc_feature: Ceres CLONE 1788572
  misc_feature: Encodes the peptide sequence at SEQ ID NO. 16315
tttttttttcgcgcaaacccccacgtcgcctcccagccgatcaccacggcaccaccaaaccccccgtacgtttcgttccggatcccccaccgccgccgacgaccccgaccggaaccctaataataggtggaaagtaagccatgaggccgcacgctgcggggacgggcggcggcggcgtggggagacggaaggcgggggccgctgctgccgccgccagccgggagtggatggtggtgccggcgtcgggcccggcgagggtggaggaagccgggaagcacgcggtgatggcacggacggggcttcctgcgcgcgatctcagggtgctcgacccgttgctctcctacccgtccacgatcctgggccgtgagcgcgccatcgtcgtcaacctcgagcgcgtcaaggccgtgatcaccgccgccgaggtgctgcttccaaattccaaggaccccgccttcgcgcgcttcgtccgtgacctacagacccgtgtcctcgcgtcctcctcagaccaggctgcagatctcaccgacatggagggtgaatcgtcagctgttgcttcaccatttcctgttccgaattcatccaaaggacatgaattggagatgactaagaagtctactaccgtggtgccagaaatgacaagcagcaccagtatgcctaatttggctgctgcaaaagatggaaatgccaaggttttaccttttgaattccgagcacttgaagtctgccttgagtcagcctgcagatctttggaagaggaaacttctactctggagcaagaggcatatccagcattagatgagctgacatcgaagatcagtacattaaaccttgagcgagttaggcaaatcaagagccgcctggtggcgatatctggtcgtgtacagaaggtgagggatgagcttgagcatttgctggatgatgaaatggatatggctgaaatgtacttgacagataagcttactcaacaagaaatcagtgaggcttcatctagagttgaggttgatgatccatctaagactgaggaggacagggatgaagattatagaagtgagccagatggaagcaatggtagctttattggttataagcctaacattgaagaactggagatgcttcttgaggcatactttgtgcagattgatggcacacttaacaagctgtcgcatctgagggagtatgttgacgacacagaagattatatcaacataatgttggatgacaagcagaatcagcttctacagatgggggttatgctctcgactgcaactgtcgtcattactgctggagtggctgttgttggactttttgggatgaatattggcatatcactttacgacgatccaacaactgaggaggagaaaagggcggcaaacatgaaattctgggagaccactttggggaccgttgctggctgtatgattttgtacattgtagccatgggttgggggaagagaagtgggttgctgcaatgatggcagaagcctgcatcttaacttcacccaaagaaaactagattgacaaagttctccaatggcgagattggcatacagctcggtacataatgggggaaaacatcttttgtactgctagtaaacgggtaatgagagcgaaagaacactgttgtaaaatttgctgctgcacagttgaggcggcaactcagttattttgtcttgcacctggtgtgcaactgtttaccagactagtgtggtttctgcacttgctattgtaatctgtagctgtcgtatatgtacctagttacctgtagcttgttgttccaagtgttgtatcaatgccacaagtctgtcttccctc

SEQ ID NO: 16315 - protein, 443 aa, Panicum virgatum
  misc_feature: Ceres CLONE 1788572
  misc_feature (24)..(442): Pfam Name: CorA Pfam Description: CorA-like Mg2+ transporter protein
MRPHAAGTGGGGVGRRKAGAAAAAASREWMVVPASGPARVEEAGKHAVMARTGLPARDLRVLDPLLSYPSTILGRERAIVVNLERVKAVITAAEVLLPNSKDPAFARFVRDLQTRVLASSSDQAADLTDMEGESSAVASPFPVPNSSKGHELEMTKKSTTVVPEMTSSTSMPNLAAAKDGNAKVLPFEFRALEVCLESACRSLEEETSTLEQEAYPALDELTSKISTLNLERVRQIKSRLVAISGRVQKVRDELEHLLDDEMDMAEMYLTDKLTQQEISEASSRVEVDDPSKTEEDRDEDYRSEPDGSNGSFIGYKPNIEELEMLLEAYFVQIDGTLNKLSHLREYVDDTEDYINIMLDDKQNQLLQMGVMLSTATVVITAGVAVVGLFGMNIGISLYDDPTTEEEKRAANMKFWETTLGTVAGCMILYIVAMGWGKRSGLLQ

SEQ ID NO: 16316 - DNA, 887 bp, Panicum virgatum
  misc_feature: Ceres CLONE 1788598
  misc_feature: Encodes the peptide sequence at SEQ ID NO. 16317
gctctagggaataacaagtatataatcagagttctaggatatggccacgagttcttatggggacatgaatcccttgaacctcattatttcctagtcgaggaatacttgccaaacggaaacatgggcgacattatttatggttctcaatctgttaattggtcctcccgatttctgataattcagggattagcccacggcctaaattacctacatgagcaaaacattgtccatatgaacgtgaaaccagccaacatcctcttggattctgatatgaatccaaagctaactgattttggaatagctagaacgttgaagcaaccgatggttgaagatgaaaacatagcaggcacagtgggttatatgcctccttaatatatcttggaaggtactttgtcgatgaggtacgatgtctacagctttggtgtaaccctccttgagactattaatggtatgtgcagagatgtacctgctcgtcaccatgcttcagttccatgggcctggaatgtgcgagaaagtaaacaacaaatggaggatctatttgaccggtccttgtacaaggaatctcaactaacagagataaagaggtgcttggatataggactactgtgcactcaatttgagccgggcaagcgccctaccatggcggaagttctcgacatgcttgatggcaagaaacagttattagcaaccccaaagcaaccggaatacaccaaaagaaggagccagccataagaccagaagtgggaggtagcaacacgcccaaatggcatgtagcataattgatccatcatactcatacaattaattattttccaaaaatctactgtgaccgaagttgtaaatacaattgattcgctcgtaacaagaatacaaaaaattgcaagcag

SEQ ID NO: 16317 - protein, 123 aa, Panicum virgatum
  misc_feature: Ceres CLONE 1788598
  misc_feature: SWISSPROT Homolog: EC 2.7.11.1 Non-specific serine/threonine protein kinase
ALGNNKYIIRVLGYGHEFLWGHESLEPHYFLVEEYLPNGNMGDIIYGSQSVNWSSRFLIIQGLAHGLNYLHEQNIVHMNVKPANILLDSDMNPKLTDFGIARTLKQPMVEDENIAGTVGYMPP

SEQ ID NO: 16318 - DNA, 1733 bp, Panicum virgatum
  misc_feature: Ceres CLONE 1788605
  misc_feature: Encodes the peptide sequence at SEQ ID NO. 16319
cagccagaccacccagacaaccaaccaacaaacttattagcttgttgctggccgcaccaccaccgtacaaccagcagcagtcagcaggcagacgatgcagccgccggaggtggtggacggcgacacgccggcgctgcggtccgccgcggacgccgcgcgcatggtgtgggacgagtcgaagcgcctgtggggcatcggcctccccatcgccgtgggcacgctcagcgcgtacgccctcagctccgtcacccagatgttcgccggccacctcggcaacctccccctcgccgccgcctccatcggcctctccgtcttcgccaccttcgcgctcggcttcctcctcggcatgggcagcgcgctcgagacgctctgcggccaggccttcggcgccggccaggtcgccatgctcggcgtctacctccagcgctcctggatcatcctcctcgccgccgcgctgctcatgtcgccgctcttcgtcttcgccgagccgctgctcctgctcatcgaccaggacccggacgtcgcgcgcgaggccgccaggttcgtgctctacatcctccccgccgtcttcgccatggccatcaacttcgccgccggcaagttcctccaggcgcagagcaaggtcacggtgcccgcctggatcggcctcgccgccctgctcgccaacatcctcctcaattacctctttgtcgtcctcctcggctggggcctccccggcgcggccgccgcctacgacctcgcccactggggcatcgcgctggcgcaggccgcctacatcatcggctgatgcggggacggctggaagggctggtccgccgccgccttccacgacatctgggccttcgtcaagctctcgctcgagtccgccgtcatgctctgcctcgagatatggtacctgggcctcatcaccgtgctcaccggcgacctcgaggacgcgcagatcgccgtggactccctgggcatatgcatgagcatcaacggatgggaggccatgatcttcatcggcctcaacgcggccatcagcgtccgggtctccaacgagctcggctccggcagacccagggccgcgtggaacgccgtcatggtcgtcgtcgcggaggcgctgctcatcggcgtcctctgcatggtgctcgtgcttgtcttcagggacagcttctccatcatcttcaccagcgacgatgacctgcggcgcgccgtgtccaggatcgccggcctgctggggataaccatggtgctcaacagcgtgcagccggtgatctcgggggtggcggtcgggggtggatggcaggggctcgtcgcctacatcaacctcggctgctactacatcttcggcctgcccctgggatacatgctcggctaccacctaaactttggagttggggggatttggtccggcatgctctgtggtattgctctccagacgctcatcttgctagccgtggtctggagaacagattggaaagcagaggccgcccaagcttcaagccgcgtgcaaaagtggggcggcaagggcactgatgatgaacaagtcaacaagcctctcctagaatgaatgtcgagagtttaattacctttcccttctcttgccaaaaaaatggcactttgccctctttaggacagaggcgtccttaattttttgactagtatttgaataactgtaaactggattggattcacctatgagctagctagctttgatgatggcttggaatgaacttgaacaactttctctc

SEQ ID NO: 16319 - protein, 226 aa, Panicum virgatum
  misc_feature: Ceres CLONE 1788605
  misc_feature (1)..(160): Pfam Name: MatE Pfam Description: MatE
MLCLEIWYLGLITVLTGDLEDAQIAVDSLGICMSINGWEAMIFIGLNAAISVRVSNELGSGRPRAAWNAVMVVVAEALLIGVLCMVLVLVFRDSFSIIFTSDDDLRRAVSRIAGLLGITMVLNSVQPVISGVAVGGGWQGLVAYINLGCYYIFGLPLGYMLGYHLNFGVGGIWSGMLCGIALQTLILLAVVWRTDWKAEAAQASSRVQKWGGKGTDDEQVNKPLLE

SEQ ID NO: 16320 - DNA, 293 bp, Panicum virgatum
  misc_feature: Ceres CLONE 1788616
  misc_feature: Encodes the peptide sequence at SEQ ID NO. 16321
ttttgtacgagctaggatccagcgaatccatggccaagccccacctcctcttggggcccctgccggccccctgccccgacacccccatgatggagctcgaccaccgcttggtcgagcacggcttgaacgtcacgttcgtcaagaccgaagagcctcacgacgcggttcgtccgagcgctgcaggccgcgggcggcacagcggcgctggccggcatccacctggcgtacatcccagaccggctggagcctggagaacgcttggacgtcgtcaaggtcatcgagtcctaccaccg

SEQ ID NO: 16321 - protein, 87 aa, Panicum virgatum
  misc_feature: Ceres CLONE 1788616
  misc_feature: Useful for making plants with altered carbohydrate content
MAKPHLLLGPLPAPCPDTPMMELDHRLVEHGLNVTFVKTEEPHDAVRPSAAGRGRHSGAGRHPPGVHPRPAGAWRTLGRRQGHRVLP

SEQ ID NO: 16322 - DNA, 2226 bp, Panicum virgatum
  misc_feature: Ceres CLONE 1788628
  misc_feature: Encodes the peptide sequence at SEQ ID NO. 16323
aacaaacctctccacttcggcacttcccagccgaggaaggaagcgagagggggggactgcggcggcgccggcggagatggggataatggcggcggcgagggaccagctcctggacgcgatccgcgggctgatggcggtccagtcgccgccgctccacgcgctgatcgtcccctccgaggacgcccaccagagcgagtacgtctcggagcaggacaagcggcgggagttcatctccgggttcacgggtagcgctggcttggctcttatcaccatgaaagaggccttgttgtggacggatggacgctacttcttgcaagcaacacaacaactgagtgatcgttggaaattaatgcgcatgggagaagacccaccggttgaagcttggatagctgataatctggcagataaagctgtcattggaatcaatccatggtgtatctcggttgactctgctcaaagatatgatcatgcattttcaaagaagcaccagacattatttcagctttctattgacttagtggatgaagtatggatggatcgcccaccagtcgaacctaggcctgtaattgtacacccagtagaatttacagggcgtagtgtatcagaaaagatcaaggagctaagaaaaaagctagtacatgaaaaagctactgcaattataataactgctcttgatgaggttgcttggttgtacaacattcgaggaagtgatgtggattacagcccagtggttcattcttatgctattgtaaccttggacagtgctttcttttatgtggacaagagaaaagtaacagccgaggttcagaaatacatggttgaaaatgatattgatataagagagtatgaaacggttcaatcagatgtgagtctactcgcatctggcaatctaaaaagttctgtgcatggggaaaaggatatcaatgttgtggagggttcaaaaatttggattgattctgcctcatgttgccttgcactctactcaaagttgaacccgcatcaagttttgatacttcaatcaccaattgcccttccgaaggctgttaagaatcccacagaactggatgggttaaggaaggcgcatattcgagatggtgcagctgttgtgcaataccttcattagctggataatcagatgcaggagaactatggagcttctggttacttcagtgagataaaaggatcacataaaaagggaatttcagcagccaagcttactgaggtttctgtgagtgataaacttgaaggcttccgtgcaacaaaagagcacttcagaggtttgagtttccctacaatttcatctgtgggaccaaatgcagcagttattcactataaacccgaagcaagcacatgttcggaaatggatgctgataagatctatctttgtgactctggggcacagtacttggatggtacaacggacattacaagaactgtacattttggtaaaccctcagagcatgagaagtcatgctatacagcagttttgaaaggccacatcgcacttgacattgctgtatttcctaatgggacgacagggcatgctcttgatatcctttcacgagccccactatggagagaaggtcttgactatcggcatggtacaggccatggaattgggtcttttttgaatgttcatgaaggtcctcatctagtcagcttcagacctactgctcgaaatgtgccattgcaagcatcaatgactgtaacagatgagcctggttattatgaagatgggagctttggtatcagattggagaatgttcttatttgcaaagaggccaatgctaaatttaattttggagataaaggttatttggcgtttgaacatataacatgggctccataccaggccaaactgatagacaccaagctgctaacccctgtcgagatcgagtgggtaaacacgtaccactctgactgccggagaatcttggaaccctatctgaacgagcaagagaaggaatggctgcgcaaggccactgagcccattgcccaaagtggctgagcccagtcatgtagtgctgtagcgtcccgtgcgtagatatagattgcctgctccggctccttggtcttcttgctgcgaaaatggagtcagtcttgaaattaaaattaaatttatggataatgtacatacagttttcaaattaaattccgtgtggatctttcagtaagaacaacgatggcttgccctcgagcttatcgtaatacataacaattggtttc

SEQ ID NO: 16323 - protein, 348 aa, Panicum virgatum
  misc_feature: Ceres CLONE 1788628
MGIMAAARDQLLDAIRGLMAVQSPPLHALIVPSEDAHQSEYVSEQDKRREFISGFTGSAGLALITMKEALLWTDGRYFLQATQQLSDRWKLMRMGEDPPVEAWIADNLADKAVIGINPWCISVDSAQRYDHAFSKKHQTLFQLSIDLVDEVWMDRPPVEPRPVIVHPVEFTGRSVSEKIKELRKKLVHEKATAIIITALDEVAWLYNIRGSDVDYSPVVHSYAIVTLDSAFFYVDKRKVTAEVQKYMVENDIDIREYETVQSDVSLLASGNLKSSVHGEKDINVVEGSKIWIDSASCCLALYSKLNPHQVLILQSPIALPKAVKNPTELDGLRKAHIRDGAAVVQYLH

SEQ ID NO: 16324 - DNA, 2644 bp, Panicum virgatum
  misc_feature: Ceres CLONE 1788629
  misc_feature: Encodes the peptide sequence at SEQ ID NO. 16325
ggaagaaaagaccctattctctcacagggagtccgcctccccctccacgcttcgcccgctgaccctacccaacacggccaccgcagccgccgccgccgcggccggcaagcgccatgcggccttcctcccgcgtactcgcggcgggccacctcctccgcggcttccggcttgaaccctcccagactgctgccgccgccgccgttttccggcggctgaacggagccagcaggccgggcgtgccgaaacctctcgccaaccctctcctcggaagcttcggacccaactgtggcatccctcccgggaaaggggccctttttggccgcctcggcagcttcctgccagactctgcctacccgccacacggcgcgcggcttccccgggacacgagaggacatgcattctccacatctgcaaatgctgtgacagtcgggaagccggataacgacaaggtcaagaaagatgcttcaaaaaaggatgttgatgagcagatagcagattctcagatactgaaaaaccttgggaagtacttattgttgaatgacagccctgacttccgcttcaggcttgtgttgtcgctgggcctattagttggtgcaaaggttataaatgttcaagtgcctttcttgtttaagctcgctatcgattggcttgcagcccttggtggtgctgaagcctcactggcatcattcacggaaactaatgccaccctattggctctctttgcaagcccagcagctgtgctgattggttatggaattgcacgatcaggagtgtcggcctgtacagagcttcgaaatgctgtattttcgaaagtgaccttgagagccatccgttcagtatccagaatggtattttctcacttgcatgagcttgatcttcgttatcatctaagccgacaaactggtgctctaaatcgcataattgatcgaggcagccgtgcaataaattacattctaacagtgatggtattcaatgttgtgcccacaatattagagattggtatggtctcaagcatacttgcgtacaagtttggttccacttttgcttggattacttctgtttcagttgctacttatattgctttcactttggctgtcacacagtggcggactaaattcaggacagccatgaacaaagctgataatgcttccagtacagtggcagttgactctcttctgaattatgagactgtgaagtacttcaacaatgaacaatttgaagttgagaagtacgacaaatatttaagaaaatatgaggatgctgcattgaagacccaaagtagccttgcctacctgaattttggtcaaaacgttatctttagctcggctttatcaacagcaatggttttgagctcatatggagtaatgagtggtgctcttaccgtgggtgatttggtcatggttaatggacttctattccagctctcattgcctctaaatttccttgggagtgtgtatcgagaatctagacaaagcctgattgacatgaagtctatgtttcagttgcttgaggaaaaacctggaataaaggatgagcctcatgcacaacctttgcaattcaagggaggatgcattgaattcgaaaatgttcattttgggtacgtaccagaaaggaagattcttgatggtgctacttttactgtacccgcaggacagagcgtggccattgtaggaactagtggcagcgggaaatcgaccattcttagacttctgttcagatttttcgattcaacatcaggatctatacggattgatgggcaagatatccgaagagtaacactagatagccttcgaaaatgtcttggtgttgtgcctcaggacactgtactttttaatgacacaattaagcataatatacagtatgggcggttatcagcaaaagacgacgaggtctatgatgctgcccgacatgctgctattcatgatacaattatgaacttcccagacaagtatgacacagtagtaggagaacgaggattgaagctaagtggtggggagaaacaacgagtgtcaatagctcgtgtattcttgaaggagccttcaattctattatgtgatgaagcaacaagtgctcttgatagtactactgaagcctcaattttgaattctctgaaatctttatccgttgaccgtacatcaatctttattgctcatcgactcacgactgcaatgcagtgcgatcagataattgttttggagaatgggaaggtaatagaacaaggacctcatgatgttcttctgtcaaagggtgggcgatacgcagaattgtggtttcagcagaacaacagtgataccattgaccctgctgcagttaacctagaggtttgattgacggtgtatactttccctttctgcaagggaaaacagtcttgtaactgagaggggagcaggtttcaacttatctgcaccttgtaaatggagtaggattttagatataaggggacataaggagagagatctccattccaagatagcctgggcgattctttttcccctttgagattatatagacagtcccatttgttttttttcatggcaatgtaacatttctgtagcacaaggaataaggctagtaaatatctacttgtctcagctcaattaccattttggtacagatgctgttactgtgcacacgtattactgat

SEQ ID NO: 16325 - protein, 737 aa, Panicum virgatum
  misc_feature: Ceres CLONE 1788629
  misc_feature (513)..(697): Pfam Name: ABC_tran Pfam Description: ABC transporter
  misc_feature (151)..(441): Pfam Name: ABC_membrane Pfam Description: ABC transporter transmembrane region
  misc_feature: SWISSPROT Homolog: EC 3.6.3.44 Xenobiotic-transporting ATPase
MRPSSRVLAAGHLLRGFRLEPSQTAAAAAVFRRLNGASRPGVPKPLANPLLGSFGPNCGIPPGKGALFGRLGSFLPDSAYPPHGARLPRDTRGHAFSTSANAVTVGKPDNDKVKKDASKKDVDEQIADSQILKNLGKYLLLNDSPDFRFRLVLSLGLLVGAKVINVQVPFLFKLAIDWLAALGGAEASLASFTETNATLLALFASPAAVLIGYGIARSGVSACTELRNAVFSKVTLRAIRSVSRMVFSHLHELDLRYHLSRQTGALNRIIDRGSRAINYILTVMVFNVVPTILEIGMVSSILAYKFGSTFAWITSVSVATYIAFTLAVTQWRTKFRTAMNKADNASSTVAVDSLLNYETVKYFNNEQFEVEKYDKYLRKYEDAALKTQSSLAYLNFGQNVIFSSALSTAMVLSSYGVMSGALTVGDLVMVNGLLFQLSLPLNFLGSVYRESRQSLIDMKSMFQLLEEKPGIKDEPHAQPLQFKGGCIEFENVHFGYVPERKILDGATFTVPAGQSVAIVGTSGSGKSTILRLLFRFFDSTSGSIRIDGQDIRRVTLDSLRKCLGVVPQDTVLFNDTIKHNIQYGRLSAKDDEVYDAARHAAIHDTIMNFPDKYDTVVGERGLKLSGGEKQRVSIARVFLKEPSILLCDEATSALDSTTEASILNSLKSLSVDRTSIFIAHRLTTAMQCDQIIVLENGKVIEQGPHDVLLSKGGRYAELWFQQNNSDTIDPAAVNLEV

SEQ ID NO: 16326 - DNA, 1864 bp, Panicum virgatum
  misc_feature: Ceres CLONE 1788631
  misc_feature: Encodes the peptide sequence at SEQ ID NO. 16327
gcggagagcgacgacatcgccgccagggggaggtgagagagatcccccagcgagcagagagccagagactgctactacaaagtctcctccggctttgactcccccgactccatttgatggtcgcggggggaccgggaccgggagcggggagccggcggcgacgacgacgatgggcctctgcagctcctccaccgcggcggccgcggacgcgccccggcggcccggcggcgcggcggcggggaggagggagagggagaaggggcgcgggatcgtggcgtgcggcaagcggaccgacttcgggtacgacaaggacttcgaggcgcggttctcgctcggcaggctgctgggccacggccagttcgggtacaccttcgccgccgtcgaccgcgcgtccggcgaccgcgtcgccgtcaagcgcatcgacaagaacaagatggtccttcctgttgctgttgaagacgtaaagcgagaagttagaatattgaaggccttacaagggcacgaaaatgttgtacatttttacaatgcatttgaagatgacaactttgtgtatatagtcatggaattatgtgagggtggtgaattacttgatcgtatattagccaagaaagatagccgttatagcgagaaagatgctgcagtaattgtccgacagatgctcaaggttgcagctgagtgccacctgcacggtttggttcatcgggacatgaaacctgagaacttcctattcaaatcaacaaaggaggactcacccctcaaggctacagattttggcctttcagatttcataagaccaggaaagcaattccgtgacattgtcggaagtgcctactatgtggcaccagaagtactcaagcgaaagtcagggccggaatctgacgtttggagtataggcgttattacctatattttgctgtgtggaagacggcctttctgggacaaaactgaagatggaatatttaaagaggtattaaaaaacaagccagattttcgccgcaagccttggccaaatattactccagctgcaaaggattttgtacaaaagttactagttaaggatccccgtgcaagactaactgctgcacaggcattatcacatgattgggtaagagaaggaggaaaagcatctgaaatacccttggatatatcagtattacataatatgcgacagtttgtgaaatatagccgtttcaagcaatttgctttaagggcattagcatctacactaaactcagaagagttgtctgatcttcgtgatcagttcaatgccattgacgttgacaaaaatggaacaattagcctggaggaattgaagcaggctcttgcaaaggatgttccgtggagattaaagggtcctcgtgttttagagattattgaggcgattgatagtaatacagatgggctagttgattttgaagagttcgtggcggcaacactacacgtgcatcagctggtggaacatgatactgaaaagtggaaatcattgtctcaagctgcatttgataaatttgacgtcgatggcgatggctatatcacatctgatgaacttagaatgcatacaggaatgaagggttctattgaccccctcctagaggaggctgacattgacaaagatggcaaaataagcctagacgaattccgcaggctcttgaaaactgcaagcatgagcgcgcgcactgtacaaactccgaggggcgtttgcgtgtcatagtttctcaattttcatagttcacttcactgaacaagggagcaggaaatggtgagatgtttttgggcgacacatgtaattgagaattgttgccggaaaggcttcttgatgtatgtaaggtatacaatcaatgcacatgaaatagggttgacctgt

SEQ ID NO: 16327 - protein, 513 aa, Panicum virgatum
  misc_feature: Ceres CLONE 1788631
  misc_feature (53)..(313): Pfam Name: Pkinase Pfam Description: Protein kinase domain
  misc_feature (360)..(388): Pfam Name: efhand Pfam Description: EF hand
  misc_feature (469)..(497): Pfam Name: efhand Pfam Description: EF hand
  misc_feature (439)..(467): Pfam Name: efhand Pfam Description: EF hand
  misc_feature: SWISSPROT Homolog: EC 2.7.11.1 Non-specific serine/threonine protein kinase
  misc_feature: The sequence is a functional homolog of SEQ ID NO 2 in US patent 7084323
MGLCSSSTAAAADAPRRPGGAAAGRREREKGRGIVACGKRTDFGYDKDFEARFSLGRLLGHGQFGYTFAAVDRASGDRVAVKRIDKNKMVLPVAVEDVKREVRILKALQGHENVVHFYNAFEDDNFVYIVMELCEGGELLDRILAKKDSRYSEKDAAVIVRQMLKVAAECHLHGLVHRDMKPENFLFKSTKEDSPLKATDFGLSDFIRPGKQFRDIVGSAYYVAPEVLKRKSGPESDVWSIGVITYILLCGRRPFWDKTEDGIFKEVLKNKPDFRRKPWPNITPAAKDFVQKLLVKDPRARLTAAQALSHDWVREGGKASEIPLDISVLHNMRQFVKYSRFKQFALRALASTLNSEELSDLRDQFNAIDVDKNGTISLEELKQALAKDVPWRLKGPRVLEIIEAIDSNTDGLVDFEEFVAATLHVHQLVEHDTEKWKSLSQAAFDKFDVDGDGYITSDELRMHTGMKGSIDPLLEEADIDKDGKISLDEFRRLLKTASMSARTVQTPRGVCVS

SEQ ID NO: 16328 - DNA, 1723 bp, Panicum virgatum
  misc_feature: Ceres CLONE 1788636
  misc_feature: Encodes the peptide sequence at SEQ ID NO. 16329
agtttggggggtcgtcgccgcgttagtgtcgctcgccatatccccttcctccccttccctctccgagtccgactccggcaatccgccccgcctgaaccctactccacgtcgcctcgccggttgggctgggggccgagccgatccgatcggatcggggccggttcctgcgccgccgctgggtgacctcctcccggtcgctcgcctgctcggctcgatcggccggggacggcggcggccagatctgcgatggagggcaacaaggacgacgcggccaagtgcttgcgcatcggcaggggcgcgctcgaggccggcgaccgcgcgcgcgccgtcaagttcctctcgaaggccaagcgcctcgacccgtccctccccatcgacgacctcctcgctccgctcctcagcccccaggacgactcccccgcttcctcgtcatcatcgccgccgccgcccccaccgccacaaccttcagcagggccagcgggagcaggagcagctgaggctgacgggctgagagagaggaaacagaagggcagaaggagggaggaggaggaagaggcgactggcgctgcgagagagtacacggtggagcagctcgaggttgtgcgccaggtcaagaagcactccagggactactaccagatcctgggcctcgagaaggactgcaccgtcgaagacgtgcgcaaggcctaccgcaagctctcgctcaaggtgcaccctgacaagaacaaggcccctggcgcagaggatgccttcaaggccgtttccaaagccttccagtgccttagtgataccgagagtcgtaagcgctatgaccttgttggctcggatgagccagtaacacaccacaggagggcctccactgcccgtgcatacaatggtttctatgaggatgactttgacccagatgagatattcagaaacttcttctttggtggtatggcacctgccaccaccaggcagtttggacagtttgggacgttccatttcagaactggtggaatgcatgctcatgggcagcaaaactctggtggctcaactgtcaggatgcttattcagttgttgccagttctacttctgctgttgctcaacttcctgccatcctctgagcctgtttactccctctcacgctcctacccatatgagcacaagttccaaacaccacgtggagttgcatactatgtcaagattcctaattttgaggagcagtatccacaccaaagcactgaacgagcagcactggagcggcatgttgagagggattattactcaataatcacacagaattgcagggtcgaactgcagcgccgccaatgggggttagcataccagacaccacactgtgatatgcttaaaaaatttgaggcagcagctcagtaattcattcaatggtccaaggttgacagggagaagagaagctggctgtgtaaaagtttccaatacctgtgcccttggctgtcagctgatcggaggggacgtcaagtttggactagtagtaaattttgtggaataagtgcctttgatgactatacaccacctgcccagatgctatcttagttgtgctgagtgcatcacagagctacttcaaaaggatatgtaatggttaagcttcataggtttatcacatgcagacctgtgtatgtatatgaagtacatcgacctcatttttttttttactttttgagagaatacccgacttaacagcaatagcagaaatggcttctcc

SEQ ID NO: 16329 - protein, 376 aa, Panicum virgatum
  misc_feature: Ceres CLONE 1788636
  misc_feature (128)..(189): Pfam Name: DnaJ Pfam Description: DnaJ domain
MEGNKDDAAKCLRIGRGALEAGDRARAVKFLSKAKRLDPSLPIDDLLAPLLSPQDDSPASSSSSPPPPPPPQPSAGPAGAGAAEADGLRERKQKGRRREEEEEATGAAREYTVEQLEVVRQVKKHSRDYYQILGLEKDCTVEDVRKAYRKLSLKVHPDKNKAPGAEDAFKAVSKAFQCLSDTESRKRYDLVGSDEPVTHHRRASTARAYNGFYEDDFDPDEIFRNFFFGGMAPATTRQFGQFGTFHFRTGGMHAHGQQNSGGSTVRMLIQLLPVLLLLLLNFLPSSEPVYSLSRSYPYEHKFQTPRGVAYYVKIPNFEEQYPHQSTERAALERHVERDYYSIITQNCRVELQRRQWGLAYQTPHCDMLKKFEAAAQ

SEQ ID NO: 16330 - DNA, 1840 bp, Panicum virgatum
  misc_feature: Ceres CLONE 1788643
  misc_feature: Encodes the peptide sequence at SEQ ID NO. 16331
acgcccacgcccctaaaattaagaagggaactcgggaatcgctcgaggtggtggggcgagagctcgcgcgaggagggggcgagaagcttctggcgggtggtggtgcggaccctcgccgtcgaagcgggcggggagagagagagagagagagagagagagagagagagagagagagagagagaggagcggggatcgcgcggcggaaggggggaggcggtggatggcggtggagtaccactgctgctcggcgcccttcttcgagcacatcgtcatcatcgtcgtgctcgtgctcttcgcgggcctcatgtcgggcctcaccctcggcctcatgtccctcagcctcgtcgacctcgaggtcctcgccaagtccggcaccgaacaggaccgcaagcacgcagctaagattttgcctgttgtgaagaaccagcaccttctgctatgcactcttctgatctgcaatgctgcagccatggaggctttgcccatattccttgatagcttggtgactgcttggggtgcgattttgatctcagtgacactgattctactgtttggtgagatcttaccacagtccatctgctcacattatgggctggctattggtgcttcagttgctccattagtccgtgtgcttgtctggatctgcttccccattgcctatcctataagcaagctactagactgtgtactgggtcatggtcaaacagctctcttccgcagagctgagctaaaaacacttgtcactctgcacggaaatgaggctggtaaaggtggagagttaacccatgatgaaactaccataattgctggagcacttgaactcactgaaaagaaggctaaagatgctatgacaccgttatgtcaaacctttgcaattgatataaacgcaaagcttgacagagaactgttgcaagaggtcctcgagaaagggcatagcagagtgccagtttattatgaaaagaagacaaatattattggattgatattggtgaagaacttattatcagttaacgccgatcacgaggttcccataaaaagtgtgactatccgcaaaattcctcgtgtttttgaagatatgcccctgtatgacatcctaaatgagtttcagaaaggccacagccacatggcagtggtcataaggaaaaacattcccaatgaatcagctgaacaacctgccaatgatggaggaacttatgaggtgtccattgctattgatgaaaagaacaacgaaaaggtcgtgaagaacctgccgccaccactgcgaagatggaagagctaccctaacactcagaacgtatcaaataggggaagcaggcctaaaaaatggtccaaagatcaatcagatgtcctgcagatacatgaagagcccctgcccacattgagcgaagacgaagaggctgtcggtatcataaccatggaggatgtcattgaggagcttctgcaggaggagatatatgatgagacagacgtacatgaggagcaatgacactggcttcacggcccgctgtttatagctgcctactggacagagaagcagctgttagaaaagtgcggcatacgtaatatctgtactttatgttgataggtatatacattgagagagactagccatccattgtagtaccaggtggctgtctaggatatcatattggtaagaatactgtttggactttggagtatttcggtctcaggactgcaggattgcccaggtccggaaattatgccgggtaccctggtaagaaacggaccggaaactgtaacgagcatcctggtggtaagaaacggatgcgtttgacggatccgttcggttcagaagccccaataagatatcagtttcttt

SEQ ID NO: 16331 - protein, 421 aa, Panicum virgatum
  misc_feature: Ceres CLONE 1788643
  misc_feature (210)..(318): Pfam Name: CBS Pfam Description: CBS domain pair
MAVEYHCCSAPFFEHIVIIVVLVLFAGLMSGLTLGLMSLSLVDLEVLAKSGTEQDRKHAAKILPVVKNQHLLLCTLLICNAAAMEALPIFLDSLVTAWGAILISVTLILLFGEILPQSICSHYGLAIGASVAPLVRVLVWICFPIAYPISKLLDCVLGHGQTALFRRAELKTLVTLHGNEAGKGGELTHDETTIIAGALELTEKKAKDAMTPLCQTFAIDINAKLDRELLQEVLEKGHSRVPVYYEKKTNIIGLILVKNLLSVNADHEVPIKSVTIRKIPRVFEDMPLYDILNEFQKGHSHMAVVIRKNIPNESAEQPANDGGTYEVSIAIDEKNNEKVVKNLPPPLRRWKSYPNTQNVSNRGSRPKKWSKDQSDVLQIHEEPLPTLSEDEEAVGIITMEDVIEELLQEEIYDETDVHEEQ

SEQ ID NO: 16332 - DNA, 1824 bp, Panicum virgatum
  misc_feature: Ceres CLONE 1788652
  misc_feature: Encodes the peptide sequence at SEQ ID NO. 16333
aaaccaggcgaaaaagccctatcaccagcgggaggccgagaaggcgaatcatggctgccgcgatggccaccgccgccatggctgcggccgcctcctcacgggcgttcctgcgcccgcacggcggcctcctcctccccctcatccgccccctccgacgccgcttctccgccacagccgcctccgcctccgcacccgtctccaccgccgcgccgggcggcgtcgtggacgtgctgcgggagcgcggcctcgtcgaggccaccacctcggaggcactcgcggcggcgcgccccggggagctcaaggtgtactgcggcttcgaccccaccgccgagagcctgcacctcggcaacctcctcggcctcgtcgcgctctcctggttccgccggtgcggccacaccgccgtcgcgctcgtcggcggcgccacgggccgcgtcggggacccgtccggcaagagcgccgagcgccccgagctcgacgtcgccgccgtcgaagccaactccgacgccatcaagtccctcgtcgcccagatcctcggccgcgttcccgagccggcccaccattcccaacccggtacgaaccagcagcctttggtcaattcagcagcgggttcgtcagcaaacatgggttccttcgtgatcctggacaactacgactggtggaaggacatcacgctgctggatttcctcaaggaggtggggcggttcgcgcgcgtcggcacaatgatcgccaaggagagcgtgaagaagcggctcgcgtcagaggagggaatgagctacaccgagttcacctaccagctcctccagggctacgacttcctgcacatgttcaagaacatgggtgtcaatgtgcagatcgggggcagtgatcagtgggggaacatcacggctggaacggagttgatccgaaagatcttgcaggtcgagggggcgcatggcctgacgttcccgctcttgctgaagagcgatgagaccaagtttgggaagacggaggatggcgccatctggctctcgtcaaagatgctctccccatacaagttctatcagtacttctttgcagttccagatgttgatgtcatcaggtttatgaaaaccctgacgttcgtaagcttggatgagattcaggagctggaagagtctacgaaaaagcccgggtatgtgcccaacactgttcagaagaggcttgcagaagaggtgactcgattcgtccatggcgaggagggattggcagaggcgctgaaggcaaccgaggccttgagacctggggctcagacacaattggacgcacaaacaattgagggaatagcagatgatgtgccatcatgctctttggcttatgatctagtagtgaaatctcctctggttgatctggctgtttccacaggtttgcttactagtaagtcggcagttaagcggcttataaagcaaggtggcttgtacctgaataatattaggattgatagtgaggataagttggttgaggaaggtgatatagttgatgggaaggttctgttactatctgctggaaagaaaaacaagatggttgtgaagatatcttgattgttacttttttgagtgtttctaatttttgtctgtggaggagaaaagttcggtgctgagcctttgaacttgaattagctgtcaccaagcatacagattgctgtgtgtttttctttttgagattacattcagattgctgtgttggagagattgaatacacgttctttttcgatcgttttgttcatcagagttttttgtgttctatcagctttgagaagaattcttatatccatatcaatatcatagctggacgtgtaatttcaagttc

SEQ ID NO: 16333 - protein, 497 aa, Panicum virgatum
  misc_feature: Ceres CLONE 1788652
  misc_feature (75)..(399): Pfam Name: tRNA-synt_1b Pfam Description: tRNA synthetases class I (W and Y)
  misc_feature (430)..(477): Pfam Name: S4 Pfam Description: S4 domain
  misc_feature: SWISSPROT Homolog: EC 6.1.1.1
MATAAMAAAASSRAFLRPHGGLLLPLIRPLRRRFSATAASASAPVSTAAPGGVVDVLRERGLVEATTSEALAAARPGELKVYCGFDPTAESLHLGNLLGLVALSWFRRCGHTAVALVGGATGRVGDPSGKSAERPELDVAAVEANSDAIKSLVAQILGRVPEPAHHSQPGTNQQPLVNSAAGSSANMGSFVILDNYDWWKDITLLDFLKEVGRFARVGTMIAKESVKKRLASEEGMSYTEFTYQLLQGYDFLHMFKNMGVNVQIGGSDQWGNITAGTELIRKILQVEGAHGLTFPLLLKSDETKFGKTEDGAIWLSSKMLSPYKFYQYFFAVPDVDVIRFMKTLTFVSLDEIQELEESTKKPGYVPNTVQKRLAEEVTRFVHGEEGLAEALKATEALRPGAQTQLDAQTIEGIADDVPSCSLAYDLVVKSPLVDLAVSTGLLTSKSAVKRLIKQGGLYLNNIRIDSEDKLVEEGDIVDGKVLLLSAGKKNKMVVKIS

SEQ ID NO: 16334 - DNA, 2074 bp, Panicum virgatum
  misc_feature: Ceres CLONE 1788655
  misc_feature: Encodes the peptide sequence at SEQ ID NO. 16335
ctctctctctctctctctctctctctctcttccttcctagctagcggcgaccgacatacagggcgagtggcgccgcccagttcttcgtcgggcgcttcgccggccgacaagggttgcaaccagcacaatagattgcgattcacgggaggcgcattggccacaatggctctaacgctcctccaagggatgaggacgccgatctcatttagatcaagtacaggcttattctttactgttctaagacctcggctggtccgcttcacaaccagggtggagagtgcacaggcaactgaggccaaagcagcagccaaatcaattcaactggtgaccaaggaggcagcagagcagaagacacaagggtttgaagcgatcattggaattgagacccatgtccaactctcgaccgtcacaaaagcattttgttcttgcccgtacaactatggctcccagcccaataccactatctgccccacctgcatgggccacccagggacactgccagttctgaatgagaaggtcgttgagtgtgccgtgaagttgggccttgctctcaactgtgagatctcaatgacatccaagtttgatcggaagcagtatttctacccggacctccccaaggggtaccagatttctcagtttgacattcccattgccaagaagggctatgttgatttggatcttccagtggaatttggtggtgggcataggaagtttgggatcacaagggttcacatggaagaagatgctggcaaactgcttcattctgaatccggcagttactcgcaggttgacttaaacagggctggtgtacctttgcttgaaattgtctcggagccagacatgagaacagggatagaggctgctgaatatggtgctgaactgcaaaagatcgttaggtacctcggagtgagtaatggtaatatgcaggaaggttcccttcgttgtgatgtgaatgtttctgtccgacctgttggacaatcagaatttggtacaaaggtagaaataaagaatatgaactcattttctgagatcaatagggcaattgattatgagatatcccgacaaattctgctccataaagaaggtcaggctgatcaaattgtgcaagaaacccgtctatgggatgaatcttctcagaaaacttttacaatgcgaaaaaaggagggacttgccgattacagatattttcctgagcctgatcttcctgaagttgttctctctactgactatattgatgaaatcagcaagtccttgccagagcttccagaggcaaaacgtaggcggtatgagaatatgggacttagcatgcaagatgttctgttccttgctaatgatgacaatgttgctcatttctttgattctactcttgagcatggtgctgatgcaaagctggcttgcaactggatcatgggtgacattgctgctcatctaaacaatgaaaagctctccattgatgaaactaaattaacacctctggagctttctgaacttattgcatccatcaagaacggaactatcagtgggaagattggcaaagagatactggttgaactcatttccaaaggtggcacagttaagggtgtgatagaggagaaagatttggttcagatagcagatccagcagcaatcgaggcaatggtagataaagtaattgctgacaatccaaagcaacttgagcagtaccgtgctgggaaaactaagttgcaaggattttttgcgggccaggtgatgaaagcatcgaagggcaaggccaaccctgttttgttgaataaaatcctcggagagaagttaaatgccaattagttcttattgccctcacatggattaacgagcacgacatcgggtgaaatcccagaaaattatttgccggataggaaatcccttgtttgggtctggaaattattatctctactccattaaattcagaatgcgattagctctttcgtttccttgtggatattgtagaagtccagttcacaatacgcatctttgtacttgactcagctcatttgaaaaggaagcatacccgttgcatcttaagcaagcagctagtataactgaagattaaaattgc

SEQ ID NO: 16335 - protein, 546 aa, Panicum virgatum
  misc_feature: Ceres CLONE 1788655
  misc_feature (65)..(308): Pfam Name: GatB_N Pfam Description: PET112 family, N terminal region
  misc_feature (396)..(543): Pfam Name: GatB_Yqey Pfam Description: GatB/Yqey domain
  misc_feature (327)..(394): Pfam Name: GatB Pfam Description: PET112 family, C terminal region
  misc_feature: SWISSPROT Homolog: EC 6.1.1.18 Glutamine--tRNA ligase
MALTLLQGMRTPISFRSSTGLFFTVLRPRLVRFTTRVESAQATEAKAAAKSIQLVTKEAAEQKTQGFEAIIGIETHVQLSTVTKAFCSCPYNYGSQPNTTICPTCMGHPGTLPVLNEKVVECAVKLGLALNCEISMTSKFDRKQYFYPDLPKGYQISQFDIPIAKKGYVDLDLPVEFGGGHRKFGITRVHMEEDAGKLLHSESGSYSQVDLNRAGVPLLEIVSEPDMRTGIEAAEYGAELQKIVRYLGVSNGNMQEGSLRCDVNVSVRPVGQSEFGTKVEIKNMNSFSEINRAIDYEISRQILLHKEGQADQIVQETRLWDESSQKTFTMRKKEGLADYRYFPEPDLPEVVLSTDYIDEISKSLPELPEAKRRRYENMGLSMQDVLFLANDDNVAHFFDSTLEHGADAKLACNWIMGDIAAHLNNEKLSIDETKLTPLELSELIASIKNGTISGKIGKEILVELISKGGTVKGVIEEKDLVQIADPAAIEAMVDKVIADNPKQLEQYRAGKTKLQGFFAGQVMKASKGKANPVLLNKILGEKLNAN

SEQ ID NO: 16336 - DNA, 1679 bp, Panicum virgatum
  misc_feature: Ceres CLONE 1788659
  misc_feature: Encodes the peptide sequence at SEQ ID NO. 16337
gcgctgacacgcatcattaattccggaggggaaacgcacgcggtatccatccagtggctggctgagtagcgggggcgcagccgcgcaggtgcaggcgggcgagcgagctcggccatggcgagcgcgatgagcggcggcggcggcggggcgctgaagcggatgggcccgctgcgggtgcagtactacatcgtgatgggcgcggtggcggcggccgtggtgctggccacgctgcgctacatgccgggccccgccgccgccgccaccagcagcgtggtccggccgggcgcctcctccgcggcggcggcccccggcgccgaggcggaggcagaggcggatgagggggtggcggcggagagggagaagaggaagaagaagggggacggggtggtgctgttcaacttcggcgactccaacagcgasacgggcggsgtggcggcggsgakgggsrkscscakccscccgcsggagggccgggcctacttccaccaccccacggggaagctctcccacggccgcatcatcctccacttcatctgccagagcctgagcactcaccatctaagccccttcatgaatccgctggactccaacttcaccaacggcgtgaacttccccatcgcatgatccaccgccatgccatgggtcaccacattctcgctggacgtgcatgtcgaccacttcatcttcttcaaggatagatgccttgatgccatccagagaggtgagagtgcccctgttgatgacatggccttccaaactgctttatacaccatgcacatcgggcacaatgatatcaatggcgttctccacatgccctatgatgaaatgcttgccaatcttccccctgtaattaccgaaatcaagaaaaccattgagaggttgcataaaaatggcgccaggaagttctagatacactggacaggtgcgcttggttgcatgcctcacaagcttgctatgccgaaggacgacgacartggtctcgatgagcatggatgcatcgcaagcataaacaatgtttgcaagaagttcaattctttgctgagcgaagccttggatgagctgcgcttgacccttaaaaagtcggcaatcgtcttcgttgatatgtttgctatcaagtatgatcttgttgccaaccacaagaaatacgggattgagaagccgttgatgacatgttgcggccatggaggccctccttacaactacgacccgaaggaaagctgcatgacttcggataaacacctgtgcaagcttggtgaaaagttcataagctgggatggtgttcacttcaccgatgctgcaaacggcattgtggcttccaaggtgctcagcggcgagtactccattcccagggtcaagctggccagcctcgtcagcactgcaaaatctgatgattaatggtgatatggcattctaattggccctccctttggtttctcacaaggacgatgaagatggaaccactaacaaaactgacccccaaaatttaattatttcgaggtttttaccttacagccatcgttgacaaagattttctccttttcttctcctttttgtataattggggcgaatgtatagcctagggttttaatacatggtcatccttgtgtctctgttccatgtatgacttctttttttcttcttcttctgaattttggatcaataaatagagatgaatattt

SEQ ID NO: 16337 - protein, 169 aa, Panicum virgatum
  misc_feature: Ceres CLONE 1788659
  misc_feature: SWISSPROT Homolog: EC 3.2.1.51 Alpha-L-fucosidase
  misc_feature (102)..(102): Xaa is any aa, unknown, or other
  misc_feature (109)..(109): Xaa is any aa, unknown, or other
  misc_feature (110)..(110): Xaa is any aa, unknown, or other
  misc_feature (112)..(112): Xaa is any aa, unknown, or other
  misc_feature (113)..(113): Xaa is any aa, unknown, or other
  misc_feature (114)..(114): Xaa is any aa, unknown, or other
  misc_feature (115)..(115): Xaa is any aa, unknown, or other
  misc_feature (117)..(117): Xaa is any aa, unknown, or other
MASAMSGGGGGALKRMGPLRVQYYIVMGAVAAAVVLATLRYMPGPAAAATSSVVRPGASSAAAAPGAEAEAEADEGVAAEREKRKKKGDGVVLFNFGDSNSXTGGVAAXXGXXXXPXEGRAYFHHPTGKLSHGRIILHFICQSLSTHHLSPFMNPLDSNFTNGVNFPIA

SEQ ID NO: 16338 - DNA, 2229 bp, Panicum virgatum
  misc_feature: Ceres CLONE 1788664
  misc_feature: Encodes the peptide sequence at SEQ ID NO. 16339
actttccccgcctccatcgcgatctcctctcgcctcccgcgtcgcacctcgcaaaccccgcgcgcggaattcccctccgcagcaaccgccatgggcggctcccacagccgtgaggacatcgacctcacctcgtccgacgaggaggagtacgaggaggactacgactcccgatcccccatctccgagcccgccgcgagcgcgggccagcgcgacgacgacctcctccgcaccgccacccccgcgtcgctcgaggccatcgacgccaagctcagatcgcttgatctcaagtaccagcgccccaccgccgccaagctctacctccacgtcggggggtcctcgccctcagcgcgctgggtgctcgacgagcgccgcgcgacctacgccttcatcgacaaggcgagcgacgacgcctcctcccccaggtggttcctggaggtccgcccggggccgcgggtctccgcccccgtggactcggcgctccagctgaagacgaaccctgctcagcgccgggcggacttcgctgcgggcggctccgtatgggctctgcgactgcccaccgacgccgaattccgccgattcgggatggagtacgagcggtgctttttcgagaatacgtacggggtcgaggccacggatgagggccgcaaggaggtgttcggcgctgacttcgccgcgtgggcgcgccccgacgaggccgacgacgccgtttgggccgacgcgcaggaaagcctcaaccctcccgtcaccgctccagcgagggacctccttgagcagttcgaggaggaggccggcgacggcgacagcatccagagcctcgcgcttggagcgcttgacaacagcttcttggtcggcggcgctgggatacaggttgtcaagaacttccagcatggcttgcacggaaagggcgcgtcggtgaggatctcacgtggccgtggtggcagtgggaacgcctattcgacaccgaagaaggctctccttatgcgcggcgagacaaacatgctgctgatgagccctggagaggctctgcgttctaatggtgtccaccatgttgatattgaaactggaaaggtcgtggccgaatggcagttcgaaaaggatggaactgacattacaatgcgagacattgccaatgacagtaagggtgcgcagctggaacctgccggatcgacattcttggggctggatgacaaccggttgtgcagatgggatatgcgcgatgccagaggcagagtgcagactattggtagctcatcagaatcaccagtgctaaattggtcacagggccatcagttctcgcggggcactaacttccagtgctttgcaagtactggggatggttcaatcgttgttggttcagtggacggcaagataagactctattctaagagctcaatgcgtatggcaaagacagcattcccagggcttgggtccccaattacacatgtcgatgttacgtatgacgggaagtggattttgggcacaacagacacatacttgattctgatctgcaccatcttcaaggacaaggatggcaaagaaaagactgggtttagtgggcggatgggaaataggattgctgcaccaaggttgctcaagctcactccactagattcgattttagcagggactgacaacaaattccatggtgggcagttctcatgggtaacagacaacggtaagcaggaaaagcatcttgttgcaacggttggcaaattcagtgtcatatggaactttcagcaagtcaaggacagcaaccatgattgctaccgtggtcagcagggccttaagagctgctactgctacaaggtcgtcctcaaggatgaatccattgttgacagccgcttcatacacgagaagttcgcaactagtgactctcccgaggctcctctagtggttgcgacgccgatgaaagtcagctctttcagtatagcaaataggcgctagctctggcagttttgatttttcttttgtttgtgtaagatagtgtgggaagttgcagattcctgttcgtttagtggttggtttgttcgttctcatgcacggtttggttggtttccttacatggttggctgtaaagtttcttggtacaaagctgatttagcttcattgaggaagttggtaacaaattgtgcttattatcatttgttgtggatcagtcaagtggtttgcactatttgtttggtaggcatcatgtgtaaaaggatttgcatatataaaaatgtggatttc

SEQ ID NO: 16339 - protein, 617 aa, Panicum virgatum
  misc_feature: Ceres CLONE 1788664
  misc_feature (1)..(597): Pfam Name: VID27 Pfam Description: VID27 cytoplasmic protein
MGGSHSREDIDLTSSDEEEYEEDYDSRSPISEPAASAGQRDDDLLRTATPASLEAIDAKLRSLDLKYQRPTAAKLYLHVGGSSPSARWVLDERRATYAFIDKASDDASSPRWFLEVRPGPRVSAPVDSALQLKTNPAQRRADFAAGGSVWALRLPTDAEFRRFGMEYERCFFENTYGVEATDEGRKEVFGADFAAWARPDEADDAVWADAQESLNPPVTAPARDLLEQFEEEAGDGDSIQSLALGALDNSFLVGGAGIQVVKNFQHGLHGKGASVRISRGRGGSGNAYSTPKKALLMRGETNMLLMSPGEALRSNGVHHVDIETGKVVAEWQFEKDGTDITMRDIANDSKGAQLEPAGSTFLGLDDNRLCRWDMRDARGRVQTIGSSSESPVLNWSQGHQFSRGTNFQCFASTGDGSIVVGSVDGKIRLYSKSSMRMAKTAFPGLGSPITHVDVTYDGKWILGTTDTYLILICTIFKDKDGKEKTGFSGRMGNRIAAPRLLKLTPLDSILAGTDNKFHGGQFSWVTDNGKQEKHLVATVGKFSVIWNFQQVKDSNHDCYRGQQGLKSCYCYKVVLKDESIVDSRFIHEKFATSDSPEAPLVVATPMKVSSFSIANRR

SEQ ID NO: 16340 - DNA, 1608 bp, Panicum virgatum
  misc_feature: Ceres CLONE 1788666
  misc_feature: Encodes the peptide sequence at SEQ ID NO. 16341
gaaccaccctcacacgcctccttccaccgaaccggaccccgccggccgccgccctgctccgacgaagaaggtcgccgccgccgcctcctcccgggctcggatcgacatcctctccctccgtccgcaagggaacggcgatgtctacttcggtgcaatcatcgtaccttcctgctaccactgagtcgatatcaaaggctcaggaggctaaggatgcttctgagtccatctcaatcctctaccaagtgctcgaagacccatcttcttcagcagatgcagtgagagtaaaagagcttgccattacaaatctgacaaattacctcacgaaagaaaacagagctgaggacctcaggaatcttttgacccagctcaggcccttctttgcactgatccccaaggcaaagactgcgaagattgtgcgtggtatcattgatgctgttgccaagatacctggaacatctgagcttcagatctcactctgcaaggagatggtagaatggacccgtgcagagaagcgtaccttcctcaggcagcgtgtggaagcaaggctggcagcccttctgttagagaaccaggagtatactgaggcccttacgctcctttccggtctcatcaaggaagtcaggaggctggacgacaagttgcttcttgtggacattgaccttctggagagcaaactccatttctctctgagaaacctgccaaaggccaaagcttctctgactgctgcaagaaccgcagccaatgccatttatgtgccaccatctcagcagggcaccattgatctgcagagtggaatccttcatgctgaagagaaagactacaagactgcttacagctacttcttcgaagcatttgaagctttcagttctctggaggatcctaaggccatcttcagcttgaagtacatgcttctgtgcaagataatggtcaatcaagctgatgatgttgcaggaatcatctcatcaaaggctggtctgaagtatctggggcctgatgttgatgccatgaaagctgtggccgatgcctactccaaaaggtctctgaagtactttgaaactgccctccgtgactacaaagcccagctggaggaagatcctatcgtccacaggcacctctcgtctctgtacgataccctactggagcagaacctctgcaggttgattgagccttactcgagggtggagattgcacacatagccgagatgattgagctgccaatcagccatgttgagaagaagctgtcccagatgatcctcgacaagaaattcgcggggactctggatcagggtgctggctgcctcatcatcttcgaggataccaagaccgaggagatcttccctgccacactcgagacaatcacgaatgttgggaaggtcgtggacagcctttacatgagatcggccaagatcatggcttaaaatatgtggatctactgtcagtttagctgacctcacttagcgctgcatgtgacgacatttaattctgaatttgtttcctttttcttttccttggggctgtggaatgtttgagctacaattatgccatgttgcttatggacgagactgttgtttctgggtgatggaagtactgttaaagctttgatgtttt

SEQ ID NO: 16341 - protein, 426 aa, Panicum virgatum
  misc_feature: Ceres CLONE 1788666
  misc_feature (288)..(392): Pfam Name: PCI Pfam Description: PCI domain
MSTSVQSSYLPATTESISKAQEAKDASESISILYQVLEDPSSSADAVRVKELAITNLTNYLTKENRAEDLRNLLTQLRPFFALIPKAKTAKIVRGIIDAVAKIPGTSELQISLCKEMVEWTRAEKRTFLRQRVEARLAALLLENQEYTEALTLLSGLIKEVRRLDDKLLLVDIDLLESKLHFSLRNLPKAKASLTAARTAANAIYVPPSQQGTIDLQSGILHAEEKDYKTAYSYFFEAFEAFSSLEDPKAIFSLKYMLLCKIMVNQADDVAGIISSKAGLKYLGPDVDAMKAVADAYSKRSLKYFETALRDYKAQLEEDPIVHRHLSSLYDTLLEQNLCRLIEPYSRVEIAHIAEMIELPISHVEKKLSQMILDKKFAGTLDQGAGCLIIFEDTKTEEIFPATLETITNVGKVVDSLYMRSAKIMA

SEQ ID NO: 16342 - DNA, 1866 bp, Panicum virgatum
  misc_feature: Ceres CLONE 1788668
  misc_feature: Encodes the peptide sequence at SEQ ID NO. 16343
aagccaaagctcttctccatcgtatccatggacggcggcatgcgccaccaccagctcgaagcagcagcatgccaaagccagagtcttcctcctcctccccctgccggcgccagtagtttctgcggcatctccttggtcgccgccgtctgcctcttcctcgtagcagcttggtcggcgatctactgcttgcgtgtcgtgatcacctcatctaacaaggagagcctcctccacaagctcaagggctggatttccaaggaggagaagagccggcggcatcagctgggcgacaatgcgcgacggccggagccgccgggaagggggagcggctggtggtggtccgccgtggagacgctggccttcgtggccgccaacggcagcggcaggggcttctacagcttcgtccacgcgcgccaccgccggcacgggccccccggcttccgcaccgcgctcttcggcgccacccacgtcttcgtctcctcgcccgacgccgcccggtcgctcctcgccgccgagcccgccggcttctccaagcgctacgtgcgcaccgccgcggacctcctcggcgagcacagcctcctctgcgcctcccacgccgcgcaccgctccctgcgccgcgcggtcgcgcccctcttcagcgcccggggagccaccgcgtccttcgccgccgccttcgacgccctcacgctccgcctcatgcggggctgggccgcctcctcctcctcgggccgccgcggcgccggttccgtcgtggtgctcgacgccgcgctcggcgtaaccttcgaggcgatctgcgacacgctcgtggccacgctgccgcgcgacgccaagaggcagctccagggtgacgtgctggccgtgacgcgggccatgctggcgttcccgctcaggctgccgggcacgaggttccacgcgggcctccgggcgcggaagcggatcgtggaggtgctccgactagagatcgcctccagacggcgggacggctgcctgcggcagcgcggtgatcacggcggcgacgacatggacttcctgcagagccttctcctccggagccagcagcagcagcaaccggacaaggacgacgaggcgctcctcacggacgagcagatcatcgacaacattctgacgctcatcatcgccggccaggtaacaacagcgaccgcgattacatggatggtcaagtatcttgccgacagcagagatttccaagaaaccttaaggtcggttcagctgcagctggcgcccaagcaggatcaggattccctccttacgctccaacatctcagcagcatggagcttgcatacaagacggtgaaagaatcactgaggatggccagcatagtttcctggtttccaagggtagcactcgaggactgccaggttgcagggtttcagatcaacaagggctggattgtgaacgtcgatgcgaggtccctgcactatgatccgacgatttacgacaaccccaccacgtttgatccttggaggttcaacggggaggacacgaagccgccgtacagcttcctggtgttcggagcaggcgggagaacctgcttggggatgaacctcgccaagatcatgatgctcatctttctgcaccggcttgttacgaccttcagatgggagatggcagacgaggacacaagccttgagaagtgggcaatgttccctaggctcaagaacggatgccccattcaccttacacccatctgatgaaccatggatcagatcggatcagataataacttgggggatcgcgctcgtgggatcaatgaagaaagtcaagcacctaattctgtatgggaaagaatggcatgctcatgtgcatactcctaaatgctcccattcaataatacaaggaatttcttt

SEQ ID NO: 16343 - protein, 560 aa, Panicum virgatum
  misc_feature: Ceres CLONE 1788668
  misc_feature (94)..(555): Pfam Name: p450 Pfam Description: Cytochrome P450
  misc_feature: SWISSPROT Homolog: EC 1.14.13.93 (+)-abscisic acid 8'-hydroxylase
MDGGMRHHQLEAAACQSQSLPPPPPAGASSFCGISLVAAVCLFLVAAWSAIYCLRVVITSSNKESLLHKLKGWISKEEKSRRHQLGDNARRPEPPGRGSGWWWSAVETLAFVAANGSGRGFYSFVHARHRRHGPPGFRTALFGATHVFVSSPDAARSLLAAEPAGFSKRYVRTAADLLGEHSLLCASHAAHRSLRRAVAPLFSARGATASFAAAFDALTLRLMRGWAASSSSGRRGAGSVVVLDAALGVTFEAICDTLVATLPRDAKRQLQGDVLAVTRAMLAFPLRLPGTRFHAGLRARKRIVEVLRLEIASRRRDGCLRQRGDHGGDDMDFLQSLLLRSQQQQQPDKDDEALLTDEQIIDNILTLIIAGQVTTATAITWMVKYLADSRDFQETLRSVQLQLAPKQDQDSLLTLQHLSSMELAYKTVKESLRMASIVSWFPRVALEDCQVAGFQINKGWIVNVDARSLHYDPTIYDNPTTFDPWRFNGEDTKPPYSFLVFGAGGRTCLGMNLAKIMMLIFLHRLVTTFRWEMADEDTSLEKWAMFPRLKNGCPIHLTPI

SEQ ID NO: 16344 - DNA, 3095 bp, Panicum virgatum
  misc_feature: Ceres CLONE 1788670
  misc_feature: Encodes the peptide sequence at SEQ ID NO. 16345
agggctgctccttcttcgcctttcttctcactggctgttctggttcttctccacctctctttcccgctttggtttccatctgcgctctcttccatgggaagaagatgctaagcgaatttattttacaagtgtacggtcgccggaagcgagaagctggaatttttttttcttgtcctgccagattctgctgtaatcttcagggactcataattgatcgttatttccaaagatcagagtaacgtgcccgactttgtcaccttcatcctcgggggtcgctcggcagctgatgccctcgttgggggattgttgaagggataaggtcgtggcaatgagcaagccggcgcgcgtgcagcgcgcgtccccgccgcccctggttgcttcggccgccatcttgctgctattctccgcgttaccgcgctgtcagccatacacttacgagcaagatgtgtttgcgataaatggcttgtacacggcgcttggagcaccgcagctgccaaattggactacaaatggcggtgacccctgcaatgagggctggcagggtgtttcatgcgtggcctcaaatattacctccataattctcagcggtgcaaacttgggtggacagctgggtaacactttggggaatttcacatcattaatcaccttggatcttagcaacaataatattggcggaactatacccgatggtctaccagtcacaatgcagaaatttttcctttcagctaaccagctaagtggtagcctcccaagtacattgtcatcccttacacttttgacaagcatgtcactcaataacaaccaattatctggagatattccagatgtatttttagcactcactgggctcgcgaatttagatttttcttctaacaacttaaccggtccgctgccaccttcaatgggaaatttgacagcattgactagcctgcatattcagaacaatcaactaacaggaacccttgatgtgctgcaagatcttcctttccaagatttgaatgtagaaaacaatcttttgtctggtcccgtgcctgtgaagttactcaacttgccaaactttaagaaggatgggaacccattcaataccagcatagccccatccgctcagcctcctgcagcgccaacaccattaccatcagtctcacctccagctaggcatgtcccctcaaaagaaccttcaacctcttctagtgttcagggaggaagtactccaggatcaggaaaacatactgtttccacaatcaaattagttggatatatccttatcggggtggtatcagcagtagttattgtgctaatggcaatgtactgtctatccaagtgcaaagaaagaaagtcaagggatgacatttataccaaaaacaagatgggaagggtgcctcagaagcttggagagcctaaaatcaaggaagtggcagaaatcaaggagccaccagtaaaactcgagaataatgttgggaaagcttcccatgttgtttctgatgcaaaggaggagcataagttaaaaatgccaacatcagcttcaaatgcggtttatgatgcaagagatgggcggaaatcagactcaccggtagcagctgctcctgggctggttgcaatgaagcaaaaagagcatgtgattgatatggaaaaggctgataatttcgttgaggaacagctgcattctactcaacctgttgcacaacgttctgaaaaggtcatcgtcaatcccagtgttcgtactcgaaagggaagagtaccttcagttggaaaagtggacctgactactactgtcaagtccttttccattgcatcccttcaacaatataccaatagtttcagtgaggaaaatttcataagggatagcaggtttggtaagatatttctggcagagcttcctgatggagagcagttactggaagttttgaagatagatgcttttaactcaaaagtaccagtggatgcctttcttgagctagttgtgagcatttctgaactgaggcatcctaacatacttgggcttgttggatactgtgcggagtttgagcagcgactacttgtctatgagcactgtagcaagatgactctacatgatgaactccactatgtagatgactcaagcaagccattatcatggaatgctcgcctccatgttgctgtgggggcagcaaaagcattacaacatcttcatgatggtttccagccaccaattgtacatcagaattttgaaccatctgttgttcttctaaacagcaccttagttgtgcatatttctgaatctggccttgcatcattagcatcaaaatcagcatctcagttgtctggccgtagcttattccattatgaagcccctgaggtgcatgaatctggatccataagtgatcgaagtgatgtttacagcttcggtgttgttatgttggagcttctaacagggcgtaaaccttatgatagctcacgtccacgggctgaacaacatctggtgcgatgggccacttctcagctctatgatattgatgccatagcaaagatggtagatccttccattcaaggacaatgttctgaaaaggcactgtctcgttttgctgacattattagccgctgcattcagcacgaaccagaatttaggccaccgatgtctgaagttgtccaagacttaactcgcatggcaagtaatgcatcaaaggcttccatgtaggcggtccagaaggtgggttaaaaatgtgggggcctgtgcttcaaaattggaatgcaataatgcacctcattttggagtgtcatgtggttcttgccagattcattttctcccaagttgtgaagacgcacttgtaccattgatgcagtagtaggatactctggccgacgcaagaaggatggaatacagtagcaggatgcaagaatgcaccgtgctttatccattgccataattgctcctccgaatctccggtcaaatttttttagttcgaagttattgttgtaattctgtagtctgcacaatgtatttctcggctcctggttccgattccagatcactcgatgtgatcatgcatggttctctagaccatatgtaaatacaagtactgaaataaatatattagaatttgctcatgttaaagatc

SEQ ID NO: 16345 - protein, 781 aa, Panicum virgatum
  misc_feature: Ceres CLONE 1788670
  misc_feature (497)..(769): Pfam Name: Pkinase_Tyr Pfam Description: Protein tyrosine kinase
  misc_feature (36)..(76): Pfam Name: LRRNT_2 Pfam Description: Leucine rich repeat N-terminal domain
  misc_feature: SWISSPROT Homolog: EC 2.7.11.1 Non-specific serine/threonine protein kinase
MSKPARVQRASPPPLVASAAILLLFSALPRCQPYTYEQDVFAINGLYTALGAPQLPNWTTNGGDPCNEGWQGVSCVASNITSIILSGANLGGQLGNTLGNFTSLITLDLSNNNIGGTIPDGLPVTMQKFFLSANQLSGSLPSTLSSLTLLTSMSLNNNQLSGDIPDVFLALTGLANLDFSSNNLTGPLPPSMGNLTALTSLHIQNNQLTGTLDVLQDLPFQDLNVENNLLSGPVPVKLLNLPNFKKDGNPFNTSIAPSAQPPAAPTPLPSVSPPARHVPSKEPSTSSSVQGGSTPGSGKHTVSTIKLVGYILIGVVSAVVIVLMAMYCLSKCKERKSRDDIYTKNKMGRVPQKLGEPKIKEVAEIKEPPVKLENNVGKASHVVSDAKEEHKLKMPTSASNAVYDARDGRKSDSPVAAAPGLVAMKQKEHVIDMEKADNFVEEQLHSTQPVAQRSEKVIVNPSVRTRKGRVPSVGKVDLTTTVKSFSIASLQQYTNSFSEENFIRDSRFGKIFLAELPDGEQLLEVLKIDAFNSKVPVDAFLELVVSISELRHPNILGLVGYCAEFEQRLLVYEHCSKMTLHDELHYVDDSSKPLSWNARLHVAVGAAKALQHLHDGFQPPIVHQNFEPSVVLLNSTLVVHISESGLASLASKSASQLSGRSLFHYEAPEVHESGSISDRSDVYSFGVVMLELLTGRKPYDSSRPRAEQHLVRWATSQLYDIDAIAKMVDPSIQGQCSEKALSRFADIISRCIQHEPEFRPPMSEVVQDLTRMASNASKASM

SEQ ID NO: 16346 - DNA, 1634 bp, Panicum virgatum
  misc_feature: Ceres CLONE 1788672
  misc_feature: Encodes the peptide sequence at SEQ ID NO. 16347
gcgagcagagttcctgtctgacctccgaactcctccctcttctccctctccctcctccctcccttccttacttcccccaaaagttcgatcttatccctcctccttccagctccgcttccgcccgcctggatccaccctgcctcgctattaataccgcccgtggctcgtgcctccgatctccattcccaggcctttctcctcgctccgcggaggaaacgcgcgccgcttgccctgcagcccgcgctctttcctgttgccgtttttagctcgccctcggatctcgctcccgtcgcgtgcgcctgctgtgttcctgtcggcgctgctggaaaggcgggccctttcggccggccggcctctcgtgtgagccgtgatctttccttctcatccttggacccggaggaggtgccgccgccatgaacgcgctcgccgccaccagccgcaacttccggcgcgccgcgaggctgctcgacctcgaccccaagctcgagaagagcctgctcatcccgtttcgcgagatcaaggtggaatgcaccatccccatggacgacggcaagttggcgtccttcgtggggttccgcgtgcagcatgacaacgcccgtgggccgatgaaaggcggtatccgctatcaccctgaggttgatccagatgaagtaaacgcacttgcacaactgatgacatggaagacagcagttgcagcagtaccttataccacacaaccaaccacactagcactgatcgagctagctagctaccagccaagatggcggccaagcgtctggcgcttgccatcctcgtcctccttagcgtaagcatggtggccactgctgctggagcccgcaagctgggctacggtcccggaggaggaggaggcggcggtagtggtggaggtggagggggtggctatgggggatcaggctatgggtccgggtcagggtacggtgagggaggtggaagtgggggtgctgctggtgggtacggacgtggtggcggcggcggaggtggtggcggcgaaggcggtggtgctggtggctcagggtatgggtctggccaaggctctggctatggagccggcagtggtggtgctggtgggtatggaagtggtggaggcggcggaggtggtggcgggcaaggtggtggttccggctatggccatggaggtggcgaaggctatggctccggctccggctatggaggtggtgctagtggtggtggtggcggcggtgggcatggtggcggtggtggtggtggccaaggtgggtcgggttatggctccggctccgggtacggatcaggtgaagggtatgggcagggtggagctcatggaggaggctatggcagcggcggcggtggtggcggcggccaaggtggtggctctggctatggctccggatccggctctgggtatggctctggtggtggacacaactaagctcagattcagaggcaactacagagtatatagctacaaatgtatcatcagtggtgcgtttgtctcatgttatacagaaaactgcttatttgagtgtgtaacactaaaagcttgtttgacagtatacatgtaatgttgtactcagcttgccgctttatctaattggcaagggctaaggaataaataaaccaatcttttggctcgg

SEQ ID NO: 16347 - protein, 222 aa, Panicum virgatum
  misc_feature: Ceres CLONE 1788672
  misc_feature: Useful for making plants with modulated nitrogen use efficiency
  misc_feature: The sequence is a functional homolog of SEQ ID NO 1086 in the 10/225,066 US patent application
  misc_feature: The sequence is a functional homolog of SEQ ID NO 1436 in the 10/666,642 US patent application
  misc_feature: The sequence is a functional homolog of SEQ ID NO 1700 in the 11/479,226 US patent application
  misc_feature: The sequence is a functional homolog of SEQ ID NO 2096 in the 10/374,780 US patent application
  misc_feature: The sequence is a functional homolog of SEQ ID NO 860 in the 10/412,699 US patent application
  misc_feature: The sequence is a functional homolog of SEQ ID NO 952 in the 11/435,388 US patent application
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: Useful for making plants with altered lignin content
  misc_feature: The sequence is a functional homolog of SEQ ID NO 110 in the 10/225,066 US patent application
  misc_feature: The sequence is a functional homolog of SEQ ID NO 128 in the 10/666,642 US patent application
  misc_feature: The sequence is a functional homolog of SEQ ID NO 136 in the 10/374,780 US patent application
  misc_feature: The sequence is a functional homolog of SEQ ID NO 44 in the 11/375,241 US patent application
  misc_feature: The sequence is a functional homolog of SEQ ID NO 850 in the 11/435,388 US patent application
  misc_feature: Useful for making plants with altered alkaloid content
  misc_feature: Useful for making plants with altered terpenoid content
  misc_feature: Useful for making plants with modulated phosphate use efficiency
MAAKRLALAILVLLSVSMVATAAGARKLGYGPGGGGGGGSGGGGGGGYGGSGYGSGSGYGEGGGSGGAAGGYGRGGGGGGGGGEGGGAGGSGYGSGQGSGYGAGSGGAGGYGSGGGGGGGGGQGGGSGYGHGGGEGYGSGSGYGGGASGGGGGGGHGGGGGGGQGGSGYGSGSGYGSGEGYGQGGAHGGGYGSGGGGGGGQGGGSGYGSGSGSGYGSGGGHN

SEQ ID NO: 16348 - DNA, 257 bp, Panicum virgatum
  misc_feature: Ceres CLONE 1788673
  misc_feature: Encodes the peptide sequence at SEQ ID NO. 16349
gtgctctctcagaggtgggttggcttctcctccccctcttacccagtcctcggctctagggttttactgcgaagggagatggccgcggcggatgtggatgtacccctgcttcctcctgcccctcgccgtggcccccggtgcacgccgtccaggctgcaggcggcgagggcgatggcgtcgtccctgttcggccacgtcgagccggcgcccaaggaccccatcctcggcgtcaccgaggcctacctcgcgcacccctc

SEQ ID NO: 16349 - protein, 59 aa, Panicum virgatum
  misc_feature: Ceres CLONE 1788673
  misc_feature: SWISSPROT Homolog: EC 2.6.1.1 Aspartate transaminase
MAAADVDVPLLPPAPRRGPRCTPSRLQAARAMASSLFGHVEPAPKDPILGVTEAYLAHP

SEQ ID NO: 16350 - DNA, 637 bp, Panicum virgatum
  misc_feature: Ceres CLONE 1788673-R
  misc_feature: Encodes the peptide sequence at SEQ ID NO. 16351
cctgttcatggtgcactagttgtttctataatcctcagtgatccagaattgaagagtttatggttaaaagaggtcaagggtatggctgatcgtatcattggaatgcggacggcacttaaggaaaatcttgaaaagctaggttcacctttgtcatgggagcacatcactaatcagattgggatgttctgctacagtgggatgacaccagaacaagttgaccggttgacaaatgaattccatatttacatgacccgcaacgggaggataagcatggctggtgtaacgacaggaaatgttcaatacttggcaaatgctattcacgaggttaccaaaccgaattgagtttggccctcctaccctcgtcggccgatgaaatgaggctttcaagtggcttttttttgtgcctgacatatcaacattatcattcttgagaagtaagttcaagcctgtttgggctgccccagagcgaatctcacatgtacgagagtcatgtacgagagttatagatgtgatgaaacttcaatcttgagagctacatgatcctgtttcttttctttttctttcttttttcccatcttgtcatggcaatttttacacttagctgcaaatggttgtagcatgatctacagttctgaag

SEQ ID NO: 16351 - protein, 113 aa, Panicum virgatum
  misc_feature: Ceres CLONE 1788673-R
  misc_feature: SWISSPROT Homolog: EC 2.6.1.1 Aspartate transaminase
PVHGALVVSIILSDPELKSLWLKEVKGMADRIIGMRTALKENLEKLGSPLSWEHITNQIGMFCYSGMTPEQVDRLTNEFHIYMTRNGRISMAGVTTGNVQYLANAIHEVTKPN

SEQ ID NO: 16352 - DNA, 680 bp, Panicum virgatum
  misc_feature: Ceres CLONE 1788683
  misc_feature: Encodes the peptide sequence at SEQ ID NO. 16353
gtccactccgtcgcccccaccaacctcgccgccgccgccgccgccgctccccccgccgacccgtaccccttgacagcatggcctcgccggcgccggcgacccccgcggccgccgcggcccactcccctcccccgcgcatcgggctcgcgggcctcgccaccatgggccagaacctcgcgctcaacatcgccgagaaggggttcccgatctccgtctacaaccgcaccgccgccaaagtggactccacgctcctccgcgcgcgcgacgagggcgcgctcccggtgctcggacaccgcgacccgcgcgggttcgtgctctccctctcccgcccccgcaccgtcgtgctgctcgtgcaggcgggccctgccgtcgacgccaccatcgacgccctcaccccctacctcgagcccggcgatgccatcgtcgacggcggcaacgagtggtaccagaacacggagcaccgcatcgaggaggccgcggcgcgcgggatcctgtacctcgggatgggcgtgtccggcggggaggagggcgcgcggaacgggccctcgctcatgcccggcggccacgttgacgcctacaacaacatcagggacatcctcgagaaagccgcggcgcagacggaggatggggcgtgcgtcaccttcgttgggcccggtggggccggcaactttcgtcaagat

SEQ ID NO: 16353 - protein, 200 aa, Panicum virgatum
  misc_feature: Ceres CLONE 1788683
  misc_feature (18)..(192): Pfam Name: NAD_binding_2 Pfam Description: NAD binding domain of 6-phosphogluconate dehydrogenase
  misc_feature: SWISSPROT Homolog: EC 1.1.1.44 Phosphogluconate dehydrogenase (decarboxylating)
MASPAPATPAAAAAHSPPPRIGLAGLATMGQNLALNIAEKGFPISVYNRTAAKVDSTLLRARDEGALPVLGHRDPRGFVLSLSRPRTVVLLVQAGPAVDATIDALTPYLEPGDAIVDGGNEWYQNTEHRIEEAAARGILYLGMGVSGGEEGARNGPSLMPGGHVDAYNNIRDILEKAAAQTEDGACVTFVGPGGAGNFRQ

SEQ ID NO: 16354 - DNA, 694 bp, Panicum virgatum
  misc_feature: Ceres CLONE 1788683-R
  misc_feature: Encodes the peptide sequence at SEQ ID NO. 16355
aatgcatcgaaaatttgtagctatgcgcagggcatgaatttgatacgagccaagagcgaggagaaaggatggaaccttaaccttgcggagcttgcccggatttggaagggtgggtgcattatccgtgcgaggtttcttgataggatcaagagggcctatgacaggaaccctgagctggccaatttgatcgttgaccgagagtttgcaagggagatggtgcagcggcagaatgcatggagatgggttgtggcacgggcagtggaggctggcattagcactccaggaatgactgctagtctttcctactttgatacttacaggtccagtcgattgcctgcaaatctgatccaagcacagagggacctgtttggtgcgcacacctatgagcgaatcgaccgttcgggttcattccacactgaatggaccaagctggcaaggaggagcaatggtgcagccatttgaggacttggtctcagcagagctgtcagttactctgggtgatatctctttgtgggttctccttcatttcaatattgttgtctttatggtcctagatctgagttgtgtacttcgaataatgatgtattgtgctgtttgcacatggagaacattgtgtagcttcagttttactttggtctaggtacacccagtttaatgtacttaattttggtatggaataactataatgcctctc

SEQ ID NO: 16355 - protein, 153 aa, Panicum virgatum
  misc_feature: Ceres CLONE 1788683-R
  misc_feature (1)..(142): Pfam Name: 6PGD Pfam Description: 6-phosphogluconate dehydrogenase, C-terminal domain
  misc_feature: SWISSPROT Homolog: EC 1.1.1.44 Phosphogluconate dehydrogenase (decarboxylating)
NASKICSYAQGMNLIRAKSEEKGWNLNLAELARIWKGGCIIRARFLDRIKRAYDRNPELANLIVDREFAREMVQRQNAWRWVVARAVEAGISTPGMTASLSYFDTYRSSRLPANLIQAQRDLFGAHTYERIDRSGSFHTEWTKLARRSNGAAI

SEQ ID NO: 16356 - DNA, 1933 bp, Panicum virgatum
  misc_feature: Ceres CLONE 1788689
  misc_feature: Encodes the peptide sequence at SEQ ID NO. 16357
agaagaaactttgcagggcccaaatcaaaaccgcctcgctgcgccccgtgtgtactcgccgccgtcctatcctctaccacctcctcgctctccccaacaagcaaccctaatccgtggccacggacccgccgcaagctccttccctcgaattggttgggaattcaatcgaggctgcgcgggaatcggtggtgctcgtgattcaacccccacacctgaaacctcgctgttgttgctgcggtgtaggtgatgagatcttgcggagcgcgcctcgcccggtcctaagatgctggctggctacggcggtggtggccgcggcgtccatctctcctcccacaaggacctcctcctaggccgcggcggccggagcttcctcttcggcaacacgtggttcctcctttccacctacccggcgcgcctcctgcacaccacggaccgccgcgcgcccgccgccttctttgccgcgatcaaccgggccccctgcgtccgctcgcactgcgcggggcagggcctgctacagagaggtggcattgtaatggccgcctgtggctatgctcttcggcgagctgagctgggtgccaccaagcgccaaccggacaaggatccatctccagggacacgcacctcgcgtattgcggccatgggatccgcggggagtgcacctcggccagatgtcactttcaggtatagaggggtggagtcttgtaagaagtttggtgcaagcttgaagtgccgtgagccctgggggaataggtcattctggacaaatgcagttgggccaagatggaaattgagctttgcagttgagccatgggctagggacttcagctcgtcatgtgtggcaccatattctgccggagctacagagcatcaattgtcactcgatgagaagatggataactcaaccgtcgcatctgatggaaaggcacctacttctgaaaatttgaagctggtctcaggctcttgttacttgcctcaccctgccaaagaggcaactggcggtgaggatgctcattttattagcactgatgagcatgtgattggcgtagcagatggtgttggtggttgggcagatcttggtgttgatgctggactgtatgctaaggagctcatgagaaattccgtaagtgctatcaaggatgagccagaaaggaccattgatccatcaagagttttagaaaaggcttatacgagcaccaaagcaaggggatcatctactgcttgtatcatcactcttaaaaatcagggtatccacgctgtgaatcttggggacagtggcttcgtagtagtcagagatggtcgcactgttctcagatcaccttcacagcaacatgatttcaattttacttatcagcttgagagtgggggtggcagtgatcttccaagttctgctcaggtatttcactttccggttgctcctggtgatgttattgttgctggcacggacggtctttttgacaatttatacaacaatgagattagtggtgttattgttgaagctctcagggttggacttgaaccccaagtcgcagcacagaaaattgctgcccttgctcgacaaagagcaacagataagaacaggcaatcaccatttgcagcagctgctcaagaagctgggtaccggtactacggtgggaaacttgatgatatcacagtcgtggtctcatatgtgaagagcgcctgagccgcaggatgtgagcctttcttttggatgtaatgtacataaatcctgtcccgaacttatggcacgtgtatgcactggggcgtagaagcatattaggtgtgaaatcccctgatcccgagaagcacttgtgctggatttagcatggttgcgctttagccctggaagatgttagaaaaccattatgccattttactctctgttgctgcgtggaaaagataattctctgaaacctggatgggttccttttcctcc

SEQ ID NO: 16357 - protein, 465 aa, Panicum virgatum
  misc_feature: Ceres CLONE 1788689
  misc_feature: SWISSPROT Homolog: EC 3.1.3.16 Phosphoprotein phosphatase
MLAGYGGGGRGVHLSSHKDLLLGRGGRSFLFGNTWFLLSTYPARLLHTTDRRAPAAFFAAINRAPCVRSHCAGQGLLQRGGIVMAACGYALRRAELGATKRQPDKDPSPGTRTSRIAAMGSAGSAPRPDVTFRYRGVESCKKFGASLKCREPWGNRSFWTNAVGPRWKLSFAVEPWARDFSSSCVAPYSAGATEHQLSLDEKMDNSTVASDGKAPTSENLKLVSGSCYLPHPAKEATGGEDAHFISTDEHVIGVADGVGGWADLGVDAGLYAKELMRNSVSAIKDEPERTIDPSRVLEKAYTSTKARGSSTACIITLKNQGIHAVNLGDSGFVVVRDGRTVLRSPSQQHDFNFTYQLESGGGSDLPSSAQVFHFPVAPGDVIVAGTDGLFDNLYNNEISGVIVEALRVGLEPQVAAQKIAALARQRATDKNRQSPFAAAAQEAGYRYYGGKLDDITVVVSYVKSA

SEQ ID NO: 16358 - DNA, 1506 bp, Panicum virgatum
  misc_feature: Ceres CLONE 1788694
  misc_feature: Encodes the peptide sequence at SEQ ID NO. 16359
cttctcgtctctctcatcggcggcggtggtatcccctcacctcttctccccgcaagggtcgcaagacccggtgtgtcggcgtgccagcgcctccacccgtctgacggtagccggcggcggagcagcagtgccttctccttcaacgggcaacacgcccacacgcaacaaggccgctccttcggcaccgcgagctatctcctcccttcgctcgcccagcgccgccgccctccacgtggtcggcccgtgcgcccccgtccaccctcccctgcccagctgcagctcgactccggctggtgcggcagcatcctcccttcccacgactactccgttctttctctcggcctcggtcttcctttcctcgcggcgacgacagggcgagttgcgctgcccgttgttcgtcgagcgacaggcgcttcgccggcgacgagcatccgacagggtatatgaccatgtcctatactgggtccgctcctgtgaaccagcacaaggaggaggatgccttgagaggtcgcgcggtcaaaaaccagaaggcaatatgggacaagaccctggagatgagattcctgctgcagaaggcattttccacttctaacaagctgccccaggaacccatcaaaacaaggttttgcaaccatgataagcagatagagcaagcctatgaggacttgctgaattcatcaaagcagactctggcaagcatgacagaactgcaggaggctttgatggagagtaaccaggctgtaaaggatgctgatgaaattccttctgcctccaatggagagaatgacgagtggtcagaagtacagagattgcagacaaggataacaacatttagaaatacagagatcgataaatggcagaggaaaatacaggtgacgacgggtgctgctgcactgaaaggaaagctacattcatttaatcagaacataagtgaccaagttgctggttacatgagagatccaagccgaatgattaacaggatgtacttgaccaaatctgctgttggtgtatttggagaggatgcgggagaacctggagcagctgaggaggggcgcattgtggaaggtgatcctgaacttattgatgattctgagttttatcaacaacttctcaaggagtttctcgagtcatgtgatagaggatcatcagactcagcattttacgctctgcaaaaacagcaggtgaaaaagagaaagcttgttgatcgccgcgcttcaaagagcagaaagataaggtatcatgttcacgaaaagatcgctaatttcatggccccggtacccatggctgttcctccaatggctccgaagttgtttgagaatttgtttggcacgagcaactagaaatccaccaaagcatgaattcaaatttcacataacatgtagcgatttttgtaatttaaaattgtagcatactagcatgtatgatgttgctgtagacttgaaactgtgaatcgaacattttcatgatctgatcagttttgtgcatcgacaagcaaatgtaaggcgc

SEQ ID NO: 16359 - protein, 296 aa, Panicum virgatum
  misc_feature: Ceres CLONE 1788694
  misc_feature (217)..(292): Pfam Name: TRAUB Pfam Description: TRAUB (NUC102) domain
MSYTGSAPVNQHKEEDALRGRAVKNQKAIWDKTLEMRFLLQKAFSTSNKLPQEPIKTRFCNHDKQIEQAYEDLLNSSKQTLASMTELQEALMESNQAVKDADEIPSASNGENDEWSEVQRLQTRITTFRNTEIDKWQRKIQVTTGAAALKGKLHSFNQNISDQVAGYMRDPSRMINRMYLTKSAVGVFGEDAGEPGAAEEGRIVEGDPELIDDSEFYQQLLKEFLESCDRGSSDSAFYALQKQQVKKRKLVDRRASKSRKIRYHVHEKIANFMAPVPMAVPPMAPKLFENLFGTSN

SEQ ID NO: 16360 - DNA, 2161 bp, Panicum virgatum
  misc_feature: Ceres CLONE 1788724
  misc_feature: Encodes the peptide sequence at SEQ ID NO. 16361
acttgcactcgcgctcgcgtcgctgctctggttctcgacccccaagcgacgccacccccacgtccggacccgccgttcctccgaggaaatggctgcacttcaaccctcattttcatcaacaatggctctgaggagcagcggcagcaatcttaagttccccaaaactgcacttctacctggttttggtggcatttcacgtcaagacatgcaagacaggaatgctagcttcgcttgtttaatccccaaggttgcttcggtaactgatcagtcaatagcagaaccatcaaaacccaggaaaaataagcacacagtcgaccctacagcaccagaatttctgccactcccatcatttgaagaatgctttccaaggagtaccaaagaatcaagtgaaatcgttcacgaggaatctggtcatgtcctcaaggtcccattccgaagagtccatttgactggagatcagaagcactttgacacatatgacacaagtggtcctcaaaatataagcccaaggactgggctcccaaagataaggaaggaatggattgataggagggaaaagctgggtagtcctcgttacacgcaaatgtattatgctaaacagggaatcataacagaggagatgatatactgtgccaagcgtgagaaccttagtcctgaatttgtccggacagaagttgcccgaggacgagccataattccttccaacaagaggcacctggaattagaacccatgattgttggaagaaacttccttgtaaaggtgaatgcaaatattgggaattcagctgttgtgagctccatcgaggaggaagttcacaagctccagtgggccacaatgtggggagctgatactgtcatggatctttcaactgggcaacatatccatgagactcgggaatggattattcgtaactctccagttcctattgggactgttcctatttaccaagcacttgagaaagtaaatggtattgcagaaaatctgagctgggaaatctttagggataccttgattgaacaagctgagcagggtgttgattacttcacaatccatgctggtgtcctgcttcgttacattcctcttacagcaaagagaatgactggcatagtttcgcgtggcggctccattcatgcaaaatggtgcttaacttatcacaaggagaactttgcttatgaacactgggatgacattcttgacatatgcaatcaatatgatgtggcgttatcaattggtgatggtttgaggcctggttctatttatgatgcaaatgatagtgctcagtttgcagagctgttgactcaaggggaactaacacgtcgagcatgggcgaaagatgtgcaggtgatgaatgaaggcccagggcacatcccaatgcataaaattcctgaaaacatggagaaacagctggaatggtgtaatgaggcacctttctatacgttgggtccactgacaactgatattgcacctggttatgatcacatcacctcagccattggtgctgccaacattggagctcttggcactgcactcctttgttatgtaacaccaaaggagcaccttgggctgcctaatcgttatgatgttaagacaggtgttatatcctacaaaattgctgctcatgctgctgatttggcaaagggtcatccctatgcacaagcttgggacgatgcccttagcaaggcaaggtttgagtttagatggctcgatcaattcgctctatcgctagacccagtaactgccatgtctttccatgatgaaacattgccatctgagggtgccaaagttgcgcatttctgctcaatgtgtgggcccaagttttgttcaatgaaaatcacagaggatattagaaagtatgcggatgaacatggctacggaacagtagaggaagctgtgaaggaagggatgaatgctatgagtgctgaatttttggctgcaaggaagacaattagcagggaacagcatggtgaagctggaggggagatctacgtaccagaaagctatgcagctcacaaatgagatctcctcagagccacccaacgaagcagatttgctggctagggccttcggcagcagcaattctaccatcttatgttaggagatggtaagcagtatgtgaatgccattatggattgtaataaaaggaaactccgttccgtgtcc

SEQ ID NO: 16361 - protein, 642 aa, Panicum virgatum
  misc_feature: Ceres CLONE 1788724
  misc_feature (164)..(587): Pfam Name: ThiC Pfam Description: ThiC family
  misc_feature: SWISSPROT Homolog: EC 2.5.1.3 Thiamine-phosphate diphosphorylase
MAALQPSFSSTMALRSSGSNLKFPKTALLPGFGGISRQDMQDRNASFACLIPKVASVTDQSIAEPSKPRKNKHTVDPTAPEFLPLPSFEECFPRSTKESSEIVHEESGHVLKVPFRRVHLTGDQKHFDTYDTSGPQNISPRTGLPKIRKEWIDRREKLGSPRYTQMYYAKQGIITEEMIYCAKRENLSPEFVRTEVARGRAIIPSNKRHLELEPMIVGRNFLVKVNANIGNSAVVSSIEEEVHKLQWATMWGADTVMDLSTGQHIHETREWIIRNSPVPIGTVPIYQALEKVNGIAENLSWEIFRDTLIEQAEQGVDYFTIHAGVLLRYIPLTAKRMTGIVSRGGSIHAKWCLTYHKENFAYEHWDDILDICNQYDVALSIGDGLRPGSIYDANDSAQFAELLTQGELTRRAWAKDVQVMNEGPGHIPMHKIPENMEKQLEWCNEAPFYTLGPLTTDIAPGYDHITSAIGAANIGALGTALLCYVTPKEHLGLPNRYDVKTGVISYKIAAHAADLAKGHPYAQAWDDALSKARFEFRWLDQFALSLDPVTAMSFHDETLPSEGAKVAHFCSMCGPKFCSMKITEDIRKYADEHGYGTVEEAVKEGMNAMSAEFLAARKTISREQHGEAGGEIYVPESYAAHK

SEQ ID NO: 16362 - DNA, 1498 bp, Panicum virgatum
  misc_feature: Ceres CLONE 1788732
  misc_feature: Encodes the peptide sequence at SEQ ID NO. 16363
tcctctccacagactactctcgcgcacgccaccgccgaccagcgccgcccaagccgcctccgttcgcctggccgggccgccggggccgagcgcgcccgtccagcttcccccggtgcttagccgcctcgaattccaatctaccagcagtagcctccctccccctccgctctatcgcgatggcgtcgagtggggatgcgcccggatctaccgatgagaagaaagcctcaaaaccagaaggatcatccattgagcgccaaggggttcctccagcaagcttttcgaatcctttcgactttgcttctatgcaaaatttgctcaatgatccatctattaaggagatggcagatcaaattgcaaaggatcctgcattcaaccagatggctgagcagctacagaaaagtgctcagagtacaggagaacagggaatgcctccattggaccctcaacagtacatggaaacaatgcaaaaggtcatggaaaacccccagtttatgacaatggctgagcgtctggggaatgctcttatgcaggatcctgctatgtccagtatgctggaaacctttagtagtccatcacacaaggagcagctggaagagcgtatgtcccgcattaaggaagatccagctttgaaatcaattatagatgagttagagaatggggatcctgctgcaatgatgaagtactggaacgaccctgatactcttcaaaagattggccaggcaatgggaggtagcttcccatttggtgctggttcttctgctgaaccttctggtgctgaagaaactggggaaggtggagatgaagatgaatccatcgtccatcacacagccagtgttggtgatgacgagggtctgaagaaggcactggatggtggagcagacaaggatgaagaagactccgagggaagaagagccttacattttgcatgtggatatggggagttgaagtgtgcccatgtccttcttgaggccggtgcagcagtggatgctttggataagaacaagaacaccccgctgcattacgctgctggctatgggcgcaaggagtgcgtcgatcttctcttgaagcatggtgctgccgtcacgctccaaaacctggatgggaagacgcccatcgacgttgccaagctcaacaaccaggatgaggtcctcaagttgctcgagaaggacgccttcctttaaatcccatggctctcatagacacatagacagttggttccagtatggtcatgtttcacatctgttgactttgctttgctcggatggtcaatactcgtatcagcatttatctgttctgtaagatttgctatctggtctagctggctcttagcctgctgcaattcgtgatacagtgaagggggcagctattagaactactgccctgttatgttgtcacggtggcttgtgtacccctttctttatttccgttgttttcacgattgaaatcgggattgttaatattactctgttatatatgtttcatgccgacattgaagctg

SEQ ID NO: 16363 - protein, 334 aa, Panicum virgatum
  misc_feature: Ceres CLONE 1788732
  misc_feature (275)..(307): Pfam Name: Ank Pfam Description: Ankyrin repeat
  misc_feature (242)..(274): Pfam Name: Ank Pfam Description: Ankyrin repeat
  misc_feature: SWISSPROT Homolog: EC 2.7.11.1 Non-specific serine/threonine protein kinase
  misc_feature: The sequence is a functional homolog of SEQ ID NO 1839 in the 10/374,780 US patent application
MASSGDAPGSTDEKKASKPEGSSIERQGVPPASFSNPFDFASMQNLLNDPSIKEMADQIAKDPAFNQMAEQLQKSAQSTGEQGMPPLDPQQYMETMQKVMENPQFMTMAERLGNALMQDPAMSSMLETFSSPSHKEQLEERMSRIKEDPALKSIIDELENGDPAAMMKYWNDPDTLQKIGQAMGGSFPFGAGSSAEPSGAEETGEGGDEDESIVHHTASVGDDEGLKKALDGGADKDEEDSEGRRALHFACGYGELKCAHVLLEAGAAVDALDKNKNTPLHYAAGYGRKECVDLLLKHGAAVTLQNLDGKTPIDVAKLNNQDEVLKLLEKDAFL

SEQ ID NO: 16364 - DNA, 1263 bp, Panicum virgatum
  misc_feature: Ceres CLONE 1788736
  misc_feature: Encodes the peptide sequence at SEQ ID NO. 16365
gcaaacatcctcacaaacatcttatctcccgaggccggagaattgggattcccctcctcctccgtccttgtgtttcttcgccggcgcgccggggccatggctaggaagtgctctagctgtggcaacaatggccacaactcgaggacctgcagcgggcacggcggcagggtctcggagcacgccgccggcggcgccggggtgagactgttcggggtgcagctgcacgtggggccctcgtcgtctcccttgaagaagtgcttcagcatggagtgcctctcgtccgcggcgcccccgccggcgtacttcgcggccgccctcgccgccagcagctcctcgccgtccgtgtcgccggcgtcgtcgctcgtctcggtggaggagaacgccgacaaggtgaacagcgggtacctctcggacgggctcatgggcagggcgcaggagaggaagaagggagttccatggacggaggatgagcaccggaggttcctggcagggctggagaagctcggcaagggcgactggcgaggcatctcccggcacttcgtgacgacgcggacgccgacgcaggtggccagccacgcccagaagtacttcctccggcagagcagcctcgcgcacaagaagcggaggtccagcctcttcgacgtggtcgagaacgccggcggcagggcggcgaggttggagccggacgcggagctcccggctctgtccctcggtctcagcaggccggcgaagcccgagcgcgtcctcctgcctccgagcctatcgtccctgctgccgcggtgctcggcggcaacgagcagcggcagcacgtcgcccggcggaatcacggcgccgaagcacaagcactcttcgtcgtccctgacgccggtgtcgaagcctcatcaggcgccggacctggagctgaagatctcgaccgccgaccaccaggccggctcgtcgccgaagacgcccttcttcgggaccatcagggtcacataaccggaaagacgagatcgacgacgatcggtacggcgggaacatccatccgttgctagaagatcgagcttgtgctgatccggagaagatgaagaaagggagggggagcagggaaaggatcggaggaagcttttggtagtggtgtattgtgtgtgtcgccggcgacacgatgccgccgccggcgtccgcgcgtccgtcctgtcccgttgatgtactatcatcagaagatgaaactttactggcctaattttagacgtgcaaataaagaggggctgctgccttgttgtc

SEQ ID NO: 16365 - protein, 293 aa, Panicum virgatum
  misc_feature: Ceres CLONE 1788736
  misc_feature (118)..(165): Pfam Name: Myb_DNA-binding Pfam Description: Myb-like DNA-binding domain
MARKCSSCGNNGHNSRTCSGHGGRVSEHAAGGAGVRLFGVQLHVGPSSSPLKKCFSMECLSSAAPPPAYFAAALAASSSSPSVSPASSLVSVEENADKVNSGYLSDGLMGRAQERKKGVPWTEDEHRRFLAGLEKLGKGDWRGISRHFVTTRTPTQVASHAQKYFLRQSSLAHKKRRSSLFDVVENAGGRAARLEPDAELPALSLGLSRPAKPERVLLPPSLSSLLPRCSAATSSGSTSPGGITAPKHKHSSSSLTPVSKPHQAPDLELKISTADHQAGSSPKTPFFGTIRVT

SEQ ID NO: 16366 - DNA, 667 bp, Panicum virgatum
  misc_feature: Ceres CLONE 1788736-R
  misc_feature: Encodes the peptide sequence at SEQ ID NO. 16367
agttgacacatggcaaatgaaatgtgaacaacagctgacagacattgaactagcaagtaaacaaaaggctgtatttgaaagcctgaaggctggaaatgctgcccttaagtctatacagaatgagataaacattgatgatgtccaaaagctgatggatgatacagccgaggctaaggcttatcaagatgaaataaatgctgttctaggcgagcagctatcggctgaggatgaagaagctgttatggttgagtttgagaatttggaagctcagcttgccgtcgagtctttgccagacgctcctgttactgaagtacggcctgaagagaaaatgaaagcaccagctgacacagaagctgcatctgaggacattgatgaggttattgagcttcctgatgtgcctacgaaagtgccagagagaccagaagctcctgaaaaaacgaaagttttggaagagccgctacctgcatagtggatggagctgagatgaatagggcactctcggtttgcagttgtaacatacccatcatttcattgtactaccccattttcagccatctcagaattttattctgtacagcatgaaaaaaaaagttgttgctctagactattgattattgccaggttggatttggcagtctccatttatagtacataatgttttggatgc

SEQ ID NO: 16367 - protein, 155 aa, Panicum virgatum
  misc_feature: Ceres CLONE 1788736-R
  misc_feature (1)..(104): Pfam Name: Snf7 Pfam Description: Snf7
VDTWQMKCEQQLTDIELASKQKAVFESLKAGNAALKSIQNEINIDDVQKLMDDTAEAKAYQDEINAVLGEQLSAEDEEAVMVEFENLEAQLAVESLPDAPVTEVRPEEKMKAPADTEAASEDIDEVIELPDVPTKVPERPEAPEKTKVLEEPLPA

SEQ ID NO: 16368 - DNA, 2240 bp, Panicum virgatum
  misc_feature: Ceres CLONE 1788743
  misc_feature: Encodes the peptide sequence at SEQ ID NO. 16369
ggcccagtggttgcctcttcgttccccactcctgcggcctctgagctccgaaccgagccgagccgcccacgagtcccccgcccccgcgcatctcgtggcgagccccacgaccgcctccgcccccgctccggaccgagatccccaaccgccgcgcgagggcgcgcgccctgcctgcacggcatgccggccgagccccgctccggttaaacccctcgccaagctccccattttatggcgctctcccgcgggcgcgcgcgcgctgcccccgccgccgtccccagcgtctgcttcctcctgctcctcctcacctcctcctccctcccctccgcccccggccgcgacggcgactcctccacctccaccgccccggccagcggcgcggttctcggtgtcacaacgtcgtcgtcgtcctccgggaaggggcaggggaacgactgcgcggagctgcagtccatcgacggcggggcggcccgttgcgcctacctccgcgcgcactccccctgctccccggcgaggtacgtggactacctccgcctcttctactgcggcttcgccggcgcgccggcggcggcgtgtgccgcgctcgcgctgtggctcgcggtgctcttctacctgctgggcgacaccgcgtccgagtacttctgcgcgtcgctcgagggcctctccgcggcgctgcgcctgccccccgccgtcgcgggcgtcacgctgctctcgctcggcaacggcgcgcccgacgtgttcgccagcgtcgtctcgttcgccgcgggcgacggcggcggggtcgggctcagcagcgcgctcggcggggcgctgttcgtgtccaccgtcgtcgcgggcgccgtcgcgttcgccgtgggggcccgcggcggggtggtcgtcgagtggcgcggcttcgtgcgcgacctctgcttcctcctcctcgcgctctgctacctgctcaccgtgcttgtcaacggcgcggtcaccgtctgggtggccgtgtcgttcgtctcgctctacgtcggctacgtcgtcatcgtctggacctcccactgctgcgccgagcagggcaagccgccggccgccgggctcgccgcgccgctcctcctcgatgaggaggactacggcgacgacgtcccgtccctgccgtcccactccaagacacagtcggcggcatctggtgccgcaccaaggggaagagcctggctgcattgcatcgcgcgcgcgctctgcatgccgctgtacctcccgcgccgcctcaccatcccggacatcgccgcgcaccgctggtcccgcccctacgccgtcgcctccgccgcgctggcgccggtcctcctcgccttcacctggacctcgcagcgccaccacctggtgtcctcctcccaccggcaacacagcctcccggtgctccttggcggcgccatcctcgggctcctgctcgcggcgctcgccgctgccaccacggacgccgggtcccctccccgcgggcgcaagcgccgcgtgctgtggctcgccgcggggttcctgatgagcgtgctgtgggcctacaccctggcccgcgagctcgtggcgctcctggtggccatggggtacgtggccggcatcaagccgagcgtgatgggcgtgacggtgctggcgtggggcgactccctgggcgacctggtgtcgaacgtggcgatggcggtgcacggcggccccggcggcgcgcagacggcggtgtccgggtgctacgcgggcccgctgttcaacacggtggtggggctgggcctgtcgctggcgctggcggcgggcgcgcagcacccggcgccgttcgtggtgcccgcggacacggcggcgtacgaggcggtggggttcctgggcgcggcgctggcgtgggcgctgttcgtggtgcccgtccgggggatgcgcatcgaccgcgtctacggcgtcgggctcctcgccatctacctctgcttcttcgccgtgcgcgtcttcgaggccctggggctctggacctagaggagagtcgagagagcaccgcgcgccatcacagcgtcgtttgtttcttgctaatgatcgccgttgtagagaagcgtcaggctgggtaattggtagttctagattggtagtaaattatagtaaggtgaaagataggtaatcctgtgtatattactgtagcatatggtaggcgctagcactactccacacgtaggtgttggttttagtgtcgtgtccgagaatttgtttctttcccccctcctgttttggcaggggttctgacc

SEQ ID NO: 16369 - protein, 581 aa, Panicum virgatum
  misc_feature: Ceres CLONE 1788743
  misc_feature (128)..(263): Pfam Name: Na_Ca_ex Pfam Description: Sodium/calcium exchanger protein
  misc_feature (429)..(572): Pfam Name: Na_Ca_ex Pfam Description: Sodium/calcium exchanger protein
MALSRGRARAAPAAVPSVCFLLLLLTSSSLPSAPGRDGDSSTSTAPASGAVLGVTTSSSSSGKGQGNDCAELQSIDGGAARCAYLRAHSPCSPARYVDYLRLFYCGFAGAPAAACAALALWLAVLFYLLGDTASEYFCASLEGLSAALRLPPAVAGVTLLSLGNGAPDVFASVVSFAAGDGGGVGLSSALGGALFVSTVVAGAVAFAVGARGGVVVEWRGFVRDLCFLLLALCYLLTVLVNGAVTVWVAVSFVSLYVGYVVIVWTSHCCAEQGKPPAAGLAAPLLLDEEDYGDDVPSLPSHSKTQSAASGAAPRGRAWLHCIARALCMPLYLPRRLTIPDIAAHRWSRPYAVASAALAPVLLAFTWTSQRHHLVSSSHRQHSLPVLLGGAILGLLLAALAAATTDAGSPPRGRKRRVLWLAAGFLMSVLWAYTLARELVALLVAMGYVAGIKPSVMGVTVLAWGDSLGDLVSNVAMAVHGGPGGAQTAVSGCYAGPLFNTVVGLGLSLALAAGAQHPAPFVVPADTAAYEAVGFLGAALAWALFVVPVRGMRIDRVYGVGLLAIYLCFFAVRVFEALGLWT

SEQ ID NO: 16370 - DNA, 684 bp, Panicum virgatum
  misc_feature: Ceres CLONE 1788750
  misc_feature: Encodes the peptide sequence at SEQ ID NO. 16371
aagcaaaccagaaaagtaacaaaaattcgacaagctagctacacccccatcttggagatggagctaagcgcagcaacgctcctctttgtcttcctactttccttgccaattcttgtgaccttgctgaggcgccaatcggcctccaagaagaggcggcctcctggcccgtggaacctccccttgattggaagcctcctccacttcgtcaagtcgcatccgccagtcgttctccgggacctggccagcaagtatggccctgtgatgttcctccggatgggccaggtcgacactgtcgtgatatcctcgccggcggcagcgcaggaggttctccgcgagaaggatgtcatcttcgcatcgaggccgagcatcgtggcttcggaggtcttctgctacggaaacctcgatgttggcttctcgccatatggcgcctattggcggacgctgcgcaagctctgcacggtggagctcctcagtgcaaagatggtgcgacagttcgcacccgtcagggataacgagacgttgtccctcatcaaaaatatccaagctgctggccgaggtggtcagccggtgaccaatctcgcgagcctgctcctatcctgctcgaactcgatcacggcaaaggcggccttcggccaggtttgcagcaaggagctccgggacaagttcctgaggtcaattgctgtc

SEQ ID NO: 16371 - protein, 208 aa, Panicum virgatum
  misc_feature: Ceres CLONE 1788750
  misc_feature: SWISSPROT Homolog: EC 1.14.13.68 4-hydroxyphenylacetaldehyde oxime monooxygenase
MELSAATLLFVFLLSLPILVTLLRRQSASKKRRPPGPWNLPLIGSLLHFVKSHPPVVLRDLASKYGPVMFLRMGQVDTVVISSPAAAQEVLREKDVIFASRPSIVASEVFCYGNLDVGFSPYGAYWRTLRKLCTVELLSAKMVRQFAPVRDNETLSLIKNIQAAGRGGQPVTNLASLLLSCSNSITAKAAFGQVCSKELRDKFLRSIA

SEQ ID NO: 16372 - DNA, 670 bp, Panicum virgatum
  misc_feature: Ceres CLONE 1788750-R
  misc_feature: Encodes the peptide sequence at SEQ ID NO. 16373
agcctagatggacgagctgcactacattaaaatggtgatcaaggagagcatgaggctgaacccagtggtgccattgctggttccccatttctgtcaggagacttgcgaggtaggtgggttccaagtcacgaagggcactagggtcatggtcaacgcgtgggctatggcaaggagccctgagtattggcatgacgcagagaagttcaggccggagaggtttgaggatggcatgcttgacttcaaaggctctcgctttgagtacttgccatttggggcagggaggagaaggtgccctggtgatactttcgggttggctgtgttagagctcattgttgcacgccttctctactacatcgactggagcctcccagcagggatgcagcctgatgacattgacatggaaatgatcgttgctgcaacaactaggagaaagaacccgctgcagctggtggtatcaccatataaggtggttcccatgaaatcctgattcatgggataattagtatatgcatgctggccaacatctacagttgtgcctccggacctcataaggtccctattttgttttttgattaaggtccctatcttgtttgtctaatgggaatgtacgaataaatataaaaaaactatgtattgtggccaacggcgtgagtactactccgttgaaggt

SEQ ID NO: 16373 - protein, 159 aa, Panicum virgatum
  misc_feature: Ceres CLONE 1788750-R
  misc_feature: SWISSPROT Homolog: EC 1.14.13.68 4-hydroxyphenylacetaldehyde oxime monooxygenase
MDELHYIKMVIKESMRLNPVVPLLVPHFCQETCEVGGFQVTKGTRVMVNAWAMARSPEYWHDAEKFRPERFEDGMLDFKGSRFEYLPFGAGRRRCPGDTFGLAVLELIVARLLYYIDWSLPAGMQPDDIDMEMIVAATTRRKNPLQLVVSPYKVVPMKS

SEQ ID NO: 16374 - DNA, 640 bp, Panicum virgatum
  misc_feature: Ceres CLONE 1788753
  misc_feature: Encodes the peptide sequence at SEQ ID NO. 16375
aaaccttgaagaacacagcagcatggtcctctgttcttgctttcttccgtccttgctctgttttgcacaggtcgtgatcgataacgatgcctccgacgacgcgacggtgatccgggtggacagcgtgaacagccacggcacgctgctcgccgtcgtccaggtcatcgccgacctcagcctcgtcatccgcaaggcctacttctcctccgacggcaactggttcatggacgtgttcaatgtcaccgaccgtgacggcaacaaggttgttgacgcctcaaccatctcctacatccagaagacgctggaggcggacgactggtactacccggaggcgcgcaacacggtgggcatcgtgccgtcggaggagtacacctccatcgagctgacgggcaccgaccggccgggcctgctctccgaggtgtgcgcggtgcttgtcgtcatgggttgcgcggtccagagcgccgagctgtggacgcacaacacgcgcgtcgccgccgtcgtgcacgtcaccgacgccgagtccggcggcgccatcgaggacgccggccgcatcgccgacatcagcgcgcgcctcggcaacctgctgcgcgggcagagcgacgtgcgcgccggcggcggcgcgggcaccccggcgcagcac

SEQ ID NO: 16375 - protein, 205 aa, Panicum virgatum
  misc_feature: Ceres CLONE 1788753
  misc_feature (117)..(180): Pfam Name: ACT Pfam Description: ACT domain
  misc_feature: SWISSPROT Homolog: EC 2.7.7.59 [Protein-PII] uridylyltransferase
MVLCSCFLPSLLCFAQVVIDNDASDDATVIRVDSVNSHGTLLAVVQVIADLSLVIRKAYFSSDGNWFMDVFNVTDRDGNKVVDASTISYIQKTLEADDWYYPEARNTVGIVPSEEYTSIELTGTDRPGLLSEVCAVLVVMGCAVQSAELWTHNTRVAAVVHVTDAESGGAIEDAGRIADISARLGNLLRGQSDVRAGGGAGTPAQ

SEQ ID NO: 16376 - DNA, 229 bp, Panicum virgatum
  misc_feature: Ceres CLONE 1788753-R
ttatgggtgtagattaagattcaaaagtagaaatttaggggagaaaatattggctcagctcccaaaagatttgtagcagataggaagtaagcaaagcagatggttactgtatattactccttaggatttagggttaaagtattggggtgtgcaactgtctctgtaaatactcgtcttgtacatgtgctcatcacctcatgcatattcttgaggggagtaaatacaggag

SEQ ID NO: 16377 - DNA, 1690 bp, Panicum virgatum
  misc_feature: Ceres CLONE 1788758
  misc_feature: Encodes the peptide sequence at SEQ ID NO. 16378
atctcgccggccgcggtgcccctcccctcctctcctaggcaggcgcacgagatacccagccagccatccccagcaagcaaatcccctagcagcaagcgccgaccatggggcagggcactcctggaggcatgggcaagcagggaggagccggcgaccgcaagcccggggacggcgccgacaagaaggataagaagttcgagccgcccgccgccccctcccgcgtcggccgcaagcagcgcaagcagaagggcgccgaggccgccgcgcgcctccccaacgtcgcgccgctctccaagtgccgcctccgcctcctcaagctcgagcgggtcaaggactacctcctcatggaggaggagttcgtcgccgcgcaggagcgactccgcccgcaggaggacaaggccgaggaggaccgatccaaggtcgacgacctccgcggcacgcccatgagcgtcggatccctcgaggaaatcatcgacgagagccacgccatcgtatcctcctccgtcggacccgagtactacgtcggcatcctctccttcgtcgacaaggaccagctcgagccgggatgctccatactcatgcacaacaaggttctgtccgtggttggtatattgcaagatgaagttgatcccatggtatctgtgatgaaagtagagaaagctcctctggagtcttatgccgacattggtgggttagatgctcagattcaagaaattaaagaggcagttgagcttccattgacccatcctgagctgtatgaagacattgggatcaggccccccaagggagtcatattgtatggagagcctggaaccggaaaaactctacttgccaaggctgtcgctaactcaacatctgcaactttcttgcgtgtcgttggaagtgagcttatccaaaagtaccttggtgacggtcccaagctagtcagagaactttttagggtggctgatgagctttctccctcaatagtctttattgatgagattgatgcagttggaacaaagagatatgatgctcattcaggaggagaacgtgagattcaaagaactatgttggagctgctgaatcagctagatggttttgactcgcgtggagatgttaaagttatcctagcaacaaaccgcattgaaagtcttgatccagctttgcttcggccaggtcgcatagaccggaagattgaatttcctttgccagatattaaaactagacgtcgcatcttccagatacacacctcaaaaatgacgttagccgatgatgtgaacttggaagaatttgtgatgacgaaggatgagttctcgggggctgatatcaaggctatttgtacggaagctgggttgctagcattgcgagaacgtagaatgaaggtgacccatgcggatttcaagaaagcgaaggagaaggtgatgtacaagaaaaaggaaggcgtcccagatggtctctacatgtaacgaatcggtcccttcattgtcaggacaagctatctttattatagtagcacttctctcttcagcatgggagatttgttggcttggtgtcgcactcagtttggaaaacatgtattatcttttgatttatttgaagtaaattccctttgagaggatgctggaacgctgtgtaggcaaggtatgcactaaaaaaatacgattaattttctcgtggtcgcaatgaaacattcactatcgtgtttccc

SEQ ID NO: 16378 - protein, 447 aa, Panicum virgatum
  misc_feature: Ceres CLONE 1788758
  misc_feature (228)..(415): Pfam Name: AAA Pfam Description: ATPase family associated with various cellular activities (AAA)
  misc_feature: SWISSPROT Homolog: EC 3.6.4.3 Microtubule-severing ATPase
MGQGTPGGMGKQGGAGDRKPGDGADKKDKKFEPPAAPSRVGRKQRKQKGAEAAARLPNVAPLSKCRLRLLKLERVKDYLLMEEEFVAAQERLRPQEDKAEEDRSKVDDLRGTPMSVGSLEEIIDESHAIVSSSVGPEYYVGILSFVDKDQLEPGCSILMHNKVLSVVGILQDEVDPMVSVMKVEKAPLESYADIGGLDAQIQEIKEAVELPLTHPELYEDIGIRPPKGVILYGEPGTGKTLLAKAVANSTSATFLRVVGSELIQKYLGDGPKLVRELFRVADELSPSIVFIDEIDAVGTKRYDAHSGGEREIQRTMLELLNQLDGFDSRGDVKVILATNRIESLDPALLRPGRIDRKIEFPLPDIKTRRRIFQIHTSKMTLADDVNLEEFVMTKDEFSGADIKAICTEAGLLALRERRMKVTHADFKKAKEKVMYKKKEGVPDGLYM

SEQ ID NO: 16379 - DNA, 683 bp, Panicum virgatum
  misc_feature: Ceres CLONE 1788760
  misc_feature: Encodes the peptide sequence at SEQ ID NO. 16380
agggtgaggagcttgccttggatgcgtcagagcttgtcatcacgagcacaaggcaagagattgatgagcaatgaggattgtacgatggattccatgtcaagcttgagaaagtgttgagggcacgggcaaggcgcggtgttagttgccatggccgtttcatgcctaggatggtggtgatccctcctggaatggatttcagcaacgtttttccagaagacattgatggagatggtgacggcaaagatgatatcattagtttggagggcgcttcaccgaagtcgatgcccccaatttgggctgaggtgatgcggttcctaaccaatcctcacaagccgatgatcctggcactgtcaaggcctgacccaaagaagaacatcaccaccctcgtgaaagcgtttggagagtgccgcccactcagggaacttgcaaatcttactctgatcatggggaacagagatgacatcgacgaaatgtctgctggcaacgcaagtgtcctcaccacagttctgaagctgattgacaagtatgatctgtacggaagcgtggcatttcctaagcatcacaaccaggctgacgttccagagatctaccgccttgctgccaaaatgaagggcgtcttcatccaccctgctctcgttgagtcattttggcctccccttgatcgaggctgcggcacacggact

SEQ ID NO: 16380 - protein, 171 aa, Panicum virgatum
  misc_feature: Ceres CLONE 1788760
  misc_feature: SWISSPROT Homolog: EC 2.4.1.14 Sucrose-phosphate synthase
  misc_feature: Useful for making plants with altered carbohydrate content
  misc_feature: Useful for making plants with altered cell wall content and/or composition
  misc_feature: Useful for making plants with modulated biomass
  misc_feature: Useful for making plants with modulated carbohydrate content
MVVIPPGMDFSNVFPEDIDGDGDGKDDIISLEGASPKSMPPIWAEVMRFLTNPHKPMILALSRPDPKKNITTLVKAFGECRPLRELANLTLIMGNRDDIDEMSAGNASVLTTVLKLIDKYDLYGSVAFPKHHNQADVPEIYRLAAKMKGVFIHPALVESFWPPLDRGCGTR

SEQ ID NO: 16381 - DNA, 1550 bp, Panicum virgatum
  misc_feature: Ceres CLONE 1788762
  misc_feature: Encodes the peptide sequence at SEQ ID NO. 16382
accttgctcggctcccacctcctccgagcttccatttccggcggccggaatcagatggctccggcggcctgattccggcgtggcgagaaaggatgaacagtggaaacagtgaactgataatgggggaggcagaggaggaccgcgcggccggctgctccttctcgctcatgtgcctggaggacggcgccgacctcggcggcggcgtcgacgacgggaagctgctcctgctgtacggggaagctgaggaagaggaagaggagtacatgggccacctcgtgtccaaggagagcagcttctgcagctcgccttccccgtcctcgtcccctgcctcctcctctgacgccggcgccgagtcgccgccgtcgccggtgccctcctccgaggactggttccggcgcgcgcgccgggacaccgtcaagtggatcatcgagactcgagcttgcttcggcttctcccaccgcacggcgtacctggccgtctcctacttcgaccgcttctgcctccaccgctgcttcgacaggtcggtgatgccgtgggcggcgcggctcctggcggtggcgtgcgtgtcgctggcggcgaagatggaggagtaccgcgcgccggcgctgccggagttccgcgccgacgacgagtacgacttcagctgcgactccatccggcggatggagctgctggtgctgtccacgctggggtggcgtatgggcggcgtcacccccttcgactacctcccctgcctctcttccaggctacgccgcggcggcggcgccggcggcggtctcgccgctgccaaggcccccgccctcatcttcacaacagccgaagctgcgagcgtgctcgactaccggccgtccaccgtggccgtcgccgccgttctggcggctagccatggtggcgctttgtcaaaggaggcgctggagtcgaagatgagcagcatctccccatcctgcctggttgacaaggaggacgtgcgcgcctgccacagcctgatgctgagcgcgagcgagaactcgccggcggccaagaggccgccgccgtcgccatgcagccccggctcgatcggcgccggcggcagcacgtacgagcccgtgaccgtcgacgcggcctcctccccgttcgcggcagcggcaaggagcagcaacaagagggcgcggctgctcgagctgccggccgtcggccggtgaggagcgccgccgggacgggcacgtttttgtcagccgtcctacggtggcagcagctccgatcgacgcagctaattaatcatgttcacggatcttagtgtgtttcctttagttctttgatcgccagtggcgctgccaaataagcggtgattggcagcgccgcccgccgtgttggattgccgatgttcttgtgtgaggttgatgagatcgagcgagagcgagaggatgaagaaaaggacaaaaaaacagagaaagaagaatgaagagggtggcgatggccgagcttgagctcctttcccgaggataggggagatatcaagaaaatctcgaaggtgtgagcacataatataaggtcctgtttagttcccaccc

SEQ ID NO: 16382 - protein, 362 aa, Panicum virgatum
  misc_feature: Ceres CLONE 1788762
  misc_feature (76)..(204): Pfam Name: Cyclin_N Pfam Description: Cyclin, N-terminal domain
MNSGNSELIMGEAEEDRAAGCSFSLMCLEDGADLGGGVDDGKLLLLYGEAEEEEEEYMGHLVSKESSFCSSPSPSSSPASSSDAGAESPPSPVPSSEDWFRRARRDTVKWIIETRACFGFSHRTAYLAVSYFDRFCLHRCFDRSVMPWAARLLAVACVSLAAKMEEYRAPALPEFRADDEYDFSCDSIRRMELLVLSTLGWRMGGVTPFDYLPCLSSRLRRGGGAGGGLAAAKAPALIFTTAEAASVLDYRPSTVAVAAVLAASHGGALSKEALESKMSSISPSCLVDKEDVRACHSLMLSASENSPAAKRPPPSPCSPGSIGAGGSTYEPVTVDAASSPFAAAARSSNKRARLLELPAVGR

SEQ ID NO: 16383 - DNA, 1172 bp, Panicum virgatum
  misc_feature: Ceres CLONE 1788763
  misc_feature: Encodes the peptide sequence at SEQ ID NO. 16384
accaccgcatctcacaccccctgagctcagctccaagcagagtcttctccacctcctgtggttagagcgagaggccaggccgtgaaaatgccgatcagcaggatcgccgtcgggagccaccaggaggtgtaccacccgggcgccctcaaggcggcgttcgccgagttcatctccaccctcatcttcgtcttcgccggccagggctccggcatggccttcagcaagctgtccgccggcggcgctacgacccccgctggcctgatctcggcggcggtggcgcacgccttcgccctgttcgtggccgtgtcagtcggcgccaacatctccggcggccacgtgaacccggccgttaccttcggcgccttcgtcggcggcaacatcaccctgttccgcggcctcctgtactgggtcgcccagctcctgggctccaccgtggcgtgcctcctcctccgcttctcgaccggcggcctcgccaccggcaccttcggcctgaccggcatctccgtgtgggaggccctggtcctggagatcgtgatgaccttcgggctggtgtacacggtgtacgcgacggccgtggacccgaagaagggcagcctgggcaccatcgcccccatcgccatcggcttcatcgtgggcgccaacatcctggtcggcggcgccttcgacggcgcgtcgatgaaccccgccgtgtccttcggccccgccctcgtgagctggtcctggacccaccagtgggtgtactgagtcggccccctcatcggcggcggcctcgccggcgtcatgtaggaggtgctcttcatctcccacacccaggagcagctccccaccaccgactactgagctgagggctgaggcttcggtagccgccgccgccgccgccgccgccgccgaagacgttcgcgcgcagccgccggttcctccgtccgtttgatcagttccgcctcgccgctgtttgagttagttttttccctcgcaccgcgtgctgcttgcatcgaccaccgccatgtaccatgaacccatcgaactatccgctgccggtgcgccgctcgccatggtttgcttcgatcagtcgcatcaagttggaactgtaaccgccaccgtgaattccagaccccgtttgcatgcttctgtaaaatttgtgaatttgcccgcgagtactccatttgccatcc

SEQ ID NO: 16384 - protein, 218 aa, Panicum virgatum
  misc_feature: Ceres CLONE 1788763
  misc_feature (13)..(218): Pfam Name: MIP Pfam Description: Major intrinsic protein
MPISRIAVGSHQEVYHPGALKAAFAEFISTLIFVFAGQGSGMAFSKLSAGGATTPAGLISAAVAHAFALFVAVSVGANISGGHVNPAVTFGAFVGGNITLFRGLLYWVAQLLGSTVACLLLRFSTGGLATGTFGLTGISVWEALVLEIVMTFGLVYTVYATAVDPKKGSLGTIAPIAIGFIVGANILVGGAFDGASMNPAVSFGPALVSWSWTHQWVY

SEQ ID NO: 16385 - DNA, 1885 bp, Panicum virgatum
  misc_feature: Ceres CLONE 1788781
  misc_feature: Encodes the peptide sequence at SEQ ID NO. 16386
gtgcctcctcctctctccactccaacccccgaaacgaaccagaccgagcggccgccgccgccgccgccttccctcctcttttcgtctgactttttctccaagctcatctccctccttccctcccccgatctcgggagagagagcgaagcatgtcctggcggtgggctctcgcgcgccgcgtcgccgcgctggccgccgggagcggggcaggcggcgcggcccaggcgcagaggctcctgacgacctcgtccggcgcgggcgccgccctactggggcggcagcacctgcccctggcctcccagattcggagcaaggtggtgggttgcagaggagctgctttcgtgagctccagatggctacatgatgcgcaataccaggttcgccctgatggggattcaaggtctcaggaacacagagatccatttgaattagttgccgatgatctatcactcgttgcagatagattacgatccatggtggctgctgaggtccccaaactggcatcagcagctgagtactttttcaaagtgggagctgaggggaaaaaattccgacctacggttttgttactgatggcttcagctctcaaattccccctgtcagaatcaacagaaggcggagttctcagtatcttagcggataaactccgcgcaccccatctgaacattgcagagataacggagatgattcatgtcgcaagccttctgcatgatgatgttctagatgatgctgatactaggcgtggtgtcagttcgttgaatcttgttatggggaacaagctctccgtattggcaggtgacttcctcctgtctagagcatgtgtggcacttgcagcacttgggaacacagaggtggtatccctaatggcaactgctgtagaacatctagttactggtgaaactatgcagatctcaacaagcagagagcaacgacgaaggtttaatattttctctcgcgtgcactttgttgctctagtcagatgtaacatatatattcaaagagttggagagtgaaattattgcaatgttcaattctttattttgaattacattctttgttcgatctgttcatctttgctaattagttctggcatggggttccaaaatttgtgcagcatggaacactacctgcagaagacatactacaaaacagcatcactgatatcaaatagttgtaaggctgttgctattcttgcagggcacactgctgaggtctcaatgcttgcatacgaatatggtcgaaacttgggtttggcgttccagttgattgacgatgttctagatttcacgggcacatccgcatcccttgggaagggttcattatctgatattcgccatggaatcattactgccccaattctatatgcaatggaggaattcccgcaactacatgaagttgttgacagcggtttcgacaatcctgcaaatgttgaacttgcccttgactatctccagaagagccgtggaattgaaaggacgaaagagcttgcgcgggaacatgctaaccgtgcaatcaaagctatagaagccctcccggatagcgacgacgaggatgttctgacttcgagacgcgctcttattgacataacagagagagtcatcacaaggacaaagtagcaagtgtttcgcgttcccaaggtgaatagaaagctgaacctcgccacaggccaagtattccacttggaagattttgtacactccggttcattgcattcatttcacagcccaagttttgtgtaacattgctggaagtttaggacctgcatttctcagagctgtagtggtttttttttctacaagtggcagcaaaatatgtatatcactgattgcaatgatcaccagatattatgtagacatataattgggagcactgaacccaatatacg

SEQ ID NO: 16386 - protein, 287 aa, Panicum virgatum
  misc_feature: Ceres CLONE 1788781
  misc_feature (116)..(283): Pfam Name: polyprenyl_synt Pfam Description: Polyprenyl synthetase
  misc_feature: SWISSPROT Homolog: EC 2.5.1.30 Trans-hexaprenyltranstransferase
MSWRWALARRVAALAAGSGAGGAAQAQRLLTTSSGAGAALLGRQHLPLASQIRSKVVGCRGAAFVSSRWLHDAQYQVRPDGDSRSQEHRDPFELVADDLSLVADRLRSMVAAEVPKLASAAEYFFKVGAEGKKFRPTVLLLMASALKFPLSESTEGGVLSILADKLRAPHLNIAEITEMIHVASLLHDDVLDDADTRRGVSSLNLVMGNKLSVLAGDFLLSRACVALAALGNTEVVSLMATAVEHLVTGETMQISTSREQRRRFNIFSRVHFVALVRCNIYIQRVGE

SEQ ID NO: 16387 - DNA, 866 bp, Panicum virgatum
  misc_feature: Ceres CLONE 1788783
  misc_feature: Encodes the peptide sequence at SEQ ID NO. 16388
gttccaaccctgtaacctccacatgccgacataattccacgccgccccaccacgcgaccattattccccctctgcctctccactcgtccacactcccactccgccactcgaccccatcgccatctcctctcctccctcccctcctgctcgtctcgtgccggcggcaagggcgatggcctccctccgtgcgtccctcctccttgccgcggcgctttgcgcgctcgcggcttcgggcgccgccgcatcccgcgacctccgcccgctccgggccggcttcgtcgtgcgcggacgcgtctggtgtgacacctgccgcgccggtttcgagacacccgcctccacctacattgccggagcaaaggtaagagttgactgcaggtcgaaaaccactggagtgaagacatgcagcttcgaggggcacactgatcgcactggcacttacaacatccttgttgccgatgagcacgagcatgagctctgtgagtccgtccttgtcagcagcccggacatgaggtgtgctacgaccgtgcctggtcgggagagggcccctgtcttcctcaccagcaagaatggtgtggcttctaatgttcgtctggcaaatgctctgggcttccagaaggacgttgctctacccagatgtgcgcaaatcctcaagatgtatgaggatgtggatgaccgtgtgtaatggtgcagagtttgacactgctcggcgagctatatatttatgccttgtgtctgaagtgttcttgaacctctatatctattacgaggaccaacagcattattgcctgttagtttagcactttgattatgtatgtctatctgcagttgaactgcgaatgttatcagcaactaaatctacctggctg

SEQ ID NO: 16388 - protein, 169 aa, Panicum virgatum
  misc_feature: Ceres CLONE 1788783
  misc_feature (37)..(157): Pfam Name: Pollen_Ole_e_I Pfam Description: Pollen proteins Ole e I family
MASLRASLLLAAALCALAASGAAASRDLRPLRAGFVVRGRVWCDTCRAGFETPASTYIAGAKVRVDCRSKTTGVKTCSFEGHTDRTGTYNILVADEHEHELCESVLVSSPDMRCATTVPGRERAPVFLTSKNGVASNVRLANALGFQKDVALPRCAQILKMYEDVDDRV

SEQ ID NO: 16389 - DNA, 730 bp, Panicum virgatum
  misc_feature: Ceres CLONE 1788805
  misc_feature: Encodes the peptide sequence at SEQ ID NO. 16390
cacgacctccccgcctcgaccattcccgtggactcccggctgccccgcctccctgctgtgctgccgccccgctccagcattcccaacccccaccccgcgcggccgtcgccggagcgagcagagcagccggagggcacgtcggatccgccgccgccaagatgaacgacgccgatgtctccaagcagatccagcagatggtgcggttcatctgccaggaggccgaggagaaggccagcgagatctccgtctccgccgaggaggaattcaacattgagaagttgcagcttgttgaagctgagaaaaagaagatcaggcaagagtatgaacgaaaagagaagcaggttgaagtacggaagaaaattgagtactctatgcagttgaatgcttctcgcatcaaagttcttcaagctcaggatgatctagttaacaaaatgaaagaggatgccatgaaggaactccttcgtgtcagcaacaaccaccacgaatacaagaaccttttgaaagatctaatcgttcagggcttgctcaggttgaaagagccagctgtactgctccgttgccgtaaagaggaccaccatcatgtggaatctgtactgcattcagcaaagcatgagtatgcatcaaaagcagatgtccatcaaccagagatatttgtagaccatgatgtgtacctgccacctgcccccagccatcatgatgctcatggccagttttggtaatgcttgctgtg

SEQ ID NO: 16390 - protein, 186 aa, Panicum virgatum
  misc_feature: Ceres CLONE 1788805
  misc_feature (16)..(185): Pfam Name: vATP-synt_E Pfam Description: ATP synthase (E/31 kDa) subunit
  misc_feature: SWISSPROT Homolog: EC 3.6.3.14 H(+)-transporting two-sector ATPase
MNDADVSKQIQQMVRFICQEAEEKASEISVSAEEEFNIEKLQLVEAEKKKIRQEYERKEKQVEVRKKIEYSMQLNASRIKVLQAQDDLVNKMKEDAMKELLRVSNNHHEYKNLLKDLIVQGLLRLKEPAVLLRCRKEDHHHVESVLHSAKHEYASKADVHQPEIFVDHDVYLPPAPSHHDAHGQFW

SEQ ID NO: 16391 - DNA, 668 bp, Panicum virgatum
  misc_feature: Ceres CLONE 1788805-R
  misc_feature: Encodes the peptide sequence at SEQ ID NO. 16392
agcgtaaatttccctgcccagtgacatgagcacaacggaccttttgttgcatacaaacaatccatcttatatgtgcttaaagatacatctatgacagtattgctcatagatctattctataacattacagctgcccagtaccatgatctatctatgtatcttcatttgatatggattgcagctgtaattctgattacatatgctctgtttccaacagtttgtggatggctgtcattccagtgttttattctaaaagtatctgtttttttcagctctggaggtgttgtcctggcttctcgagatggaaagattgtgtttgagagtacacttgatgcaagactggaagttgttttccgcaagaaattgccagagatccggaagcttctttttggccagaaggcagtctaatagacttatccgatgacggcgatgatggtacagctgcttctatgtaatggctgctgccctgcagccgtaagcgactccaccagtttttgccaaattgattgtttaaagtattcatcccctatgtacaaactacctatttgttcattattatcgccgagcaccgactatttgcactctgtttgctccgaggaataagaataaagcaccgccagactcttcactgcgaagctgaataaatattgtaaattatttgctttgct

SEQ ID NO: 16392 - protein, 105 aa, Panicum virgatum
  misc_feature: Ceres CLONE 1788805-R
  misc_feature: SWISSPROT Homolog: EC 3.6.3.14 H(+)-transporting two-sector ATPase
MTVLLIDLFYNITAAQYHDLSMYLHLIWIAAVILITYALFPTVCGWLSFQCFILKVSVFFSSGGVVLASRDGKIVFESTLDARLEVVFRKKLPEIRKLLFGQKAV

SEQ ID NO: 16393 - DNA, 1830 bp, Panicum virgatum
  misc_feature: Ceres CLONE 1788820
  misc_feature: Encodes the peptide sequence at SEQ ID NO. 16394
ctctcctcccctgcgtgcgagagcaccagcagcttccgcttccaattccgccgcccccgccgccgtgcctctcctccattggctcgccgtcgccgcggcctcgaccgcctcgcctcacccgtcgccaccggcctcgtcacctcctgtgctactccgtgccatcggggcctgacagggacggcctacccgcacagcggaggacggcgtcaggacaagcgctcccgagcaacaagtatcccggcagcgcttcgctgccgctcggcgctcgagctccacatacaccagcagcagcagcacgccagcacgagcggaagcgggagggagcgctggctgcttgattcggtcaactcccgcgcgctcgcggcaggatcaaggccaatggggcgggagaggaggccgtggccggcggcggccgccgccgttcttctgctcgtcgcctcctgcgtcgccgcggcgccgctgcagcagcaccagcgcgccaggatcacaggggacgccggcggcgtgctggacgacaacccggtggggaagctgaaggtgttcgtgtacgagatgccgcgcaagtacaaccagatgctgctgtccaaggacagccggtgcctgcaccacatgttcgcggccgagatcttcacgcaccagttcctgctgtccagcgcggtgcggacgctggacccggaggaggccgactggttctacacccccgtgtacaccacctgcgacctcacgccgcagggcttccccctcccgttccgggcgccacgaatcatgcgcagcgccgtcaagtacgtcgccaccacgtggccctactggaacaggaccgagggcgccgaccacttcttcctaacaccccacgacttcggcgcctgcttccactaccaggaggagagggcgatggagaggggcatcctgccgctgctccggcgcgcgacgctggtgcagacgttcgggcagcggaaccacgtgtgcctgcaggaggggtccatcaccatcccgccctacgccaacccgcacaagatgcaggcgcacctcatcaaccccggcacgccgcgctccatcttcgtctacttccgcggcctcttctacgacatgggcaacgaccccgagggtggctactacgccaggggcgcgcgcgcgtcagtgtgggagaacttcaaggacaacccgctgttcgacatttcgacggaacacccgtcaacgtactacgaggacatgcagcgcgccatcttctgcctgtgcccgctggggtgggcgccgtggagcccgcggctggtggaggcggtggtgttcggttgcatcccggtgatcatcgccgacgacatcgtactgcccttcgcggacgccatcccctgggagcagatcagcgtgttcgtggcggagcgcgacgtaccgcgcctcgactccattctcacctccatcccgctccaggacatcctcaggaagcagcgcctgctcgccggcgcgtccgtcaagcaggcgctgctcttccaccagcccgcaaggcccggggacgccttcgaccagatactcaacgggctggcgcgcaagctgccgcacggcaagggcgtgttcctccagcccggggagaaggtgctcgactgggacgctgggctcgagagcgacctcaagccttggtaggcgcagcagcgcctgccttcacatttgttcatgttcttttgttttgttcttttatttaaatctttcgatcgatggatggatggatcacgcattagtttttgcacgaccagtttacacgcagcagcaatatagagcgagatttctcgggatatttgtgagaggcagcccttgtgtgatttaaatttagtgttcact

SEQ ID NO: 16394 - protein, 418 aa, Panicum virgatum
  misc_feature: Ceres CLONE 1788820
  misc_feature (54)..(358): Pfam Name: Exostosin Pfam Description: Exostosin family
  misc_feature: Useful for making plants with altered carbohydrate content
  misc_feature: Useful for making plants with altered cell wall content and/or composition
MGRERRPWPAAAAAVLLLVASCVAAAPLQQHQRARITGDAGGVLDDNPVGKLKVFVYEMPRKYNQMLLSKDSRCLHHMFAAEIFTHQFLLSSAVRTLDPEEADWFYTPVYTTCDLTPQGFPLPFRAPRIMRSAVKYVATTWPYWNRTEGADHFFLTPHDFGACFHYQEERAMERGILPLLRRATLVQTFGQRNHVCLQEGSITIPPYANPHKMQAHLINPGTPRSIFVYFRGLFYDMGNDPEGGYYARGARASVWENFKDNPLFDISTEHPSTYYEDMQRAIFCLCPLGWAPWSPRLVEAVVFGCIPVIIADDIVLPFADAIPWEQISVFVAERDVPRLDSILTSIPLQDILRKQRLLAGASVKQALLFHQPARPGDAFDQILNGLARKLPHGKGVFLQPGEKVLDWDAGLESDLKPW

SEQ ID NO: 16395 - DNA, 1593 bp, Panicum virgatum
  misc_feature: Ceres CLONE 1788828
  misc_feature: Encodes the peptide sequence at SEQ ID NO. 16396
ggctacaacgctcgcctccgccgcatttcctctcgactctctcggctcctctgggctctggctgcccccttcgccggcggagagctgctgtcggcgagtcccatcaccgtttggggccggctggcggcgacctcctccgttggtgccttgggtcagcaagttgcttttagcttgtgaaaaatggagcatgaactacgttctccatctgggatccagagggttcatgggcagcccgtgttgttgagcagaatctcttcttattctgccatgaataaccctgtattcaacaatgtgcccctctggtcgcatcatgggatgagtgcaactgttgggctcccatcagtcatgatgccgtcccccgtctttgcttctgcccccaaagagaaaggtttttctggatttatggttgactttctgatgggtggagtctctgctgctgtttccaagactgctgctgctcccattgagcgtgtcaagctgttgattcagaaccaggatgagatgatcaaaagtggtaggctttctgaaccctacaagggtattggagactgctttgcccggacgatgaaagatgagggtgtcatctcactgtggagaggaaacacagctaatgtcatccgttacttccccacacaggcactgaactttgcattcaaggaccacttcaagcgcatgttcaacttcaagaaggacaaggatggatactggaaatggtttgctggaaaccttgcttctggaggagctgctggtgcttgctctctcttctttgtttactctctggactacgctcgtacgcgtttggccaatgatgccaaggctgcaaagaagggtggtgggaggcagttcaatgggctcgttgatgtttacaaaaagacccttgccagtgatggtatccgtggcctctaccgtggattcaatatctcttgtgtaggaatcattgtgtaccgaggtctttactttggaatgtacgactccctcaagccagttcttcttgttggtaccctacaggacaacttctttgccagcttcttgctcggctggggtataacaattggtgctggccttgcctcgtaccccatcgatactgtccgccgtcgtatgatgatgacgtctggtgaggctgtcaagtacaacagctccttggatgccttcaagcaaattgttgcaaaggagggcaccaagtccctcttcaagggtgctggtgcgaacatcctccgtgctgttgctggcgctggtgtccttgctgggtatgacaagctccaggtgatcgtctttggcaagaagtacgggtctggcggcgcctaagagtagatgatggtgaacaaaagaaaggatgtttagttggtgcctttgcatagcttatgtggaccatggacaccatttctaaatctagcacttgcacagactgtgactggttttgttatgcggtttggattctgtggctcgtcgttttctggagatctgaaataagctactgagttagaaattgcggaccttaatgcttggagacatgttcatccccattgtgactttacatgttctacatcattttgctggatggttgattgcatggtctaatttgacactgttgtt

SEQ ID NO: 16396 - protein, 374 aa, Panicum virgatum
  misc_feature: Ceres CLONE 1788828
  misc_feature (73)..(170): Pfam Name: Mito_carr Pfam Description: Mitochondrial carrier protein
  misc_feature (178)..(274): Pfam Name: Mito_carr Pfam Description: Mitochondrial carrier protein
  misc_feature (278)..(368): Pfam Name: Mito_carr Pfam Description: Mitochondrial carrier protein
MEHELRSPSGIQRVHGQPVLLSRISSYSAMNNPVFNNVPLWSHHGMSATVGLPSVMMPSPVFASAPKEKGFSGFMVDFLMGGVSAAVSKTAAAPIERVKLLIQNQDEMIKSGRLSEPYKGIGDCFARTMKDEGVISLWRGNTANVIRYFPTQALNFAFKDHFKRMFNFKKDKDGYWKWFAGNLASGGAAGACSLFFVYSLDYARTRLANDAKAAKKGGGRQFNGLVDVYKKTLASDGIRGLYRGFNISCVGIIVYRGLYFGMYDSLKPVLLVGTLQDNFFASFLLGWGITIGAGLASYPIDTVRRRMMMTSGEAVKYNSSLDAFKQIVAKEGTKSLFKGAGANILRAVAGAGVLAGYDKLQVIVFGKKYGSGGA

SEQ ID NO: 16397 - DNA, 702 bp, Panicum virgatum
  misc_feature: Ceres CLONE 1788864-R
  misc_feature: Encodes the peptide sequence at SEQ ID NO. 16398
gacacaaaatcgcaatgatcagggctttgagaaaatgatctctgagatatatcctggggaaattgcaaggcttgtgcttcatcgaatggctctagaatccgatgtttttggtgatgctgctgataatctatctatccccttcacattgagcacaccgcttctggcggcaattcgcgaggacgattcaccagatctgagcgaagtcaaaaggatactgcaagaacatctgaagatacctgacactcctctgaaaacccgaaggcttgtcgtcaaagtttgtgacataatcaccaggagagctgcccgcctagctgccgctgggatcgtcgggatactgaaaaagctgggccgggacaggagcggcgtggcttcaagtgggagaatgcgggggcagcctcggcggacggtggtggcgatcgagggtggcctgtaccagggctacccggtgttcagggagtacctagacaaggccttggtggagatcatgggggaggaggtggcgcggacggtggagcttacggtgatggaggatgggtcgggggtgggagccgccctcctttccgcagtacattcatcgaatagacagcaaggttccatatagggagagatggtgatacaggagctagcccctctgtgcaaatgtaaaaagggacattgtttgatatctatattcatatatataaaattcggtcttgtgcagtg

SEQ ID NO: 16398 - protein, 199 aa, Panicum virgatum
  misc_feature: Ceres CLONE 1788864-R
  misc_feature (1)..(192): Pfam Name: Hexokinase_2 Pfam Description: Hexokinase
  misc_feature: SWISSPROT Homolog: EC 2.7.1.1 Hexokinase
TQNRNDQGFEKMISEIYPGEIARLVLHRMALESDVFGDAADNLSIPFTLSTPLLAAIREDDSPDLSEVKRILQEHLKIPDTPLKTRRLVVKVCDIITRRAARLAAAGIVGILKKLGRDRSGVASSGRMRGQPRRTVVAIEGGLYQGYPVFREYLDKALVEIMGEEVARTVELTVMEDGSGVGAALLSAVHSSNRQQGSI

SEQ ID NO: 16399 - DNA, 163 bp, Panicum virgatum
  misc_feature: Ceres CLONE 1788864
accgctctcttctctctgatcctctctgtctctgtctctcttccccaggaggcgacggttggagcagcgctgggttccatcgcctcgcgtcccccccgccctttgctggcgcggagcctagaccgacaacgcgtcccgggcgcgcgttcgtgatagcccgagc

SEQ ID NO: 16400 - DNA, 865 bp, Panicum virgatum
  misc_feature: Ceres CLONE 1788871
  misc_feature: Encodes the peptide sequence at SEQ ID NO. 16401
ggcctaccatagcaagaatagtgatttgcacgtacgcccgggcgcccggccagcagcgcatcatcacggtcagataaggctaagcatcgtcatggccaacgccctgcctctcgtcgcgctgctcgtcgccgggtgcgcggcgctggcctcggccaccacgttcaccgtcggcggctcgcagggctggacgaccggcgtcgactacaacagctgggccagcgacaagagcttcgccatcggggacacgctagtgttccggtacgtgagcaaggcgcacacggtgacggaggtgagcaagagcggctacgacacctgctccggctccggcgccaacgcgctgagcgacgacgacagcggctccaccaccgtcacgatcaccacccccggcacgcactacttcatctgcaacgtccccggccactgcgccagcggcatgaagttcgccatctccgtctccgccacgcgctccggcgccgccgcgtccgcggccgccccgcaacttccggcgacaatggcttccgccgctgccgccgcggccgcggcgatcaggctcgcgctcttctgacgacggagctgagcacggccgtctcgtcgatcggatcagtctcagggtagagacagtgcatgcattgcaggctacacgttcttggccgctgatgatgacattcgtgtaataatccatcagtaattgctgtgtccatattattcctgctacgttttctggcgattggtcgtcgtgcagcagctcgtgtacgtacttacgctgccgtggcgtgtccttttgatgtctgtagctgtgtgtattcgtcaccaggtgtacatcatgtatgatcgttttttgttcggtttatatatattttcgttc

SEQ ID NO: 16401 - protein, 157 aa, Panicum virgatum
  misc_feature: Ceres CLONE 1788871
  misc_feature (32)..(115): Pfam Name: Cu_bind_like Pfam Description: Plastocyanin-like domain
MANALPLVALLVAGCAALASATTFTVGGSQGWTTGVDYNSWASDKSFAIGDTLVFRYVSKAHTVTEVSKSGYDTCSGSGANALSDDDSGSTTVTITTPGTHYFICNVPGHCASGMKFAISVSATRSGAAASAAAPQLPATMASAAAAAAAAIRLALF

SEQ ID NO: 16402 - DNA, 608 bp, Panicum virgatum
  misc_feature: Ceres CLONE 1788879
  misc_feature: Encodes the peptide sequence at SEQ ID NO. 16403
ctcggccaccgaggccgcgaacagctcaagaaaagtagcagcagcaacccgcggcggcgacgagtaaccaaccgggccacgccattgccagtcgcccggccgcctacaagccctgcctcgcgcccttgcccggccaccgcgccttccttctccctcccgctgcgggttctctcgcgcagcccgaatccgcggggtggtttctgtttctttgaccgcttcttctgagttctttctcggcggcgcgccatggaggagacggggaagagggtggtgaggaccgtgcgggtgcggaacatatcagatctggcgacagagcgggaggtgcgcgagttcttctccttttccggtgaaatcgaacacgtcgacatcagattggacggtacgcggaggacggcctacgtgacattcaaagatcccaaagccctcgagattgcccttctcctatcggtcgtctgtgagatcctaaggaggccaacgaagattgatgaataagcaacgagaataaagatattgagtattttattggctgcttgaattgacacagtttgtgggcaacataaattatagttttacaatgtaatctttgactgtatgaatctattcagtgc

SEQ ID NO: 16403 - protein, 81 aa, Panicum virgatum
  misc_feature: Ceres CLONE 1788879
  misc_feature (12)..(79): Pfam Name: RRM_1 Pfam Description: RNA recognition motif. (a.k.a. RRM, RBD, or RNP domain)
  misc_feature: Useful for making plants with altered lignin content
  misc_feature: Useful for making plants with altered alkaloid content
  misc_feature: Useful for making plants with modulated biomass
MEETGKRVVRTVRVRNISDLATEREVREFFSFSGEIEHVDIRLDGTRRTAYVTFKDPKALEIALLLSVVCEILRRPTKIDE

SEQ ID NO: 16404 - DNA, 610 bp, Panicum virgatum
  misc_feature: Ceres CLONE 1788894
  misc_feature: Encodes the peptide sequence at SEQ ID NO. 16405
gaatgttgctgtgaaggatctgaagcgtgggtatgtggcctccaactccaaggatgaccctgccaaggaggctgccagcttcacctcacaagtcatcatcatgaaccaccctggccagatcggcaacggctatgccccagtgctggactgccacacctcccacattgctgtcaagtttactgagctcattaccaagattgacaggcgatctggtaaggagcttgagaaggagcccaagttcctcaagaatggtgatgctggtatggtcaagatggttcccaccaagcccatggttgtggagaccttctctgagtaccctcctcttggtcgcttcgccgtccgtgacatgaggcaaacggttgctgttggagtcatcaagagcgtggagaagaaggaccctaccggcgccaaggtcaccaaggctgcagccaagaagaaatgatgtgtctggtggttgatagcgtacctagatgcgttattgtcgcttaagttttgttcatggtcattgctgttatctcgtgaactctcagctggcaatgtgtgccctcagtctgtgtgtcgttcacatacggttttaatattttattcggcaaaacttaaattacctgcc

SEQ ID NO: 16405 - protein, 146 aa, Panicum virgatum
  misc_feature: Ceres CLONE 1788894
  misc_feature (21)..(129): Pfam Name: GTP_EFTU_D3 Pfam Description: Elongation factor Tu C-terminal domain
  misc_feature: The sequence is a functional homolog of SEQ ID NO 576 in the 10/666,642 US patent application
NVAVKDLKRGYVASNSKDDPAKEAASFTSQVIIMNHPGQIGNGYAPVLDCHTSHIAVKFTELITKIDRRSGKELEKEPKFLKNGDAGMVKMVPTKPMVVETFSEYPPLGRFAVRDMRQTVAVGVIKSVEKKDPTGAKVTKAAAKKK

SEQ ID NO: 16406 - DNA, 684 bp, Panicum virgatum
  misc_feature: Ceres CLONE 1788902
  misc_feature: Encodes the peptide sequence at SEQ ID NO. 16407
gccgcccctctcctctcgctctccgattcgatgctctcctcccgtctcccatgatctgaggtctccgacggagtagcaccgagactattcagaagctgacaagccatccaagaattcaggcacaggacgccagcagcaagacgacgaagcgaagctaaagggggaaggagaggagagagcgcatccggttccgtcatggagggcggcgagacgacgctgtcggggttcggcggcgcgggggccggcgtggacactaaggtgctgcacgcgttccagacgagcttcgtgcaggtgcagagcctgctggaccagaaccgcgtcctcatcaacgagatcaaccagaaccacgagtccaaggtgcccggcgacctctcccgcaacgtcggcctcatccgggagctcaacaacaacatccgccgcgtcgtcgacctctacgccgacctctcctcgctcttcgccgcctccgacggcggcggccgcgcggcctccgagggcggatccgtcggcaccgtccggcaggccggcgccggccacaagcggatcaggtccggcctcgactgacgacttcatcatctctcagcctcatagctagctagccagggaccgacctccttcctctctctcctctctctttgacttgagctgttcttgtatctatcgacatatctacccaccttatctact

SEQ ID NO: 16407 - protein, 121 aa, Panicum virgatum
  misc_feature: Ceres CLONE 1788902
  misc_feature: Useful for making plants with altered lignin content
MEGGETTLSGFGGAGAGVDTKVLHAFQTSFVQVQSLLDQNRVLINEINQNHESKVPGDLSRNVGLIRELNNNIRRVVDLYADLSSLFAASDGGGRAASEGGSVGTVRQAGAGHKRIRSGLD

SEQ ID NO: 16408 - DNA, 861 bp, Panicum virgatum
  misc_feature: Ceres CLONE 1788904
  misc_feature: Encodes the peptide sequence at SEQ ID NO. 16409
gactgggagcgctggcatcactaggagtcttgcctctgtaggtagagactgttgttgcaggggaagagaccagaagaggggaagagggcaatggcgacctccttccaggggacgacaaccaagtgcaccgcctgcgacaagacggtgtacctcgtcgacaagctcaccgccgacaaccgcgtctaccacaaggcctgcttccgctgccaccactgcaagggcaccctcaagctcgcgaactacaactccttcgagggggtgctctactgcaggcctcacttcgaccagctgttcaagaggacggggagtctggacaagagcttcgaaggaactcccaaggttgtcaagccagaaagaaagaatgagaatgctattaaagtctccactgcctttgctggcaccagagagaaatgtgttggatgcagcaagacagtctatccaattgagagggttactgtcaacaacactatgtatcacaagagctgcttcaagtgctgccatggaggatgcaccatcagcccttcgaactacatcgcgcacgaggggaagctctactgcaagcatcaccacatccagctgatcaaggagaaggggaacttcagccaactcgagaatgatcacgagaagacatcacaggctggatcgctggaggacgaagaagcagagtattaatctttgagcatttccacagatgaataatgaatctccttgcatttgctcgagagcaatatatctttctgtggcacggtttggtttcagttttaccaatggaggtcatgtgcactgagaacaatgatacatcgtcttgtatctgcatgtaaaccttgttaaatctgagtcaaattctctaccggtttcacc

SEQ ID NO: 16409 - protein, 193 aa, Panicum virgatum
  misc_feature: Ceres CLONE 1788904
  misc_feature (108)..(164): Pfam Name: LIM Pfam Description: LIM domain
  misc_feature (12)..(68): Pfam Name: LIM Pfam Description: LIM domain
  misc_feature: SWISSPROT Homolog: EC 2.7.11.1 Non-specific serine/threonine protein kinase
  misc_feature: Useful for making plants with altered carbohydrate content
  misc_feature: Useful for making plants with modulated heat sensitivity
  misc_feature: The sequence is a functional homolog of SEQ ID NO 428 in the 10/412,699 US patent application
  misc_feature: The sequence is a functional homolog of SEQ ID NO 616 in the 11/435,388 US patent application
  misc_feature: The sequence is a functional homolog of SEQ ID NO 992 in the 11/479,226 US patent application
MATSFQGTTTKCTACDKTVYLVDKLTADNRVYHKACFRCHHCKGTLKLANYNSFEGVLYCRPHFDQLFKRTGSLDKSFEGTPKVVKPERKNENAIKVSTAFAGTREKCVGCSKTVYPIERVTVNNTMYHKSCFKCCHGGCTISPSNYIAHEGKLYCKHHHIQLIKEKGNFSQLENDHEKTSQAGSLEDEEAEY

SEQ ID NO: 16410 - DNA, 707 bp, Panicum virgatum
  misc_feature: Ceres CLONE 1788959
  misc_feature: Encodes the peptide sequence at SEQ ID NO. 16411
agggttttggcttcgggcacaccttctatccttgcgccgccaccgccatctacgccgagcgcctcttccccgtcagtctcttcgagcatcaaccatggccgagcagactgagaaggctttcctcaagcagcctaaggtgttcctctgcccgaagaaggccgccaaggggaacaagcctggcaaggggggcaacaggttctggaagaacattggccttggtttcaagactccccgagaagccattgaaggaacctacattgataagaaatgcccgttcactggcactgtgtcaattagaggtcgcatcattgcaggaacatgccatagtgctaaaatgaacaggactatcattgttcgtaggaactaccttcacttcgtcaagaaataccagaggtatgagaagaggcactccaacatccctgcccacatttccccctgcttccgtgtgaaggaaggagaccacgtgatcattggccagtgcagaccactgtccaagacggtgagattcaatgtgctgaaggtgatccctgccgggtccaagagtggtgccgtgaagaaggcattcactgccgcatgagattttgaaagccacagatcatcagattttgatgtcattgtgtattgctatttgatctgcactaggatttttgattgaaaataccgtgagaaattaaagtcaaagagcagctgaattcagcaatattgtc

SEQ ID NO: 16411 - protein, 160 aa, Panicum virgatum
  misc_feature: Ceres CLONE 1788959
  misc_feature (74)..(143): Pfam Name: Ribosomal_S17 Pfam Description: Ribosomal protein S17
MAEQTEKAFLKQPKVFLCPKKAAKGNKPGKGGNRFWKNIGLGFKTPREAIEGTYIDKKCPFTGTVSIRGRIIAGTCHSAKMNRTIIVRRNYLHFVKKYQRYEKRHSNIPAHISPCFRVKEGDHVIIGQCRPLSKTVRFNVLKVIPAGSKSGAVKKAFTAA

SEQ ID NO: 16412 - DNA, 704 bp, Panicum virgatum
  misc_feature: Ceres CLONE 1788967
  misc_feature: Encodes the peptide sequence at SEQ ID NO. 16413
gtcattgccccgccgccgccttcctcgtccccggtccctgcgcgcgcggcagccggcggctagcagagatggccctgcagcaggctccggcgtcgtccctggcgcgcgcgccggcgccgccgccccggtcgtccttctcggcgccgtggccggcgctgcggcagccggcgccggcgcggcggcgggcggccgcgtccacggccgcgcggatcatcaccatgcgggtcgcgtccaagcaggcctacatctgccgcgactgcgggtacatctacaacgacaggagcccgtttgagaagctggccgacaactacttctgccccgtttgcggagctccaaagaggaggttcagaccttaccagccggcggtgtccaagaacgcgaactccaccgatgtccgcaaggcgaggaaggagcagctgaagaaggacgaagcaatcgggcaagccttgccgatcgccattgtcgccggaatcatcgctctggccggcctctacttctacctcaacaacgcctacaactagacgaacaaacacgcttcagagacgaccaatccatttggtgccggggacaggattcttcccattttgccctttgtttttgtggctgtacatgtgtgcgtcatgctacatgcatactactagggatccaattcaacctccaagacagttatacaacccgttgttgagcttgaaatgccatacgtt

SEQ ID NO: 16413 - protein, 150 aa, Panicum virgatum
  misc_feature: Ceres CLONE 1788967
  misc_feature (58)..(93): Pfam Name: Rubredoxin Pfam Description: Rubredoxin
MALQQAPASSLARAPAPPPRSSFSAPWPALRQPAPARRRAAASTAARIITMRVASKQAYICRDCGYIYNDRSPFEKLADNYFCPVCGAPKRRFRPYQPAVSKNANSTDVRKARKEQLKKDEAIGQALPIAIVAGIIALAGLYFYLNNAYN

SEQ ID NO: 16414 - DNA, 740 bp, Panicum virgatum
  misc_feature: Ceres CLONE 1788968
  misc_feature: Encodes the peptide sequence at SEQ ID NO. 16415
atccatcagtccgtgctcatcagtcatcaggctctcaggccgtcgtgcgtgccgtccctctgcgccgactccgctttcttctccggatccggtgaaagccccgatgatccgggcagcaacggtgcatgctcaactcctcctacagccgcgctcctacgcaagccaggcaaaggcggcgtcccgctggcctctcgtctccaggaagccttcgcttcttgggtgtgggcgtcctttctatcagatgggcacaagaggacaagatgaaaataaagtgttgactgcaagagggtgccatacttcccctgagagtcaagaattagcaaagaaaagttgtgttccatgcagctctaaggatttacatcccatgtcagaagattctgctaaaaaattgcttggacaggtgaatggttgggaactgacaactgaaggtggtattctgaaattgcatagagcatggaaggtgaagaactttgttaaaggacttgagttctttaaacttgttgctgcaattgctgagcaagaaggtcaccatccagatcttcatcttgttggttggaataacgtgaaaattgatgtttggactcactctgtcagaggtttaacagataatgatttcatccttgctgcaaagatcaatcatctcaatttagaaggcattttaagcaagagagccaatgtccagaagtagctccaacgtgtcgaccaaatcagacctatttttacgtgctccactccaactt

SEQ ID NO: 16415 - protein, 194 aa, Panicum virgatum
  misc_feature: Ceres CLONE 1788968
  misc_feature (82)..(182): Pfam Name: Pterin_4a Pfam Description: Pterin 4 alpha carbinolamine dehydratase
  misc_feature: SWISSPROT Homolog: EC 4.2.1.96 4a-hydroxytetrahydrobiopterin dehydratase
  misc_feature: Useful for making plants with altered alkaloid content
MIRAATVHAQLLLQPRSYASQAKAASRWPLVSRKPSLLGCGRPFYQMGTRGQDENKVLTARGCHTSPESQELAKKSCVPCSSKDLHPMSEDSAKKLLGQVNGWELTTEGGILKLHRAWKVKNFVKGLEFFKLVAAIAEQEGHHPDLHLVGWNNVKIDVWTHSVRGLTDNDFILAAKINHLNLEGILSKRANVQK

SEQ ID NO: 16416 - DNA, 473 bp, Panicum virgatum
  misc_feature: Ceres CLONE 1788968-R
gcatcccaggcccgacgagtcgcagaacaaattgctcgggcaggtgaaggggaggggcccgacggcgggatgcggtcttctgaaattgcatagggcatggaaggggaagagctttgttaaagggctggagttcttgaggctcgccgtcggaagtgccgggcaaggaggtcaccgtcccgatcttcgtctcgtcgggagcaagaaggggaaaattgaggttggggcccacccggtctcaggggtgccagaagactatcttttccgagccccaaagtccaatgatgtcaattggaaggacattttccgcaagagagccaatttccagaagtagctcaaaggggttcaccacatctggtcctaattttatgtgctccactccaaggtttggctcgcaactcgtatctcgtgggaagcggtggaggcggggtgaagtcacatgtcaggtctccaagattgtgagtttgcactcgagc

SEQ ID NO: 16417 - DNA, 971 bp, Panicum virgatum
  misc_feature: Ceres CLONE 1788989
  misc_feature: Encodes the peptide sequence at SEQ ID NO. 16418
gttaatatctccacccctcccggctcctcccctccccccatcctcctcctcaggtcttccccctcctcccccgatccccaaatcctccggatttcgcactcagccgcggcgcaggtggtgaagggaggcagagaggggaaacatggggctcgcgttcgggaagctcttcagccggctcttcgccaagaaggagatgcggatcctcatggtcggcctcgacgccgccggtaaaaccaccatcctctacaagctcaagctcggcgagatcgtcaccaccatccccaccatcggtttcaatgttgagaccgttgagtacaagaacattagcttcaccgtctgggatgtcgggggtcaggacaagatcagacccctctggaggcattacttccagaacacacagggtcttatctttgttgtggacagcaacgaccgtgaccgtgttgttgaagccagagatgagctccacaggatgctgaacgaggatgagctacgtgatgctgtgctgcttgtttttgccaacaagcaagatcttcccaacgctatgaatgctgctgagatcaccgacaagcttggattacactccctgcgccagcgacactggtacatccagagcacttgtgccacaactggtgagggtctgtatgagggcctggactggctgtccagcaacattgctagcaaggcttgaggcattgctttggatatcaactgcgaactgactaggagctccggatgtatcatggaaacttaggacagaatcgcctctgcaacctgttaggtgtcttctgccggcacgatatattttttgtttggaatatgtaatgatgtcactatcgaatgtttgttctaccctactctactgttggatgttctttggacttgttcattttgcccaaggattggagttccaatatcatgatactttgggaacttattatatattgcattcctatacctgattagtagtagcc

SEQ ID NO: 16418 - protein, 181 aa, Panicum virgatum
  misc_feature: Ceres CLONE 1788989
  misc_feature (5)..(177): Pfam Name: Arf Pfam Description: ADP-ribosylation factor family
  misc_feature: Useful for making plants with altered alkaloid content
  misc_feature: Useful for making plants with altered lignin content
  misc_feature: Useful for making plants with modulated nitrogen use efficiency
  misc_feature: Useful for making plants with altered terpenoid content
MGLAFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATTGEGLYEGLDWLSSNIASKA

SEQ ID NO: 16419 - DNA, 906 bp, Panicum virgatum
  misc_feature: Ceres CLONE 1789006
  misc_feature: Encodes the peptide sequence at SEQ ID NO. 16420
tagccgagcgagcaaccagccccaaaaacccctccccgagatcatcacattctatatatccatcagcagctcaccgcattcgcatcatcacctgcaacgagcaatcaatccccagattttcaccgacggaacacaggcaaggccgtgactagcagcccatcgaccggcgaccagcagctagcaatggcggcggcagcggcggaggggacggcgaagaagagcggcggcgagatgacggtggtgcgcgggctggacgtggcgcggtacatggggcgctggtacgagatcgcgtcggtcccgtccttcttccagccccgggacggccggaacacgcgcgccacgtacgcgctgcaggaggacggcgcgacggtggacgtgctcaacgagacgtggagcaagggtaagcgcgactacatcgaggggacggcgtacaaggccgaccccgccagcgacgaggccaagctcaaggtcaagttctacctcccgcccttcctcccaatcatccccgtcgtcggcgactactgggtgctctacgtcgacgacgactaccagtacgcgatcgtcggcgagccgcgccgcaagaacctctggatcctgtgcaggaagacgagcatcgacgaggaggtgtacaaccagctggtggagcgggccagggaggaaggctacgacgtgagcaagctgcacaggacgccgcaggacgacccgccgccggagagcgacgccgcgcccaccgacaccaagggggtctggtggttcaagtcgctcttcggcaaatgatcgtccatcacattgctgcgcttgcttgctgcttgttgcttgctagctagctagtacactagtgaatctatctgctataatccgtgccgcgcgcggcgaataaaattggattgctgctgaattcttctc

SEQ ID NO: 16420 - protein, 197 aa, Panicum virgatum
  misc_feature: Ceres CLONE 1789006
  misc_feature (23)..(171): Pfam Name: Lipocalin_2 Pfam Description: Lipocalin-like domain
MAAAAAEGTAKKSGGEMTVVRGLDVARYMGRWYEIASVPSFFQPRDGRNTRATYALQEDGATVDVLNETWSKGKRDYIEGTAYKADPASDEAKLKVKFYLPPFLPIIPVVGDYWVLYVDDDYQYAIVGEPRRKNLWILCRKTSIDEEVYNQLVERAREEGYDVSKLHRTPQDDPPPESDAAPTDTKGVWWFKSLFGK

SEQ ID NO: 16421 - DNA, 516 bp, Panicum virgatum
  misc_feature: Ceres CLONE 1789007
  misc_feature: Encodes the peptide sequence at SEQ ID NO. 16422
atctctccctttcctccccgaggctccaaaacctagctcttcccttttcctcgggcggcggcggccatggacaagagcatgctcggcgacctggacggcctccccgaggaggacaagatgcgcatggcctccatgatcgagcagctccagatccgtgacagtctgagaatgtacaattccctggtggagagatgcttcacggactgcgtggacacattccgccgcaagaccctggacaagcaagaggagtcatgtgtccgccgctgcgctgagaagttcctgaagcactccatgagggttggcatgagatttgctgagcttaaccagggtgtggccacacctgactaaactttgttgcccttgccaagttccccccgtggggatttttgtcagcatctatttgtaatcctaaaaaagattttagcaccctttgagaaatgcaactcggtaaggttgcccttgaaccaactgctgggtatgacattgaataaaattacctagattcattttatccag

SEQ ID NO: 16422 - protein, 93 aa, Panicum virgatum; identical to SEQ ID NO: 15996
  misc_feature: Ceres CLONE 1789007
  misc_feature (20)..(85): Pfam Name: zf-Tim10_DDP Pfam Description: Tim10/DDP family zinc finger

SEQ ID NO: 16423 - DNA, 522 bp, Panicum virgatum
  misc_feature: Ceres CLONE 1789008
  misc_feature: Encodes the peptide sequence at SEQ ID NO. 16424
gcatctgacttttctctctacacgacttgctcgggcgccgccgccgacgtcacagcagccaccgggacctgcaacccgagaaagcatggatactcaggttaagctcgccgtcgtggtcaaggtgatgggccgcactggttccaggggtcaggtgacccaggttagagtgaagtttctggatgaccagaaccgtctcatcatgaggaacgtcaagggccctgtacgagagggtgacatcctcaccctgctcgagtctgagagggaggccaggaggctgcgctgaaacagctggtggttgtgccagttgttcgctgttcttgtcttaaacaagttaaatgatggattgattcccccttgcctagtgtactgctttcgtatcaagttattgaagaatgctaccctgtcttttgagtaggctatagaatgagttaagagcaatggaaatgtaatttgtgcacttgtcctgttgcaagttttggtctgttaccctgaatgaatttaagtgcactttgatgctgtgtg

SEQ ID NO: 16424 - protein, 65 aa, Panicum virgatum; identical to SEQ ID NO: 9766
  misc_feature: Ceres CLONE 1789008
  misc_feature (1)..(65): Pfam Name: Ribosomal_S28e Pfam Description: Ribosomal protein S28e

SEQ ID NO: 16425 - DNA, 744 bp, Panicum virgatum
  misc_feature: Ceres CLONE 1789046
  misc_feature: Encodes the peptide sequence at SEQ ID NO. 16426
acttgttttcatctagaacccagacgccagaccgttggcacagcgagtgagcaatggcaaccatcagcgcggccgcatccgccgccctctttgccggcgccggcgtcgccaggccgtctcaggctcacgggctgcctcagctgagagcgagagccggcaaggtgcggtgcggcgcctgctcgaagcagcacgacggcaacggcaaggcgccagcggcggctccggccggcgcgtccctgctggccgtggcgagcgcgatgacgacgtcgccggcgctggctctggtggacgagcggatgtcgacggagggcaccgggctcagcctggggctgagcaacaacctactggggtggatcctgctgggcgtgttcggcctcatctggtccctctacaccgtctacacctccacgctcgacgaggacgaggactccggcggcctctccctgtgaaatccttttgattaccagctattttcttcagccctgacctgtgcgagttcgacgatctgtggttgcaactgcaagtctgcgactgaaggcatggtttgtatgcgactgtgaattgtgattgggttgcatcggagatggtaatgacgagtacttagtagttggctttctggtgggttgagattgcacctgtgatgcatggaagaatctgggcacacgctgtactgtctgaagtttgatagcagtctgattttgttgctgagtactgtcatagtgtggcatgagaaagaaatattct

SEQ ID NO: 16426 - protein, 131 aa, Panicum virgatum; identical to SEQ ID NO: 14579
  misc_feature: Ceres CLONE 1789046
  misc_feature (1)..(131): Pfam Name: PsbW Pfam Description: Photosystem II reaction centre W protein, PsbW

SEQ ID NO: 16427 - DNA, 716 bp, Panicum virgatum
  misc_feature: Ceres CLONE 1789059
  misc_feature: Encodes the peptide sequence at SEQ ID NO. 16428
ctcgctgcgcttctactcgaggaagtagattcgacgaggaaacccaaagcgggagcgcgcgcgcatcaaggagttcttctatctacccagcatggagaccgagttccaggatggcaagcaggaggttattgaagcatggtacatggatgacagtcaagaagaccagagacttcctcatcaccgtgaacccaaagaattcattcctctggagaagctttcagaactaggaatcgtcagctggcgcctaaaccctgataactgggagaatgatgagaacctcaagaaaattcgtgaagccagaggttactcttacatggacatttgtgatgtatgcccggagaagctgccaaattatgagactaagattaagaatttctttgaagagcacctgcatactgatgaagaaatacgctattgccttgaagggagtggatactttgatgtgagggatgaaaatgatcagtggatccgtgtagcagtgaagaagggaggcatgattgttctgcctgcagggatgtatcaccgcttcacattggacactgacagctacatcaaggcaatgcggctcttcgttggtgatcctgtttggacgccgtacaaccgtccccatgatcatctgccagagaggaaggagtatctggacaagcttatcgaggcagaaggtggagatcaagctattgaagctcgctgaggccactttgaacctacctgttggg

SEQ ID NO: 16428 - protein, 199 aa, Panicum virgatum
  misc_feature: Ceres CLONE 1789059
  misc_feature (14)..(168): Pfam Name: ARD Pfam Description: ARD/ARD' family
METEFQDGKQEVIEAWYMDDSQEDQRLPHHREPKEFIPLEKLSELGIVSWRLNPDNWENDENLKKIREARGYSYMDICDVCPEKLPNYETKIKNFFEEHLHTDEEIRYCLEGSGYFDVRDENDQWIRVAVKKGGMIVLPAGMYHRFTLDTDSYIKAMRLFVGDPVWTPYNRPHDHLPERKEYLDKLIEAEGGDQAIEAR

SEQ ID NO: 16429 - DNA, 526 bp, Panicum virgatum
  misc_feature: Ceres CLONE 1789083
  misc_feature: Encodes the peptide sequence at SEQ ID NO. 16430
tccccctcagctgtaaactacttaaacatcaatccagctggcactctgtagctagcattcgcttaccttaccaagatcatcttctcaatcatcataatacactgacaatggctttgatgatcaaaaacaacaggatgcaggcggtggaggccttggccgtcgacatggcacctgctgcgctggtggagtcggcgtcggcggccatcacgtgcggccaggtgagctcggcgctggcgccgtgcatcccgtacccgacggggaaggcaagcgcgctgccctcgtcatgctgcggcggcccgcacaccccgaacaccgcggcgcggacgagcgcggaccggaaggcggcgcgccgttgcctactgagcctggccagcaccgtcaagacggcgaacatggtcaccgtcaccaccatccccggcaagagcggcgtctccatctcattccccatcaacatgtccactcactgcaacaaggtcaactaaataaatggaatatatgtacataccacctgatcgacgatgacaag

SEQ ID NO: 16430 - protein, 124 aa, Panicum virgatum
  misc_feature: Ceres CLONE 1789083
  misc_feature (35)..(120): Pfam Name: Tryp_alpha_amyl Pfam Description: Protease inhibitor/seed storage/LTP family
MALMIKNNRMQAVEALAVDMAPAALVESASAAITCGQVSSALAPCIPYPTGKASALPSSCCGGPHTPNTAARTSADRKAARRCLLSLASTVKTANMVTVTTIPGKSGVSISFPINMSTHCNKVN

SEQ ID NO: 16431 - DNA, 701 bp, Panicum virgatum
  misc_feature: Ceres CLONE 1789107
  misc_feature: Encodes the peptide sequence at SEQ ID NO. 16432
gagaggcgtctgcgtgcgtggtcggtgccggtgcgtggcgtggtggccgtgcggtcccctcttcctctcttcctctcggcgccggcggacgtgtcggggggaggaatggccgcgccgagggctccgctcggggcggtcgcagtggccgcgctcgtcgtcgccatcttcatgccggccgcggcggcgcaggggccggcgccggctcccaccagcgacggcacatcaatcgacctgggaatcgcgtacatcttgatgctggtggccctggtgctcacctacctgatccacccgctggacgcgtcctctccctacaagctcttctaatccctgttcgttttgtttgttcgtcgatgatgttatgggtctgataggatttttagccatgcaagacgtttaggtgaggtttggagatttagaatgaacgtcaacgtctgatctgatcttggcatgtatggtaagttttttggtggtctgaatgcctgattggttgtatcggattccatgatcttgtgcccagttgtgcttgctgttggccgttgctggattctatttccgctggtcccgcccgggtgctcattgacatgtgctctgccatggatgccgttgcaagttgcaacaccaaacatgtgaaggattgggtcatggctgtgcctgtcactgctgacacgacggtggtttcattgtggtcctattcatctgtt

SEQ ID NO: 16432 - protein, 72 aa, Panicum virgatum; identical to SEQ ID NO: 13860
  misc_feature: Ceres CLONE 1789107
  misc_feature: Useful for making plants with altered carbohydrate content
  misc_feature: Useful for making plants with altered cell wall content and/or composition
  misc_feature: Useful for making plants with modulated nitrogen use efficiency
  misc_feature: Useful for making plants with modulated salt sensitivity

SEQ ID NO: 16433 - DNA, 743 bp, Panicum virgatum
  misc_feature: Ceres CLONE 1789116
  misc_feature: Encodes the peptide sequence at SEQ ID NO. 16434
atctcattccgctttgagcttgcttgcagctccagctcccctcgtctcttggtggctacgccatggccaccgtagtcctgatgagctgcagcctccgcgcgccggcctgcagcggcttatctggcgtccgcgccgccccggcaccggccatcgtcgccatgcccgccgccaagcagcaggttgttggccgcggcgccaggctgcgcgcgcaggccacctacaacgtgaagctcatcacgcccgacggcgaggtagagctgaaggtgcccaacgacgtgtacatcctggaccaggccgaggaggaagggatcgacctgccctactcgtgccgcgcggggtcctgctcctcctgcgccggcaaggtcgtctccggcagcgtcgaccagtccgaccagagcttcctcgaagacgaccaggtcgccggcggctgggtgctcacctgcgccgcctaccccacctccgacgtcgtcatcgagacgcacaaggaggaggagctcacctcctcttcgtaatccgatccagtatatgcggctttcattgcttattaattatctcagctcccttgattatatatatataaatataattaaaccctacgtcgtgcgtgctatacttaattggtttgcaattcagctatatgcataatgcatgctagctgtggctatttatatctggtttatttgcaattgatcgagctatttttttttgtgttaatgtttcagctccatataaataatgtaatg

SEQ ID NO: 16434 - protein, 149 aa, Panicum virgatum
  misc_feature: Ceres CLONE 1789116
  misc_feature (58)..(133): Pfam Name: Fer2 Pfam Description: 2Fe-2S iron-sulfur cluster binding domain
MATVVLMSCSLRAPACSGLSGVRAAPAPAIVAMPAAKQQVVGRGARLRAQATYNVKLITPDGEVELKVPNDVYILDQAEEEGIDLPYSCRAGSCSSCAGKVVSGSVDQSDQSFLEDDQVAGGWVLTCAAYPTSDVVIETHKEEELTSSS

SEQ ID NO: 16435 - DNA, 672 bp, Panicum virgatum
  misc_feature: Ceres CLONE 1789136
  misc_feature: Encodes the peptide sequence at SEQ ID NO. 16436
acggccgaggcacctcgccaccgcgaaaccttatccccaaaaccacacggataaaccctagcgctccggcgatggcggcggcggcggcggccatccgctccggcgagctcctcgcgtaccccgtcgcgctgcggcggacgccgctgtcggtgtcggtgcgggtgcggggcgcgccggccgcgagggcggccgtggcgatggtgcgggcggaggcgacggccgagggggtcgggaaggccaagggggcgggggcgggggcggggaagaagaggccggcgagcgggatcacgaagcccaagccgatctcgccggatctgcgcgagttcgtcggcggcgcggcggagctgccccggaccgaggccatcaagctcgtctgggcgcacatcaagggcaacaacctgcaggatccaaataacaagaagataataatctgtgatgacaaattgaagaagatatttggaggtcgtgatcgtgttgggttccttgaaatctctggactgcttaacccccacttccagaaatgacaggatttttgtagatcacactgttttgttttgtattagctgtggctgttgtatgggtacatttagctaaacctggtttaaaggcaaatatgttccctgacgacgcatggtcatctaatatttgccattaatggtgtgctagctcctc

SEQ ID NO: 16436 - protein, 150 aa, Panicum virgatum
  misc_feature: Ceres CLONE 1789136
  misc_feature (72)..(149): Pfam Name: SWIB Pfam Description: SWIB/MDM2 domain
  misc_feature: Useful for making plants with modulated biomass
MAAAAAAIRSGELLAYPVALRRTPLSVSVRVRGAPAARAAVAMVRAEATAEGVGKAKGAGAGAGKKRPASGITKPKPISPDLREFVGGAAELPRTEAIKLVWAHIKGNNLQDPNNKKIIICDDKLKKIFGGRDRVGFLEISGLLNPHFQK

SEQ ID NO: 16437 - DNA, 646 bp, Panicum virgatum
  misc_feature: Ceres CLONE 1789161
  misc_feature: Encodes the peptide sequence at SEQ ID NO. 16438
ccatcttgaaaagagttcggaggacatctgggccccgtttggtttctctgggcagttcctagcacgaattccttttgcatcgttcctccccctgccttgcaggatctccagcacctccacgcctcgatccagatccagctgaaatatggatgcaaacagacgccagagtggaattcagcagttgttggctgcagagcaagaggctcagcagattgtaaatgcagctagggcagccaaatcggcaaggcttaggcaagccaaggaagaagctgagagggaaatagctgaataccgttcccaaatggaggctgaattccagagaaaggttgcagaggaagaagaagatgggagaagaagaaaatagagagaggagagggtggggaagaggtagaagaagacatcagccccccttacgtctcttggctagatccgccactgaacgttgctgtgcggtgaatatatgattgcaaccttttgtatctctcaatttctttatatcagaggggtaataaaggatttgtcacttatagctgtaattccatgttattgatcacagaataagctgctgcagtttagcagcaaacctgccttgtactatcagaacttggtgatcatttggtatcagtaaatattgtgttttctggtc

SEQ ID NO: 16438 - protein, 72 aa, Panicum virgatum
  misc_feature: Ceres CLONE 1789161
  misc_feature (5)..(72): Pfam Name: V-ATPase_G Pfam Description: Vacuolar (H+)-ATPase G subunit
  misc_feature: SWISSPROT Homolog: EC 3.6.3.14 H(+)-transporting two-sector ATPase
MDANRRQSGIQQLLAAEQEAQQIVNAARAAKSARLRQAKEEAEREIAEYRSQMEAEFQRKVAEEEEDGRRRK

SEQ ID NO: 16439 - DNA, 811 bp, Panicum virgatum
  misc_feature: Ceres CLONE 1789162
  misc_feature: Encodes the peptide sequence at SEQ ID NO. 16440
gaagcagcttcagaagcaatctatattgaactggtcgaccatgtggaagctaaaggtctcagagggaggaggggcatggctgcagacggtgagcaactttcatggccggcaggtgtgggagttcgactccgacgccggcacggaccaggagcgcgccaaggtggagcagcttcgccgggagttctgggagaaccgcttccgaaggagggaatcgcaggacctcctcatgcgcatccagttcacgggactatatcatctgcgggcggatatgcccgcggccgcgaaactggaagacggtgacgaggtaacggaagaaattctgaaggagtcgctcagacgagcgctcggttggatgtcagacctccaagctgaagatggccactggccaggtgatttcagtgggatcatgtacctgctgcctttctggattttcgcgctgcacatcacaggatcaatcgataatgtactatccaaagagcacattcgtgagatatgccgccatatctacaaccatcagaacgaggacggcggctggggcttcaacgttttggacgagagtgccatgtttggcacatgcttaaactacgtcacattgaggctgctcggacaagtgcaaaaggatgagaatgatggactagcaaaaggtcgcgcatggatcttgtcccatggcactgcaactgcagcgccacaatgggcaaagatattactctcggtagtaaacttattctcctttctaaaactgattggtaaagctcgccttttcgagagaaagcattgcaaatttaagttatggacgcttctcggtactgtc

SEQ ID NO: 16440 - protein, 256 aa, Panicum virgatum
  misc_feature: Ceres CLONE 1789162
  misc_feature (146)..(189): Pfam Name: Prenyltrans Pfam Description: Prenyltransferase and squalene oxidase repeat
  misc_feature: SWISSPROT Homolog: EC 5.4.99.8 Cycloartenol synthase
  misc_feature: The sequence is a functional homolog of SEQ ID NO 15 in US patent 7186884
MWKLKVSEGGGAWLQTVSNFHGRQVWEFDSDAGTDQERAKVEQLRREFWENRFRRRESQDLLMRIQFTGLYHLRADMPAAAKLEDGDEVTEEILKESLRRALGWMSDLQAEDGHWPGDFSGIMYLLPFWIFALHITGSIDNVLSKEHIREICRHIYNHQNEDGGWGFNVLDESAMFGTCLNYVTLRLLGQVQKDENDGLAKGRAWILSHGTATAAPQWAKILLSVVNLFSFLKLIGKARLFERKHCKFKLWTLLGT

SEQ ID NO: 16441 - DNA, 804 bp, Panicum virgatum
  misc_feature: Ceres CLONE 1789163
  misc_feature: Encodes the peptide sequence at SEQ ID NO. 16442
gcagccagcagtcggccggttctcgccacctctcgcacctccactgagcgcaccagccgcccccatcctcctctccctcccccggcgcaggctgagcacgcggatctctcgggcagcggaggcaaggcgcggcggcggcggcggcggcggccctcgaagcggcgcccccgggtggggcctcgcaggcggcggggagggaggcggaggcggagatgagccgggggcggtcgccggagccattggatttcttcatctggactgtgcaggatgtgggtttatggttggaggaaataaatctcggaagctatcgccagtcatttgaagaaaatggtgtgaatggagagtatctagaaagcctgtcgatgttcaccacagagcagattcttcgattcataagacggtgtcatatgaaatggggagattttattacgctctgtaaagagttgaggcgcatcaaagtcgcctgcctgaaaggggagcaggaagtccgcaggccgtggtgggcgccatcatgcctgtcggctgtgttcgtgcgggtggccaagcgcaaccggcagtcccgtgtcgtctccctgaagcttgaagcctagcaggcttgccatcacccaccccgtgcaccgccggcgcgctccagggcgcctctctcactctgtaccatgcagcactaggtcccggcggtcctggaacctgttctttgccttagaattatcatcctgctggatgaccagcgccatcgagctcaatgaccagtgcgtgtgtcgtgaatttgcttctttcccatatatatacacacatagggttgtg

SEQ ID NO: 16442 - protein, 125 aa, Panicum virgatum; identical to SEQ ID NO: 14820
  misc_feature: Ceres CLONE 1789163
  misc_feature: SWISSPROT Homolog: EC 2.7.10.2 Non-specific protein-tyrosine kinase

SEQ ID NO: 16443 - DNA, 805 bp, Panicum virgatum
  misc_feature: Ceres CLONE 1789200
  misc_feature: Encodes the peptide sequence at SEQ ID NO. 16444
acaagccaaaccggataggataccgacacagaaccaagcaagaagagggagccgccgctacttctctcctccgatcaaatcagagcgaccccgtagccgtccggcggcgtgccctcctcgcgattcgccgccgtccgcccccccccccccccacccccaccgcgagcgcctgctccgaagtcgcgctagcccctagggttccttcgctgccgccgcgccgctgtcacaggaggaggaggaggaggggaatacatcgccatggcgggtaggcttctcgcgaatctgatcgtcgttggcggaaccgttttgggcagggccgtgctccaggcctaccgacaagctatcgtcaatgcgaacaaaaatggagctgcccaagaagctataaatggtattagacgtgctagcaaggccatgactgagcaagaagcccggcagatacttggtatcagtgaaaaatcgacttgggaggagattattcagaagtatgacgcgatgtttgagaggaatgcgaagaacggaagcttctatctccaatcaaaggttcatcgtgcaaaagaatgcctggaacctttgtatcaaaaggctgatataccaaactgagactgtgttgacgcctagcatccgcatgaagcactatgcttaactgatgaattagagatgatgattctgtttcgagttatgttggttgcgtcaggttgattagttgtaacgggacgcagctttgctggactcagaataatgtttaacaaagatacaatattcttttttctttttttgaaataaaggattatatcttttagatatt

SEQ ID NO: 16444 - protein, 113 aa, Panicum virgatum
  misc_feature: Ceres CLONE 1789200
  misc_feature (1)..(111): Pfam Name: Pam16 Pfam Description: Pam16
MAGRLLANLIVVGGTVLGRAVLQAYRQAIVNANKNGAAQEAINGIRRASKAMTEQEARQILGISEKSTWEEIIQKYDAMFERNAKNGSFYLQSKVHRAKECLEPLYQKADIPN

SEQ ID NO: 16445 - DNA, 720 bp, Panicum virgatum
  misc_feature: Ceres CLONE 1789237
  misc_feature: Encodes the peptide sequence at SEQ ID NO. 16446
aatcaaacggctcgctccttttccttataaacttagcttgctacccctgtgcagaagcactagtgtgatctgactcttggccttggcaagctcccagctccagcttggtgccggtgcctgctctgaagcatagcaagatgggcaggggagctcagccatctgcgccgctcctgctcttctctctggggctggtgcttctctacttcaccgcaggcagcaccgtccgtcttgcggaggcacagaagacgtggtgcatcgcgaagccgtcggcgtcgaacgagatcctggcgcagaacctggactacgcgtgctcccaggtgagctgcgccgtgatccagaagggcgggccgtgctactacccggacagcctggtgtcccgcgccgccgtcgccatgaacctctactacgcctacagcggccgccacgcctggaactgctacttcaacaactccgcgctcgtcgtccagtccgaccccagttacggatcctgcacgtactactgatggtgagtggcgccggttgtggagtggagggacgccgtgcgaactcaactgcaaactgctgatgcagctgagacaactcagattgtcggggaacggcagaggctactctctgattgttgtgtggtggattgtgatgtgtctagtgaactgtgatgcagttgacctttggagattttcgaacagctcattgatatcttaactcgaggttgtcgcttcg

SEQ ID NO: 16446 - protein, 121 aa, Panicum virgatum
  misc_feature: Ceres CLONE 1789237
  misc_feature (37)..(120): Pfam Name: X8 Pfam Description: X8 domain
  misc_feature: SWISSPROT Homolog: EC 3.2.1.39 Glucan endo-1,3-beta-D-glucosidase
MGRGAQPSAPLLLFSLGLVLLYFTAGSTVRLAEAQKTWCIAKPSASNEILAQNLDYACSQVSCAVIQKGGPCYYPDSLVSRAAVAMNLYYAYSGRHAWNCYFNNSALVVQSDPSYGSCTYY

SEQ ID NO: 16447 - DNA, 2239 bp, Panicum virgatum
  misc_feature: Ceres CLONE 1789258
  misc_feature: Encodes the peptide sequence at SEQ ID NO. 16448
gctcccctccactactccagacgcctctcgccgtcgcccaccgcccccgccgcggccgcctcctccgcgcctcgctcgctctgcttcctccgccgcggcccgagccgtttcgcggcggagcggacccggaggcccaccatggccgaggcgatccagctggaggccgccgccggcctggcccacgacctcgggtgctcggccgtcacagccggcgtcgccctcgcgctcctcaaattcttcgaggagctcgccaagcgcggcgtcttcgaccaggtaaccgcccttcgcgtggcccctcccttctgcgctcatcttcgccgatttagcgcttgaatcagactaccagtaagtactagcgtcagaattttcagttactattaccagcagtaagaatccctgctgcattacgttgatgaactaatttgaacaaaaacgagttgggaatagttcttattctatcaactggcgaaaaaaaccgataaaaccgataatcgggtttataggtggtagctggtttgataaaatttcttggtaattttgaatccgtactcaccccttacctcctaggccacatacatgtcttctcatttctaagcattatgatgtcttgtttttcatattagattgtttgaagataatctagattattttgcatacggtttgagagggttttttccgaaaattttccaagaaatccgataaacacgtttatcagcaacctccgattttttccccacccgctaaagttaaccctgtgaagtacaacttgcatgttcaaactacacagtgattcattagctcgttgctgctgaagttacagacgctgtgctatcacagcatcaccatcagtccagtgaagtaccacggtacttgcgccagaatcttctgtaaccagtacttgcagcaaggaagccgctgtttcattgggttgtattataaccatgcagagtgagttggtgggaggcgatactgtcctgtgaactgtggattgagtgattcagtggtccttgctttgcagaaatttagagtaccactgcaatgaggatttgcagatttgcagtggactctattgttcaagcgacacaggacaggagccctgcactgccaagtgctaagtactagctgtgcctttcagaagtatttgttgaattattactgtgagtaggatattttcggtggaattggcgatcaactagtagccaaacccacacaaaatgactatggtagaaagatattgtgcagtgccgaatgatgagtttaggtctatttaattttagttaggacaagaatgagaaatgaatagttcagcagctgctattcattagtcacatttacaaagagtgaaaaagttcgcgttgtattgttggaaaagaactttgagaacctttggagttgcacccagtttttcaacaatctaaggccgactcaaagtgcattgtgtattgaaaattttgctttacttttgtgtagaaattcagcaggaaacttgttcatataagtgttggactggtgttcttgctcttttggcctcttttcagctctggaacatatgctcctttccttgctgcgctagcaccaggggttaacattataaggatgcttctactggggctgggactagtgaaaaatgaagctatggttaaatcaataagccgctctggagatcacagggaacttctcaagggaccactctattatgctaccactataacttttgccacttctgtattatggagaagctcaccaattgctatagcacttatatgcaacttatgtgctggggatggtatagctgatgtattggggagacgtctaggtaaagaaaagcttccatacaaccccaacaaatcatatgctggaagcatagcaatggtggttggtggttttctggcttcacttgggtacatgcattacttccacacttttggttttattgaagaaacatggaacatggcgttaggcttccttgtggtgtctatagctgcaacactcgttgaatcacacccaatcagcacagaactggatgataatttgactattcctttgacatcattcctagttggtagcctcattttctgatgtttagcctcaaagggaagctaagatgtttttctctatcgtgttctaacatgtaaaagattacggacagttttaaattgtgagaattatacctgagtatggtgaatatattttctgtagtgtctgtagctgcaacactcgttgaattacacccaatcag

SEQ ID NO: 16448 - protein, 160 aa, Panicum virgatum
  misc_feature: Ceres CLONE 1789258
  misc_feature: Useful for making plants with modulated nitrogen use efficiency
MLLLGLGLVKNEAMVKSISRSGDHRELLKGPLYYATTITFATSVLWRSSPIAIALICNLCAGDGIADVLGRRLGKEKLPYNPNKSYAGSIAMVVGGFLASLGYMHYFHTFGFIEETWNMALGFLVVSIAATLVESHPISTELDDNLTIPLTSFLVGSLIF

SEQ ID NO: 16449 - DNA, 1683 bp, Panicum virgatum
  misc_feature: Ceres CLONE 1789268
  misc_feature: Encodes the peptide sequence at SEQ ID NO. 16450
aaaaaaaaaaaactgtgttctccatctctctctctccccccaccatttctgctctctccctctctctctctcaagaggatcgttgctcctccctctaatctctcccagacccagactctcatcagggccagggcggcaggcccgtgccgtgcaggtggcagcggcagcgcggccaaatcccggcggtggtgcggactgcggagcagggagcgggcggcggtgcggcgccgaggcgggggccgccgccccccatcggcataaggggcaggggataggacacagcctatttccgtctctctctctctctctctctctctctctctctctctctctctctctctctctcggtatcggccttcctttcctagcggcggcgactgggcgagtggcgcggcccctggcccgttcttcgttcttcgtggggcgcttcgccggcgacgagcatccgacaggggcaatggcatcacaggctggaggtggcagaggcggtgatgctggctcggcgcaacacgggcaggttcagggtttggcaagacaggggtccttatacaaccttaccctggatgaggtgcagaaccatttgggagagccattgcttagcatgaattttgatgagctcctgaagagcgtgcttcctgacggtgtagacccaaatggcactgtcactggcaagcctgatacagcatcgagtctgcagcgacaagggagcattatgatgcctccgcagctgagcaagaagactgtcgatgaggtgtggaagggtatccaggatggacctgggaccagtgctacggatggtggacggcacaggcgggaaaggcagccaacgcttggggaaatgacccttgaggaatttttggttaaagctggggttgtttcggaaggacttatgaaggattcggatgatttgccgagtaatatgaatacatttgggagcaatgttgtggcgggtggcggttctggtttgaactctggagcacagtggttgcagcagtaccagcagcaagctttggagtcccggcagccgagtttggtgggttcatacatggctagtcagttgtctccccagccattatctgttgctacaggtgctatgttggattcaatttactcggatggccagattacttcgccaacagttggtgcattttcggaccctcaaacacctgggcgcaagcgtggtgccttaggggaggtggtagataaggtgattgaaagaaggcagaagaggatgataaaaaatagggaatcagctgcacgatcaagagcgagaaagcaggcttacactaatgagcttgaaaacaaggtttcccatctagaagaggagaatgagagactaaagaagcagaaggagttcgatgagatattgagctctgctctgcctccagaacccaagtatcagctcaggcgaacaagctcggctgccttttgattttggatggtgacaatgctcacaatgacctttgtacattagacaaaggttcaacttatatagttttgcctctttgtgggttagaaacaattgatagattgaggttatagctttccccagcccggtggtccagtgtatgtagattggtagcaacatgtagcatgccctggggctgttcgttaccgaggcgtttgccagaatgtaaatgttctagacacatgttttaagttctgagagctttctcaaactgg

SEQ ID NO: 16450 - protein, 324 aa, Panicum virgatum
  misc_feature: Ceres CLONE 1789268
  misc_feature (250)..(305): Pfam Name: bZIP_1 Pfam Description: bZIP transcription factor
  misc_feature: The sequence is a functional homolog of SEQ ID NO 1538 in the 10/412,699 US patent application
  misc_feature: The sequence is a functional homolog of SEQ ID NO 1539 in the 10/412,699 US patent application
  misc_feature: The sequence is a functional homolog of SEQ ID NO 1541 in the 10/412,699 US patent application
  misc_feature: The sequence is a functional homolog of SEQ ID NO 1537 in the 10/412,699 US patent application
  misc_feature: Useful for making plants with altered alkaloid content
MASQAGGGRGGDAGSAQHGQVQGLARQGSLYNLTLDEVQNHLGEPLLSMNFDELLKSVLPDGVDPNGTVTGKPDTASSLQRQGSIMMPPQLSKKTVDEVWKGIQDGPGTSATDGGRHRRERQPTLGEMTLEEFLVKAGVVSEGLMKDSDDLPSNMNTFGSNVVAGGGSGLNSGAQWLQQYQQQALESRQPSLVGSYMASQLSPQPLSVATGAMLDSIYSDGQITSPTVGAFSDPQTPGRKRGALGEVVDKVIERRQKRMIKNRESAARSRARKQAYTNELENKVSHLEEENERLKKQKEFDEILSSALPPEPKYQLRRTSSAAF

SEQ ID NO: 16451 - DNA, 2276 bp, Panicum virgatum
  misc_feature: Ceres CLONE 1789271
  misc_feature: Encodes the peptide sequence at SEQ ID NO. 16452
ggttccgccccccaacacgcgcgctccacttcgcctccccgcgcctccccgtcgccccacctctcccatccgctaccggcctcaccgcttggatcccccgccggccgctgctcctcctcgtcctgcgccgccgtcgccttcgcctccgtcctctctgcgcccggcggccagcgagactaggacgcggactccgctgcgcatcgggggtgcgggccggtgctcacgccgccgccactgccgccatcctcgcgtacctcgcccccgaggaaatctctcgatctcctttctcctccagtcctcccgctcctccctggccagcacaagcagaagacttcgacggcgcgactcgtggccgccggctcctcgtccgggctcctgcggcccccctcttccctcctctacaaggcggcggcgccctgggacgggggcgtcgtgcgcgtctacagctccgacgacttccctgctgcgtggcgcctccgcgtcttcctcctctacaaggcggcgacgcccctccacttcacgccttccaaggtggccccgctcgaccgccccctgctcggccgccgacccggaggtctgcaagaccctgtcctcgccgcctgccgttcaacttctgctgccggttgctagctcaggaaatcattccaagtgttacctaggggatatgcagatttaaagagaatcagaagactgaagttctggctactgggctgtgtacttattaagagatcggagctcgtgcagtggcctgtcgctctaccgttcacctctgcagcaggcttgcaggaatccaaagggctcctttgatcagctctggtttgatgttggtggtttctgcttgtcagatcactccaagtggtgtaggtgttgagccgttcgttcaggttgggtcggtcccggtcccagacctccgattgctgatggatctcctctctgctgcgtacggcggcgctacctcagacgaggacgacgacgagccgccctcctccccgccagtcgccaccgccctcacctccttcgcaccacctcccgtaaagcggccgcggtgggaataccaaccatgcctccccccaccctcgtccttctcgcagccgcccctacccaaagcagcgccgccgccgacatctccagccagcggcaggtacatctccaagaggcagcgcgccctcctggctgcatctcgagcacccgtggacgccgcatcactccttcctccgcagacgacagcagaggtcgattcctcagttggctccatcactgattcaaatctgcgagctgacattttgcattccttgcgatgccaaccaaagcctggctctagcaaaagtttgccttcaaagctctcggtttctttgaagggtcacacaaaggcaataaattgtatagattgatcgccaactcatgcacatctactcacttctgctggaatggatcatacagtccacgtatggaacgtatgggacaaaaggaatactactgcttgtgttttgaagcatcacactgctgctgtaaaggatgtgaggtggtcccctcatagcctctctttactttctggagggcttgattgttccgtacagttaattgatgttgtggaaggaaaggtaatcaaagtattcaaggaagatcaagctgtggaggttatcaagttcaacccaagtaaccccaatctcttcctatctggtgggtcgaagggttctcttaggctatgggatattcgaagtggtctggtaacagaagaatttcgtagaagtcttgggaccatccttgacatcgaattcagtgctgatgggagacaatttatctcttcaacggacacaaccagaagcaatattagtgagaacactataattgtctgggatgtcctgcgacaagttccattatctaatcaggtttatactgaagcattcacatgcccatgtgtaagatatcacccgcatgaagcatcttttgttgcacaatcgaacgggaactacatagctattttttcagcaaggccacccttcaagctgaacaagtatatgcggtttgaaggacatggagtttggggtttcccgataaagtgcaatttttctccaagtggaagagaacttgcatccggttcgtcagatggatccatttacttttttgattataaatcagcaaggcctttacggaaaatcgaagcattcaaagaagcctgcactgatgttgtataccaccctgtaataccaaatgtgattgcttcatgtggctggactggtgaaatatctgtttttgagtgagatataatgctcggt

SEQ ID NO: 16452 - protein, 277 aa, Panicum virgatum
  misc_feature: Ceres CLONE 1789271
  misc_feature (15)..(53): Pfam Name: WD40 Pfam Description: WD domain, G-beta repeat
  misc_feature (57)..(95): Pfam Name: WD40 Pfam Description: WD domain, G-beta repeat
  misc_feature: SWISSPROT Homolog: EC 2.3.1.48 Histone acetyltransferase
MDHTVHVWNVWDKRNTTACVLKHHTAAVKDVRWSPHSLSLLSGGLDCSVQLIDVVEGKVIKVFKEDQAVEVIKFNPSNPNLFLSGGSKGSLRLWDIRSGLVTEEFRRSLGTILDIEFSADGRQFISSTDTTRSNISENTIIVWDVLRQVPLSNQVYTEAFTCPCVRYHPHEASFVAQSNGNYIAIFSARPPFKLNKYMRFEGHGVWGFPIKCNFSPSGRELASGSSDGSIYFFDYKSARPLRKIEAFKEACTDVVYHPVIPNVIASCGWTGEISVFE

SEQ ID NO: 16453 - DNA, 1512 bp, Panicum virgatum
  misc_feature: Ceres CLONE 1789276
  misc_feature: Encodes the peptide sequence at SEQ ID NO. 16454
ccatctatccatctcgccgctctcgtctctgacaaccgttcgcccccaccgccttcccgcgccgcccacgcacgcctccgtctccgtctcgactctcgtccccggcgcgcccaggcccatgacgacggtgtcgcgcgcgctcggctccgcgttcgcgggattcacgccggccgcgacgaccctgcactccccgtgcggctcgtcggcgctactgcggcactggcagtggagccgggccagccgcgcccggcggttatcctccggccgcgcggcacggattagcatgagtctccgcgcaggaattgtcgggctgcccaacgttggcaagtccaccctcttcaacgccattgttgaaaatgggaaggcacaagctgcaaactttcccttttgtacaatcagtccaaatgttggtgtggtggctatccctgatcctcgcctgcaggtgctctcaaaattaagcaagtcacagcagactgtcccgacatccatagaacttgtggatattgcaggtcttgtcaaaggagcaagcaaaggagagggactaggaaatcaatttctttcaaacatccgtgaagtagattccatacttcaggttgtgcgatgctttgaggatgatgatattgttcatgtcaatggcaaagttgatcccaggtcagacattgatgtcatcaacctagagctgatattttcagatcttgagcagatagagaagaggttagataagcttaaaaagagcgaaacaaaagatgcacaagtaaaagtgaaggaacaagcagagagaacaggactggaaaaaatacagggggcgcttatggatggaaagcctgcaagatcggttgacttggctgaccatgagaaagaagctatacagcatctttgtctcctgactatgaaacctgtcatttatgttgctaatgtcgcagaatcagatctcgctgaacctgatagcaatcctcatgtcaaggaggtggttaaagcagcatcggacttgcagtctggcatggttacaatatcagctcaggttgaagctgaactggctaagctacctttggaagagagagtagaatatctaaaatctcttggtgttgctgaaagcggactaggcaatttggtaaaagcgacatatgacctattgggactacgaacttatttcacaaccggagataaggaaacgaaagcttggactattctttcaggcatgactgcgcctcaagcagctggagtcattcatagtgactttcagaaaggatttatcagagctgaaactgtctcctatgacgattttgtggcggctggttctcttggagcagcaagggagaaagggctgttgagattggaagggaaggattatgttgtgcaggaaggcgatgtcatgctttttagattcaacgtgtgacagtagcacaaagcttcaaaatttgggattttgtaaaaggcagattggcataatatactttgcccatactgtgacaaattcttttggccttatgacacaactattcatgtaccggc

SEQ ID NO: 16454 - protein, 425 aa, Panicum virgatum
  misc_feature: Ceres CLONE 1789276
  misc_feature (58)..(201): Pfam Name: MMR_HSR1 Pfam Description: GTPase of unknown function
MTTVSRALGSAFAGFTPAATTLHSPCGSSALLRHWQWSRASRARRLSSGRAARISMSLRAGIVGLPNVGKSTLFNAIVENGKAQAANFPFCTISPNVGVVAIPDPRLQVLSKLSKSQQTVPTSIELVDIAGLVKGASKGEGLGNQFLSNIREVDSILQVVRCFEDDDIVHVNGKVDPRSDIDVINLELIFSDLEQIEKRLDKLKKSETKDAQVKVKEQAERTGLEKIQGALMDGKPARSVDLADHEKEAIQHLCLLTMKPVIYVANVAESDLAEPDSNPHVKEVVKAASDLQSGMVTISAQVEAELAKLPLEERVEYLKSLGVAESGLGNLVKATYDLLGLRTYFTTGDKETKAWTILSGMTAPQAAGVIHSDFQKGFIRAETVSYDDFVAAGSLGAAREKGLLRLEGKDYVVQEGDVMLFRFNV

SEQ ID NO: 16455 - DNA, 1833 bp, Panicum virgatum
  misc_feature: Ceres CLONE 1789286
  misc_feature: Encodes the peptide sequence at SEQ ID NO. 16456
caagatctttttcccagtcaagtcgcttgcccctcctggtgctcccctccccttcccacacccatctcgcaccccgcgcccgcgcacaccgcagccgccgcgcgagatcgcgaggaggccatggccaaggccaagccctcctcctcggccgccgccgccaagccggccgccaccgcggcgccggccacggtgcactcggcgctggtcacctacagctccatgctcgcgctcctctccctctgtccgcccttcgtcatcctcctgtggtacacgatggtgcacgcggacggatcggtgttgaagacctacgagcacctccgggagcacggcctggtggaggggctcaaggccatctggcccatgcccaccgccgtcgcgtggaagatcatcttcggcttcgggctcttcgaggccgtcctgcagcagctgctccccgggaagcggttcgagggccccatctcccccacggggaatgtgccagtctacaaggcaaatggcttgcaagcatatgcagtgaccttgataacttatctcggtttgtggtggtttggaatatttaaccctgcaatagtatatgaccacttgggggagatattctctgctcttgtttttggaagcttggtattctgtatttttctgtacataaagggtcatgtagctccatcttcatctgactctggatcatcagggaatctgataattgacttctactggggtatggaactgtaccctcggattggcaagtactttgacatcaaagtcttcacaaactgtcgttttggcatgatgtcctgggctgttcttgctgtaacctactgcataaaacagtatgaaatgaatggcagagtcgcagattctatgcttgtgaatactgcactgatgttgatctatatcactaaattcttttggtgggaatctggatattggtgtaccatggacattgctcacgacagagctggtttctatatttgctggggatgcttggtttgggttccatccatatacacctctcctggaatgtaccttgtaaaccaccctgtgaatttgggtccgcagctagcactctcaattcttcttgctgaaattttgtgcatatacataaactatgattgtgaccgccagcgccaagaatttcgacggacgaatgggaaatgctcagtctggggcaaggctccatccaagattgttgcctcgtatcagactacaaagggagaaactaaaaccagtcttctcttgacttctggatggtggggcctgtcacgtcacttccactacgtcccagaaatattatctgcatttttctggactgttcctgctcttttcagtcatttcctaccatacttctacgtgatctttcttacaatattattgtttgaccgagcaaagagggatgatgatcggtgctcatcaaagtatggaaagttctggaagatgtactgcaacaaagtaccttacagggtcatccctggcatttactgagcatctaagatgctacaactctctctagctcagcagatgcttccagtcttcaactctgctacagcttgtgtaacttcgatgccattagcttcccttgtatgcagtattagatgtaggcagattggcatctaccttgaatgtgatgtactcaggactggaacagctgcttttgttgtttctttcgccgttcctaatacgggaggaattaaagtgcaggacagtctgccttgtcgggtatttttcacttagagtcacaaggcagcacaacaataaggcccctgtgctcgcttgaataatactgtgctgcacgaaatgtaactatagttgctatggttcaaatattttatctttgcc

SEQ ID NO: 16456 - protein, 452 aa, Panicum virgatum
  misc_feature: Ceres CLONE 1789286
  misc_feature (7)..(452): Pfam Name: ERG4_ERG24 Pfam Description: Ergosterol biosynthesis ERG4/ERG24 family
  misc_feature: SWISSPROT Homolog: EC 1.3.1.21 7-dehydrocholesterol reductase
MAKAKPSSSAAAAKPAATAAPATVHSALVTYSSMLALLSLCPPFVILLWYTMVHADGSVLKTYEHLREHGLVEGLKAIWPMPTAVAWKIIFGFGLFEAVLQQLLPGKRFEGPISPTGNVPVYKANGLQAYAVTLITYLGLWWFGIFNPAIVYDHLGEIFSALVFGSLVFCIFLYIKGHVAPSSSDSGSSGNLIIDFYWGMELYPRIGKYFDIKVFTNCRFGMMSWAVLAVTYCIKQYEMNGRVADSMLVNTALMLIYITKFFWWESGYWCTMDIAHDRAGFYICWGCLVWVPSIYTSPGMYLVNHPVNLGPQLALSILLAEILCIYINYDCDRQRQEFRRTNGKCSVWGKAPSKIVASYQTTKGETKTSLLLTSGWWGLSRHFHYVPEILSAFFWTVPALFSHFLPYFYVIFLTILLFDRAKRDDDRCSSKYGKFWKMYCNKVPYRVIPGIY

SEQ ID NO: 16457 - DNA, 733 bp, Panicum virgatum
  misc_feature: Ceres CLONE 1789288
  misc_feature: Encodes the peptide sequence at SEQ ID NO. 16458
acacaactcgcctcctcgtcttagctcagcccatcgccctcagcggaagcaggacttgatggctgcgcccgctcctctgctcgtcgtcctcctcggcctgacattattgccactgctcttcttccccggtgcagaagcgggcgaggtgggcgtgtgctgggggactgtggcggacaacctgccgagcccagcggcggtggtgcagctgctgaagcggcaaagcatcacgatggtgaggatctacgacaccgaccgtggggtgatcagagctctggccaacaccggcatcaagctcatggtgtcgctgcccaacgagcagctggcctccgcggcctccagcccgccgttcgcgcgccagtgggtgcaggacaacgtggcggcgttctaccccaccacgcggatcaacggcgtcgccgtggggaacgaggtgttcgacatggccaagggcctgacccagcagctcgtcccggccatgaggaacgtgcaggcggcgctggctggcctgggcctcgacggcgccatcaaggtgtccacgccggtggcgttcaccgcgctcaagacgtcgtggccgccgtcggagggcgcgttccaggacgacatcgcgcagtccgtgatgagccccctggtcgccttcttgaggcagacgggctcgcccttcatgatcaatgtctacccattcagggcctacttggatgacccacagcacatcagcgtcgcgtactggacgttccac

SEQ ID NO: 16458 - protein, 224 aa, Panicum virgatum
  misc_feature: Ceres CLONE 1789288
  misc_feature (30)..(224): Pfam Name: Glyco_hydro_17 Pfam Description: Glycosyl hydrolases family 17
  misc_feature: SWISSPROT Homolog: EC 3.2.1.73 Licheninase
  misc_feature: Useful for making plants with altered carbohydrate content
MAAPAPLLVVLLGLTLLPLLFFPGAEAGEVGVCWGTVADNLPSPAAVVQLLKRQSITMVRIYDTDRGVIRALANTGIKLMVSLPNEQLASAASSPPFARQWVQDNVAAFYPTTRINGVAVGNEVFDMAKGLTQQLVPAMRNVQAALAGLGLDGAIKVSTPVAFTALKTSWPPSEGAFQDDIAQSVMSPLVAFLRQTGSPFMINVYPFRAYLDDPQHISVAYWTF

SEQ ID NO: 16459 - DNA, 705 bp, Panicum virgatum
  misc_feature: Ceres CLONE 1789291
  misc_feature: Encodes the peptide sequence at SEQ ID NO. 16460
agaccaagaggagtagagagcctgtgtagaacaagcaaacatagagtacataacaggcacgcttagaccaaacaagcaagcctgtgtagaaggagcaaacatggcgttgagaggcttggcaacagcgctgctcctaatcaacttctcctcttgttatctctctactccatccttcgccacctctgatggctatggcttcatccagtgcctgacacacaagatacccggtgagctgatcgtcacgccgggctccagcaacttcaccagcgtgcttgtctcaaccagcaagaactccaacttcttaaccaataccacggtgaagccgatttgcatcgtcgccgtggcagacgcctcccacgcgcaggccgccgtggtgtgcgggtgtcagaacggcgtgcgcctccgcgtgcgcagcggcgggcacgactacgagggcctgtcctaccggtcggcgcgggccgaggtgttcgcggtggtcgacctcgccaacctccgcgccatcaccgtgtccgccgacgaggagtgtgggccgactgcgtgggtcgactccggcgccaccgtcggccagctctactacaccatcgccaagaccaacccggagctcggtttcccggccggcgagtgcccgactctcggtgtcggcggtcacttcagcggcggcgggatcggcatgatgatgcgcaggcacgggctcgccgtcgacct

SEQ ID NO: 16460 - protein, 201 aa, Panicum virgatum
  misc_feature: Ceres CLONE 1789291
  misc_feature (75)..(201): Pfam Name: FAD_binding_4 Pfam Description: FAD binding domain
  misc_feature: SWISSPROT Homolog: EC 1.21.3.3 Reticuline oxidase
MALRGLATALLLINFSSCYLSTPSFATSDGYGFIQCLTHKIPGELIVTPGSSNFTSVLVSTSKNSNFLTNTTVKPICIVAVADASHAQAAVVCGCQNGVRLRVRSGGHDYEGLSYRSARAEVFAVVDLANLRAITVSADEECGPTAWVDSGATVGQLYYTIAKTNPELGFPAGECPTLGVGGHFSGGGIGMMMRRHGLAVD

SEQ ID NO: 16461 - DNA, 631 bp, Panicum virgatum
  misc_feature: Ceres CLONE 1789291-R
  misc_feature: Encodes the peptide sequence at SEQ ID NO. 16462
gaccggaacatcggctacaatgccttcttcaaggtcaagtccgactacgtccgacatgccatcgacaaggaggtctggccggagatcttcaactggttctccatgaacggctccgggttcgtgatgctggaaccccacggcggggtcatcggcaccatccccgccggggcgactccgtacccgcaccggagcggtgtgttgtacatcatccagtacatcgctccctggccggccggcgacgatggctcgactgcgagaaactgggtcagagacttctacaacttcatggggcagtacgtgaccaagagccccagagaggcgtacattaacttccgggacctagatatcggcgagaacaaagtggtgaatgacgtcagcgtgttcggtagcagtaaggtgtggggtaaaaagtactttggtggcaacttcaaaaggctcgcgaaggtgaaggggatggtggatccaactgattacttcaggaatgagcagagcatcccgccactgctccaaggctattgaatctagtgaagttgtgtttcccgtgtgcgttgtactattagtggcgcgagtgcttaccttggtatttctgtcttgtgattgttttcaatgaatccgcaccaaacacggcccg

SEQ ID NO: 16462 - protein, 172 aa, Panicum virgatum
  misc_feature: Ceres CLONE 1789291-R
  misc_feature (107)..(166): Pfam Name: BBE Pfam Description: Berberine and berberine like
  misc_feature: SWISSPROT Homolog: EC 1.21.3.3 Reticuline oxidase
DRNIGYNAFFKVKSDYVRHAIDKEVWPEIFNWFSMNGSGFVMLEPHGGVIGTIPAGATPYPHRSGVLYIIQYIAPWPAGDDGSTARNWVRDFYNFMGQYVTKSPREAYINFRDLDIGENKVVNDVSVFGSSKVWGKKYFGGNFKRLAKVKGMVDPTDYFRNEQSIPPLLQGY

SEQ ID NO: 16463 - DNA, 677 bp, Panicum virgatum
  misc_feature: Ceres CLONE 1789294-R
  misc_feature: Encodes the peptide sequence at SEQ ID NO. 16464
ttttcctcgattcgacattatgatgatgaaggcataacggatgacactggtggctctgatgcgccagctaaaaagtctttttcacaccttgatctggacaatgatgggctgttatcagttgatgaactaaagcctataattgataatctccatccatcagaacacttctatgccaagcaacaagctgactacgtaatatcgcaggctgacacaaacaaagatggacggttgagcatgaaagagatgattgataatccctatgtcttctacaatgctttattcacagaaaatgattatgagtttcacgacgaactccgttagttccttgggcaagagcacaaagctttgccgaatcaccaccttcagaagtcagaacaatttattatgtactgctgcgaatagatcatttccatggtctacctggtttcgtatacaggctgcaagcacatttggtggtgattccatgtacaatacaagcatgttttttcacgcacctgtaactacaagctgtgtgttcttttgtagcctttttaatattttctagtttgtttttaatcatatgttcggtgcggatgtgagttagctttcgttctttcatttttttgatacaaaggtagctcattgttcaaggatcacaatttgtaaaccaaactaaaccaggaaggtgttaaaaacct

SEQ ID NO: 16464 - protein, 106 aa, Panicum virgatum
  misc_feature: Ceres CLONE 1789294-R
  misc_feature: SWISSPROT Homolog: EC 3.1.3.16 Phosphoprotein phosphatase
FSSIRHYDDEGITDDTGGSDAPAKKSFSHLDLDNDGLLSVDELKPIIDNLHPSEHFYAKQQADYVISQADTNKDGRLSMKEMIDNPYVFYNALFTENDYEFHDELR

SEQ ID NO: 16465 - DNA, 698 bp, Panicum virgatum
  misc_feature: Ceres CLONE 1789294
accaaatcacctgccaaaaaaaaacagagagaagtgcccgagccgcgactcgtcggccatggcgaagccgccgccggcggcgcccaccgtcgcgctgacactggctctgattctcgcctccgcgggcctcctcctcctgctgctccgcctctcgcccacctccccgtcccccaccccgcacccgcaccgccgcctccgcctccgcgcccgcgctcacgcgcgcgagcaccaccagatcccgttcgaccccgtcgtcgcgcacctcgagcgccgcctcgaggaccgcgagtgggagcgcctcgccgccgcggggctgcacgcgcccggcatggaggcggcgccggtccctgaggacctctccgacggcgaggactacatcaacgacgccgcgcgtttcaacgtcacgcgccgcgtggaagagctgttcccgaggatcgacgtcgaccccgccgacggcgccgtcacgggcgacgagctggccgcgtggaacctcgccaacgcgcggcgggaggtgctgcaccgcaccgcgagggagctcgagctgcacgaccgcgaccacgacggccgcctcgccttcggcgagtacgagcggcccagctgggcctggcgtttcgacgatcataactcaaccaatgatggggtcggatggtggaaggaggagcatttcagtgccgcaratatggacgacgatggcttcc

SEQ ID NO: 16466 - DNA, 1309 bp, Panicum virgatum
  misc_feature: Ceres CLONE 1789297
  misc_feature: Encodes the peptide sequence at SEQ ID NO. 16467
gagcatgcgcacgcttcatgtggccgcctctccgcagtagcagcttacatggatacgctgtttaggttggttaacctccaagcctccgagcagcagcagcagcagtcggcgtcctacaactcgaggagcaccacgtcgagcagctccaggtcgtcgtcgcaccagaccaacgcctcctacaactactacaaccacagcaacagcggcggcagcggcggccagtactactacagccagcagcagcagcaccagcaccagcaccagcaccagcggtactacctggagccgtaccagcacgaagaatgcggcaacgcccaccacctttacatggatgaagacttctcatcgtcgtcctcgtcgaggcagcacctccactcgcacggcgcggcggtacagccgccgacgtcgtccgtggccacggcgccgacgcccccgctgtccacgtcgtccacggccgcgggggcggcgcacgcgctgttcgaggcggcggacctgtcgttcccgcccgacctcaacctcgacttctcgtccccggcgtcgccctccggcgggggcgctgcgtcgtcggcggcggtcgggggaggtgccggcggcgggaggtgggcgagccagctgctgctggaatgcgcccgggcggtggcggcgcgggacagccagcgcgtgcagcagctcatgtggatgctcaacgagctggcgtcgccgtacggggacgtcgagcagaagctggccaactactttctccaggggctcttcgcgcggctcacggcgtccgggccgcggacgctgcgcaccctcgcggcggcgtccgaccggaacacgtccttcgactccacgcgccgcacggcgctgcggttccaggagctcagcccgtggtcgtccttcggccacgtggccgccaacggcgccatcctggagtctttcctggaggccgccgcggcgtcgccggagccgcagcgcttccacatcctcgacctcagcaacaccttctgcacgcagtggccgacgctgctcgaggcactcgccacgcgctccgccgacgacacgccgcacctgtccatcaccaccgtggtgtcggccgcaccgtccgcgccgacggccgccgtgcagcgcgtgatgcgggagatcggccagcggatggagaagtttgcgcgcctgatgggcgtgccgttcagcttccgcgccgtgcaccacgccggggacctcgcggagctcgacctcgacgcgctcgacctgcgcgacggcggcgccaccaccgcggtcgccgtcaactgcgtcaactcgctgcgcggcgtggtgccgggcgggcgtg

SEQ ID NO: 16467 - protein, 420 aa, Panicum virgatum
  misc_feature: Ceres CLONE 1789297
  misc_feature (160)..(420): Pfam Name: GRAS Pfam Description: GRAS family transcription factor
  misc_feature: The sequence is a functional homolog of SEQ ID NO 2710 in the 10/374,780 US patent application
  misc_feature: The sequence is a functional homolog of SEQ ID NO 356 in the 10/225,066 US patent application
MDTLFRLVNLQASEQQQQQSASYNSRSTTSSSSRSSSHQTNASYNYYNHSNSGGSGGQYYYSQQQQHQHQHQHQRYYLEPYQHEECGNAHHLYMDEDFSSSSSSRQHLHSHGAAVQPPTSSVATAPTPPLSTSSTAAGAAHALFEAADLSFPPDLNLDFSSPASPSGGGAASSAAVGGGAGGGRWASQLLLECARAVAARDSQRVQQLMWMLNELASPYGDVEQKLANYFLQGLFARLTASGPRTLRTLAAASDRNTSFDSTRRTALRFQELSPWSSFGHVAANGAILESFLEAAAASPEPQRFHILDLSNTFCTQWPTLLEALATRSADDTPHLSITTVVSAAPSAPTAAVQRVMREIGQRMEKFARLMGVPFSFRAVHHAGDLAELDLDALDLRDGGATTAVAVNCVNSLRGVVPGGR

SEQ ID NO: 16468 - DNA, 562 bp, Panicum virgatum
  misc_feature: Ceres CLONE 1789297-R
gtgtgggcaagcgcgtggaggccatgattgagatcgatcgaggacggatcggagctcatcttatcgatgcaaatgcaagcaagctcggtgagtacgtgcgtcgaatgaacagcatgagcagggagaggcaagcaagggcgccgccatacctagccatccagcgttgatgcatcgatcgatgatccctgcattggatctcgcgcacgtgtgcatgggtatggcttgctcgatctctccttgctcgtcttgaaaaccgatcgaatggaatggctcacacacatgtagggttttgaagcagcgtaagcgtagggattgctcacgtacacattggttgcagcgaggtaatcgatcgaggaggaggaagggtgtgtggtcgatagttttaggttttagacttgatctatttcaaatttaaatcatctatcgtcacaagttcttggcgtgatgatttcgatttgcttgcttcttttctctctgattcctctgtgtttaatttccttcttgcattgtaagcccaacaactttcttccctttggacggaattacgtgcatggtttttgtc

SEQ ID NO: 16469 - DNA, 1017 bp, Panicum virgatum
  misc_feature: Ceres CLONE 1789298
  misc_feature: Encodes the peptide sequence at SEQ ID NO. 16470
attccaaatcagtcaagcaagcaagtaacaaaaaggacggattttatagaagaaaagaaacacaagcacgaggtaggtagtaggaagtaggaaccatcgatccatggcggctgcagctcacatggacttagtataccaattcatggatgcgacgacgaaacttgctctagcgcagaggcttctgctgttcgtcctccctctcgtgctgctgctgcacgtcgcctcccgaagccgccggaagcaggcgaagcctctgccgccttcgcctccggggctgcccgtcctcggccacctgctccacgtcggcgcccgcccgcccgtctccctccgcgaccttgccgccagatacgaccccggcggcggcggcctcatgctcctccgcctcggcaccgtgctgagcctcgtcgtgtcctccccgcgcgcggcgcgggcggtcctgcgcacgcacgaccatgccttcgcctcgcggccaccgtccaggatcgtcgacgacctcgtctacgggtcgtccaacgtcggcttcgccccctacggagagtactggcggcgggccaggaagctcgtcaccgtgcacctcctcaccgccaaaaaggtgcactcgtaccgcgccgcccgccaggaggaggtgggcctggtggtggccaagctccgggaggcagcggccgcgggcgcggcggtggacgtcggcggcgcggtgaacgcgttcgccaacgacatcatctgccgcgccgtgtgcggcaagttcttccgggaggaaggccggaacaggctcttccgggagctgaatcacatgaccaccgtcctggtcgcaggattcaacgtggaggactacttcccagggctcgcgagttttctgggtgtgttcaccaggtttatgaacaacaaagtgagccagacgcaccagagatgggacaggttgcttgaggagataataagcgaccacgagaggcgaagaatcgctgatcattggagcggtgcaggtggtggtggtggtggtgatgatgatgatgatgaaga

SEQ ID NO: 16470 - protein, 304 aa, Panicum virgatum
  misc_feature: Ceres CLONE 1789298
  misc_feature: SWISSPROT Homolog: EC 1.14.13.21 Flavonoid 3'-monooxygenase
MAAAAHMDLVYQFMDATTKLALAQRLLLFVLPLVLLLHVASRSRRKQAKPLPPSPPGLPVLGHLLHVGARPPVSLRDLAARYDPGGGGLMLLRLGTVLSLVVSSPRAARAVLRTHDHAFASRPPSRIVDDLVYGSSNVGFAPYGEYWRRARKLVTVHLLTAKKVHSYRAARQEEVGLVVAKLREAAAAGAAVDVGGAVNAFANDIICRAVCGKFFREEGRNRLFRELNHMTTVLVAGFNVEDYFPGLASFLGVFTRFMNNKVSQTHQRWDRLLEEIISDHERRRIADHWSGAGGGGGGDDDDDE

SEQ ID NO: 16471 - DNA, 568 bp, Panicum virgatum
  misc_feature: Ceres CLONE 1789298-R
  misc_feature: Encodes the peptide sequence at SEQ ID NO. 16472
aactagggtcatcatcaacgcatgggctatttcgagagatccaaagtcatgggagaaggcggaggagtttatgcccgagaggttcatggatggtgggagctctgtggacattgacttcaaggggaaagactttcagtttacaccattcggggctggccggaggatgtgcccgggcgccaactttgggttggccactatcaatatcatgctggcgaacctcatgtattgttttgactggatgttgccggagggcatggagaaggaggatattgatatgacagaggtgtttggattgacagtccatcgtaaggagaagctcatccttgttcccaaaccaccacatgatacttttgctcaccccgtgcaaccatgcataccctgaggcaggattaataaaggcgtaatcagaaaagatttgcaattttaatgtactgcttgtaagtgtccgtgcatctctctctctccctcactctccctctctctccctctttctcaaattgtgtgagagagaaaggatgttgtataagctctatctatgcagtaatacaatatttcataaagaagttac

SEQ ID NO: 16472 - protein, 126 aa, Panicum virgatum
  misc_feature: Ceres CLONE 1789298-R
  misc_feature: SWISSPROT Homolog: EC 1.14.13.68 4-hydroxyphenylacetaldehyde oxime monooxygenase
  misc_feature: Useful for making plants with altered carbohydrate content
  misc_feature: Useful for making plants with modulated biomass
  misc_feature: Useful for making plants with modulated drought sensitivity
TRVIINAWAISRDPKSWEKAEEFMPERFMDGGSSVDIDFKGKDFQFTPFGAGRRMCPGANFGLATINIMLANLMYCFDWMLPEGMEKEDIDMTEVFGLTVHRKEKLILVPKPPHDTFAHPVQPCIP

SEQ ID NO: 16473 - DNA, 679 bp, Panicum virgatum
  misc_feature: Ceres CLONE 1789299
  misc_feature: Encodes the peptide sequence at SEQ ID NO. 16474
cattgcgaatgcatggaatgttctcatctggagggcagggtccatctctatctggtgttcaggcaactgcagaaggcagcaaggcaaaaaggcgaacaaaggcggagaagaccgtgagcttgcaggttcttcggcagtatttcgctggtagcctgaaagatgcagcaaggagccttggagtgtgccctacaaccctcaaaagaatatgcagacagcatggtataacccgctggccatcacgaaagatcaagaaggtagaccactctctaagaaagcttcaacagatcattgattcggttcatggagcagagacatctttccagctcaacaccttgtacaaggatctcacaaacacctcaatatcatctgaaaacaatttgtcaggaagtaacaccgctcctccaactaatcagagcaatcttaccaactttgacaagcaccaacaccacaaatcaaacagcattgtgccatcaacttcacactcacactcatcgtgcagccacaattctgattcaagcccctcgtgtagcggtggtccaacaaaacatgcaccacagggtataattggtctgatgaagtcaggaaatcctgtaaaagacagccctattcagaatctgcaaacagaaaatacttcattatatgagcatttctcagttaatgaggcaccaacagatcttct

SEQ ID NO: 16474 - protein, 225 aa, Panicum virgatum
  misc_feature: Ceres CLONE 1789299
  misc_feature (34)..(85): Pfam Name: RWP-RK Pfam Description: RWP-RK domain
LRMHGMFSSGGQGPSLSGVQATAEGSKAKRRTKAEKTVSLQVLRQYFAGSLKDAARSLGVCPTTLKRICRQHGITRWPSRKIKKVDHSLRKLQQIIDSVHGAETSFQLNTLYKDLTNTSISSENNLSGSNTAPPTNQSNLTNFDKHQHHKSNSIVPSTSHSHSSCSHNSDSSPSCSGGPTKHAPQGIIGLMKSGNPVKDSPIQNLQTENTSLYEHFSVNEAPTDL

SEQ ID NO: 16475 - DNA, 1963 bp, Panicum virgatum
  misc_feature: Ceres CLONE 1789301
  misc_feature: Encodes the peptide sequence at SEQ ID NO. 16476
acctccacctcacaccagacgcgacgtcgcggccgtgccactcgcgcgcgcgccgatgccgccgccgtcttcctcgctctactcccccggccggctcctcccggcccgcccggcgtccgcggccacggtggggagatgggcgcgcgcgtcgtgctcgctgtccatgaacggctgcgcgccgggcgccggggaccgcggcgcggtgtgcgtgcgcgaggcgcgggcgctgccggccgcgcccgcgccgctggacgccgtgggccagctcagggccgccgtggacgcgctcggggccggcgcgccgcccgccgcgccctccggcatcatccgcatcgaggtgcccatcaggcagcgggtggacgccgtcgagtggctgcacgcgcagaccgcactgccgcgctgcttcttctcggcgcgggcgccgttgcccgacacgcccgccctcgccggcggcaatggcaacggtgccctgagcggtcggtggaaggagccggtgagcgtcgcgggcgtgggctcggcggtcttcttccgcgggaccgagcccttctccctcgctgattggcgcgcaatcaagagatttctttcaaaggactgtccactgattcgtgcatatggcgccatccgtttcgacgcaacgagcgatgtttcggttgaatgggaggactatggctcattttacttcattgttcctcaagttgagttcaatgagcttgaggagagctcggtccttgcgacgaccatcgcatgggacgattcactatcttggacatggcacaacgctgtggatgatctccaatcattgttgcagaagatatcaccttgttctgtagaagtgaacacgtccagcctgcacacaaccatcatgagtctaaatcatgtcccaaccaaggcatcttgggatcttgcagttactaaagctcttcagatgatcaaagagaaggaaagagagttggtaaaggttgtactggcaaggtgtagcagatacattactgatacttgtatagatcctgtggaactgctagcttgcttgaaggtcgagggccaaaatgcttatcaattctgcatacagccatcagatgctccagcgtttgttggaaatagtccagagcaactatttcaccggaaatacttgaacatttccagtgaggcattagctggtactcgagcaaggggaaaaacaagggcagatgactttcaaatcggtcaggacttgcttctaagtggcaaagaggatattgaatttactatagtgcgggacagcataaagaagaagctggagatgatatgtgatgaggtggttgtccatcccagcaaggctcttcggaaacttccaagagtacagcatttgtcagcacagttagctgcgagaataaggaacgaagatgacgagtttgagattctaaatactcttcatccaagtccagctgtttgtggtttacccactgaagaggcacgccattttatacgagattacgaaatttttgaccgtggaatgtatgctggtcccattggttggtttggaggagctgaaagcgagtttgctgtcgggattaggtcagcgttgcttggaaaaggtcacagcactttagtgtacgccggtgcagggatcgttgaaggtacaaatccatcttttgaatgggatgaacttgatctcaaagcatctcagtttgcaaagttgttgcggtaccaagaacaacatatttgctaccaagaagctgaaaatatgggaacagtgatatgaacagagaagtagtaactagtaagtcatcacaaagttcagcatccatttttgctagttattgcacacttatttgtttgatagtaaactagaaggaattctattgaaattgtgtaattatggaattcagaacagcagtagtgctgaaaatacattgatttaattagcacgtgaatgtaatagaatatatttacagcaattgaaacatcccaaatcactccttcc

SEQ ID NO: 16476 - protein, 561 aa, Panicum virgatum
  misc_feature: Ceres CLONE 1789301
  misc_feature (277)..(542): Pfam Name: Chorismate_bind Pfam Description: chorismate binding enzyme
  misc_feature: SWISSPROT Homolog: EC 5.4.4.2 Isochorismate synthase
MPPPSSSLYSPGRLLPARPASAATVGRWARASCSLSMNGCAPGAGDRGAVCVREARALPAAPAPLDAVGQLRAAVDALGAGAPPAAPSGIIRIEVPIRQRVDAVEWLHAQTALPRCFFSARAPLPDTPALAGGNGNGALSGRWKEPVSVAGVGSAVFFRGTEPFSLADWRAIKRFLSKDCPLIRAYGAIRFDATSDVSVEWEDYGSFYFIVPQVEFNELEESSVLATTIAWDDSLSWTWHNAVDDLQSLLQKISPCSVEVNTSSLHTTIMSLNHVPTKASWDLAVTKALQMIKEKERELVKVVLARCSRYITDTCIDPVELLACLKVEGQNAYQFCIQPSDAPAFVGNSPEQLFHRKYLNISSEALAGTRARGKTRADDFQIGQDLLLSGKEDIEFTIVRDSIKKKLEMICDEVVVHPSKALRKLPRVQHLSAQLAARIRNEDDEFEILNTLHPSPAVCGLPTEEARHFIRDYEIFDRGMYAGPIGWFGGAESEFAVGIRSALLGKGHSTLVYAGAGIVEGTNPSFEWDELDLKASQFAKLLRYQEQHICYQEAENMGTVI

SEQ ID NO: 16477 - DNA, 1745 bp, Panicum virgatum
  misc_feature: Ceres CLONE 1789303
  misc_feature: Encodes the peptide sequence at SEQ ID NO. 16478
aacttccatctcacggcaagtatctccctccttcccctgcctcgcctccgccagcgctagggttttatttttcgcattgctcctgctggtggttgttggttgttaccctcctcttccgtcgtctccctcgcagccgccgccttcgccttcgccgccgccgcagatctcccgcgaaccctaacgactcggcagcttcccttgctcggctcggggaaccggagttggcgttgcgatggcgctgcagtacgtggaggcgcagcggcaggcgcgcccggacctcgccgactggtacgcctccctcgccgacctctaccagcggaagctgtggcaccagctcaccctcaagctcgaccaattcctacagctccaggcagcacagactggagacactatcattcagctctacaacaacttcatcactgacttcgagaccaagattaatctgctaaagcttgcccattttgcggtgatagcttctcgccaatatcctgacaaggatgctgcaattactttcttagagggggtgatcacaaagttgcgtgagacaagggagtcgcggattaatgagccaattctctacgtgaagatgcaaattgcagcaattaatcttgagaaaggaaaccaaaaagagtgcaagaatttgttggaggaagggaaaaccactctggatagtatgaccgatgttgatcccacagttcatgctaacttttactggatatcatctcaataccacaaggcccgccaagaatttgctgagttctacaagaacgctcttctctatctggcctacacaactgtggaatctctctctgagtcattcaagctggacttggcatttgatctttctctctcggccttgcttggtgataacatttacaactttggggaattgttatcacacccaattatcaatagtcttattggaaccaaggtggagtgggtctaccatatgttacaagcgttcaacaccggtaaccttgctctctaccaagaactttgcagggttcacaaagccgcacttactgcacagccagctttggtgcagaatgaacggaagctgcttgagaagatcaacattctttgtctgatggagataatctttagccgtccatcagaagatagaactatcccattgagtgttattgctgagcggactaagctttctatcagtgatgtcgagtatcttcttatgaagagcctctcggttcatcttattgagggaataattgatgaagtagacagtacagttcacgtctcgtgggtccagcctagagtacttggaattccacaggtcaaggctttgcgcgagaggctggatgcctgggttggaaaagtgcataccacattgctttcagttgaggcggagacccctgatcttgttgctgcataattttgcgtctgttccacttctgcgagaggcttggtcagcgatgtcttgatgtgaagtgtgagatgctctgtgtgtgacgcttgtagtcaccgtcttctggataatgaaacttgctgccctgagcattctgcctgcctgtgactgcgtcctactgatcgaggcctgtaatttcctttttgttatcctttggacatggatggttagaacttcacggagtgtcattgagacgaggccaatggattggaaatttcatactagcagggtgttactgtagtttccaagttgaatttgatttgtaactgagtttatactcgtccgttggacatggatgcaggaaaatcttgctgaatctttc

SEQ ID NO: 16478 - protein, 385 aa, Panicum virgatum; identical to SEQ ID NO: 11642
  misc_feature: Ceres CLONE 1789303
  misc_feature (235)..(343): Pfam Name: PCI Pfam Description: PCI domain

SEQ ID NO: 16479 - DNA, 1827 bp, Panicum virgatum
  misc_feature: Ceres CLONE 1789305
  misc_feature: Encodes the peptide sequence at SEQ ID NO. 16480
ctcgccgccatctcccacctctatccccccacgccctcacgctctccccgaagcgccgccgctagggtttgctccgccagccgtgacccgtgaaccctaaaccctactgctctgctcccttccctacagcgcaggcgactactcagcaatctagctgctgcgcttagctccccgcctcgatcgagagctagggtttcactcgcccccaatctcgggtggtttcgggccgccggcgacgcggcatggcggggtacggggatgagaacccggacgccatgaacgggtacgaggaggaggaggaagaggaagaggtggaggaggtcgaggaggtctacgaggaagaggaggaggacggggacggggaggcggacgacggggctgcggtggcggccgcggagcctactgagatgagaagcggaggcggaggtcgaggcatagcggaggtcgttggggatgctgacgccggtggcgaggaagggagggatgcggattctgggggcggcgacgcctcggggaagattttcgtagggggtgtagcctgggagaccaccaaagaaacgttcactaagcattttcagaagtatggtgcaataaccgattccgttatcatgaaggacaagcatacgaagatgcctcgtggatttggatttgtcacattttccgatccatctgtgattgatagggttctagaggatgaacatgtcatagatggaagaacggttgaagttaaaaggactgttccaaaagaggaaatgtcaacaaaagatggtcctaagacaaaaaagatctttgtgggtggtatcccgccatctcttactgaagataaattgaaagagcacttctcctcatatgggaaggtggttgagcatcagattatgcttgaccatagcactgggcgttcacgaggctttggatttgtcacgtttgaaagtgaagatgctgttgaaagggttatgtcacaggggagaatgcacgatcttggagggaagcaggttgaaataaagaaagctgagccaaagaaacctggcggtggtgattcaagctcaaatgggagatatagtcgtgggggtggtggtcaccgtgattcttaccgtggcagtggcggtggcagctctgggagcagcagtggcggtggctatggatatggaggtggctaccgatcagctgcagcctattatggcagcacagcttatggcgcatatggcagaggatatggatatggcaatactgctggctatgggtctggttatggctcagtttatggtggttccatgtacggcggtccatatggtgcatacggggcatatggtggtgcctatggaggtggagcatatggtgcaccaggaggctacggtggtgcaggaggatatggtggatatggtggggctggaggcatgggtggtggtggcagcactggcggtcggggctcgaggtaccacccttatggaaaatgatcatcgattcatagcggttttctaggatctgataataaagagtcctatataccttacctcatttctgctactgagaaaatggaacgttccattcaattcgcctgagtcagcggcgtcagaacattttttttcctggaacttagcgttgcactgtgtccggcaaaagattgtaggctatagtcgctgaaccctgaactacccccctgagctttctgtagaagctgcagcaaaaactcttgttgtattcttgtagcctgctatgaatcttagaacccttgaaccaaactttgtgatagtagacatatggtgtgatggaacatatgtatgtcgatgtaacattcgctcactgatcggctgactgttgctatctctt

SEQ ID NO: 16480 - protein, 403 aa, Panicum virgatum
  misc_feature: Ceres CLONE 1789305
  misc_feature (182)..(253): Pfam Name: RRM_1 Pfam Description: RNA recognition motif. (a.k.a. RRM, RBD, or RNP domain)
  misc_feature (93)..(162): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with altered lignin content
  misc_feature: Useful for making plants with altered alkaloid content
  misc_feature: Useful for making plants with altered terpenoid content
MAGYGDENPDAMNGYEEEEEEEEVEEVEEVYEEEEEDGDGEADDGAAVAAAEPTEMRSGGGGRGIAEVVGDADAGGEEGRDADSGGGDASGKIFVGGVAWETTKETFTKHFQKYGAITDSVIMKDKHTKMPRGFGFVTFSDPSVIDRVLEDEHVIDGRTVEVKRTVPKEEMSTKDGPKTKKIFVGGIPPSLTEDKLKEHFSSYGKVVEHQIMLDHSTGRSRGFGFVTFESEDAVERVMSQGRMHDLGGKQVEIKKAEPKKPGGGDSSSNGRYSRGGGGHRDSYRGSGGGSSGSSSGGGYGYGGGYRSAAAYYGSTAYGAYGRGYGYGNTAGYGSGYGSVYGGSMYGGPYGAYGAYGGAYGGGAYGAPGGYGGAGGYGGYGGAGGMGGGGSTGGRGSRYHPYGK

SEQ ID NO: 16481 - DNA, 1813 bp, Panicum virgatum
  misc_feature: Ceres CLONE 1789306
  misc_feature: Encodes the peptide sequence at SEQ ID NO. 16482
aggcgtgtgcctgtgtactttccactcgaggaaaagcgtaagcaagcaagcaaaggaatactactcagtttgcgagagaccgatcgatcaggaattgggacaaaggaatactacttgtctgctacgtactctacttcttcgcttctactccatccagtccagctcgctataaagttcagtgtgtgctgtgctgagcttctagatgaggcagagacactaaacttcagtagtgatggccaccgacgagctccggtcgccgctcctcccgccgcggcgcccacggcgagtcagcagcgccgcggcgacgctcgcgctcctcctggtcgccggcctcggccctctccccagcgcctgctgcggcacgagtaggagcaggcacagcccccgctcctcgccgccggaccccgtggagctcaccctcctggccgcagctcacgacaagggcgccggtacgccctacgccgccgtgccgcccacgcatcctgttttcctccgaccagtcctctccaccgttgcgtgctaagacgacgcgcgcgtcgcagtgtgcctggacgggagcccgccggggtaccacctgcagacgggctccggcgccgggtcgcgcagctggctcatccatctcgagggcggaggctggtgcaacaccgtgcgcagctgctccggccgcaggacgaccgacctcggctcatccaagttcatgcagacacgcatcaacttcacgggcactcttagcaacgatccggcactgaaccctgatttctacagctggaacagagtgtttgttcggtactgcgacggggcttcgtttgctggggactcgcagcacggtgatcaggatgggaacggcaagctcttcttcagaggccggcgcatatgggaggcggtccttgacgagctcatgcagaaagggctcgcccattccgaacaggccagtcctacattcctacatcagcagcagtactagtcctcatccctgacgaactcaactcgaccgaactgatcgaagtgatccgtcgccctccaggccttgcttacgggttgctctgctggtggtctggctaccctgctgcactgcgatgacttccgcgcacggttctcttcggaggttttggtgaagtgccttcctgacgccggattctttctgaacgtagaggatatctcaggtcaaaggtcaatgaggtctgtatacagtggagttgttcaccttcagaatgttactgaagttttgcccaaggactgcctcctggccaacaaggatccgacagagtgtttctttcctgcggagatcatcaagagcgtcaggacgcccacgtttatcatgaactctgcctacgactcttggcaggtacagaatgttgttgcgccggatagttcctctcctgatgagtcatggcgtcgctgcagagctgacattcgcagctgcaactcctcgcagatacaagtcctcaatggatttaggaaggcgatggtggatggcctcaaggctgtaggggacaacaaggactgcagctggttcatcgattcatgcttcagccactgtcaggcatggttcgataactcgccatgggacacaccagttgccccaaggctaggaaacaagacactggtggaggctgttggggattggtacttcggtaggagcccaagccaggcagtgagagagattggctgcgagtatccatgcaaccccacatgcaacagcctccagttgccagctcaatttacgacagatttgtactatgggaaagaaaagagtgatcgtctagtagtgtaacactataaatataaaagaccggatcgagtgctctaactt

SEQ ID NO: 16482 - protein, 88 aa, Panicum virgatum
  misc_feature: Ceres CLONE 1789306
  misc_feature (1)..(88): Pfam Name: PAE Pfam Description: Pectinacetylesterase
  misc_feature: Useful for making plants with altered carbohydrate content 220>
  misc_feature: Useful for making plants with altered cell wall content and/or composition
MQTRINFTGTLSNDPALNPDFYSWNRVFVRYCDGASFAGDSQHGDQDGNGKLFFRGRRIWEAVLDELMQKGLAHSEQASPTFLHQQQY

SEQ ID NO: 16483 - DNA, 1051 bp, Panicum virgatum
  misc_feature: Ceres CLONE 1789308
  misc_feature: Encodes the peptide sequence at SEQ ID NO. 16484
gcgctcgccgcgctcggctccgcctccgcgcaccccgctccaatggctgccacggctgtgaccgtgccctcctcgggcgtccccttccccgtctccaacaccgccgcacggcgctgcctgctactcccctccccgcttccccgccgagctctccgcgtcgtcgcctccgcggccaccgaagcgccgcccaagccgacgccgccgccgatctcgccctccggcatcgtgctcgttgaccccgcagaggcccagagggtgcaccggctcaaggccgtctacgaccagaaggtcgtcccgctcatcaccgaggagttcggctacaccaatgtccaccaggttcccaaggtggagaagattgtggtgaactgcggcctgggcgccgaggcgggcaactccaaggggctggaggccgccatgaaggacctcgccaatatcaccggacagtggcccgtcaagaccaaggccaagaagtcagtggccagcttcaagatccgtgagggaaacaccatcggtatcgcagtcaccctccgcggcaggataatgtacaacttcctggataggatcatcaaccttgggcttcctaggaccatggactttcttggcgtcaaccccaacagcttcgacgggcacggcaactatagtcttggcctccgtgatcagggcgtgttccctgagatcccctacgaggtgggcgggaagaagaacggcatggacgtgtgcatcgtcaccaccgccaagacggacaacgaggccttcaggctgctcgccctccttggcatgcccttctcggagaacatcaagtctgacgtggtgatccggaagaagaggttgaagcgccaccacttcttgagcaagggcaagggcaagggaggaagaaagtgaggagaggaacccatggtctggcagtgagctagctgcacagcttgttaattgtgatatttttttgcagggtttggtttagaaatctgatgttgttgtctctcaattctgtaactgttgtacttaagaaaggtcagaattcggaatgcaaaagctttcttagcatgatttc

SEQ ID NO: 16484 - protein, 279 aa, Panicum virgatum
  misc_feature: Ceres CLONE 1789308
  misc_feature (155)..(249): Pfam Name: Ribosomal_L5_C Pfam Description: ribosomal L5P family C-terminus
  misc_feature (95)..(151): Pfam Name: Ribosomal_L5 Pfam Description: Ribosomal protein L5
MAATAVTVPSSGVPFPVSNTAARRCLLLPSPLPRRALRVVASAATEAPPKPTPPPISPSGIVLVDPAEAQRVHRLKAVYDQKVVPLITEEFGYTNVHQVPKVEKIVVNCGLGAEAGNSKGLEAAMKDLANITGQWPVKTKAKKSVASFKIREGNTIGIAVTLRGRIMYNFLDRIINLGLPRTMDFLGVNPNSFDGHGNYSLGLRDQGVFPEIPYEVGGKKNGMDVCIVTTAKTDNEAFRLLALLGMPFSENIKSDVVIRKKRLKRHHFLSKGKGKGGRK

SEQ ID NO: 16485 - DNA, 640 bp, Panicum virgatum
  misc_feature: Ceres CLONE 1789318-R
  misc_feature: Encodes the peptide sequence at SEQ ID NO. 16486
aaaagcaaattgaggaagaggagctagaatccaatctcgcatccaagcaagcatcattaccatcagaaccacctccggacatagaaggtgctgtgacagttgtagttcgcatgcctgacggtagtcgacaggggcgtcgctttctcaaaactgataagcttcagtttctatttgatttcttggacatcgggaggacttgcaagccagggacctacagattggtcaggacatacccgaggcgcacctttacaaccagcgaggatgatgtatcattcagtgatcttggcctcacaagcaagcaagaagccctgtttctagaacagatcacagaatagtgcctgtgtcttaggcattgttagagagagatgctatcaggaattggaggttttacatttctatacttgcgccttgtatctgtaaagattcagtccgtcaaatggttcggttgaagaaaggttaaaaattcttttgtggcgacacttttattatgttatatgtgcctgctaaagtgctaagaaaaggttcatgccagagtaaaccgtggagggcatggggccaggatatgtatacagtatgaaaccttgtaccgatgcattatcattcatttcaaagagtacccctctgcgcaaattggttttgt

SEQ ID NO: 16486 - protein, 110 aa, Panicum virgatum
  misc_feature: Ceres CLONE 1789318-R
  misc_feature (25)..(107): Pfam Name: UBX Pfam Description: UBX domain
KQIEEEELESNLASKQASLPSEPPPDIEGAVTVVVRMPDGSRQGRRFLKTDKLQFLFDFLDIGRTCKPGTYRLVRTYPRRTFTTSEDDVSFSDLGLTSKQEALFLEQITE

SEQ ID NO: 16487 - DNA, 679 bp, Panicum virgatum
  misc_feature: Ceres CLONE 1789318
agtttgttgccggctctctcgcccttcacccttcgcgcaccgcgcccccttcccctctctctctctctctctctcggcgccgcgtcgcctccggaccctctcgccatggcgaggccgccgcaggaggcgatcgacaccttcgtcagcatcacgggggcggacgaggccctggccgtccgcaagctcgaggaacatggtggtgacctcaatcgggccatcaattctcatttcaatgaaggagacagcacactgaatgcaatcaatcaaaacactgtaattgctagtcgtgatgatatggatgtggatggaccacttgataatacattccaaagatctttgttcccggagaatttccgtgatccttttgcactgatggatccaaattttcagcaacaatttttcgacagaatcggtgccactgatagtgtcagtcttgggccactggtttcacaccctagagaggtaagagagattcctattgaagttaaggagggtgatcctcaaacaggtccatctggtcaggcccctgttattgaggatgttactggaaatgagtcttcacatggccctgaagttcatggaactatcataattgatgatgaggatgacatgttgccatcggcaccatctgctccgcatgctaatattcctagcaacacatcttctgtgccaactgctc

SEQ ID NO: 16488 - DNA, 2809 bp, Panicum virgatum
  misc_feature: Ceres CLONE 1789335
  misc_feature: Encodes the peptide sequence at SEQ ID NO. 16489
aggcggtattccgaccggcatcacctatcccaatctccctctctctcctcacctgtcgagctccctaccgcccgtacccacctccccccagtccccgcccgttcgccccgcggcttatccaccaccaccactccaccgccgggccggatcgatcgggatcgcgccgccgccgccgccgccgccgccgccatccgcgcccgcggggatcctgctcctaccatgctgcggcgctgcgcccttgcccgaccgcgccggcccgccgaaccgcgcctccggctccccgacgaccacccgcccgtcgccgtcttctccttcctcttcatccccacctaaattgatcgccccgccgcgcggtcccggcggccctcctcggcggcgctgggaggacgagcagcgggcggatcgccgccgcgcgcgcgtcgtccggccgggcgggatgagccgggaggggcagaagctcgactgcgccggcggcgccggcggcgtcgggatcggggtgctgtcgctggacctgctgggccaggtgctcgaccgcctgcgcgagccgcgggaccgcaaggcgtgccgcgtcgtcagccgcgccttcgagcgcgccgaggccgcgcaccgccgcgcgctgcgggtgctccggcgggagcgcctcccgcgcctgctccgcgcgttcccggcgctcgagcgcctcgacctctccgcctgcgcctcgctcgacgacgcctcgctcgccgcggccgtcgccggcgccggagggggcctcgcggggctccgccgcgtgtgcctggcccgggccagcggggtcgggtggcgcgggctcgaggcgctcgtcgccgcatgccccaggctggaggccgtcgacctgtcgcactgcgtcggcgccggggaccgcgaggtcgcggcggtggcggccgcggccgggctcagggagctcaggctggacaagtgcctcgctgtcacagacatggggctcgccaaggtggctgtcgggtgccccaggctggagaagctcagtgtcaagtggtgccgtgagatttctgacatcggaattgatctgctcgccaagaaatgccccgagctccgcagcctcaacatctcctacctcaaggtgggtaatgaatcccttagatcaatatctacacttgagaagctcgaggagttggcaatggttggttgctcgtgtatagatgatgaaggcctggaattactgagcaaggggagcgactcactgcagagtgttgatgtgtcaagatgtgatcatgtgacttaccagggattagcttcactcatagatggtcgcaaatttctccagaagttacatgctgcagattgtttgcatgagataggacagtgttttctgtccaagttggcaacactgaaggaaaccttgactgtgttgaaactcgatggtcttggagtctcagactctctccttcaagcctttggtgaaggttgtaacaacctggttgagattggacttagcaaatgcagtggcgttacagatgaaggaatctcatctcttgtagctcgatgtagtgacctaaagacaattaatctcacatgctgcaatctcatcaccaataatgcgcttaattcaatagcggacaactgtaagatgcttgaatgcttgctgttagaatcctgctctttgataaatgagaagggaataaagcaaattgcaacttgttgccccaatcttaaggagatagacctcactgactgtggagtgaatgatgcagcgctggagtacttggctaaatgttctgaactgcgaatattgaaattaggcctatgctcaagtatttccgacaaaggcattgcttttattagttcaaactgtggcaagctcgtggagcttgacctctaccggtgcaactcctttactgatgatggactggcagctttagcaaatggctgcaagaagattaagttgttaaacttgtgctactgcaacaagattactgatagtggtttgggccacttaggctctctggaggagcttacaaatcttgagctgaggtgcttggtccgcatcacgtgcatagggatctcgtcgattgcaatcggatgcaagagcctgatagaactggatttgaaacgttgctattcggttgacgatgctagtctggaggcccttgctcgtaatgctttgaaccttagacagcttaccatatcatactgccaagtcaccggcttgggcctgtgccacctgctgagctccctgcggtgcctccaggacattaagatggtgcacctctcgtgggtctccatagaagggttcgagatggcgctgcgagcggcctgtgggaggctgaagaagctgaagatgctcaccgggttgaagaccgtgctgtccccggagctcctccagatgctgcaggcgtgcggctgccgaataagatgggtcaacaagcctcttgtctacaaggactgctgaagccgcgttcgtcacattccctctgcagcggcaacacctgcgtggatcgtgaattcaagatcttccaagctttgcttcagcgtaagttgtgacccatgtgagtgaagatagtctccaataatcgttgggggcgtaagctcctgcccccaggttgtgattatgttgtctacctttcgggcgccgtcttgcggcgtttgttgttttgggcccagacgcccagtatatgtacactgaggaatcggtacagttcatgtatcaggttagtttgtgcatagcctgcagcggaatcatcctgtttctgggattagttagtgtatttgttgcttcatttcgcatggtttgagatgaaacaatcataacagaatatgatcggtgttctgc

SEQ ID NO: 16489 - protein, 663 aa, Panicum virgatum
  misc_feature: Ceres CLONE 1789335
  misc_feature: SWISSPROT Homolog: EC 1.14.11.27 [Histone H3]-lysine-36 demethylase
  misc_feature: Useful for making plants with altered carbohydrate content
MSREGQKLDCAGGAGGVGIGVLSLDLLGQVLDRLREPRDRKACRVVSRAFERAEAAHRRALRVLRRERLPRLLRAFPALERLDLSACASLDDASLAAAVAGAGGGLAGLRRVCLARASGVGWRGLEALVAACPRLEAVDLSHCVGAGDREVAAVAAAAGLRELRLDKCLAVTDMGLAKVAVGCPRLEKLSVKWCREISDIGIDLLAKKCPELRSLNISYLKVGNESLRSISTLEKLEELAMVGCSCIDDEGLELLSKGSDSLQSVDVSRCDHVTYQGLASLIDGRKFLQKLHAADCLHEIGQCFLSKLATLKETLTVLKLDGLGVSDSLLQAFGEGCNNLVEIGLSKCSGVTDEGISSLVARCSDLKTINLTCCNLITNNALNSIADNCKMLECLLLESCSLINEKGIKQIATCCPNLKEIDLTDCGVNDAALEYLAKCSELRILKLGLCSSISDKGIAFISSNCGKLVELDLYRCNSFTDDGLAALANGCKKIKLLNLCYCNKITDSGLGHLGSLEELTNLELRCLVRITCIGISSIAIGCKSLIELDLKRCYSVDDASLEALARNALNLRQLTISYCQVTGLGLCHLLSSLRCLQDIKMVHLSWVSIEGFEMALRAACGRLKKLKMLTGLKTVLSPELLQMLQACGCRIRWVNKPLVYKDC

SEQ ID NO: 16490 - DNA, 750 bp, Panicum virgatum
  misc_feature: Ceres CLONE 1789336
  misc_feature: Encodes the peptide sequence at SEQ ID NO. 16491
gccgcctcatcctcctttttccgactccgcctccaccagtcccctatccccggcggaccgcgcagatggcgaccgcggcgacggcgtccgccacggcggcgacccgcttcacgctcctagcgggcgccggcctccgcgcccgcgccggccgcctccccaccgccgtgcagttccagcgccagcgggggctcaccaccaccgcgctcctgaagaccgccgacctccgccccaaggagcagggccagcctgagacgctcgactaccgcgtgttcctcgtcgacggcgggggccgcaaggtgtcgccgtggcacgacgtgccgctgcgcgccggggacggggcgttccacttcatcgtcgagatccccaaggagagcagcgccaagatggaggtcgccaccgacgaggccttcacgccaatcaagcaggacaccaagaagggcaacctccgatactacccgtacaatattaattggaactatggattatttcctcaaacatgggaagacccgactactgcaaattctgatgttgaaggagcattcggagataatgaccctgttgatgttgttgagataggtgaaagacgtgccaatattggggatgtccttaaggttaaaccattggcagctttagcaatgattgatgaaggggagctcgactggaaaattgtggccatttctttggatgaccccaaagcatctcttgttaatgatgtggatgatgttgagaagcatttttcggggacactgt

SEQ ID NO: 16491 - protein, 228 aa, Panicum virgatum
  misc_feature: Ceres CLONE 1789336
  misc_feature (94)..(228): Pfam Name: Pyrophosphatase Pfam Description: Inorganic pyrophosphatase
  misc_feature: SWISSPROT Homolog: EC 3.6.1.1 Inorganic diphosphatase
MATAATASATAATRFTLLAGAGLRARAGRLPTAVQFQRQRGLTTTALLKTADLRPKEQGQPETLDYRVFLVDGGGRKVSPWHDVPLRAGDGAFHFIVEIPKESSAKMEVATDEAFTPIKQDTKKGNLRYYPYNINWNYGLFPQTWEDPTTANSDVEGAFGDNDPVDVVEIGERRANIGDVLKVKPLAALAMIDEGELDWKIVAISLDDPKASLVNDVDDVEKHFSGTL

SEQ ID NO: 16492 - DNA, 636 bp, Panicum virgatum
  misc_feature: Ceres CLONE 1789336-R
  misc_feature: Encodes the peptide sequence at SEQ ID NO. 16493
cctcgccgctcccggcgctggcggagcagatggagaaggcggcgctcttcgacttcaacctgacgctcccggcgatcgcgatcgagttcctgctgctcatggtcgcgctggacaagctctacttcacgccgctcggcaagttcatggacgagcggaacgccaagatccgcggcgagctaggagacgtcaaggacgcctccgaggaggtgaagcagctggaggagcaggccgccgccatcctgaaggccgcgcgcgccgagatcgctgcggcgctcaacaagatgaagaaggagaccaccgcggagctggaggccaagctggacgagggccgccgccgcgtggaggccgagctcgtcgaggcgctcgccaacctcgagtcccagaaggaggaggccgtcaaggcgctcgacgcgcagatcgcctcgctcagcgacgagatcgtcaagaaggtgctcccatccgcgtgagcgaatcaaaacagcgagccggccggccggccttcttccttgcttagcttctgatctgtgtgtatacgcttgttgggctgccgtccattgccggccctgctttatcctatgatgtgtgtaattgcatcaacattttgtggcaagtataaatgaatcaatcatatttctg

SEQ ID NO: 16493 - protein, 154 aa, Panicum virgatum
  misc_feature: Ceres CLONE 1789336-R
  misc_feature (21)..(152): Pfam Name: ATP-synt_B Pfam Description: ATP synthase B/B' CF(0)
  misc_feature: SWISSPROT Homolog: EC 3.6.3.14 H(+)-transporting two-sector ATPase
SPLPALAEQMEKAALFDFNLTLPAIAIEFLLLMVALDKLYFTPLGKFMDERNAKIRGELGDVKDASEEVKQLEEQAAAILKAARAEIAAALNKMKKETTAELEAKLDEGRRRVEAELVEALANLESQKEEAVKALDAQIASLSDEIVKKVLPSA

SEQ ID NO: 16494 - DNA, 1858 bp, Panicum virgatum
  misc_feature: Ceres CLONE 1789341
  misc_feature: Encodes the peptide sequence at SEQ ID NO. 16495
actggtgttctcctcccctctcactcttcagtagtcagtactcaccctccctttcgctgaccactcacacccaccctgcaaggaagaatggagtacgagaggattcatcagaaagcccaggctgatgccctttctccaacaaagctaaggatgaagattatgggggcccacaatcgagtaagagttatcaccagcaactcatcatcgcgaacatcacctgcaaaaaacgttgaagcgtcacaagcgcagaacaggttactagtctgtgatgttcttgaagaagtttcagacaactcagatggcaccaaacacccttcagaaattaacaaaactgaagctgtaggaaaggattcagccttatatgtcaataaggttcagaacacttccaagagttcagttccccaaccagcaacaagcaactcgagcatgatacatccagtgagacctgtggaagaagacagtgctgaatgtcataatgggcttgacaatgctagtactagtagctttgagttccatggaggtgacaagccggcgacgcagaatccagcagcggggtatttctccagacaagcttcctcgaagtggaatgacgctgagaaatggatcgtgaaccggcagaatgttaatcagaacatctccaaaggcacagcacagaatcagactgtacaccagatgaattctgctgcagccaggggcgtcattgtgcccaaaatttctggtcgccctgtgcagaaaatgaagagagtgaatccagctttgtctgctccacgtagcatattagagaggttatcttttgcttcgtatcagccaaagttggttaggcatgctgatgtctgtccagttagtagttctagtgctacccccgagtatcacaaggcaactgatactggttcagaaatagaagtgaagccctgcaacgaaccaaaggctatttcaacagttcagtcagtgtccgtgagagatgttggcacagaaatgactccgatacctagtcaggaaccttcaaggacgggaactccacttgggtcaatgactccaactcgaagccctaattgttcgataccatcaacacctgtaggagggaggtcagtagcatcacctggagaagacaacacagatgatggaccatatttcaacagaaaaggtggtacacatggaaatgaattgtcagatactgaaatgaggctcaagacaaggcaagaaattgccgctctcggtatacagctaggtaagatgaacattgctacatgggccagaaaagaagagctagaactagtctctgcagcaccgagcattgctgatttggagcagatgaagaaggaatatgcttcccgtgctgcatcatatgaggaggcagaaaatactaaacatacagcaagattcaaaaaggaagaggtgaagattgaagcttgggaaagtcgtcaaagagcaaaaattgaatctgaaatgagaagaatagaggaatgtgctgagagaatgagaagtgaggccatggcgaagatggctgaaaagctagagatgacacgccgcatcgctgaagagaaacgagcttcagccaatgccaaaatgaaccagcaagcagcaatagcagttcagaaggctgagaagattcgccaaacaggaggagttccaggatcaaatatcctatgctgcagtggctacttctgtggaccttagtagatattcaacaaatagtatgttgaatgtagtggtgggaaatctaaactccaccctctaaatcagcattccttgattttagtgtggaaacgggaatgtctggttaggtattcagatacaaacaaattcttgtttgtcatgtaaattattccaatgcatttttttttatcttggccagtgt

SEQ ID NO: 16495 - protein, 529 aa, Panicum virgatum
  misc_feature: Ceres CLONE 1789341
  misc_feature (408)..(519): Pfam Name: Remorin_C Pfam Description: Remorin, C-terminal region
MEYERIHQKAQADALSPTKLRMKIMGAHNRVRVITSNSSSRTSPAKNVEASQAQNRLLVCDVLEEVSDNSDGTKHPSEINKTEAVGKDSALYVNKVQNTSKSSVPQPATSNSSMIHPVRPVEEDSAECHNGLDNASTSSFEFHGGDKPATQNPAAGYFSRQASSKWNDAEKWIVNRQNVNQNISKGTAQNQTVHQMNSAAARGVIVPKISGRPVQKMKRVNPALSAPRSILERLSFASYQPKLVRHADVCPVSSSSATPEYHKATDTGSEIEVKPCNEPKAISTVQSVSVRDVGTEMTPIPSQEPSRTGTPLGSMTPTRSPNCSIPSTPVGGRSVASPGEDNTDDGPYFNRKGGTHGNELSDTEMRLKTRQEIAALGIQLGKMNIATWARKEELELVSAAPSIADLEQMKKEYASRAASYEEAENTKHTARFKKEEVKIEAWESRQRAKIESEMRRIEECAERMRSEAMAKMAEKLEMTRRIAEEKRASANAKMNQQAAIAVQKAEKIRQTGGVPGSNILCCSGYFCGP

SEQ ID NO: 16496 - DNA, 2592 bp, Panicum virgatum
  misc_feature: Ceres CLONE 1789354
  misc_feature: Encodes the peptide sequence at SEQ ID NO. 16497
acctcacagccctggctgctcctccatggctccgttcttcctcctcctaatcagccagatcctactctgcgcagccgtcgacaccatcaactcctccgcgccgttgtctggtgtgcagcagattgtatccaagggaaacaagttcactttgggcttctacacaccgcctcaaggtaaaaccacctccagctccagcaactactacatcgccatatggtacagcaacatacctcagaagacaaccgtgtggacggccaactccgacgcgcctgtgacggacccaactaccgcagccttgaccatcggcagcgacggcaaccttgtcctccttgatcaatccaagaatcggcagctgtggtcgaccaacatgagcatcggatccaactccatcatcgccgtcctccaggatgacggtagcctcgacctcattgatgccaccaattcatcaaatgtttactggcgaagcattgatcatcccacaaacacatggcttccggggggcaagcttgggctgaacaagaccacagggatcagtcagcgtcttgttccatggaggaacacagccaacccatctcctggcttgttctcgctggagctggacccaaacggctcaacacagtacttcatccagtggaaggattccataacttactggaccagtggcccttggaatggcaatattttcagccttgtgccagagatgacggccggttacaactacaacttccaattcattgacaacgccacagagagctacttcacctatacgatgaaggataataatatcatctcaaggttcatcattgatgtgagtgggcagatcaagcaggagacatgggtgagcgccacacagtcgtggacattgttctgggcccagccacggtcacagtgtgaggtgtatgctctctgtggggcatatggcagttgcaaccttgatgccctgccgttctgcaactgtatcaaggggttcactcagaaaattcagagtgattgggacctccaggattacagtggtgggtgcaaacggagagtaccactgcagtgccagaccaattctagcaatgcacagtctcagtctgataagttctacaccatggaaagtgtgaggctacctgataatgctcagactgctgtggctgctagttctcaagactgtcaagtggcttgtctgaatagttgttcttgtaatgcatacacttacaatagtagcggctgctttgtttggcatggggacctcattaacctccaagaccaatacagtggaaatggaggaggcacgctcttcctcaggcttgcagcttctgagctgccagactccaaaaagagcaagacagtgatcataggcgcagttattggaggagttgctgcagttttaatagtcattgctattgtatcatacttcctatttcagaaataccgccgagagagaactcttcggatatccaagactgctgggggcacactgatcgcctttaggtacagtgatctacagcatgtcactaacaacttctcggagaggcttggtggaggtgcctttggctcagtgttcaaagggaagctcccagattcaactgccattgctgtgaagagactagacggagtccaccaaggggagaagcaattccgtgctgaggtgagcaccattgggacaatccagcatgtcaatttggtccgcttgcttggattttgctctgaaggatcacggaggctgcttgtatatgagttcatgccaaagggctccctggacttgcagctattccctggtgagaaaacggcactgagctgggctaccaggtaccagatagcacttggaacagcaagaggcttaaattacctgcacgaaaagtgtagggattgcattatacattgtgatgtgaagccagaaaacatactcttggatgagtcatttgtgccaaaagttgctgattttggtctagccaagctcttaggcagagacttcagtcgtgtattgacaacaatgagaggaacaaggggttacctcgcacctgaatggatcagtggtgtggcaataacagcaaaggcagatgtctttagctatggtatgatgctcttcgaactcatatcaggcaggagaaattctgatcacggaaaagagtgtggaaccaccttcttcccaacctttgctgcaagcaagcttcatgaaggggatgtacggaccttgatagaccccaggctgaatagagatggaaatgttgatgaactcacaagagcttgtaaggttgcctgttggtgcatccaagatgatgaaaatgcaagacccacaactggtcagattgttcaaatcctcgaagagttccttgatgttaacatgcctcctgttccaaggtcattgagagttcttggtgaaagccctgatgctattaacttcttttcagatatatcttcaagtcagacttctcagacacaaaacagcacgacaacttcccagacgcacagtgctacttcaggcacctaacatttccaaagttcaaaaatcagataatctgcaatttgttagggtgaatttttgaagattattattatgagtgagtgaagctgtacataatagaacctaatatgctcagcttctgt

SEQ ID NO: 16497 - protein, 816 aa, Panicum virgatum
  misc_feature: Ceres CLONE 1789354
  misc_feature (198)..(323): Pfam Name: S_locus_glycop Pfam Description: S-locus glycoprotein family
  misc_feature (493)..(764): Pfam Name: Pkinase Pfam Description: Protein kinase domain
  misc_feature (70)..(183): Pfam Name: B_lectin Pfam Description: D-mannose binding lectin
  misc_feature (340)..(407): Pfam Name: PAN_2 Pfam Description: PAN-like domain
  misc_feature: SWISSPROT Homolog: EC 2.7.11.1 Non-specific serine/threonine protein kinase
MAPFFLLLISQILLCAAVDTINSSAPLSGVQQIVSKGNKFTLGFYTPPQGKTTSSSSNYYIAIWYSNIPQKTTVWTANSDAPVTDPTTAALTIGSDGNLVLLDQSKNRQLWSTNMSIGSNSIIAVLQDDGSLDLIDATNSSNVYWRSIDHPTNTWLPGGKLGLNKTTGISQRLVPWRNTANPSPGLFSLELDPNGSTQYFIQWKDSITYWTSGPWNGNIFSLVPEMTAGYNYNFQFIDNATESYFTYTMKDNNIISRFIIDVSGQIKQETWVSATQSWTLFWAQPRSQCEVYALCGAYGSCNLDALPFCNCIKGFTQKIQSDWDLQDYSGGCKRRVPLQCQTNSSNAQSQSDKFYTMESVRLPDNAQTAVAASSQDCQVACLNSCSCNAYTYNSSGCFVWHGDLINLQDQYSGNGGGTLFLRLAASELPDSKKSKTVIIGAVIGGVAAVLIVIAIVSYFLFQKYRRERTLRISKTAGGTLIAFRYSDLQHVTNNFSERLGGGAFGSVFKGKLPDSTAIAVKRLDGVHQGEKQFRAEVSTIGTIQHVNLVRLLGFCSEGSRRLLVYEFMPKGSLDLQLFPGEKTALSWATRYQIALGTARGLNYLHEKCRDCIIHCDVKPENILLDESFVPKVADFGLAKLLGRDFSRVLTTMRGTRGYLAPEWISGVAITAKADVFSYGMMLFELISGRRNSDHGKECGTTFFPTFAASKLHEGDVRTLIDPRLNRDGNVDELTRACKVACWCIQDDENARPTTGQIVQILEEFLDVNMPPVPRSLRVLGESPDAINFFSDISSSQTSQTQNSTTTSQTHSATSGT

SEQ ID NO: 16498 - DNA, 1824 bp, Panicum virgatum
  misc_feature: Ceres CLONE 1789357
  misc_feature: Encodes the peptide sequence at SEQ ID NO. 16499
agcgtggactcactcgtcaatctcgtgtttggcagatcagaacacaaaggacaaagaaaaaaaaaaacacgccctttcttttcggtggtttatttgcagcgagcgagcgagggtagcaagcatagcaattagcaacaaggcaaacaacttcctcctcccttcgatccactcggcgccgcggttgcagacttgcagtcgcagtcggttccctcttccttcaatccttcctccccgccctccgcctccgcctcggcccttccttctcttctccatcgcttgcttgcttgcttgtggttccttccacacaaacctacatacaacagcagaggatcggaggacaagaaagggagcccgtcggcggaaggggtgcctgcagtctcaccacaccagtgtctctccccatggggaactgcgccagcgccatcgacgccttcgtccagcggggcagcaggccgtcgccgtcggctgctccgggaatgtctgcatcgaggaggactagtagctctgccaccaccgggaagctgtcaacactgagtaccagcaccttcatgccatccacagttagtggtgttagtgctgacgatgattatcaagatggtcagattcttgagtctccaaacctcaaaacatacacctttgccgaactcaagagtgccaccaagagcttcaggcccgagacggtgcttggggagggcggattcggaaaggtttacaagggatgggttgatgagaagaccttgaacccgtccaggagtaccactggtatggtggttgctgtcaagaagctcaattctgagagcgtgcagggaatggagcaatggcagtctgaggtcaatttccttgggaggatttcacaccccaatctcgtcaaactcttgggatatagcatggatgacaacgagctactgctcgtgtacgagttcatggcaaaggggagcttggagaaccacctgtttcgaagaggggcggtctacgagccactgccttggagcctcaggctgaagattctcatcggtgcagctcgtggccttgcttttcttcattcatcagaaaggcaaatcatctacagggacttcaaggcttccaacatcttattagattcgcacttcaatgcaaagctctcagatttcggattggccaagcatggtccagatggtgaggagtctcatgtgacaacaagagtcatgggaacctacggctatgcagctccagagtatgtttctaccggccacctgtatgtgaaaagtgatgtgtatggatttggagttgtactgctggagatgatctctggcctgagggcgctggacccaagccgcgtgagcgagaaggtgaacttggtgaactgggcaaagccattgctagctgaccggaggaagcttagccgagtgatggacccgggattggaggggcagtacagttccaaaggagccctccttgctgctcagctgaccctcaagtgcctgaacagtgacccgaagagccgtccatccatgaaggaagtggtggaggcgctggagcagattgagtcgataaagagcagggtgagggagcccaggagtagtggctccttgcgccgtggccagggacagtcaccgaggagtgacagcgctaggaagaactccaggggcaggtagatgcatggtcacgaggatacataggaggaactgattctgatgtggaaattgtaaatgtagaccgcattttttgttgtcatgatgaagtttgtgtcgatcatgatgatcaatgtaatagtatagcgttacacttttgatgacttggtacatgcctacctgacatatatatgcatacattcaaccactttcc

SEQ ID NO: 16499 - protein, 410 aa, Panicum virgatum
  misc_feature: Ceres CLONE 1789357
  misc_feature (89)..(371): Pfam Name: Pkinase Pfam Description: Protein kinase domain
  misc_feature: SWISSPROT Homolog: EC 2.7.11.1 Non-specific serine/threonine protein kinase
  misc_feature: Useful for making plants with modulated drought sensitivity
  misc_feature: Useful for making plants with modulated heat sensitivity
MGNCASAIDAFVQRGSRPSPSAAPGMSASRRTSSSATTGKLSTLSTSTFMPSTVSGVSADDDYQDGQILESPNLKTYTFAELKSATKSFRPETVLGEGGFGKVYKGWVDEKTLNPSRSTTGMVVAVKKLNSESVQGMEQWQSEVNFLGRISHPNLVKLLGYSMDDNELLLVYEFMAKGSLENHLFRRGAVYEPLPWSLRLKILIGAARGLAFLHSSERQIIYRDFKASNILLDSHFNAKLSDFGLAKHGPDGEESHVTTRVMGTYGYAAPEYVSTGHLYVKSDVYGFGVVLLEMISGLRALDPSRVSEKVNLVNWAKPLLADRRKLSRVMDPGLEGQYSSKGALLAAQLTLKCLNSDPKSRPSMKEVVEALEQIESIKSRVREPRSSGSLRRGQGQSPRSDSARKNSRGR

SEQ ID NO: 16500 - DNA, 2379 bp, Panicum virgatum
  misc_feature: Ceres CLONE 1789362
  misc_feature: Encodes the peptide sequence at SEQ ID NO. 16501
tttctacttgtagcaggcacgcggcccaaaccccttcccctttctctctcccttcctccaaatccacatcacctcgagccggcgtgcgcctccagatttggcgaccgccgcctccgacatcgccagatcggagcgggcgcggcctcgcttcgcctccccgcgcggccctcgcctgctgcagggtcatgggaatggaggtcgttggagctgaaacagcaccggcagaggtcaaagtatctgatggagaagtgaacctattccaagagaaggaaagcaaagcaactgctaaagaacgtgaggaggctgctgtttttggttcagagacaactacaaatgttgctgatctggcacctccaaaggatgcgaaggatgagtggcctgaacctaagcaaacttatgccttctacttcgtcaagatccgttcgtttgaggatcctaagctgagggcaaaactcgagcaagctgacaaagaattccagaagaagatccaagctcgttctaaacatattgaggcactaagagccaagaagtcagagcgctctagtattatctcggagctgaagccattgtctgctgagaacaaacaatataatgaagttgtgaatgagaagataaaggagatggagcctcttcggaacagtttaggcaggtttcgtgaggaaaacaatgccatgagggcacagggtgcaggtttatgctcttctatcgaagagcttgaacaaacgatcaagatgcttactgaccgtatagtacatgagagcatatccttaactgaggagaaacgtctggtcaaagaaatcaaggaccttgaaaaaaccagatcaaaagtcatatcaaatgctgctaaccgggctaaactgcaagatacagtggttgaaaaagaggccatacaggaccaggtcaaaataattggggagggcattgatggaataaagaaggaaaaacaagcagtcagatctaagattaaggtcctggaggatgagctaaaagttgttgatgctgagattgcatcgcttcaagaagatttagatgcagcaactgccagaaaggataaggcgtatgaatcattgcaagaattgagggcagtgcgcgatgcaaaaaatgcatccttccttcaaaaccgcacggttttaaacaaggctagggactattcgtcaaggaatatgctgacagaattgcaagagctccacaagactgaggttgacaagttcatgacccaatggtgcgaaagcaaggccttcagagaggactatgagaagaggattctttcctccctcaacagccgactactgagccgagatggccggatgaggaatcccgatgagaagcccatattcatcgagtcgcaggcaccagcaccagctgcagaaccagagcctgtcccagtaaaagtacctgcaaaacaagccaaggaagtgcctgctccccaagcagatgaagctcccaaggttgaagtccgttcgaaagggtctgtgaagccacccaaggcgaaagctgcactggatgctgatgatgattacgaggctgagcctccaaaggaaaaggcgaagccgactgaggcagatgtggcaaagttgaaagagaaaaagaggcaggaggagattgagaagaacaggcttgcattggagaggaagaagaggcaggctgagaagcaggcagcgaaggctgcggcccgagcacagaaggacgctgagaagaagctgaagaaagaggagaaaaaagccaagaagaaatccggagcagctgacaccgatgagccctcagaatcagatgccaagtctgatgaagccgtggaagcccaggccgaggaggaagcagccccagttaccaccacagggaagaaagaacagaaggagaatgcccggcacaggagtgtcagccggatcaaggccccaccacccaaggcgatccttaagaggaagaaggcgcagtcatattggtcgtgggctggcccagccgctgcagtggcagctgccgtgctggttgccctcctcgcggtgctgggctactaccagtactacctcccagcgagtgccagcaactagttgttgagggcttgttccgccgcagccacgcccctgaaagatgtggagaccaattttgcaggcaagaaggaacagagtgcgtggtgggcttttgagacgtagaccggaggggtcggtcttgttcgcttttcgttgtgttagcttataatctgtggagtcggagaaggtacagttgattttggttgcgactttgctagatcttatatatatactgccactgatatccgtgtacttttgaagtgaagcgtatattgccgtctggaatagtacctttctctttaggtacatcacagatacaagtaacggtctatccagttggtctctgttaagttgc

SEQ ID NO: 16501 - protein, 619 aa, Panicum virgatum
  misc_feature: Ceres CLONE 1789362
  misc_feature: SWISSPROT Homolog: EC 2.7.11.1 Non-specific serine/threonine protein kinase
MGMEVVGAETAPAEVKVSDGEVNLFQEKESKATAKEREEAAVFGSETTTNVADLAPPKDAKDEWPEPKQTYAFYFVKIRSFEDPKLRAKLEQADKEFQKKIQARSKHIEALRAKKSERSSIISELKPLSAENKQYNEVVNEKIKEMEPLRNSLGRFREENNAMRAQGAGLCSSIEELEQTIKMLTDRIVHESISLTEEKRLVKEIKDLEKTRSKVISNAANRAKLQDTVVEKEAIQDQVKIIGEGIDGIKKEKQAVRSKIKVLEDELKVVDAEIASLQEDLDAATARKDKAYESLQELRAVRDAKNASFLQNRTVLNKARDYSSRNMLTELQELHKTEVDKFMTQWCESKAFREDYEKRILSSLNSRLLSRDGRMRNPDEKPIFIESQAPAPAAEPEPVPVKVPAKQAKEVPAPQADEAPKVEVRSKGSVKPPKAKAALDADDDYEAEPPKEKAKPTEADVAKLKEKKRQEEIEKNRLALERKKRQAEKQAAKAAARAQKDAEKKLKKEEKKAKKKSGAADTDEPSESDAKSDEAVEAQAEEEAAPVTTTGKKEQKENARHRSVSRIKAPPPKAILKRKKAQSYWSWAGPAAAVAAAVLVALLAVLGYYQYYLPASASN

SEQ ID NO: 16502 - DNA, 1884 bp, Panicum virgatum
  misc_feature: Ceres CLONE 1789363
  misc_feature: Encodes the peptide sequence at SEQ ID NO. 16503
gaccgcttcactgcgagcctcgcgcccctctacctccctccgtcctcctcgcccagctaggccaggctaggctaggccggccgccgccatgccccccgtcaaggccgaggacctggtgccgcacccggtcaaggagcagttcggcggcgtcgactactgcatcaccagccccccgccatggctgacgacggtgttcgtgggcttccagcactacctggtcatgctcggcacctccgtcctcatcgccaccatcctcgtcccgctcatgggcggcggccatgccgagaaggcgatcgtgatccagaccatcgtcttcctcgccggggtcaacacgctcctgcaggtccacttcggcacgcggctccccgcggtgatggccggctcctacacctacatctacgtgatcgccgccatcgccgtcagcccgcgatacttgataatcatcgaccctctcgagaggttcgtgttcacgatgaggtcgctccagggctcgctgatcatcgccggcgtcttccaggccgtcatcggcttcttcggcgtatggagagtcttcataaggttcctgagccccctggcggcggcccccttcgtgacgctctcggggctggggctcttctacttcaccttccccggggtcgccaaatgcatcgaagtgggtctccccgcccttgttctcctggtgctcttcgcggagtacgccgcccatttctttgcgaaggggagcttcgtgttcgggcggtgcgccgtgctggtgaccatcgtgatcgtgtgggtctacgccgagatcctgacggcggccggcgcctacaacgagaggggccccgtgacgcagttcagctgccgcaccgaccgggccgggatcatccagggctcaccctgggtcaggtttccgtacccgttccagtgggggtacccgattttcttcttccaggattgcatggccatgatggctgctgcttttgtgtcgcttattgagtccaccggtaccttgaacgtggtgtcaagatactcaggcgcaacattctgcccaccttcagtgttctcacgtggaatcggctggcagggcatatccatcatacttgacgggatgtgcggtacattgacaggcacatcagcttcagttgagaatgcaggtctgctggcattgacgcgagttggaagccgacgagttataaagatctcagcctgcttcatgattttcttctcattgtttgggaaatttggggcagttcttgcatctattccattgccacttttctctgcactgtactgtgtcctctttgcttattcagttggtgcaggcatctccctacttcagtactgcaacctcaacaccctgagaacaaagttcatactcagcatctccttgttcctgggactgtccattccacagtacttccgagtctatgagatgttctttggcttcgggccagttcacacccattcggttgcgttcaatgtgatggtcaacgtcatcttctcctcgccagcgaccgtggcagccattctcgcctactttctggactgcacccacctgtactgggaagctagtgtgaggaaggacaggggctggcactggtgggagaagttcaagtcctacagacatgactctaggagcgaggagttctacgctctgccctatggcctgagcaagtacttcccctcgttttaggatgccgaaaggaggaagatgatgttccatgtgattgatggaaagtagaatttgaacattgattcagggcaatagagccaatgtaatatcccctatcaagcagttaggagggaggtagaagttttgcttataaagcattttggatgatcaactattgtactttccgggatactaggatgctattgctgccatcaaccaaggggagattttgc

SEQ ID NO: 16503 - protein, 527 aa, Panicum virgatum
  misc_feature: Ceres CLONE 1789363
  misc_feature (32)..(439): Pfam Name: Xan_ur_permease Pfam Description: Permease family
MPPVKAEDLVPHPVKEQFGGVDYCITSPPPWLTTVFVGFQHYLVMLGTSVLIATILVPLMGGGHAEKAIVIQTIVFLAGVNTLLQVHFGTRLPAVMAGSYTYIYVIAAIAVSPRYLIIIDPLERFVFTMRSLQGSLIIAGVFQAVIGFFGVWRVFIRFLSPLAAAPFVTLSGLGLFYFTFPGVAKCIEVGLPALVLLVLFAEYAAHFFAKGSFVFGRCAVLVTIVIVWVYAEILTAAGAYNERGPVTQFSCRTDRAGIIQGSPWVRFPYPFQWGYPIFFFQDCMAMMAAAFVSLIESTGTLNVVSRYSGATFCPPSVFSRGIGWQGISIILDGMCGTLTGTSASVENAGLLALTRVGSRRVIKISACFMIFFSLFGKFGAVLASIPLPLFSALYCVLFAYSVGAGISLLQYCNLNTLRTKFILSISLFLGLSIPQYFRVYEMFFGFGPVHTHSVAFNVMVNVIFSSPATVAAILAYFLDCTHLYWEASVRKDRGWHWWEKFKSYRHDSRSEEFYALPYGLSKYFPSF

SEQ ID NO: 16504 - DNA, 1628 bp, Panicum virgatum
  misc_feature: Ceres CLONE 1789372
  misc_feature: Encodes the peptide sequence at SEQ ID NO. 16505
cgcgacgccggtggagccgcaagaactaagcgccatgaccacgaccaagcaccacttcctgatcgtcacgtacccggcccaggggcacatcaccccggcgcgccacctcgcgcgccgcttcgccagcgcgtgccccggcgcgcgcgtcaccatctgcgccccggtctcggcgttccggcggatgttcccgggcgccgctgcggtggcgggggaggagaggggcggcgacggggacgacgcggtcgcgtacgtggcctactcggacggctacgacggcgggttcgacagcgccgcggacagctacgcgcggtacatggagcgggccagggcggccggggagcgctcgctggccgcggtgctccgccgcctccgcgccggcgggcgccccgtgacgtgcgcggtgtacacgctgctgctgccgtgggtggcgggcgtcgcgcgggagcacagcgtggcggcgacggccgtgttctggatccagccggccaccgcgctcgccgcgtactaccactacttccgcggccaccgggacgccgtcgtggccgccgcggcgtccggggaccccggcgcggaggtgcggctcccgggcctcccgccgctccgcgtccgcgacctgccgtcgttcctcgccatcaccgacgaggacaaccccttcgcgttcgtgctgccggagttccgcgagctcatggacgcgctggaacgcggcgagaacgactcatcgaggccgccgacgacgtacgttcttgccaacacgtttgacgccctggagcacgacgcgctcgcgtcgctgaggccacacgtcgacgtcttcgccgtcgggccggtgctctcgttcctgcacgaagcggatgacgccaagcgcacgctgtctccccctcgcgatgtctttgaccatgacaggaacggctacctcagctggctggactcgaagccggccaagtcggtggtgtacatctccttcgggagctcgtcggtgatgagcaggaaccaggtcgcggagatatccgacgccatggcgcggatcaagagaccgttcctctgggtgctgaggaaggacaactgcaaggacagcgaagacgacgacgcggcgatcaagagcctgacggcggcggccgcgggcgacgccgtcgccgggacggtggtggagtggtgcgaccaggcgcgcgtgctgtcgcacccgtcggtggcgtgcttcgtgacgcacggcgggtggaactcgaccctggagggcgtggcctgcggcgtgccgctggtcgtggcgccgcagtactcggaccagggcacgagcgcctggctcgccgcggagcgggcgggcgccggcgtccgtgccgcggcgcgggaggcggacggcgtcgtggaggccgcggagctggcgcggtgcgtgggcgccgcgacgtcgggggcggtggcgtcccgcgccgcggcgtgaagggaggaggcgagggcggccgtggccggcggcgggggctcggaccggggcctggcggagttcctgaggcggatcgtcgccgacggtggtggcaactagtagacgacgcgtagcttcttgctccatttccggcgaaagacgaacggtactcgagtgcgatttgtgcttcattcgaaatgagaataaattccgttgacgg

SEQ ID NO: 16505 - protein, 464 aa, Panicum virgatum
  misc_feature: Ceres CLONE 1789372
  misc_feature (25)..(463): Pfam Name: UDPGT Pfam Description: UDP-glucoronosyl and UDP-glucosyl transferase
  misc_feature: SWISSPROT Homolog: EC 2.4.1.121 Indole-3-acetate beta-glucosyltransferase
  misc_feature: Useful for making plants with altered carbohydrate content
MTTTKHHFLIVTYPAQGHITPARHLARRFASACPGARVTICAPVSAFRRMFPGAAAVAGEERGGDGDDAVAYVAYSDGYDGGFDSAADSYARYMERARAAGERSLAAVLRRLRAGGRPVTCAVYTLLLPWVAGVAREHSVAATAVFWIQPATALAAYYHYFRGHRDAVVAAAASGDPGAEVRLPGLPPLRVRDLPSFLAITDEDNPFAFVLPEFRELMDALERGENDSSRPPTTYVLANTFDALEHDALASLRPHVDVFAVGPVLSFLHEADDAKRTLSPPRDVFDHDRNGYLSWLDSKPAKSVVYISFGSSSVMSRNQVAEISDAMARIKRPFLWVLRKDNCKDSEDDDAAIKSLTAAAAGDAVAGTVVEWCDQARVLSHPSVACFVTHGGWNSTLEGVACGVPLVVAPQYSDQGTSAWLAAERAGAGVRAAAREADGVVEAAELARCVGAATSGAVASRAAA

SEQ ID NO: 16506 - DNA, 1904 bp, Panicum virgatum
  misc_feature: Ceres CLONE 1789373
  misc_feature: Encodes the peptide sequence at SEQ ID NO. 16507
acaattaagctctcaccgaatccctgtcaggtggttaggttacgcttacgcgagtgagagaaagcgtcatgagcggcgccggcgagaccgcgggcggcagcaagctgcagagcccgctgctggccgcctccgggccggcgaccacatcggccggcggcggccacggggtgagccggcagctggagagcatcctgggcgacggggcccggccgtggccgcggcgggcgctggcggcctccgcggtggagctgcggctgctggcacagctggcggcgccggccgtgctggtgtacatgatcaactacctcatgtccatgtcgacgcagatcttcaccggccacctcggcacgctggagctcgccgccgcctcgctggggaacaacggcatccaaatcttcgcctacggactcatgcttggcatgggtagcgccgtggagactctatgcgggcaggcgtacggcgctctcaagcacgacatgctgggcatctacatgcagcgcgccaccgtcctgctgatggccaccggcgtcccgctcgccgccgtctacgcctcctcccgcccgatcctcgtcctcctcggcgagtcgccggagatcgccggcgccgccgccaccttcgtctacggcctcatccctcagatcttcgcgtacgccgccatcttccccatccagaagttcctgcaggcgcagagcatcatggcgcccagcgcctacatctccgccgccacgctcgccgcccacctggccctcagctacctcgtcatctaccggctcggcctggggctcctcggggcctcgctcatgctcagcttcagcaactgggtcatcgcggtcgagcagttcgtgtacatcgtcaccagccggcgctgccgcctcacgtggaccggcttctcctggcaggcgttctccggcctgcccgagttcttcaagctctccgccgcctccgccgtcatgctctgcctcgagacgtggtactaccagatactcgtgctcatcgccggcctgctcaaggaccccgagcttgcgttggcctcgctgtcagtctgcatgacaatctcagggtgggtgttcatgatctcagttggcttcaatgcggcagcaagtgtcagagtgagcaacgagcttggtgccggcaacccaaagtcggcagctttctccgtcgtggtggtgacagtgttgtccttcatcctgtcagtgataatctcagtgatcatcctcctctgccgggactacatcagctacatcttcaccgagggcgaggacgtgtcgcaggccgtgtcccagctgacgccgctgctggctttcaccctcatcctcaacggcatccagccggtcctgtcgggggtagctgtggggtgtggatggcaagccttcgtcgcatatgtcaatgtcggctgctactacatcgttggcatcccccttgggtgcctcctggggttctactttgatcttggagcggcgggtatttggagtggtatgattgggggtaccctgatgcagacattgatcctggtatgggttacattcaggaccaactgggacaaagaggttgaagaagccatgaaaagattgaataaatgggaagataataagtcccctatattgtgaaccaaagagtgaaataagtcgtgtattctccgatgaaggatgaaacttaggagatatcgtccttttattgtcggaccaaaaatcatacgagtatatggattgttaagtcttggccaaatctatatattaagagtaatcaaggaaattaagattgttgtatgaggaaagaacgagtccttgtttagttcgtgattttttttgggtttttgatactatagcattttcattgttatttgacaattaatatctaattatggactaattagacttaaaagatttatcttgtcatttaccgtt

SEQ ID NO: 16507 - protein, 512 aa, Panicum virgatum
  misc_feature: Ceres CLONE 1789373
  misc_feature (291)..(454): Pfam Name: MatE Pfam Description: MatE
  misc_feature (70)..(230): Pfam Name: MatE Pfam Description: MatE
MSGAGETAGGSKLQSPLLAASGPATTSAGGGHGVSRQLESILGDGARPWPRRALAASAVELRLLAQLAAPAVLVYMINYLMSMSTQIFTGHLGTLELAAASLGNNGIQIFAYGLMLGMGSAVETLCGQAYGALKHDMLGIYMQRATVLLMATGVPLAAVYASSRPILVLLGESPEIAGAAATFVYGLIPQIFAYAAIFPIQKFLQAQSIMAPSAYISAATLAAHLALSYLVIYRLGLGLLGASLMLSFSNWVIAVEQFVYIVTSRRCRLTWTGFSWQAFSGLPEFFKLSAASAVMLCLETWYYQILVLIAGLLKDPELALASLSVCMTISGWVFMISVGFNAAASVRVSNELGAGNPKSAAFSVVVVTVLSFILSVIISVIILLCRDYISYIFTEGEDVSQAVSQLTPLLAFTLILNGIQPVLSGVAVGCGWQAFVAYVNVGCYYIVGIPLGCLLGFYFDLGAAGIWSGMIGGTLMQTLILVWVTFRTNWDKEVEEAMKRLNKWEDNKSPIL

SEQ ID NO: 16508 - DNA, 2044 bp, Panicum virgatum
  misc_feature: Ceres CLONE 1789376
  misc_feature: Encodes the peptide sequence at SEQ ID NO. 16509
ctctctctctctctctctctctctctctctgaatgactgagagatgagaagtgtttgccggttgctgccgttcttgttcttctctccctgatttgggtgctctcatataccagatctgaatcctcttgtgccattggaggctgcatcgtttgaggtgatcaggatgagcaaggaggacacgctcaaggttcagatctgcgtgttaaaagtgaacatccactgtgatgggtgcgagaagaaggtcaagaagatcctccacaagattgatggtgtgtaccagagcagcatagatgcagagcaggggaaggtgacggtgtctggcctgatggatccggacaccgtcatcaggaagctgaacagggccggcaagcccgctcagctttggggcggcaagcctggcgtggtaagcccgcttcagaagctgcagcttggcggtggtggcaagggtcagcaccagaaggacgccggcggcaagggccagcaccagaaggacgccggcggcaagggccagcccaagggtggagcgggtgctggacacggcgggggcggcggcggcgctggcgcgaaagatgcaaggatggcgatgccgcagccgactccgcagcagcttcagcaactgcagcaactgcaacagcagatgcagatgaagggactgaagcttcctccccagctcatgggcatgggcggcaagatgccattcccggcggccgcgccgccggcgaaggaccccaaccccaaggctgtcaggtttgacgttcccgaggatgacgagttcggggacgacggcagcgagttcaatgatgagttcgacgacttcgacgacgaggatttcgaggacgacggcctcgacgacatttacgacgaccccaagatgatgatgaagcctatggccatgccgccggccgccggcgggggcgacaggaagggtggcaacggcggcggcacgaaaggcggcggcggcaacgagatcccggtgcagatcaaggggaacgccaacaacggcggcaagaaggactctggcgcgaagcagaaccagggcggcggcggcaagaacggtggcggtgcgcagccgccgcagaacagcaagggtggcgccccaggcggtgggaaccagcctggccaggccaagaagggcggcggcccgatgatggccggcatgccgccgcagcagcagccgggcatgatgatgaggccgctgaacatgatgggcggcgccggtttccccggtataggccagatgggcggcgggcccatgggcggcatgccgatgggccacccccacatgggtggcagtggcatgcagcagggaggtgcggtccacggcatgccggccggcgccatgatgcctggtgctgggttctacccgagcggcggcatgccgtcggggccggagatgatgccagcggccgggaaccacatggcgcagcagcagtacctgtccatgatgcagcagcagcaggcgcagatgatgaatggccacggccaccatggtcacggcggcgccgggtacccgccgacggggtacgggtacgggtacggccggccggcgatgccctacccgccgccggcgtactaccctacgccgcacccgcatgacaacatgttcagcgacgagaaccccaccaacagctgctcggtgatgtgaggcaaaggtcgccggctcgccgctgcctgccagagctctttctcctgctgatgcctcggacaaagtagtgaaccaaccggaaggagaggaggggagctcaggtcacaggtggtcaccggtcagcgtcgtcaccatggtcgtcgcagtaacaacctggatgactggatcggtcggtcagtatacatgagagactagcccctagtaccagcagctagaatctccccccttttcttttcccatctcctttttcttttctagtttattttcactttcttcttcctttgaacaaaaaaagagcaacttccttggatgggaaggtaggtatagtaattatcaatagtggtcataagagatgatgtgctctatcaatagtagctcaagatggtggtgttgagtttc

SEQ ID NO: 16509 - protein, 493 aa, Panicum virgatum
  misc_feature: Ceres CLONE 1789376
  misc_feature (13)..(73): Pfam Name: HMA Pfam Description: Heavy-metal-associated domain
MSKEDTLKVQICVLKVNIHCDGCEKKVKKILHKIDGVYQSSIDAEQGKVTVSGLMDPDTVIRKLNRAGKPAQLWGGKPGVVSPLQKLQLGGGGKGQHQKDAGGKGQHQKDAGGKGQPKGGAGAGHGGGGGGAGAKDARMAMPQPTPQQLQQLQQLQQQMQMKGLKLPPQLMGMGGKMPFPAAAPPAKDPNPKAVRFDVPEDDEFGDDGSEFNDEFDDFDDEDFEDDGLDDIYDDPKMMMKPMAMPPAAGGGDRKGGNGGGTKGGGGNEIPVQIKGNANNGGKKDSGAKQNQGGGGKNGGGAQPPQNSKGGAPGGGNQPGQAKKGGGPMMAGMPPQQQPGMMMRPLNMMGGAGFPGIGQMGGGPMGGMPMGHPHMGGSGMQQGGAVHGMPAGAMMPGAGFYPSGGMPSGPEMMPAAGNHMAQQQYLSMMQQQQAQMMNGHGHHGHGGAGYPPTGYGYGYGRPAMPYPPPAYYPTPHPHDNMFSDENPTNSCSVM

SEQ ID NO: 16510 - DNA, 649 bp, Panicum virgatum
  misc_feature: Ceres CLONE 1789378
  misc_feature: Encodes the peptide sequence at SEQ ID NO. 16511
atccatctccgccagattccaacctcaaaccaaaaaatcccccaattccggcgtgcgagagcgcgaggaaggaggccaaggcggcggcgatgtcggggcgaggcaaggggggcaaggggctgggcaagggcggcgccaagcgccaccgcaaggtgctccgcgacaacatccagggcatcaccaagccggctatccggcggctggcccggaggggcggcgtgaagcgcatctcggggctcatctacgaggagacccgcggcgtgctcaagatcttcctcgagaacgtcatccgcgacgccgtcacctacaccgagcacgccaggcgcaagaccgtcaccgccatggacgtcgtctacgcgctcaagcgacaggggcgcaccctctacggcttcggcggctaggcggcgctggcgccggcgcgcctcctgcggggcgctgctccctcgggcgtttcggggatgcggtgccgtctgtgattagggatgcttcgttttttagttacttcgtcggcttgtgtcctggtgggtctggagctgatcttgctagcgatccctgttcgaattgttggtgacgaactgctattaatcttgtctgtctggagtgcctgtgcttcaacctcttccgccatcgcgtcgcgaacggcggccag

SEQ ID NO: 16511 - protein, 103 aa, Panicum virgatum; identical to SEQ ID NO: 12044
  misc_feature: Ceres CLONE 1789378
  misc_feature (25)..(94): Pfam Name: Histone Pfam Description: Core histone H2A/H2B/H3/H4

SEQ ID NO: 16512 - DNA, 700 bp, Panicum virgatum
  misc_feature: Ceres CLONE 1789385
  misc_feature: Encodes the peptide sequence at SEQ ID NO. 16513
gaacagcaacagcaatctcttgtaaccgggaagacacccggagcgagctgtcagcgtagagagagatggttctgacgcatgttcaggagctcgacgatgccgccgccgcgtcggccgtcgtcttcgcctcgagatacgtccaggagccgctcccgaggtacgagctggggcagaagtccatctccaaggacgcggcgtaccagatcatccacgacgagctgctgctggacagcagcccgcggctgaacctggcgtcgttcgtcaccacgtggatggagcccgagtgcgacaggctcatcctcgagggcatcaacaagaactacgccgacatggacgagtaccccgtcaccaccgagctccagaaccggtgcgtgaacatcatcgcgcggctgttcaacgcgccggtgggcgccggcgagaaggccgtcggggtcggcacggtggggtcgtcggaggcgatcatgctggccgggctggccttcaagcggcgctggcagcaccggcggagggcggcggggaagccctgcgacaggcccaacatcgtaaccggcgccaacgtgcaggtgtgctgggagaagttcgcgcgctacttcgaggtggagctcagggaggtgaagctgcgggaagggcggtacgtgatggaccccgacgaggccgtggcgatggtcgacgagaacaccatctgcgtccccgccatcct

SEQ ID NO: 16513 - protein, 211 aa, Panicum virgatum
  misc_feature: Ceres CLONE 1789385
  misc_feature (30)..(211): Pfam Name: Pyridoxal_deC Pfam Description: Pyridoxal-dependent decarboxylase conserved domain
  misc_feature: SWISSPROT Homolog: EC 4.1.1.15 Glutamate decarboxylase
  misc_feature: Useful for making plants with modulated nitrogen use efficiency
MVLTHVQELDDAAAASAVVFASRYVQEPLPRYELGQKSISKDAAYQIIHDELLLDSSPRLNLASFVTTWMEPECDRLILEGINKNYADMDEYPVTTELQNRCVNIIARLFNAPVGAGEKAVGVGTVGSSEAIMLAGLAFKRRWQHRRRAAGKPCDRPNIVTGANVQVCWEKFARYFEVELREVKLREGRYVMDPDEAVAMVDENTICVPAI

SEQ ID NO: 16514 - DNA, 1711 bp, Panicum virgatum
  misc_feature: Ceres CLONE 1789393
  misc_feature: Encodes the peptide sequence at SEQ ID NO. 16515
ggcttcgccagtttcgcctaaacctcgagggtgcttcccagaccagaccacaacacatccatggcgatctcccagatctcccgcggggccctggccctcctcctcctcctcgccgccgccttcgccgccgccccagcagcgctcgccgacggcgacgacgtgttggccctcaccgagtccaccttcgaaaaggaggtcgggcaggaccgcggcgccctcgtcgagttctacgccccctggtgtggtcactgcaagaagcttgctcctgagtatgaaaggcttggcgcaagttttaagaaagctaaatccgtcttgatcgcgaaggttgattgtgatgagcacaagagtgtgtgcagcaaatatggagtttctggatatccaacaattcagtggttcccaaaaggatccttggagcccaaaaagtatgaaggacaacgcactgcggaagcccttgctgaatttgttaatactgaaggaggcacaaatgtaaagctggcaaccattccttcaagtgttgtggtgctcaccccagagacttttgactcagttgtccttgatgaaacaaaagacgtccttgttgagttctatgccccatggtaggtttctaggtggtgttaggcttacagatggtcttctgcaccatcagtccctgaacttttcctggttatctaattgattgggtatttttttttgctgtacaggtgtggtcactgcaagagtcttgctcctgttagtacatgagtctagctttgagtttatgctacatattctattgcaattttactcttgcaagcatcgttagcgatctttgtcatctctgcatgtctaataggaattcttgtatttttttttcagatttatgagaaggtggcttctgttttcaagttggatgagggggttgttattgcaaaccttgatgctgacaaacacagggatttggctgagaagtatggagttaccggattccctacgttgaagtttttcccaaagggaaacaaagctggtgaagattatgatggcggcagggacttgggtgactttgtcaagttcattaatgagaagagtggtaccagccgtgatacaaagggtcaactcacctcagaggctggccacatagcaagtttggatgccctggcaaaggagttccttggtgctgccagtgacaagcggaaggaagtcctttccagtatggaggaggaggtagctatgctcagtggttctgctgccaagcatggaaaggtctatgtaaccatcgcaaagaagatcctagagaaaggcaatgactatactaagaaggaaactgacaggcttcagcgcatgttggagaagtccatcagccccacgaaggcagatgaatttaccatcaagaagaacgttctttcgacattctcttcctaaggcaacggctggcccaactttcatgtttcagatataggcgaagagaactgcaagtttaggggatgtgataatgagagttgattgttggtagaactaattttgggggtttccctcgagcatacgtgatacttttatcattttgtggttcacagttcttttcttcgcgcttacatggattttattacgtagcactatagtctacttttggatggagagaagcgatagaaaacattgtgactacagaacaggattttttattccaataaggctcactttatgcgataaatacgagcttggaaagctgaatgcggcc

SEQ ID NO: 16515 - protein, 179 aa, Panicum virgatum
  misc_feature: Ceres CLONE 1789393
  misc_feature (33)..(138): Pfam Name: Thioredoxin Pfam Description: Thioredoxin
  misc_feature: SWISSPROT Homolog: EC 5.3.4.1 Protein disulfide-isomerase
MAISQISRGALALLLLLAAAFAAAPAALADGDDVLALTESTFEKEVGQDRGALVEFYAPWCGHCKKLAPEYERLGASFKKAKSVLIAKVDCDEHKSVCSKYGVSGYPTIQWFPKGSLEPKKYEGQRTAEALAEFVNTEGGTNVKLATIPSSVVVLTPETFDSVVLDETKDVLVEFYAPW

SEQ ID NO: 16516 - DNA, 1834 bp, Panicum virgatum
  misc_feature: Ceres CLONE 1789407
  misc_feature: Encodes the peptide sequence at SEQ ID NO. 16517
accaccgccattagcctcctgattcccacgccacctagtcccgagccccgtcccatgcccgctttggaggcgcgagtgagtgagcagagcgaggcctgatgcggcagcggcagcagggggaggagcaccaggagctgttcgtgcagtggaggccctgcgacaagaagaggtcctaggcctcgagccgagtccgtcctcggatccactcatccactcggggcgcgcgtgaaggcgccgtctttccggctcgccggcggcggcggcgcgcggcggcgaggacggccggccgaggggagatcggaagatgagcgtgtccgtggggaagacccgggtggggaggtacgagctgggccggacgctcggggagggcaccttcgccaaggtcaagttcgccaggaacgtcgagaccggcgagaatgtcgccatcaagatcctcgacaaggagaaggtgctcaagcacaagatgatcgcccagataaagcgagagatctcgaccatgaagctcatcaggcacccaaacgtcatccggatgtatgaggtgatggctagcaagacaaagatttacatagtgatggagcttgtcaccgggggtgaacttttcgacaagattgcttcgcgtggaaggctgaaagaggatgatgcgaggaagtatttccagcaggtgatcaatgctgtcgattactgccacagcagaggcgtctaccaccgtgatctcaagcctgaaaaccttctgcttgatgctagtggcacactcaaggtgtctgattttggattgagtgcgctatctcaacaagtccgagaggatggtctgcttcacacaacctgtggaactcctaattatgttgctcccgaggttataaacaacaaagggtatgatggagccaaggctgatctatggtcatgtggggtgattctctttgtcctcatggcagggtacctcccatttgaagattcgaaccttatgtcgctttacaagaagatcttcaaggcagatttcagttgcccgtcttggttctccacaagtgcgaagaagctcatcaagaagatattagatcctaatcctaacactaggataacaattgcagagcttattaacaatgagtggttcaagaaggggtatcaacctcccagatttgagacagtggatgttaatttagatgatgtcaactccatttttgacgaatctggcgacccagcacaacttgttgttgagaggcgagaagagagaccatcagtgatgaatgcttttgagctgatctctacatctcaaggcctcaatctcggcacactctttgagaagcaaacgggctctgttaagaaagaaacaagatttgcatcaaggcttcctgcaaatgagatactgtcgaaaattgaagcagcagcaggacccatgggcttcaatgtgcagaagcgcaactacaagctgaagcttcaaggagagaaccccggaaggaaaggtcagctggccattgcaacagaggttttcgaggtgacgccttcgctgtacatggtggagctgcgcaagtccaacggcgacaccctggaattccacaagttctaccgcaacatctcaaacgggctcaaggacgtgatgtggaagccggatggcagcatcgtggaaggcaacgaggcgcggcaccggaggacaccgtgatggatctgcaaccaagttttttagaagtagcgctgcagataaaactagtcagggaactggtggaacgaagaagcttgtgactgctctctgttttaaggtgctttccgtgtagaggcgctttcatcagaccaaaagtatggataatgtgaatgaaggaatgtgcagagtttccataggact

SEQ ID NO: 16517 - protein, 449 aa, Panicum virgatum
  misc_feature: Ceres CLONE 1789407
  misc_feature (13)..(268): Pfam Name: Pkinase Pfam Description: Protein kinase domain
  misc_feature (308)..(369): Pfam Name: NAF Pfam Description: NAF domain
  misc_feature: SWISSPROT Homolog: EC 2.7.11.1 Non-specific serine/threonine protein kinase
  misc_feature: Useful for making plants with modulated salt sensitivity
MSVSVGKTRVGRYELGRTLGEGTFAKVKFARNVETGENVAIKILDKEKVLKHKMIAQIKREISTMKLIRHPNVIRMYEVMASKTKIYIVMELVTGGELFDKIASRGRLKEDDARKYFQQVINAVDYCHSRGVYHRDLKPENLLLDASGTLKVSDFGLSALSQQVREDGLLHTTCGTPNYVAPEVINNKGYDGAKADLWSCGVILFVLMAGYLPFEDSNLMSLYKKIFKADFSCPSWFSTSAKKLIKKILDPNPNTRITIAELINNEWFKKGYQPPRFETVDVNLDDVNSIFDESGDPAQLVVERREERPSVMNAFELISTSQGLNLGTLFEKQTGSVKKETRFASRLPANEILSKIEAAAGPMGFNVQKRNYKLKLQGENPGRKGQLAIATEVFEVTPSLYMVELRKSNGDTLEFHKFYRNISNGLKDVMWKPDGSIVEGNEARHRRTP

SEQ ID NO: 16518 - DNA, 1338 bp, Panicum virgatum
  misc_feature: Ceres CLONE 1789408
  misc_feature: Encodes the peptide sequence at SEQ ID NO. 16519
agaagcttccgagccctccgcggccgggcggtcgccggacgcgtggtctagaaccttccacaaggctcgcgacgtgtctcgacgcgcccgtgcggcggggatatttagtggtccggccaccgcccgcccgccgctcttctcccgcgaccttttcacagcgcagaaatatctcctctcctcgccttcgcttccatttccacccagcagccacagcagcaagtatcccaacagattccctccgcgatccgccacttgtccgggcgattccagctcccgatcgcgcgaatcgagttcgttcttggccgcaggagccgggttctggccgcaatcgggtggttcgttctcgaccggaggggaggcagctcaatcgggggttcttggtttccgcgggccgagtcctcgggcggcggctgcggccatggagccgtcggcggcggccgcgggcattgtgaaggaggagctcctggagcagcagccgctgcaggacggcgtgcgcggcggggacgcgccgcgcccgatggaggggctgcacgaggtcggccccccgccgttcctgaccaagacgttcgacctggtggaggacccggccaccgacgcggtcgtctcctggagccgcgccggcaacagcttcgtcgtctgggacccgcacgtcttcgccgacgcgctgctcccgcgcctcttcaagcacagcaacttctccagcttcgtccgacagctcaacacctatggcttcagaaaggtcgatcctgatagatgggagtttgcaaatgaaggtttcctcaggggtcaaaggcacctactgaagacaataaagagaaggaagccaccatcagctgtgccacaatcacatcaacagcaggcttccgcttcttgcctggaggttggtgagttcggatttgaggaagagattgacaggctgaagcgcgacaagaacatcttaatcacagaagtagtaaagctaaggcaggagcagcaaagtactaaagatcatgtgagagccatggaagagaggctacgcgtggctgagcagaagcaggtacagatgatggggttcttggcaagagcaatgcggaatccagagttcttccagcagttggtccagcaacaagataagaggaaggagcttgaggaagccatctcaaagaaaagaaggcgaccgattgacaacactccgttctacagccctggggaaacaagtcagagcgaacagcttgattcacagttcatgtttgattctggtgtgcttgatgggctcagtgaacctggaatgcctgagctggagaatttagctgtgaacattcaggagcttggaaagggtagtacagatggtgcaaaaat

SEQ ID NO: 16519 - protein, 306 aa, Panicum virgatum
  misc_feature: Ceres CLONE 1789408
  misc_feature (43)..(213): Pfam Name: HSF_DNA-bind Pfam Description: HSF-type DNA-binding
  misc_feature: The sequence is a functional homolog of SEQ ID NO 1685 in the 10/412,699 US patent application
  misc_feature: The sequence is a functional homolog of SEQ ID NO 1687 in the 10/412,699 US patent application
  misc_feature: The sequence is a functional homolog of SEQ ID NO 2660 in the 10/374,780 US patent application
  misc_feature: The sequence is a functional homolog of SEQ ID NO 74 in the 10/225,066 US patent application
  misc_feature: The sequence is a functional homolog of SEQ ID NO 926 in the 10/412,699 US patent application
  misc_feature: The sequence is a functional homolog of SEQ ID NO 1686 in the 10/412,699 US patent application
  misc_feature: Useful for making plants with modulated heat sensitivity
  misc_feature: The sequence is a functional homolog of SEQ ID NO 1688 in the 10/412,699 US patent application
  misc_feature: Useful for making plants with modulated biomass
  misc_feature: The sequence is a functional homolog of SEQ ID NO 2201 in the 10/666,642 US patent application
  misc_feature: The sequence is a functional homolog of SEQ ID NO 865 in the 10/666,642 US patent application
  misc_feature: The sequence is a functional homolog of SEQ ID NO 1418 in the 10/666,642 US patent application
  misc_feature: The sequence is a functional homolog of SEQ ID NO 200 in the 10/225,068 US patent application
  misc_feature: The sequence is a functional homolog of SEQ ID NO 2428 in the 10/374,780 US patent application
  misc_feature: The sequence is a functional homolog of SEQ ID NO 942 in the 11/435,388 US patent application
  misc_feature: The sequence is a functional homolog of SEQ ID NO 422 in the 10/666,642 US patent application
  misc_feature: The sequence is a functional homolog of SEQ ID NO 816 in the 11/435,388 US patent application
  misc_feature: The sequence is a functional homolog of SEQ ID NO 1805 in the 10/374,780 US patent application
MEPSAAAAGIVKEELLEQQPLQDGVRGGDAPRPMEGLHEVGPPPFLTKTFDLVEDPATDAVVSWSRAGNSFVVWDPHVFADALLPRLFKHSNFSSFVRQLNTYGFRKVDPDRWEFANEGFLRGQRHLLKTIKRRKPPSAVPQSHQQQASASCLEVGEFGFEEEIDRLKRDKNILITEVVKLRQEQQSTKDHVRAMEERLRVAEQKQVQMMGFLARAMRNPEFFQQLVQQQDKRKELEEAISKKRRRPIDNTPFYSPGETSQSEQLDSQFMFDSGVLDGLSEPGMPELENLAVNIQELGKGSTDGAK

SEQ ID NO: 16520 - DNA, 548 bp, Panicum virgatum
  misc_feature: Ceres CLONE 1789408-R
tagcccaaagtagagttgtgtttgtaacagttcacccgacagttgctggtgctttccgtactattgcagatcatcttgaacaacctgttaaacggtggagatttgtagctgttctgaggggttcgtgtgggaggcccagactgtgtggacaccagtatgctgaaggctccgtgctgcgagggatacgtgaggtgttggctaacctctccatgctgactggcaaagtgatccttacgaaggtgactggcaaagaagtcctatagacaccagaccagatcgacaagatatacagctgttatgagcccttatccagtagctcttacatccagaagctgttctactgtaaatgcccgtgctcgtgccattggtagactttcttcaggttctgcattgggttgtagcctttaggttgagtacttgagtcactctgtgattggtgtaacctgaaaacatccttagcatgataacttcatcactgtgcgtcaggttgccaaataggatcaaatctgaacgatttagcatatattcttcctattgccttcatattt

SEQ ID NO: 16521 - DNA, 1773 bp, Panicum virgatum
  misc_feature: Ceres CLONE 1789411
  misc_feature: Encodes the peptide sequence at SEQ ID NO. 16522
acacgccctgcgtttctcccactcgcagtcgcagtcttgccttgcgcttgcgcccacacacccatctctgggtcgatcgccggggagaggcagtgaccgcaagtgaatcgcgcacactaagatcgggcgttcctcctgtccatgggaggttttaggcggtggctgccgttcggcggcggcggcggcgggtgctgctgcggcggcggcggaggcggaggcggaggcggaggcaggggcgtggcggacgggctggtgtgggacgtgcccctcaaggcgcacgcgtcgggggactactccatcgccgtggcgcaggctaacgaggcgctcgaggaccaggcgcaggtgctctcggcgccgggcgccacgctcgtcggcgtctacgacggccacggcgggcccgaggccgcgcgcttcgtcaacaggcgcctcttctccctcatccaaggtgagagctgccagaacctgattatctatggatgagctctctctcgattcctcaagccaggtccttgctccagcgattgcatttctgctccccggccgggatcaaatcaaaaccttgtcttccgagttctgacgacatgtctgcgcgcgcgtcgtgatgttttttctgcagattacgcggccgagaacggcggcctgtcggcggaggtgatccagaaggccttcggcgcgacggaagacgagttcgtgggcatggtgcagaagtcgtggccggcgcacccgcggatcatgtccgtgggctcctgctgcctggtgggcgccatcgagaacgggaccctctacgtggccaacctcggcgactcccgcgccgtgctcggccgccgcgacgacgccgcccccggccgggggaacaagcgggtggtggcggagcggctgtcccgggaccacaacgtcgccgacgaggacgtgcggcgggaggtggcggagatgcaccccgacgactcgcacatcgtgctcaacagccacggcgtgtggcggatcaagggcatcatccaggtgtcccggtccatcggcgacgtgtacctcaagaggcccgacatgtgccggggcaacccgatgctgcagcagtcgctgtgcccgttcccgctgcgccgccccgtgatgagcgccgtgccgtcgatcacgacccgggagctgcgcccgggcgaccggttcgtcatcttcgcgtccgacgggctgtgggagcagctcggcgacgacgacgcggtgggcatcgtggcgggcagcccaaggaagggcgtggccatgcgcctggtgcgcgccgcgcagctggaggcggcgcggaagaaggaggtcaagtacgacaagatccggaccatcgagaagggacaccgccggcacttccacgacgacatcaccgtcgtggtgctcttcctggacagctgccggggcgcggcgcggtccggcgccggggacatcggcggcacctacgcgcccgttgacgtgttctcctgcagccccgccggcgaccatcaccacgaggacccgaccaggcccggtcctgcggcgttgagttgagactgatcctggttggtgtgctgttctttcgttcggttcatgcgatttatttcgctcttgaaacgagaggtacgtgaatcgagttgcttcccgtaatcccgtttcaaggagaatttgcctgtaaagaaagaagtgtcatcgaacagacgaacatactacagtgtcgtggcgatcaagtgtagcaaactgtaaaccttcatctattccttccttcttttgttttaagagaatgtgaatgttctactgcactcc

SEQ ID NO: 16522 - protein, 274 aa, Panicum virgatum
  misc_feature: Ceres CLONE 1789411
  misc_feature (1)..(200): Pfam Name: PP2C Pfam Description: Protein phosphatase 2C
  misc_feature: SWISSPROT Homolog: EC 3.1.3.16 Phosphoprotein phosphatase
  misc_feature: Useful for making plants with modulated biomass
  misc_feature: Useful for making plants with modulated low light sensitivity
MVQKSWPAHPRIMSVGSCCLVGAIENGTLYVANLGDSRAVLGRRDDAAPGRGNKRVVAERLSRDHNVADEDVRREVAEMHPDDSHIVLNSHGVWRIKGIIQVSRSIGDVYLKRPDMCRGNPMLQQSLCPFPLRRPVMSAVPSITTRELRPGDRFVIFASDGLWEQLGDDDAVGIVAGSPRKGVAMRLVRAAQLEAARKKEVKYDKIRTIEKGHRRHFHDDITVVVLFLDSCRGAARSGAGDIGGTYAPVDVFSCSPAGDHHHEDPTRPGPAALS

SEQ ID NO: 16523 - DNA, 731 bp, Panicum virgatum
  misc_feature: Ceres CLONE 1789412
  misc_feature: Encodes the peptide sequence at SEQ ID NO. 16524
atcgctaggcgatcgaacagaacctgctcctcctccatcgtgatccgcgagccgagcccgaggcggtggcggcgatgggcagcgtggccatggactccgactacggcgcgccgcgcgagctgtcggcgctccagaaggcgcgcgcgctctaccagccggatctcccgccgtgcctccagggtaccgcggtcagggtggagtacggtgacacagcgaccgcggcggatgttgctggtgcgcatgtcatcagccaggccttccctcacacgtacgggcagccgctggcgcacttcctcagcaagacggccaatgtgccggacgctaccatcataacagagcaccctgtcgtcagggttggtattgtcttcagtgggaggcaatccccaggagggcacaatgttatatggggcctgtatgatgctataaaggctcacaactcaaacagcaagtttattggttttcttggaggaactgatggattatttgcacagaaaactatggaaatcactgaagaagctctttcatcctataaaaatcaaggtggttatgacatgcttggtcggacaagggatcaaatcagaactactgagcaagtaaaggcagcaatggctacttgccaagcattgaagttggatgcccttgttataattggaggtatcacgtccaatacagatgctgctcagcttgctgagacatttgctgagttgaaatgtccaacgaaggtagttggt

SEQ ID NO: 16524 - protein, 218 aa, Panicum virgatum
  misc_feature: Ceres CLONE 1789412
  misc_feature: SWISSPROT Homolog: EC 2.7.1.90 Diphosphate--fructose-6-phosphate 1-phosphotransferase
MGSVAMDSDYGAPRELSALQKARALYQPDLPPCLQGTAVRVEYGDTATAADVAGAHVISQAFPHTYGQPLAHFLSKTANVPDATIITEHPVVRVGIVFSGRQSPGGHNVIWGLYDAIKAHNSNSKFIGFLGGTDGLFAQKTMEITEEALSSYKNQGGYDMLGRTRDQIRTTEQVKAAMATCQALKLDALVIIGGITSNTDAAQLAETFAELKCPTKVV

SEQ ID NO: 16525 - DNA, 652 bp, Panicum virgatum
  misc_feature: Ceres CLONE 1789412-R
  misc_feature: Encodes the peptide sequence at SEQ ID NO. 16526
atctcaagagcccagtaaacaagtggaaatgtggtgctgctcctattacgtctatgatgactgtaaaaagatggtcccgtggtcctgctgccagccaaattggcaagcctgctgtccacatggccagtgtcgacttgaaaggaaaagcatacgaactgttgcgacaaaattcttccagcttcttgatggaagacatctaccgaaaccctgggccacttcagtttgaaggatcgggtgctgagacaaagccgatttcactgtgtgttgaagaccaagactacatgggaagaatcaaacaattgcaggagtacttggagaaggtgaaaagcattgtgaagcctgggtgttcacaggatgtcctcaaagcagcgttaagcgccatggcttctgtgacggagatgctgacaatcatgtcttccccggctttcagtggccaggcaaccatctgaacaccatgcaaagactgtaccgtctgaatgctggtctcgtgtactcggtctcagacatattttggttgtctgtatcatctgtctatctgaaaccacggtcttgataggtcctctgctcaatatctgctgtgttttgggtgttttttcatctagacgtattttggaacaggaataatttgagcgtaatactacaaacttgttac

SEQ ID NO: 16526 - protein, 148 aa, Panicum virgatum
  misc_feature: Ceres CLONE 1789412-R
  misc_feature: SWISSPROT Homolog: EC 2.7.1.90 Diphosphate--fructose-6-phosphate 1-phosphotransferase
LKSPVNKWKCGAAPITSMMTVKRWSRGPAASQIGKPAVHMASVDLKGKAYELLRQNSSSFLMEDIYRNPGPLQFEGSGAETKPISLCVEDQDYMGRIKQLQEYLEKVKSIVKPGCSQDVLKAALSAMASVTEMLTIMSSPAFSGQATI

SEQ ID NO: 16527 - DNA, 2031 bp, Panicum virgatum
  misc_feature: Ceres CLONE 1789414
  misc_feature: Encodes the peptide sequence at SEQ ID NO. 16528
atccccttctcccctatgtccatcgtcctccccactcccagcttcatatacctgtcaatggcgcgctcggtgcggcggccagcacccttctgtggacggcgccggcgcgcggcctgctatccgccctcccttctctcttcaatctggtacacgcctcgcaatgggtccgccggcctacaccgcttccctttctcctggttctgctctcttctccaactcccgaatgccgccgccgccgccgcgtcttctccggccgggcctcggggtgccggggagaggggaggtggggttgtcttcggccgccggaaggtacggcggcggctgcctcaccccgccgcaggagaagcgccgccccgcaccgctgcaggagaagcgccggccctcggagtcatcccaactcacggaacggaagcggcattggaaggcgggggagttcccggggtcctccgccggcagggacggcggccgccccgcccctccgccggagaagcggcactggaaggcgggagagttcctgggcaccgccgcgccccccgactcgaaagcgtcgaggacgcccctgaagaacatcaagaagcggctggacgcccgcgcggacgccaaggcgtgggcgtgcaccgtcaccgaggccctcgccgacagcatcaactcaaagaactggcgagaggcgctgcaggtcttcgagatgctcaaggagcagcctttctaccatccgaaagagggcacctacatgaagctcatcgtgctgcttggcagatcaggccacgccgcccaagcgcgccagctattcgacgagatgctgcaacaaggatgccaacccacccctgagctctacaccaccttgattggggcctactgccgctgcggcctactggatgagtcactccagctcctcacagacatgaaggcctctccactgtgccagcctgacgtctacacctacagcaccatcatcaaggcctgtgtcgatgccagcagatttgaccttgttgaagctatgtacaaagacatggctgagcgctcgatatcacccaacacggtcatgcagaacattgtcctcagcgggtatggaaaggctggacggttggatgacatggaaagagtgctctctgacatgctcgacagcacgacctgcaagccggatgtctggacaatgaacattatcttaagcctgtttggaaacagggaccaggtggaagcgatggaggaatggtatgagaaattccgaagctatggcatcgaaccggaaactcgcacactgaacattctcattggcgcctatgggaagaagcggatgtacgataagatgtctgcagtcatggagtacatgcgcaagctagcatttccatggaccactgccacatacaacaatgtgattgaggcatttgctgaggcgggtgatgccaaaaacatggaacacacatttaaccagatgcgctctgaggggatgaaaccagatacaaagaccttctgttgtctaataaatgggtttagcaaagcaggctttttccataaggttgtgggcatggataagcttgctgagagacttggtgtgcccacagatacatctttccacaatgctattcttggtgcatgtgcaaaagcagatgatctgatggagatggagagggtcttcatgcacatgaagcataagcagtgtgatccggatgccatgacatactctatcttggtggaagcttatcggaaggaaggaatgactgacaagatttatgctttgcatcagggcaggagaacccaactttggttccaactaatcttgtcatggtgtaactgacttgctgaccgaataatggttcagacatttaagcctgtctgcattggtggaaaacttccctcctgtcccagtttggagttgataatgcaaccaagtagagtggcagccattctccaactccattttgtctgttggcctgcagagttagtatctatatctcctggcaactgtatttctgtgaactctggaggcttcactgtatcaattgaaatgtgacggtaatgtgtgtagctccg

SEQ ID NO: 16528 - protein, 544 aa, Panicum virgatum
  misc_feature: Ceres CLONE 1789414
  misc_feature (400)..(434): Pfam Name: PPR Pfam Description: PPR repeat
  misc_feature (259)..(293): Pfam Name: PPR Pfam Description: PPR repeat
  misc_feature (223)..(257): Pfam Name: PPR Pfam Description: PPR repeat
  misc_feature (188)..(222): Pfam Name: PPR Pfam Description: PPR repeat
MGPPAYTASLSPGSALFSNSRMPPPPPRLLRPGLGVPGRGEVGLSSAAGRYGGGCLTPPQEKRRPAPLQEKRRPSESSQLTERKRHWKAGEFPGSSAGRDGGRPAPPPEKRHWKAGEFLGTAAPPDSKASRTPLKNIKKRLDARADAKAWACTVTEALADSINSKNWREALQVFEMLKEQPFYHPKEGTYMKLIVLLGRSGHAAQARQLFDEMLQQGCQPTPELYTTLIGAYCRCGLLDESLQLLTDMKASPLCQPDVYTYSTIIKACVDASRFDLVEAMYKDMAERSISPNTVMQNIVLSGYGKAGRLDDMERVLSDMLDSTTCKPDVWTMNIILSLFGNRDQVEAMEEWYEKFRSYGIEPETRTLNILIGAYGKKRMYDKMSAVMEYMRKLAFPWTTATYNNVIEAFAEAGDAKNMEHTFNQMRSEGMKPDTKTFCCLINGFSKAGFFHKVVGMDKLAERLGVPTDTSFHNAILGACAKADDLMEMERVFMHMKHKQCDPDAMTYSILVEAYRKEGMTDKIYALHQGRRTQLWFQLILSWCN

SEQ ID NO: 16529 - DNA, 674 bp, Panicum virgatum
  misc_feature: Ceres CLONE 1789417
  misc_feature: Encodes the peptide sequence at SEQ ID NO. 16530
cctttctcctgagctccttccattccattcccaagctaagctagcagacaaggccgcggatccatgggcgtcttcacggtgaccaagctgtccgaggggcccgtgcggccgtccgccgccacgccgtcggggacgctgcccatggcctgggtcgaccggtacccgacgcaccgcggcctcgtcgagtccgcgcacatctaccgcaacgtcgacgacatgccggcgccggcagcggagcgagaggctggtggcactggcgccaaggccgccgccgccgccctcgccctgcaggcgccggacaaggaggcgatgatgaacggcagcaagtccccggccgcggtggtgcgcggcgcgctggcggacgcgctggtgcactactacccgttcgcggggcggatcgtggaggacgtccccggccggcccgccgtgctgtgctccggcgagggcgtctacttcgtggagggcgccgccaactgcaccctcgccgacgtcaacttcctggagcgcccgctgctgctcgccaaggagcagctcgtgccgtgcccgacgccggagctctggcccgtcgagccgcacaacaccctcgccatgatacaggtgcggtacgatgtagctaggcggatctacttgcttgtccgctctgcactaaaaaaaaacatgtttccttcaattct

SEQ ID NO: 16530 - protein, 203 aa, Panicum virgatum
  misc_feature: Ceres CLONE 1789417
  misc_feature: SWISSPROT Homolog: EC 2.3.1.167 10-deacetylbaccatin III 10-O-acetyltransferase
MGVFTVTKLSEGPVRPSAATPSGTLPMAWVDRYPTHRGLVESAHIYRNVDDMPAPAAEREAGGTGAKAAAAALALQAPDKEAMMNGSKSPAAVVRGALADALVHYYPFAGRIVEDVPGRPAVLCSGEGVYFVEGAANCTLADVNFLERPLLLAKEQLVPCPTPELWPVEPHNTLAMIQVRYDVARRIYLLVRSALKKNMFPSI

SEQ ID NO: 16531 - DNA, 632 bp, Panicum virgatum
  misc_feature: Ceres CLONE 1789417-R
  misc_feature: Encodes the peptide sequence at SEQ ID NO. 16532
agcaagctcgggttcaacgacgtggactacgggtacggcacgccggtgtccgccggcccgctggtgaactgcgacctcatcgcgtcggtcatcgtcatgagggcgccggcgccgctcgccggcacgcggctgctggccagctgcgtcaccaaggagcacgccgacgacttcgcccgctggatacgggaggatctcgtgtgatgatgcgggcttgcatacgtgaaggaactcggccgccgtaccgtatgtccgtatcacatatctgcctatctacgatacgtgtcgtcgatcagagctagtggtggtgagagctacatacgaaatgggaattggtgttcttgtctggaccgtaactatagtattgcactagttgttgtacaaagtgtgtgcaaatgaacaaattttcatggagttgttgagcggaactagctagccagtgttcataacgaaaaaaacactccatgagagtcgggttacaccttgtgtagagagtatctgagtggatgtaaaatgttgtaacaatccatatcatatcatatcatatcattcagtttggacgtgtgctcttatgtaaccaaaatgcgaaataaattattatgaagctgaataataatcaattttatttcaactag

SEQ ID NO: 16532 - protein, 66 aa, Panicum virgatum
  misc_feature: Ceres CLONE 1789417-R
  misc_feature: Useful for making plants with altered carbohydrate content
SKLGFNDVDYGYGTPVSAGPLVNCDLIASVIVMRAPAPLAGTRLLASCVTKEHADDFARWIREDLV

SEQ ID NO: 16533 - DNA, 1484 bp, Panicum virgatum
  misc_feature: Ceres CLONE 1789424
  misc_feature: Encodes the peptide sequence at SEQ ID NO. 16534
accaacgaacagcagcttcttcctcctcgcgccgccctcctccctccccaatccgctcgttcccggaggggaggacgcccgtcgggtcccgggatcgatccgttccctcggcgaggcgcgccaccacgctccggtgtcttcttttcttccgccgcaagtcaacgagccccgttctgcaaggatacagttcgtcccggattcggtgtcttcacgccacggcggggcgttggttgctagtccgatccgtacgcccgtccgcgtccctggttccgccgattgaaataggaattcgtctctccttcgtccccggcggcgcaaggtcgatcgattgagttgttcctctctggtgcgtggcgcggcgcggcgagtttcgcagtttgccggagggaattgtgcttgggttgttgcttgcagcgggggaggatggagtccgggaggaagcctcggagcctgctggacatgtgcgtccagaagctcatcgacaacctccgccacctgggcagcgtcgacggcatcgagatggagctgctcaagcgcatcctgccgcactgcacgctggagcagctcacccgcatcgagaaccgcaccgagatggatcttagcccggtaaccgattcgctgtggaagcgattctatcagcgggaatttggcaaggagcataccaacatggtcatcaagaggatgaaagagagtggagggagagcgcgttacacatggagggagctcttcaaggcaaaaacagagaagcaaaaggaagttgaagataagatgcttgagaaaatcgcaaagaagtttcaggcagagaaagctgagaaacagagcaagcaaattaaactttgtacaaaggtgcctccaagcagcaaaagaagtttctttggagggagtggaccaagcagtctatccaattccaattacaagagccctatactgaaaaaagccaggatagaggttaacagccatgcaagattgcaatgtgccatccaaaagaatacttttcggaggccatctcagccaataaggacaaactctttgagtggacagacagtgcgaacaacaaccattcatagacccaattcaaccatcaccatcaccaagccgattggttcgaacaggcaaattcagaacagcagacctaaattctagagaggttttgctgcaaatagcgtgttcaactacagagctcgtgtggcttctgcagaaacaatctcctttctacgagctgtgctacttgccatttcatgaagctcctgtgcccaaagaaaggtgtcttaagtttttgcccagctgagcacttgcagttgtatcttgcagccatttgacgaaagagaaatgcaccaactgtaacatataagggcattatcaatacttgtaagtcattttcttattaaagaaaaacatgtttcttggtgtctctgtttagcagagactggttcatgaatttacagagaatgtgtaaagttgatcacgagagaggccctcacatc

SEQ ID NO: 16534 - protein, 239 aa, Panicum virgatum
  misc_feature: Ceres CLONE 1789424
  misc_feature (9)..(142): Pfam Name: Elongin_A Pfam Description: RNA polymerase II transcription factor SIII (Elongin) subunit A
MESGRKPRSLLDMCVQKLIDNLRHLGSVDGIEMELLKRILPHCTLEQLTRIENRTEMDLSPVTDSLWKRFYQREFGKEHTNMVIKRMKESGGRARYTWRELFKAKTEKQKEVEDKMLEKIAKKFQAEKAEKQSKQIKLCTKVPPSSKRSFFGGSGPSSLSNSNYKSPILKKARIEVNSHARLQCAIQKNTFRRPSQPIRTNSLSGQTVRTTTIHRPNSTITITKPIGSNRQIQNSRPKF

SEQ ID NO: 16535 - DNA, 445 bp, Panicum virgatum
  misc_feature: Ceres CLONE 1789432
  misc_feature: Encodes the peptide sequence at SEQ ID NO. 16536
agttactaacaacacatcacctaaaagcatgggattctattcttcgtcgcgagtccctgcctctttggtgtcggcgctactgctttccttctgcgtgctgttattgggtatctatggaggatctcaaaggctatatatagcgcacctcatgcaatgttaaaaatgaacaccccaaccatatcatcgcttctctccatgatcttctaatagatgttctcggaaacaaagaagattctgtggcctccatggttcacaactacaagcatggattctcacgctttgcaccaatgctcactgaagggcaagcaaaacaatcggcacacactccagaaattatcattgtccaaccaaacagaatctacaaggtgacaaccacccgaagctgggacttcctcggtctgggctcccaaatgcccggctatctgctccgtgaaggcagacatga

SEQ ID NO: 16536 - protein, 66 aa, Panicum virgatum
  misc_feature: Ceres CLONE 1789432
  misc_feature: SWISSPROT Homolog: EC 3.4.21.25 Cucumisin
MVHNYKHGFSRFAPMLTEGQAKQSAHTPEIIIVQPNRIYKVTTTRSWDFLGLGSQMPGYLLREGRH

SEQ ID NO: 16537 - DNA, 544 bp, Panicum virgatum
  misc_feature: Ceres CLONE 1789432-R
gctgtgtcgttccaagtgctgggccacatgaagactgtgcttgttctgtcccttgggtttgtcttctttggcaaggagggcctgaatcttcaggtagtcctcgggatggtcctcgctgttctcggaatgatctggtacggtaacgcgtcggctaaaccaggaggcaaagaaaggcgcagcatcctaccagtgagatctgggagtctcaagggaagttcagaagaaacggatggtgctgagaaatagtctttgctactaccagactccaaatgatggtacagggaaattttctgtgagattaaatttctggtgatgcgtgtatcacaaaaatagaaactctggctttacatagtatgtttactgcacaaggtaaactacccttcctgtctagaaacttgggattgttatagttacaggtatacagtagtgacactttaatttctgtctgtggatcattggtacggtagccaggcgaatgtcacatgtattacgaggcttgcttgaagacagtttaacccaatatagtcttttttatcttttttgg

SEQ ID NO: 16538 - DNA, 1655 bp, Panicum virgatum
  misc_feature: Ceres CLONE 1789433
  misc_feature: Encodes the peptide sequence at SEQ ID NO. 16539
gcttggcattccacccctcgcccgatctcccgctctctccccggcgatggcgccgccggcggaaggggccacggcggggcggaagtctccggccaccgtgctcctcctctacgtagcctgcgctttcatcctgctgcttctcctcgccttctactccccccgcctccagccccacgcccacggccgcagcctccatcgccgcctcaagctccaccccaagagcttcccatcatccggcgccgcctccgttgggggagaggggaaacaccaccagcagcaccatcacgcggcttccttcgacccggccattgccgagctggagcgccggctggacgacaaggagtgggagcgcgagcactaccgcctcctccacggcgaccaagacggcggcgagccggacgaccacatgaaggaatgggaggaattcctcaaggaggaggaggatttcatcaacgacgacgaccgcttcaacctcgctgaccgcatcagcgcgctcttccccaagatcgacgtcgctccgacggacggcttcgtatccctcgacgagctcaccgcgtggaacctcgagcagtccagagccgcccagcaccaccgttcctccagggagatggagctctacgacaagagcggcagcgggatcgtctccttcgggaccttcaatgcgctgcgccaggagccccatggagagagtaatatgctggggttcccgtggtggaaggaggagcacttcaatgcttcagatacaaacggtgatggtttccttgataaatttgagtttaatgatttccttaatccaagtgattcggataatcctaaaatcatcaatttgctcagcagacaagaaataaggcagagggacaaagatggtgatggaaagctaaattttgatgaatactttaatgggctacatgaccatatacatggttatgatgatgagcatgcagatatttcccatattgggaacatgacaattgcaaaggatcggttctccaaacttgataaagataatgatgggtttatttcagagcatgaactaaaacctgttcttgataagctctatctttctgaacgctattatgctagacagcaagccattcatgctatttcagaggcagacaaggatcatgacggaaggctaactttgggtgagatgattgagaacccgtatgtattttacggcagtgtgtaccttagcgatgacgaagactatttccatgacgaattccgctgaggcatctgcagcttgacgtgcaccatgactaaagttgatcatcctgagcagattgttggtgcccttaccacgcaagcgacacgcaacagatcagcatgaaggtgcccacggttggttcaaaatgtctagcctactaaccgcaccccgggacgcagctgaaagaatggagaactgagttacttcaagttgctatatataatttaacacacctagcattagtcatcacttggttatttctttcaagttgtttgtgtacatcacaagttgctcatttcctttattatctagctaggccgagctagcaccgtctccatcctgtaaaatgcgtgtagtccaggagaagaatgagttgaacgtcatctcggtgactgaacggattcatatgcaaatcaaaggtctaacacggatcatgttgtttggtgtg

SEQ ID NO: 16539 - protein, 394 aa, Panicum virgatum
  misc_feature: Ceres CLONE 1789433
  misc_feature (309)..(337): Pfam Name: efhand Pfam Description: EF hand
MAPPAEGATAGRKSPATVLLLYVACAFILLLLLAFYSPRLQPHAHGRSLHRRLKLHPKSFPSSGAASVGGEGKHHQQHHHAASFDPAIAELERRLDDKEWEREHYRLLHGDQDGGEPDDHMKEWEEFLKEEEDFINDDDRFNLADRISALFPKIDVAPTDGFVSLDELTAWNLEQSRAAQHHRSSREMELYDKSGSGIVSFGTFNALRQEPHGESNMLGFPWWKEEHFNASDTNGDGFLDKFEFNDFLNPSDSDNPKIINLLSRQEIRQRDKDGDGKLNFDEYFNGLHDHIHGYDDEHADISHIGNMTIAKDRFSKLDKDNDGFISEHELKPVLDKLYLSERYYARQQAIHAISEADKDHDGRLTLGEMIENPYVFYGSVYLSDDEDYFHDEFR

SEQ ID NO: 16540 - DNA, 1819 bp, Panicum virgatum
  misc_feature: Ceres CLONE 1789441
  misc_feature: Encodes the peptide sequence at SEQ ID NO. 16541
ctccctctcccgactccccccatcttggccttcctttcctggcggcggcgactgggcaagctgcggcgcccttcgcacgtcttcaccgggcccttcgccggcgactagcatccaccagtgcaggaggatggcggagccgtccaaggtaatccacatccgcaacgttgggcatgagattgctgagtctgatctactccagctgttgcagccgttcgggctggtctccaagattgtcatgctgcgagccaagaatcaggctcttctgcagatggaagacatacatgcctctgtgagcgcgctgcaatattacagttctgttcaacctagtgtaaggggaaggaatatatacatgcaattctcatcccaccaagaacttaccacagaccagagctctcatggaaggaattctgatcaggactctgaacccaaccgaatcctcttagttactatccaccacatgatctatcctataacggtggaggttctacatcaagtattcaaagcttatggatttgtggagaagatagtcacatttcaaaagtcagctggttttcaagctcttattcagtataactcgcgccaagaagctgtggaagcatttggttctttgcatggaagaaacatatatgatggttgctgccagctagacattcaatattcaaacctcagtgaactgcaagtccactacaacaatgaccggtctagggattttacaaatccatcattgcctacagaacaacgtcctaggacctctcagcagcaaggttatcctgatccagctggtctctatgccttccaacaacctggagcttcgtatgcacagatgggaagagcagcaatgattgcggctgcgtttggtggaacattacctcatggagtgactggtaccaatgaacggtgcacactcatagttagtaatttgaacactgataaaattgatgaggataagcttttcaatctgttttctttgtacggaaacatagtacgaatcaagatattgcgtaataaaccagatcacgccttagctgagatggttgatggtttgcaggctgagctagctgtgcattatctaaagggcgcaattctatttggcaagaaactggaagttaactactcaaagtaccccaacatcacgcctgcccctgacgcacatgactacttaaactcaagccttaaccggttcaacagcaacgtagtcaagaactacagacattgctgtgctccaacaaagatgatccacatttctgccctcccccaagagatctccgaggaagcaatcctcaaccatgtgtctgagcacggttctgtcatcaacacaaagcttttcgaggtgaacggcaagaggcaggctctcgtcatgtttgagacggaagaggaggcaacagaggccctcgtgtcgaaacacgccagctcactggaggggaacacgatccggatctctttctcccagatgcagagtatataagccgctcctccagggaaaggtctttagccgctctcttggcctctgtgagctttgtttaggaatgcatttgaaactaagatgtgaatcctatgcgctgttctcccagactgatgctctgtctgagttgtactaccctgacatttggtttcttcttcgtttctcgtgatactggccttgcaccaaagggtttctcttctgtttcttccctgttctgtcgtttaggttatcaaaggattttaccccctcatgtcatgctattctgagttgaaaggcctgcttattgtgtgtggatcatctcttatcctttgcctcctggctgcatgaaaagaaaccctacctgtgatggcattttac

SEQ ID NO: 16541 - protein, 445 aa, Panicum virgatum
  misc_feature: Ceres CLONE 1789441
  misc_feature (370)..(437): Pfam Name: RRM_1 Pfam Description: RNA recognition motif. (a.k.a. RRM, RBD, or RNP domain)
  misc_feature (260)..(327): Pfam Name: RRM_1 Pfam Description: RNA recognition motif. (a.k.a. RRM, RBD, or RNP domain)
MAEPSKVIHIRNVGHEIAESDLLQLLQPFGLVSKIVMLRAKNQALLQMEDIHASVSALQYYSSVQPSVRGRNIYMQFSSHQELTTDQSSHGRNSDQDSEPNRILLVTIHHMIYPITVEVLHQVFKAYGFVEKIVTFQKSAGFQALIQYNSRQEAVEAFGSLHGRNIYDGCCQLDIQYSNLSELQVHYNNDRSRDFTNPSLPTEQRPRTSQQQGYPDPAGLYAFQQPGASYAQMGRAAMIAAAFGGTLPHGVTGTNERCTLIVSNLNTDKIDEDKLFNLFSLYGNIVRIKILRNKPDHALAEMVDGLQAELAVHYLKGAILFGKKLEVNYSKYPNITPAPDAHDYLNSSLNRFNSNVVKNYRHCCAPTKMIHISALPQEISEEAILNHVSEHGSVINTKLFEVNGKRQALVMFETEEEATEALVSKHASSLEGNTIRISFSQMQSI

SEQ ID NO: 16542 - DNA, 685 bp, Panicum virgatum
  misc_feature: Ceres CLONE 1789451
  misc_feature: Encodes the peptide sequence at SEQ ID NO. 16543
aatcctcctcccccgatccagccccgcagcgacgccgaggcagagcgagcgagaggagagaccgagatcgcgcgcggagatgtcgtcggactcgtcgtcgtgggcgcgcgccatggtgcagatctcgccctacaccttctccgccatcggcatcgccgtctccatcggcgtctccgtcctcggcgcggcatggggcatcttcatcacggggagcagcctcatcggggccgccatcaaggcgcccaggatcacatctaagaacctcatcagtgtcatcttctgtgaggctgtcgcaatttatggtgtaattgtggcaatcatcctccagacaaaacttgaaagtgtgccatcatctcaaataaggccaaaggccaagccacctccccccgttgcttcagttcctccgttgcgttccatttccttcaccccatatctaatcctggaccgacctgcaagaagcagcgagaggagaggaggaggagacgtagatatatagatagatagccagggagactcgtcggagctcctccgggaaaggaatttctccgtgggagaaggggtcagatctttgagacgaccagcaggaggaggagaggatgccttccagagcgatgaaccggctgctcttcgagtcctcgtcctcgtccggcggcggcggcggctgcaggaaggccgagccggccgc

SEQ ID NO: 16543 - protein, 138 aa, Panicum virgatum
  misc_feature: Ceres CLONE 1789451
  misc_feature (20)..(85): Pfam Name: ATP-synt_C Pfam Description: ATP synthase subunit C
  misc_feature: SWISSPROT Homolog: EC 3.6.3.14 H(+)-transporting two-sector ATPase
MSSDSSSWARAMVQISPYTFSAIGIAVSIGVSVLGAAWGIFITGSSLIGAAIKAPRITSKNLISVIFCEAVAIYGVIVAIILQTKLESVPSSQIRPKAKPPPPVASVPPLRSISFTPYLILDRPARSSERRGGGDVDI

SEQ ID NO: 16544 - DNA, 1957 bp, Panicum virgatum
  misc_feature: Ceres CLONE 1789460
  misc_feature: Encodes the peptide sequence at SEQ ID NO. 16545
gcaaacaaaccccaccccacccgccccggccgcggccactccacacaacgcaggacgcacgggcacggcacgctgttgcagcccaaggacgacgctgccctccggagagcagagcggggagccgacatgccggcggcgggcggcgtgttctccgggtcggtgaaccttaagtacgtgaagctggggtaccagtacctggtgaaccacttcctgacgctgctgctggtgccggtgatggcgaccaccgcgctggagctggcgcgcctcggccccggcgagctgctctcgctctggcgctcgctggagctcgacctcgtccacatcctctgctccgccttcctcgtcgtcttcgtcggcaccgtctacgtcatgtcgcggcccaggcccgtgtacctggtggactacgcctgctacaagccccccgccagctgccgggtgcccttcgccaccttcatggagcacacgcgcctcatcagcgacgacgacaagagcgtgcgcttccagaccaggatcctcgagcgctcggggctcggcgaggacacgtgcctcccgcccgccaaccactacatcccgcccaaccccagcatggaggcctcgcgcgccgaggcgcagctcgtcatcttctccgccatcgacgacctcgtccgccgcaccggcctcaagcccaaggacatcgacatcctcgtcgtcaactgcagcctcttctccccgacgccgtcgctctccgccatgatcatcaacaagtacaagctccgaagcaacatccgcagcttcaacctctcgggcatgggatgcagcgccggcctcatctccatcgatctcgcccgggacatgctgcaggtgcaccccaactcgaacgcgctggtggtgtccacggagatcatcacgcccaacttctaccagggctcccggcgcgacatgctgctgcccaactgcctcttccggatgggcgcggcggcgatcctgctctccaaccggcggcgcgaggcccaccgcgccaagtaccggctggtgcacgtggtgcggacgcacaagggcgccgacgaccgcgcctaccggtgcgtgtaccaggaggaggacgagcaggggttctcgggcatctcgctctccaaggagctcatggccatcgccggcgacgcgctcaagtccaacatcacgacgatcggcccgctggtgctgcccatgtcggagcagctgctcttcttcttccggctggtggggcgcaagctcgtcaacaagagctggcggccctacatcccggacttcaagctggcgttcgagcacttctgcatccacgccggcggccgcgcggtgatcgacgagctgcagaagaacctgcagctgtcggcgcggcacgtggaggcgtcccgcatgacgctgcaccgcttcggcaacacgtccagcagctcgctctggtacgagctcgcctacatcgaggccaagggccgcatgcgccgcggcgaccgcgtctggcagatcggcttcggcagcggcttcaagtgcaacagcgccgtctggaagtgcctccgcaccatcaagacgcccaccaacgggccctgggacgactgcatccaccgctaccccgtcgacattccggaggtcgtcaagctgtaactgtacgtcccgcgaagcatcggagctttgtgctcttttttcttctttcttctttcttctcctcttcctttttcttttccgggtctattaaaagggggtaaaaatccatactttggtcgctggacgtgtcacaccatacgtacaaggaatgacgatcatcacaggagattaattaaaactagttgttgttggaaaaattggatgttaacgtgggcgtgctgtcgaaactggcctatgccagggattgggtggtgttttggaacttggatgggaaggaaagggagcacttgtaaattgtaatccatgttgtaactggtgaaagggatacctgcattctcctgat

SEQ ID NO: 16545 - protein, 495 aa, Panicum virgatum
  misc_feature: Ceres CLONE 1789460
  misc_feature (80)..(368): Pfam Name: FAE1_CUT1_RppA Pfam Description: FAE1/Type III polyketide synthase-like protein
  misc_feature (382)..(466): Pfam Name: ACP_syn_III_C Pfam Description: 3-Oxoacyl-[acyl-carrier-protein (ACP)] synthase III C terminal
  misc_feature: SWISSPROT Homolog: EC 2.3.1.119 Icosanoyl-CoA synthase
  misc_feature: The sequence is a functional homolog of SEQ ID NO 2 in US patent 7038112
MPAAGGVFSGSVNLKYVKLGYQYLVNHFLTLLLVPVMATTALELARLGPGELLSLWRSLELDLVHILCSAFLVVFVGTVYVMSRPRPVYLVDYACYKPPASCRVPFATFMEHTRLISDDDKSVRFQTRILERSGLGEDTCLPPANHYIPPNPSMEASRAEAQLVIFSAIDDLVRRTGLKPKDIDILVVNCSLFSPTPSLSAMIINKYKLRSNIRSFNLSGMGCSAGLISIDLARDMLQVHPNSNALVVSTEIITPNFYQGSRRDMLLPNCLFRMGAAAILLSNRRREAHRAKYRLVHVVRTHKGADDRAYRCVYQEEDEQGFSGISLSKELMAIAGDALKSNITTIGPLVLPMSEQLLFFFRLVGRKLVNKSWRPYIPDFKLAFEHFCIHAGGRAVIDELQKNLQLSARHVEASRMTLHRFGNTSSSSLWYELAYIEAKGRMRRGDRVWQIGFGSGFKCNSAVWKCLRTIKTPTNGPWDDCIHRYPVDIPEVVKL

SEQ ID NO: 16546 - DNA, 515 bp, Panicum virgatum
  misc_feature: Ceres CLONE 1789469
  misc_feature: Encodes the peptide sequence at SEQ ID NO. 16547
gcacagccgacacccaccgacgccagcctattgctttcaaccgcccgccatggcgcccgacgcgtcctccccgacgccggacgttgccgtggtagcgttccctttcacctcccacgcggcggtgctgctcgccttcccgcgcgcgctggccgccgcggcggcgcctgtggggggaacgctctcgtgcctctccaccgcgggctccatcgcgcagctccgccgggcgggcggcgccgagctcccgggaaacctgcgcttcgtggaggtcccggagggcgccgggccgccggcgccgaagggcgccatgccggtgccggtgccggtgccgatgcgccggccgatggagctgatcatggccgccgcggaagccggaggagtgaaggccgggctgcaggcggcccgcgccgcgtgaggaggcgctcttgtgagctgtgtgtttcgggagacgttcgtgcggcccgctgcggatgcagctgccgcggcgagagagccgcgactgccagcgcgaatcgacg

SEQ ID NO: 16547 - protein, 120 aa, Panicum virgatum
  misc_feature: Ceres CLONE 1789469
  misc_feature: SWISSPROT Homolog: EC 2.4.1.115 Anthocyanidin 3-O-glucosyltransferase
  misc_feature: Useful for making plants with altered carbohydrate content
  misc_feature: Useful for making plants with modulated flowering time
MAPDASSPTPDVAVVAFPFTSHAAVLLAFPRALAAAAAPVGGTLSCLSTAGSIAQLRRAGGAELPGNLRFVEVPEGAGPPAPKGAMPVPVPVPMRRPMELIMAAAEAGGVKAGLQAARAA

SEQ ID NO: 16548 - DNA, 730 bp, Panicum virgatum
  misc_feature: Ceres CLONE 1789471
  misc_feature: Encodes the peptide sequence at SEQ ID NO. 16549
accagtctccccagcccatcaacgactagacgctgctggtcaggaagcaccaaccctagcccccttcccctccccttcccctcctctcccttcgcgagcggcggcgaggaagccatggattcctccagcggcggcggcggtggcgcgcagatcagggggatggcgacgcacggcgggcggtacgtgctgtacaacgtgtacgggaacctcttcgaggtctcctccaagtacgcgccgcccatccgccccatcggccgcggcgcctacggcattgtctgtgcggctatgaactcggagacaaacgaggaggttgcgatcaagaaggttggcaatgccttcgacaaccacatcgacgccaagcggacgctgagggaaatcaagctgctccgccacatggaccacgagaacatccttgccttaaaggatgtaatacgcccaccaagtaaagagaactttaatgatgtctacattgttactgagttaatggataccgatctccatcagatcatacggtcaaatcagacattgactgatgatcattgccagtacttcttgtatcagttgctacgagggctaaaatatgtgcactcagcaaatatattgcaccgtgatctgaagccaagcaatttgttcctaaatgcaaattgtgacctcaagatcgcagactttgggcttgcaagaaccacttcggagacagatctcatgacagagtatgtggtcactcgttggt

SEQ ID NO: 16549 - protein, 205 aa, Panicum virgatum
  misc_feature: Ceres CLONE 1789471
  misc_feature (40)..(205): Pfam Name: Pkinase Pfam Description: Protein kinase domain
  misc_feature: SWISSPROT Homolog: EC 2.7.11.24 Mitogen-activated protein kinase
  misc_feature: Useful for making plants with altered cell wall content and/or composition
MDSSSGGGGGAQIRGMATHGGRYVLYNVYGNLFEVSSKYAPPIRPIGRGAYGIVCAAMNSETNEEVAIKKVGNAFDNHIDAKRTLREIKLLRHMDHENILALKDVIRPPSKENFNDVYIVTELMDTDLHQIIRSNQTLTDDHCQYFLYQLLRGLKYVHSANILHRDLKPSNLFLNANCDLKIADFGLARTTSETDLMTEYVVTRW

SEQ ID NO: 16550 - DNA, 611 bp, Panicum virgatum
  misc_feature: Ceres CLONE 1789471-R
  misc_feature: Encodes the peptide sequence at SEQ ID NO. 16551
ttcttcgaagtgataacgcaaagagatacatgaaacaactaccacagtttccaaggcaggacttccgcttgcgtttccgcaacatgtctgctggtgcagttgatttgttggagagaatgctcgtgttcgatccaagcagacggatcacagttgatgaggctctgcatcacccatacttggcttctcttcatgacatcaatgaagaacctacctgccctgcacctttcagctttgattttgagcaaccatcatttacagaagcacatataaaagaactcatctggagggaatctttggccttcaacccggatcctccctactaagagcaaagtgcaggatacgttatctgctgaaggcatctgaagatctctagctccagcggatgctaaaacttatgtctgtgtgcatagattattttcacgctggggttgctgctgcaatagcaattcttgtgagaacaaacgatgtttgtttgtattccctttcagatgcctgaacccaaggcttgtattataccggttaatttcacaaactattcttatgtatctaagattgtaattttgtagacgattacttgaacgacctcctgtatatctaatatctgagttgac

SEQ ID NO: 16551 - protein, 106 aa, Panicum virgatum
  misc_feature: Ceres CLONE 1789471-R
  misc_feature: SWISSPROT Homolog: EC 2.7.11.24 Mitogen-activated protein kinase
LRSDNAKRYMKQLPQFPRQDFRLRFRNMSAGAVDLLERMLVFDPSRRITVDEALHHPYLASLHDINEEPTCPAPFSFDFEQPSFTEAHIKELIWRESLAFNPDPPY

SEQ ID NO: 16552 - DNA, 700 bp, Panicum virgatum
  misc_feature: Ceres CLONE 1789475
  misc_feature: Encodes the peptide sequence at SEQ ID NO. 16553
agatcggcaggagattttaccagcttgtcgccagccgggcggggtgatcgcgcgggcagggaaccatgggaaagaagcacgccgcaggtagcggcggctggttcgccgtcgtcaggaaggtgttccggccgtcgtcatcgtcctccgccaccacctccaaggacaaggacaccgtgcaacacgggaaacagcaggacagcgccggcgaggaggcggaggaggccgcggccggcggggccgaggaggcggaggaggtgctgctgctggagcacttcccggcgtccgagacgtccgcggaggcgagcaacgagggcggcgacgcggagtcgttgctggcggcgccaccgccggtgcggacggcggagcaccggggggcgggcagtggtggtctccgggaccacgaggaggccgacgacgacgacatggagcgcgcacgggcgctagccgccgcagccgaggccgccgtggccgcggcggccagggtggtccggttggcggcgctccggcgcctgtcgcgggaggagcgcgccgccgtgcgcatccaggcctactaccgcgggtacctggcccggcgagccctgcgcgcgctgcgcggcctggtgcggctgcaggcgctggtgcgcggccgccaggtgcggcgccaagtgcacctcaccatgcgctgcatgcaggccctcgtccgcgcccaggcccgcgtccg

SEQ ID NO: 16553 - protein, 211 aa, Panicum virgatum
  misc_feature: Ceres CLONE 1789475
  misc_feature (153)..(173): Pfam Name: IQ Pfam Description: IQ calmodulin-binding motif
MGKKHAAGSGGWFAVVRKVFRPSSSSSATTSKDKDTVQHGKQQDSAGEEAEEAAAGGAEEAEEVLLLEHFPASETSAEASNEGGDAESLLAAPPPVRTAEHRGAGSGGLRDHEEADDDDMERARALAAAAEAAVAAAARVVRLAALRRLSREERAAVRIQAYYRGYLARRALRALRGLVRLQALVRGRQVRRQVHLTMRCMQALVRAQARV

SEQ ID NO: 16554 - DNA, 683 bp, Panicum virgatum
  misc_feature: Ceres CLONE 1789475-R
ggccgccacgcagccgcagcagatgccggacgcgccggaccacgtcaagacgacgtaccagggcgccgccgccaggacggcgtcttacgcggcggcggccgctgctctccccgttggcgtgccggagaagacggtggagatggacatgtcgttccggagtccgctgaaccaggccgccacgcccgccgcgcacgggcggccgccggcgatcccaggctacatggccgcgacgagatcggcgcgcgccaaggcgcgccccgcgccgccgacgccgacgcacggcaggagaccttccggcgacgggatcgccggagactcgtctagctcggagcagagcgcggggcagaacggcggcgcaatcgccgggtacagcccggactggagctgcacgggggactggacgccgccgcggctcggcgtcaacacgcgcaccagcagggtggcctatacctgagcatggcagtgacaaagtccggtgcatcatcatgagcgcggttgagatgtgttcgcggctcatttttgaacgcttttgttgttcacaatgtgtatagcttgctatgtttgcggccaatgcctctgtaaacgcccgtatacttggccaaaggattgcgaacaaaaactcaagaattataaatcttttgttatgcctgaactgagatcgaagattttatttatctgttcgg

SEQ ID NO: 16555 - DNA, 1390 bp, Panicum virgatum
  misc_feature: Ceres CLONE 1789479
  misc_feature: Encodes the peptide sequence at SEQ ID NO. 16556
aagcagaacggcctcgtcccgacgacccatattatctctgtcggagtctctgggagcgtttgatccgcttgcgaggacgcggcggcgtgcatggcgacggcggcggccgtcggcacggtggtgctggtggacgcggcgctggccccgtacgagcaccctgacctccggtggctcgtccggaagcacgtcctcgccgtcctccaggagttccccaccctctcgccctccgtcgacacctacaccagcgacgacggcgcctccaccgtgctgctcaacgcgcggggcctcctcgccgtctcccccgccctgccgccggtcctcctcaccctgtggctccccagggagtacccctaccgcccgccgctcgtctacgcgctccccgccgcgccgtcggcgtcgctcgtccccgaccaccccttcgtcgaccaccgcaccggccgcgtccaccgcacgctgccgtacctcgacgaatggagcgtgccgacctccagcctcgccggcctcgtgcggagcctcgtcgcggccttgaggatgtgccacccgctgaagtccaccttcggcttcgccgacgcgacgaccgccggagcgacgccggtggaggaggagcggcggcgcatgcacgccgtgctggccaacgagctcgcctcgaggctgggcagggacgcagcggccttccgcggcggcgtcgccggggacatccatgccctgtcctcgctgcaggccggcctccgggcacgcggcgactccatgggccgcgccgtccgcgacctggaagaggagaggatgcggctggagcgcgccgtgacggccagcctcgcccaccgcggccagctgctcgcctggctgtgcacggcgagccgcgcgcccgatccgggagcggcgctggctccgcacgcggccgcgggcgacgcgccgcggtggctggagagcaaggcgtcggagctcgccgcggacgacgccatggacgcccttggccacgcgctggagaacggggacctcagcttccaggagtacatcaagcgcgtcaaggtcctcgccagggagcagttcttccattgctacgcagcgtccacgtcgatgaacgcctaattaataatcgattgcactagttaacatctttatttattcgtttatttggcacagtgtagtgtccaatcaacaggtatggtttcacttgtgttcagaaattgcaattttccttgggaaattagtctacaactgatgaactcttcgttcgatctgataagggaaaattgaaaactgaactctgaaattgtcaaacccgactgttgaattcagcagtgccgtgtcaaccactagctgatgtccgatttcaattgtcataacggaaaggtgattagtaccacagattttttcttgtggtgactag

SEQ ID NO: 16556 - protein, 332 aa, Panicum virgatum
  misc_feature: Ceres CLONE 1789479
  misc_feature (29)..(152): Pfam Name: UEV Pfam Description: UEV domain
MATAAAVGTVVLVDAALAPYEHPDLRWLVRKHVLAVLQEFPTLSPSVDTYTSDDGASTVLLNARGLLAVSPALPPVLLTLWLPREYPYRPPLVYALPAAPSASLVPDHPFVDHRTGRVHRTLPYLDEWSVPTSSLAGLVRSLVAALRMCHPLKSTFGFADATTAGATPVEEERRRMHAVLANELASRLGRDAAAFRGGVAGDIHALSSLQAGLRARGDSMGRAVRDLEEERMRLERAVTASLAHRGQLLAWLCTASRAPDPGAALAPHAAAGDAPRWLESKASELAADDAMDALGHALENGDLSFQEYIKRVKVLAREQFFHCYAASTSMNA

SEQ ID NO: 16557 - DNA, 670 bp, Panicum virgatum
  misc_feature: Ceres CLONE 1789491
  misc_feature: Encodes the peptide sequence at SEQ ID NO. 16558
atccctccgcaccctcttatctgctccgcctccgcgctcccgctcctcccccacctccaccaccatggccacggccgcggcggcctccgcctcctcctcgctcctcgcgccggctgccagcacggcgccggccgcgcccaacgcgctgctgttcccctcctccgtgccgacgctgcgcgcctacccgcggctgctcctctcgttccgccgccccgcggccgccgccgtcgccgacccgcagggggccgtgctcgaggaggaggaggccgaggccgaccagcgcggccggtacgacgacgaggatgaggacgacgggtacgagggcggccgcggctccgcgttcacgccccccacgcgcccgcgcaccggcaaggccgccctgccgctcaagcgcgaccgcacgcggtcgaaaaggttcctcgagatacagaagctcagggagagcaagaaggagtacgacgtgcccaccgccatctcgctgatgaagcagatggccagcgcgaaatttaaagagtcggccgaggcgcacttccgcatgaacctcgaccccaagtacaacgatcagcagctccgcgccacggtgaatttgcccaagggaacaggccagtcggtgaagattgcagtcctcacacaaggtgagaagatagatgaagctagagctgcaggagct

SEQ ID NO: 16558 - protein, 201 aa, Panicum virgatum
  misc_feature: Ceres CLONE 1789491
  misc_feature (126)..(201): Pfam Name: Ribosomal_L1 Pfam Description: Ribosomal protein L1p/L10e family
MATAAAASASSSLLAPAASTAPAAPNALLFPSSVPTLRAYPRLLLSFRRPAAAAVADPQGAVLEEEEAEADQRGRYDDEDEDDGYEGGRGSAFTPPTRPRTGKAALPLKRDRTRSKRFLEIQKLRESKKEYDVPTAISLMKQMASAKFKESAEAHFRMNLDPKYNDQQLRATVNLPKGTGQSVKIAVLTQGEKIDEARAAG

SEQ ID NO: 16559 - DNA, 1487 bp, Panicum virgatum
  misc_feature: Ceres CLONE 1789518
  misc_feature: Encodes the peptide sequence at SEQ ID NO. 16560
agaagaatcagatgcgccactacccacccggccaccacaaaggcagcaacccaaccaaacagagcatagcagagccagaaactcgagtcagcaagttgcaagctctttagcctccctcctccagcttgatttgatacactctcgatcttggttctagctgcatggcttccttgctgcggtggaaggataagtacgtgaaggagaagctgcagggcctctcctgctcatcctcggcctccacctccattgtcgtcgcctccggccgcgccatcgaccgccactccccgcgcctccgggaccctcaccggcgcctcccgccgtcggtgcccaggccaccaggctctccttattacgttagtcctgccggtaacaccaaagattcctcctcctcctcctccctgaagcagcagaagcagcttcaccaccaccatgacgacggcaaagacaaaaggaagaagaagagcgcagaaggagcggccgctgctggcggcggctcctccacgccgtcggagcgcaagaagaacaagaagaagcaggcggtggcccagctgcagctggtgagccccgcgagctcctccaggttcctgctcaactcgtccaggctgatgctgcagtccgacgacgacatcactgtcgtcgactccctgccgccgctcccgtcgtccccgcggcgcctcttgttcatcgacgacgacgacatcactgccgctggccctgacgactccttgccgcctctcccatccccgcggccggcgttcatcgatgaggacaagttgcccggccgcggcgatggcacgtcgtcgcggccttttgttccggcatggccgcagcttgaggcgccgcccgtggaattattcgcagagccatccgcgggtgcgtcatcctcctcgtcttccttgtcgtcgtcagagacaggacgccgtgccgccgccggcgacaagactgccatgacgagatcttgctcgacgagaactggccagcaccaggtggtggttctgagggtatctctgcactgcaaggggtgcgctggcaaggtgaagaagcacatctccaagatggaaggcgttagttctttcgacatcgatatcgcgacgaagaaggtgacggtggtgggagacgtgacgccgctgggcgtgctcaacagcatcaacaaggtcaagagcgcccagttctggccagaccagtctttgtcctcgctgtccacgccgccgcgagcctccgcctcctgagctatacatactcccccctcccccttcagaaagaaacaaagctatacatagtccccacacaggatgacaacttgatgggtgggacgaggacacggtcttttggattgttgtccataaattgtaaattggaagtatttgtaaaatccaatcaaattatgatatgtagtatgataaatgcattttggaacaagtcagcgtgatgtaacttttttgtttgcaatcctacgtatctagaagagaaaattcataagagatttt

SEQ ID NO: 16560 - protein, 355 aa, Panicum virgatum
  misc_feature: Ceres CLONE 1789518
  misc_feature (278)..(337): Pfam Name: HMA Pfam Description: Heavy-metal-associated domain
MASLLRWKDKYVKEKLQGLSCSSSASTSIVVASGRAIDRHSPRLRDPHRRLPPSVPRPPGSPYYVSPAGNTKDSSSSSSLKQQKQLHHHHDDGKDKRKKKSAEGAAAAGGGSSTPSERKKNKKKQAVAQLQLVSPASSSRFLLNSSRLMLQSDDDITVVDSLPPLPSSPRRLLFIDDDDITAAGPDDSLPPLPSPRPAFIDEDKLPGRGDGTSSRPFVPAWPQLEAPPVELFAEPSAGASSSSSSLSSSETGRRAAAGDKTAMTRSCSTRTGQHQVVVLRVSLHCKGCAGKVKKHISKMEGVSSFDIDIATKKVTVVGDVTPLGVLNSINKVKSAQFWPDQSLSSLSTPPRASAS

SEQ ID NO: 16561 - DNA, 716 bp, Panicum virgatum
  misc_feature: Ceres CLONE 1789525
  misc_feature: Encodes the peptide sequence at SEQ ID NO. 16562
ctgcgccgccatagcataaatcctccgccctctctctctcttcctcggccggcctgctcctgcgatccgtgctgcagatcgccagatcagtcgacatggcgctcgtattgcattctggacctggtaacaagaatgccttcaaggcacttattgctgcagaatacagtggggttaagattgagttgacaaagaattttgagatgggtgtcaccaacaagacccctgagtttcttaagatgaacccccttgggaaggtgcctgttctggagactcctgaaggtgctgtttttgagagcaatgctattgcacgctatgttgctcgcttgaatgatggcaaccctctttttgggtcttctcgtattgaacaagcccatgttgagcagtggatggactttgctgcaacagaagttgatcctggtgttgcatggtacttgtacccaaggcttggttacattccttattctcagacgacagaggaaacagctattgcctcattgaagagagcgcttggttctctgaacacccaccttgcctcaaagacattccttgtagggcattctgtcactctagctgacattgtattgacatgcaacctctaccatggatttgcacggatcttgaccaagagcttcacatccgagttccctcatgtcgagaggtatttctggaccatggttagccagcctaacttcaagaaggtcatgggtgawtgtcag

SEQ ID NO: 16562 - protein, 206 aa, Panicum virgatum
  misc_feature: Ceres CLONE 1789525
  misc_feature (1)..(76): Pfam Name: GST_N Pfam Description: Glutathione S-transferase, N-terminal domain
  misc_feature (104)..(197): Pfam Name: GST_C Pfam Description: Glutathione S-transferase, C-terminal domain
  misc_feature: SWISSPROT Homolog: EC 2.5.1.18 Glutathione transferase
  misc_feature (205)..(205): Xaa is any aa, unknown, or other
MALVLHSGPGNKNAFKALIAAEYSGVKIELTKNFEMGVTNKTPEFLKMNPLGKVPVLETPEGAVFESNAIARYVARLNDGNPLFGSSRIEQAHVEQWMDFAATEVDPGVAWYLYPRLGYIPYSQTTEETAIASLKRALGSLNTHLASKTFLVGHSVTLADIVLTCNLYHGFARILTKSFTSEFPHVERYFWTMVSQPNFKKVMGXC

SEQ ID NO: 16563 - DNA, 678 bp, Panicum virgatum
  misc_feature: Ceres CLONE 1789525-R
  misc_feature: Encodes the peptide sequence at SEQ ID NO. 16564
aagccaaaggtggttgaggcaccggcagaagaggaggcaccaaagccgaagcctaagaatcctcttgacttgctgccaccaagcaagatgatccttgatgactggaagaggctatactcaaacacaaagaccaacttccgtgaggttgccatcaaaggtttctgggatatgtatgacccagagggctactctctgtggttctgtgactacaagtataatgatgagaacactgtctcctttgtgaccatgaacaaggttggtgggttcctgcagcggatggacctgtgccgcaagtacgcctttggcaagatgcttgtggttggctctgagcccccattcaagttgaaggggctctggctcttccgtggccaggaggtccccaagtttgtaatggatgaggtctatgacatggagctctacgagtggaccaaggtggacatatctgatgaggcccagagggagcgggtcagtgccatgatcaaggaccaggagcccttcgagggtgaggcccttcttgatgcgaaatgcttcaagtgaggttccacttccctggagattgaattgcttaggcttcggattggatgtctatggaagagtttgcttgttacctgtctatgtttacctgatacaccctcgtgaactggttgaagtttgtgcttagttgaaatttttttgact

SEQ ID NO: 16564 - protein, 178 aa, Panicum virgatum
  misc_feature: Ceres CLONE 1789525-R
  misc_feature (17)..(125): Pfam Name: EF1G Pfam Description: Elongation factor 1 gamma, conserved domain
KPKVVEAPAEEEAPKPKPKNPLDLLPPSKMILDDWKRLYSNTKTNFREVAIKGFWDMYDPEGYSLWFCDYKYNDENTVSFVTMNKVGGFLQRMDLCRKYAFGKMLVVGSEPPFKLKGLWLFRGQEVPKFVMDEVYDMELYEWTKVDISDEAQRERVSAMIKDQEPFEGEALLDAKCFK

SEQ ID NO: 16565 - DNA, 1537 bp, Panicum virgatum
  misc_feature: Ceres CLONE 1789526
  misc_feature: Encodes the peptide sequence at SEQ ID NO. 16566
acccgcaaaagcacatggttgagtgtacattgcttaccttaataatttgtactttgcattttgatgtgtagatacaacatctttcataaatctaaatcctgaaattggcttttgttatgatggattagtgtgattgctaattcgttacactctccaaaaacaaaagaattattatttgtaccgtgtaccttgataaatcttatcttcattacatatacgagcatacaatttcaaagcacttgcaggtaggctttctctagagaagctgttttaattcctattctcataggtgccttgcaagtttaaactttgaagctattaatgaatttatgactgctcgtttgaggcgttcctcttatctatctaattcactgcagactattttggggcgcagagaggtcagagaatttgccagtggggcattagctggtgctatgtcaaaagctattcttgctccccttgagactatcaggacaaggatggttgtaggagtaggatctaggcatatttttggtacttttgtggagatcattgaacaaaatgggtggcaagggctttgggcgggaaatacaatcaacatgctccgcattattccaacacaagcagtagagctcgcaacattcgagtgtgtcaaaaggagcatggcagaagcacaagagaaatggaaagatgatggatacccaaagatacagcttggcaacctgaaaatcgagctgccactccacttcttgtctccagttgctattggcggtgctgctgctggaatagctggcacattggcttgtcatcctcttgaagttgtcaaggatcgcttgactatcagtcgagaggtttatcctaccattaggcttgccttcagcaagatctaccagacggaaggtataggtggtctatattctggcctcggtccaacactaattggcatgattccttacagcacatgctacttctttatgtatgatacaatcaagacctcttactgccgcttacataagaaatcatctttgagtcgtcctgagctagtacttattggggctctttcaggcctcactgcaagtacaatcagcttcccgctggaagtagcaaggaagcggctcatggtcggtgccctgaaggggaagtgcccgcccaacatgattgctgccttatcggaggtgatcaaggaggagggcctcctgggactttaccgcggatggcgtgcaagctgcctgaaggtcatgccgaattctggcatcacttggatgttctacgaggcttggaaggacattcttctcgctgacaaggacaagcagcgtgcttagcgttagctgctgaacaatgaaggcattgcgccgttgtcgttcatgaagtttcctcctttggctgggattcctggtacctttccaagtttcagaatcccacccgtgccgaggaatgggtagataggatgcactgctctttttggctgatgagtggaagcatttgttgatcctcaccgattctgaacatctgatcgccatttttttgttaacaaacaaactggttttcatgagctcgg

SEQ ID NO: 16566 - protein, 323 aa, Panicum virgatum
  misc_feature: Ceres CLONE 1789526
  misc_feature (133)..(221): Pfam Name: Mito_carr Pfam Description: Mitochondrial carrier protein
  misc_feature (227)..(318): Pfam Name: Mito_carr Pfam Description: Mitochondrial carrier protein
  misc_feature (26)..(109): Pfam Name: Mito_carr Pfam Description: Mitochondrial carrier protein
MTARLRRSSYLSNSLQTILGRREVREFASGALAGAMSKAILAPLETIRTRMVVGVGSRHIFGTFVEIIEQNGWQGLWAGNTINMLRIIPTQAVELATFECVKRSMAEAQEKWKDDGYPKIQLGNLKIELPLHFLSPVAIGGAAAGIAGTLACHPLEVVKDRLTISREVYPTIRLAFSKIYQTEGIGGLYSGLGPTLIGMIPYSTCYFFMYDTIKTSYCRLHKKSSLSRPELVLIGALSGLTASTISFPLEVARKRLMVGALKGKCPPNMIAALSEVIKEEGLLGLYRGWRASCLKVMPNSGITWMFYEAWKDILLADKDKQRA

SEQ ID NO: 16567 - DNA, 870 bp, Panicum virgatum
  misc_feature: Ceres CLONE 1789532
  misc_feature: Encodes the peptide sequence at SEQ ID NO. 16568
gggcagcgggctcctctcacacggcacggaatcgtcacggcacgggtgagggattccttccccaccctctcctctcctctcctcccccgtcgcagcccataaatacacggccctcctcgcctcttcccccaatctcatatcgtctcatcgttcggagcgcgcaaccccgttccaaatccaaatcgctcttctcgtgaccctcggcgatccttcccccgcttcaagatgcagatctttgtgaagaccttgaccggcaagactatcaccctcgaggtggagtcctccgacaccattgataacgtcaaggcaaagatccaggacaaggagggcatccccccggaccagcagaggcttatcttcgccggcaagcagctggaggatggccgcactcttgcggactacaacatccagaaggagagcaccctccacctggtgctccgcctgaggggaggcatgcagatcttcgtgaagactttgaccggcaagactatcaccctcgaggtgaagtcctccgacaccattgacaacgtcaaggcaaagatccaggacaaggagggcatccccccggaccagcagmggctkatcttcgccggcaagcagctggaggatggccgcactcttgcggactacaacatccagaaggagtccactctccacctggtgctytgtctccgtggtggccagtaagccatcggtcgtsaagctgctgctgtacctgggtctcctggtctctgccatgaagggtgtcgtcttttaagtatctgtgtcatttgacgtcgaatttgtgtatggtttcatgaactggttgtctacctaaaacagttattgcagtgcagcaggcttaagcatgaataaatgatgtttgaactc

SEQ ID NO: 16568 - protein, 153 aa, Panicum virgatum
  misc_feature: Ceres CLONE 1789532
  misc_feature (6)..(74): Pfam Name: ubiquitin Pfam Description: Ubiquitin family
  misc_feature (82)..(150): Pfam Name: ubiquitin Pfam Description: Ubiquitin family
  misc_feature: Useful for making plants with modulated nitrogen use efficiency
  misc_feature: Useful for making plants with modulated cold sensitivity
  misc_feature: Useful for making plants with modulated flowering time
MQIFVKTLTGKTITLEVESSDTIDNVKAKIQDKEGIPPDQQRLIFAGKQLEDGRTLADYNIQKESTLHLVLRLRGGMQIFVKTLTGKTITLEVKSSDTIDNVKAKIQDKEGIPPDQQRLIFAGKQLEDGRTLADYNIQKESTLHLVLCLRGGQ

SEQ ID NO: 16569 - DNA, 1648 bp, Panicum virgatum
  misc_feature: Ceres CLONE 1789533
  misc_feature: Encodes the peptide sequence at SEQ ID NO. 16570
ctcactctcgagcgctccctccctcccttctcatataagcatacgagctccccacttcgaaccaggcaagaagaaagctatccccacctcaagaacacagctagcgatcagcggctagctagcctgctagcgctagccattgccgccgttcccaggatggccatggccgtccacctcaggaagcctgtttgggctatcctcctcgtcgcctttctctgcctgacacgctccgtttccgctcatcacttcgatgatgactacgacccgcggtacgggcccgggggatacggccatggcccgaaagagtacgggcacggtccgcgcttcgggcgcgggccgtttggccgtgactgccgcttcggccgctgccgcggcggcggcggcggatttggaggcggtggaggctttggtagcggaggtggagctgggggcggccttggtggtggcggcgggatgggcgggggagcaggtggcggtctaggtggcagaggaggaggtggccttggaggtggaggtggcgcaggaggcggcttcggtggtggcgccggtgcgggaggtggcgcaggaggcgggcttggtggtggaggcggcggtggctttggaggaggaggcggtggtggactcgggggaggtggcggcaaaggcggcggctttggtgccggtggtggcatgggcggtggagctggtggtggcggcgggcttggtggcggaggcggcggcggaatgggcggcggtggaggcggtgggctcagaggaggctcaggtggtggctttggagctggtggtggagccggcagtggtggcggccttggtggcggtggaggcggcggcatgggtggcggtggaggtggtggccttggaggcggtaagggaggaggttttggaggtggaggtggcatgggaggtggagcgggcggaggaggcgggcttggtggtggtggcggcggcggcatgggcggtggtggtggcggcgggatgggcggtggcgctggaggaggatttggtggcggagcaggaggtggtgttggaggaggcggcggcatgggcggtggtggaggcggcggcggcggcatgggcggtggtggaggcggtgggttgggcggcggagcgggcggaggactcggtcatggcggaggtcttggcggcggcggcggccttggtggaggaggcggaggcggcctcggtggcggcggaggtgccggaggaggcctcgggcacggcggcggccttggacgcggcgttggtatgggcggaggcggtggcggcggcctcggcatcggaatcggcgtcggcgtgggcgtcgggatgggcgctggggcaggcggcggcgccggtgcgggcgctggcggcggcgggcgttgatgagagccgctgtcgactgggaagaaggttgtgcatgcctgcatgcccgcatgcggcaagcgtcacgatgcttcctttccttccaaactgaaaacctgtgtatgttccgcgctcgttacgacgcggtcaaattaccgttgatctcgctcatctctgtgtttgctgtgtagctagcgcgtgctcaaaagagagctcgataatgtcagtgtcaaccaacacgtgctttgtgataatccatgcaaaaaaaatcgtcaagtgaataatagtactactgatttttttttgg

SEQ ID NO: 16570 - protein, 401 aa, Panicum virgatum
  misc_feature: Ceres CLONE 1789533
  misc_feature: The sequence is a functional homolog of SEQ ID NO 1086 in the 10/225,066 US patent application
  misc_feature: The sequence is a functional homolog of SEQ ID NO 1436 in the 10/666,642 US patent application
  misc_feature: The sequence is a functional homolog of SEQ ID NO 1700 in the 11/479,226 US patent application
  misc_feature: The sequence is a functional homolog of SEQ ID NO 2096 in the 10/374,780 US patent application
  misc_feature: The sequence is a functional homolog of SEQ ID NO 860 in the 10/412,699 US patent application
  misc_feature: The sequence is a functional homolog of SEQ ID NO 952 in the 11/435,388 US patent application
  misc_feature: Useful for making plants with modulated nitrogen use efficiency
  misc_feature: Useful for making plants with altered lignin content
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: Useful for making plants with altered alkaloid content
  misc_feature: The sequence is a functional homolog of SEQ ID NO 110 in the 10/225,066 US patent application
  misc_feature: The sequence is a functional homolog of SEQ ID NO 128 in the 10/666,642 US patent application
  misc_feature: The sequence is a functional homolog of SEQ ID NO 136 in the 10/374,780 US patent application
  misc_feature: The sequence is a functional homolog of SEQ ID NO 44 in the 11/375,241 US patent application
  misc_feature: The sequence is a functional homolog of SEQ ID NO 850 in the 11/435,388 US patent application
  misc_feature: Useful for making plants with altered terpenoid content
  misc_feature: Useful for making plants with modulated phosphate use efficiency
MAMAVHLRKPVWAILLVAFLCLTRSVSAHHFDDDYDPRYGPGGYGHGPKEYGHGPRFGRGPFGRDCRFGRCRGGGGGFGGGGGFGSGGGAGGGLGGGGGMGGGAGGGLGGRGGGGLGGGGGAGGGFGGGAGAGGGAGGGLGGGGGGGFGGGGGGGLGGGGGKGGGFGAGGGMGGGAGGGGGLGGGGGGGMGGGGGGGLRGGSGGGFGAGGGAGSGGGLGGGGGGGMGGGGGGGLGGGKGGGFGGGGGMGGGAGGGGGLGGGGGGGMGGGGGGGMGGGAGGGFGGGAGGGVGGGGGMGGGGGGGGGMGGGGGGGLGGGAGGGLGHGGGLGGGGGLGGGGGGGLGGGGGAGGGLGHGGGLGRGVGMGGGGGGGLGIGIGVGVGVGMGAGAGGGAGAGAGGGGR

SEQ ID NO: 16571 - DNA, 1746 bp, Panicum virgatum
  misc_feature: Ceres CLONE 1789540
  misc_feature: Encodes the peptide sequence at SEQ ID NO. 16572
agaaggcacccaccagactcatcaaaacggagacgggggcggggggatctcgtccgctccagctcgagcacccccgtccgctgcgctgcctacctcgtctccctctgcctctgctggcctgctttatacaaactcctcctactctagaaccaactactactactcggctccagggtcttcttcttcttctttcccaacatctccggccttcccaaccaattcaatcgacccggcggcaggcggatccactccccgcgcgccggcagggagaacatcaggtagccatggcgttcgatgccttcaccgacaagaacgccgtcttccgccgcctcaaggccaagccagagaacaagatgtgcttcgactgcaacgccaagaaccccacctgggcctccgtcacctacggcatcttcctctgcctcgactgctccgccgtccaccgcagcctcggagtacacatcaccttcgtcaggtcaacaaaccttgactcatggactccagatcagctcaagatgatggctttcggaggcaacaacagggcacatgctttcttcaaacagcatggatggaatgatggtggcaaagtcgaggcaaagtacacatcaagagctgctgagttgtacaggcagatactttcaaaggaggtcgctaagagtgccaccaatgataatgccataccgtcatcacctgtcgcatcggagccaccgaagccagccgatgacttccctgaattcaagctctcagatgcaccggcagagaatttgaacgggaagcaggagcctaagtcgccaaaagcacctccccgttcaccaaaagcacctacccatcccacctttgccacctccgtaaagaagcccattggtgcgaagaaggttggagccaagtctggagggcttggtgtccgaaagcttactacaaagccaaatgaaagcctgtatgagcagaaacctgaagagccaaaacctgctgtgcctgccttgacgactacttcaactactaaaagcggtccatccttgcactcgcgttttgaatacgtggagaatgaaccatcagctgactcaaggacagggggatctcatgtgactggccatgtagcaccaccaaaatcatcagacttctttcaagagtacgggatgggcaatgggttccaaaagaaatcaagcaatgcctcaaaagctcagattgaagaaactgacgaagcaaggaagaaattctctaatgcaaaggcaatttcatcgtctcaattttttggtactcagaacagagaagagaaagaggctcaactatcccttcaaaaatatgcgggttcatcatccatctcaagtgccgatctttttggtcatggtcgtgacttggacaactctaatctggacttaagtgctgcggatctcatcaacagaatatcgttccaggcttcccaggatctttcttcactcaaggacatagctggagagactggaaagaagctgacatctttggcctccaatttcatcagcgacctcgacagaatgctctgagtgggctatttggcttgagacttggagcatttcctatgtgcaccagaacgccgccgcctcatgttttgatttgattgtggtgcatcagacaattgaaagcaattcttgctcagctctgtagaggatagtagaggattcatgttctgcgtttgtatttgaccatatttcagacataaagatatttttcatttatttgttgacagcaatgaagcatactcttttatacatt

SEQ ID NO: 16572 - protein, 410 aa, Panicum virgatum
  misc_feature: Ceres CLONE 1789540
  misc_feature (10)..(126): Pfam Name: ArfGap Pfam Description: Putative GTPase activating protein for Arf
MAFDAFTDKNAVFRRLKAKPENKMCFDCNAKNPTWASVTYGIFLCLDCSAVHRSLGVHITFVRSTNLDSWTPDQLKMMAFGGNNRAHAFFKQHGWNDGGKVEAKYTSRAAELYRQILSKEVAKSATNDNAIPSSPVASEPPKPADDFPEFKLSDAPAENLNGKQEPKSPKAPPRSPKAPTHPTFATSVKKPIGAKKVGAKSGGLGVRKLTTKPNESLYEQKPEEPKPAVPALTTTSTTKSGPSLHSRFEYVENEPSADSRTGGSHVTGHVAPPKSSDFFQEYGMGNGFQKKSSNASKAQIEETDEARKKFSNAKAISSSQFFGTQNREEKEAQLSLQKYAGSSSISSADLFGHGRDLDNSNLDLSAADLINRISFQASQDLSSLKDIAGETGKKLTSLASNFISDLDRML

SEQ ID NO: 16573 - DNA, 609 bp, Panicum virgatum
  misc_feature: Ceres CLONE 1789552-R
  misc_feature: Encodes the peptide sequence at SEQ ID NO. 16574
gaccatctcagaatcttttggagtcagtggctcaccggattgcaagtgccacattgctcaagttctctcaaatatctgctgtacgggttgaagttaagaaacctcatgttgctgtacaaggaattatcgactatttaggtgttgagatagttaggtatagaaaggacatggcaggaatttcaccatgagctccactacactagcattccgaggatggcatgtccatgttcaatctgtcaatggcgctgactgctcaacattgcgttccttcagatgtatatactgcaacaattcgtactgaatgttgctctcagaagctgttcggctcaaaattgatctagttttattggaattgaagtaggcaattaagtttttcctcaaagcttggatggagatgaaattccggcattggatacttattattagctcggttgatattttccatattgcaccttccttcccagatgtctggtctgcagttctgtaaattttgtaccattctatcaaaactatgagcaaatttgagctgtcatgttggacccatgtaataagctcaaatttatttactgacatcagaaatatcaatggctataaaactttcttgtactt

SEQ ID NO: 16574 - protein, 61 aa, Panicum virgatum
  misc_feature: Ceres CLONE 1789552-R
  misc_feature: SWISSPROT Homolog: EC 4.1.2.25 Dihydroneopterin aldolase
PSQNLLESVAHRIASATLLKFSQISAVRVEVKKPHVAVQGIIDYLGVEIVRYRKDMAGISP

SEQ ID NO: 16575 - DNA, 715 bp, Panicum virgatum
  misc_feature: Ceres CLONE 1789552
agattctcaggcgtctcagattctcaggggctccccagcctctcagtctcaggtactctactatccttcacctcccgccggcagtgtgtggcggcgccttgagatcctccttctcgctgcctgctcgtgctacttcagtccccgcatcttgtgaccctttcttcgcgcgaatcaaatctttctgcgtttccaatttcaaagaaaaaaaactacttgcgtttcaaatttaggtgcgaattgtgtggcgagtagattagattcgttcaacttttaggagtctactacgatccataaggttcaggaagtaggatatgggaatattacttgcaattttctgcctaacgtttctgtttctctgtctcagcatccatcccttgttcctggcttccaccttctggtatactcactaccttgtgggttcgtcagattgcgcatctgcccaagtgcgcaaattcaagggtagcctgtgccccttccttccttgctgtcacgcagccacctctccaatttagtttggttcacagggcatccttcagctcccaacacagccagtttacaagaagcgctgcaggttagaaagatcagagctttttttggttctgctgacttcctctgccaacattttcaatcgcctagacaacttaaacagaatcatctgaagacccgaaagcggtgttccgagtgctgccagaatgaattttttcccctatgcttt

SEQ ID NO: 16576 - DNA, 1545 bp, Panicum virgatum
  misc_feature: Ceres CLONE 1789565
  misc_feature: Encodes the peptide sequence at SEQ ID NO. 16577
ctttttttctctctcctccagcctccgcctccacgccacacagaggatagcgagagaggggcggcggcgcggagctagggttttgatctcgcctcgccgggctgcgccgctgccgccatggagagggagctgctggagacgttcgaggcggccaagaaggcagctgacgcggcggccggggaggacgactcgccggaggctgaccgctgcctcgacgccctgcgccggctgcgcgacatccgcgtcaacaccgacgtgctcgtcgccacgcaggttggcaaacgtcttcggcaccttactaagcaccctcactcgggcattcaggcagttgctacagacctttttgggtactggaaaaaggttgttcttgaagagacaggaaagaaaaatggcagctcagagaatgagagatcaagtgattcttcagggaagattgagaaggcgaggcctgtgaagattgaaagaaattcttcatcatcaagcatgaaggttgaaagatcaagtgattcttcagggaagattgagaaggcgaggcctgtgaagattgaaagaaattcttcatcagcaagcatgaaggttgagaaaagagatgtggatgttaaaggtcagaggcctgacagtgtcaaaattgaaaaggccactagtaatggttccaaagctcaacctgtgaaggttgagagggtttccaaagaagtcagtagaactcctgatacaaagaagacagcatctgtccccactggacccccaaagcttacatcccttgtcaaatgcaatgatgctacccgagacaaaatccgggaattacttgctgaagctttctcaaaggttcctgcggagactagcaatgatgaccgggatgaagtgaggagcatcttggatcaagtaaatgcatgcgacccatttagagttgctgtgacagtggagtccgcattatttgagaagcttggacgttctactggggcccagaaggcaaaatataggtcaataatgtttaacctgagagcagataacaacactgatttccggagaagagttctcattggtcaagtgaggcctgagaggcttccagatataccccccgaagagatggctagtgatgcaaggaaacaagagaacaagcagatcaaggcgaaggctatgtttgactgtgagcgcggaagagcgccgaaggcaacaactgatcagttcaagtgtggcaggtgtggccaacggaagacaacttactatcagctccagactcggagtgctgatgaaccgatgacaacatttgtgacatgcgtgaactgcaacaatcactggaagttctgttgagtgccatcctgctaaaatgtttgcctagtagtgctgagcaccagactactaaaatgtgtgctctgttagctagggctgtcattcgaatttgacagggttggaatcagtttttcgtacactaggagctgttttcttcttccctgttttttttttggctctttgcaaacctgatttattcagattgtactagttgaccgcataaatgttgttgtcttaattatcatcagcttctgt

SEQ ID NO: 16577 - protein, 397 aa, Panicum virgatum
  misc_feature: Ceres CLONE 1789565
  misc_feature (218)..(346): Pfam Name: TFIIS_M Pfam Description: Transcription factor S-II (TFIIS), central domain
  misc_feature (357)..(395): Pfam Name: TFIIS_C Pfam Description: Transcription factor S-II (TFIIS)
  misc_feature (1)..(93): Pfam Name: TFIIS Pfam Description: Transcription elongation factor S-II protein N terminal
  misc_feature: SWISSPROT Homolog: EC 2.7.7.6 DNA-directed RNA polymerase
  misc_feature: Useful for making plants with altered terpenoid content
MERELLETFEAAKKAADAAAGEDDSPEADRCLDALRRLRDIRVNTDVLVATQVGKRLRHLTKHPHSGIQAVATDLFGYWKKVVLEETGKKNGSSENERSSDSSGKIEKARPVKIERNSSSSSMKVERSSDSSGKIEKARPVKIERNSSSASMKVEKRDVDVKGQRPDSVKIEKATSNGSKAQPVKVERVSKEVSRTPDTKKTASVPTGPPKLTSLVKCNDATRDKIRELLAEAFSKVPAETSNDDRDEVRSILDQVNACDPFRVAVTVESALFEKLGRSTGAQKAKYRSIMFNLRADNNTDFRRRVLIGQVRPERLPDIPPEEMASDARKQENKQIKAKAMFDCERGRAPKATTDQFKCGRCGQRKTTYYQLQTRSADEPMTTFVTCVNCNNHWKFC

SEQ ID NO: 16578 - DNA, 2100 bp, Panicum virgatum
  misc_feature: Ceres CLONE 1789580
  misc_feature: Encodes the peptide sequence at SEQ ID NO. 16579
ttccttctcttgtacgccaacgccaacctaccccctcctacagccgccgcgtctccgcccaaaaccctagctagtgctagaccccagcgcagtcccagcagaggcagccatggccaccatccccaccaccgattccgcccttctcctcggctcatccgctctccacagggccgccaggaccgggcgggccacggcggcccggctgcccggagccaaccgccgtcgcccccgggccctggtgcgcgcgtccgccaaggagattgccttcgaccagggctccagagcctccctccaggccggcgtcgagaagctcgccgccgcagtcggcgtcaccctcggcccccgaggaaggaatgttgtcttggatgagtttggaacccccaaagtggtcaacgacggagttaccattgctcgtgctattgagctcgctgatcccatggagaatgctggtgcctcattgattcgtgaagttgctagcaagacaaacgactcggctggtgatgggaccacaactgcatccgttctcgccagagagatcattaaattgggtatgttgagtgttacttcaggggcaaacccggtgtctattaagaagggcattgataagactgttcaaaaattggtggaggaacttgagaagaagtccaggcctgtgaagggtggcggagatattaaagctgttgctgctatatcagctggaaatgatgaattcgttgggaccatgatcgccgaagctattgacaaggtcggccctgatggtgtgctctcaattgagtcgtcgtcatcatttgagaccacagttgaagttgaagaagggatggagcttgacagaggatatatctcccctcagtttgtcaccaaccctgagaaatcaactgtggagtttgaaaatgctcgaattctcgtcactgaccagaagatatcatcgataaaagaaatccttcctctgttggagcaaactacacagttaagagcaccacttctaataattgcagaggatgtaagtggtgaggctttggcaactttagttgtcaacaagcttagaggaatcctaaatgtggctgcaatcaaagctcctggtttcggtgagaggcgtaaagctcttcttcaagacattgctattgttacaggtgctgaatatcaatccaaagatcttggcttactagttgagaagacaacagtggagcagctgggcatagctcgcaaagtgatgatctccagctcgtcgacgacgattatagctgatgctgcaagcaaagatgatatccaggccagaattgcgcagctgaagagagagctttctcagacggactcgacatatgactctgagaagcttgcggagagaatcgcaaagctttctggtggagttgctgtgataaaggttggtgcctcgactgaggcggagcttgaggaccgcaagctccgcatagaggatgcaaagaatgcaacttttgcagccatcgaggaaggtattgtacctggagggggtgcagcctatgttcatctatcaacatttgtgccggctatcaaggagaagatggatgatcctgaagagcgccttggtgctgatatcattcagaaggcccttgtagcacctgcggcactgatagcgcacaatgctggggttgaaggtgaggtgattgtagataaaatcaaggagagcgaatgggagtatggttacaacgccatggctgacaagcacgagaacttggtagaggctggtgtgatcgaccctgccaaggtcacgagatgcgccctgcagaatgccgcgtcagttgctggaatggtgctgaccactcaggctattgtcgtggagaagccgaaaaagaaggctccagcagctgctggtgcacctgagggttcatttgccatgtaatgcgagaataaatttactagtctggtggtggtggggggcgattcaaatcatttgagcaagggcgagacgagaaagagagggagagagagaggaactgaatctgtgtcttgatctgttgccgaagctgataaactcttctgtcatcctgaattgttccgctaagctggcggagtgggcgaataataaacttaatcggttttgttcactttcattgctgaaatatg

SEQ ID NO: 16579 - protein, 588 aa, Panicum virgatum
  misc_feature: Ceres CLONE 1789580
  misc_feature (68)..(571): Pfam Name: Cpn60_TCP1 Pfam Description: TCP-1/cpn60 chaperonin family
  misc_feature: Useful for making plants with modulated nitrogen use efficiency
MATIPTTDSALLLGSSALHRAARTGRATAARLPGANRRRPRALVRASAKEIAFDQGSRASLQAGVEKLAAAVGVTLGPRGRNVVLDEFGTPKVVNDGVTIARAIELADPMENAGASLIREVASKTNDSAGDGTTTASVLAREIIKLGMLSVTSGANPVSIKKGIDKTVQKLVEELEKKSRPVKGGGDIKAVAAISAGNDEFVGTMIAEAIDKVGPDGVLSIESSSSFETTVEVEEGMELDRGYISPQFVTNPEKSTVEFENARILVTDQKISSIKEILPLLEQTTQLRAPLLIIAEDVSGEALATLVVNKLRGILNVAAIKAPGFGERRKALLQDIAIVTGAEYQSKDLGLLVEKTTVEQLGIARKVMISSSSTTIIADAASKDDIQARIAQLKRELSQTDSTYDSEKLAERIAKLSGGVAVIKVGASTEAELEDRKLRIEDAKNATFAAIEEGIVPGGGAAYVHLSTFVPAIKEKMDDPEERLGADIIQKALVAPAALIAHNAGVEGEVIVDKIKESEWEYGYNAMADKHENLVEAGVIDPAKVTRCALQNAASVAGMVLTTQAIVVEKPKKKAPAAAGAPEGSFAM

SEQ ID NO: 16580 - DNA, 652 bp, Panicum virgatum
  misc_feature: Ceres CLONE 1789596-R
  misc_feature: Encodes the peptide sequence at SEQ ID NO. 16581
gagaagaacaccccgccgtatctttgagggtgaggcgctgctccgccgcatgaaccgctatgggctgcttgctgagggtcagaacaagcttgattacgtccttgccctcactgctgagaacttcctggcaaggcgccttcagactcttgtcttcaaggctggcatggccaagtccatccaccatgctcgtgtcttgatcaagcaacgccacatcagggttggcaggcaaattgtcaatgtcccgtcattcatggtgagggtggagtctgagaagcacattgacttttcactgtcaagcccattcggcggaggtcccccaggcagggtgaagaggaagaaccagaagaaggcaagcggtggtggcggcgacggcggcgatgaggacgaggagtgaggatgaaccggtagccgttacctgatttaatattatctagttgtcataaacatgttggtatcttgagctcttagctgtgtggcctgatgctcagtcccttgtgttgactgggcatcacggatgtttatcgttttgccttgcagtgttattagcctatacttagctgctatgtttgaagatgtttaatcatgttgcgtttcaacttctgttgtcatcaaagctgtacctgttttctctgcacctatgatttgccaagtc

SEQ ID NO: 16581 - protein, 130 aa, Panicum virgatum
  misc_feature: Ceres CLONE 1789596-R
  misc_feature (44)..(91): Pfam Name: S4 Pfam Description: S4 domain
RRTPRRIFEGEALLRRMNRYGLLAEGQNKLDYVLALTAENFLARRLQTLVFKAGMAKSIHHARVLIKQRHIRVGRQIVNVPSFMVRVESEKHIDFSLSSPFGGGPPGRVKRKNQKKASGGGGDGGDEDEE

SEQ ID NO: 16582 - DNA, 142 bp, Panicum virgatum
  misc_feature: Ceres CLONE 1789596
ccgaggacgaacggccgttaggatgtagcaacaccggctggatccactgcagcctcgagcagccagcagcgaaggtggagaacagcgagagactcctagctttcaggagtacgagtcaaacattatcaccttccaggaggat

SEQ ID NO: 16583 - DNA, 1799 bp, Panicum virgatum
  misc_feature: Ceres CLONE 1789612
  misc_feature: Encodes the peptide sequence at SEQ ID NO. 16584
gatccctccgcctccctttctttcccctacctccagtgggggctccgcccaaacccgccgcccccttcgcgtcgccctgcaccagcgatgcgcggtcccgggcgccatggcctccccagcacgggcggcaccgggtaccacggcggcaccaccgccccagtacggccgatgccggccgccccggcggtgcggccgcgctagcacgagcagccccgtgggccctgtgggagcccttgcaagggcgccgccaggccacccgacggcgccaccgctccggcacgggccaagccagtggccgtagcacgagcgccccccctgcgcgtcggcctcaacgaccggccctgcctggtcgtgtcttcctcttccccggctactgctccgctcggcaggtggcctttgccaaggcgcgtcacctcagcgaccggatctggtgagacatcaccctcttcttctcctcctctattccatagctgctcccctaggtcctccatccctccacgttcgccttcgtgcaggtgagtggccgctgcggcagcatgtgctacctcccctctacacgccggtcgcatccaccgccttcgtggctgccgttttcgctgttggtcttcctcttcacctccgccaacccccgtgctttgcgttttcaatccccctacaaatggtatggccccagcaagctaggcttagcggtgccgagggaggtctagcagttccacctccaccatggattctttgatcaggactaatatttttcatcacacggctaaatagagttaaggcttcaagagtcttctctcctttcttgattgctgtccacatcttctttgccttccattccataagacatggagtactatcactttcatggtgtttttttttggcagaatctgtgttccaatcacccacgaactgcacttcgcaggtcaggtagcatagaaaaaaacagagaggcagcataggaccagaagagaattgaaaactgaagcccatgttgagatcattgccacaattgggtggcactccatgtagcagactatcaaccttggagcaaaacattatgcctgaacaccacatagtaccaggtgaactacggactggatggcgtaaaactgatgacatttgggcagcctcgtattggcaatgctgcttttgcttcttatttcaagacacacttgcctcatgcaattcgagttactcatgcccatgatattgtgccccacctgccaccatacttctcattcttcccagagaagacctatcatcacttcccaagagaagtatggatccataacattggactaggaagcttagtctacaatgtggagaagatctgtgatgattctggtgaagacccaacatgcagcaggtcggtaagtggaactagtgtgcgcgaccatatatactatctcggtgttagcatgcatgcagaagactggagcagctgcagaatcgtcatggattacagcaaattgcagtatcagatggacctcaacggtaatatcatattgtcgaagcagcctggtttgtcgaatgataggttcagtgcccagtgaacaagtgtatgatgtgtatagtacgatagcatcacgaatcagtaatgtgagctagcattgcacagatattccctctcatctccgttatgatgcttgctgttaaattattcctgcatcaaaccggagggtgaaaggagcatgcagatttggatatgcttgctgtaaatgtggttgcgcaatatacggttcagtttgcaaacatatgtgcttatattgacaaatgcatcggaaacaaatcattcatcc

SEQ ID NO: 16584 - protein, 146 aa, Panicum virgatum
  misc_feature: Ceres CLONE 1789612
  misc_feature: SWISSPROT Homolog: EC 3.1.1.3 Triacylglycerol lipase
MTFGQPRIGNAAFASYFKTHLPHAIRVTHAHDIVPHLPPYFSFFPEKTYHHFPREVWIHNIGLGSLVYNVEKICDDSGEDPTCSRSVSGTSVRDHIYYLGVSMHAEDWSSCRIVMDYSKLQYQMDLNGNIILSKQPGLSNDRFSAQ

SEQ ID NO: 16585 - DNA, 2083 bp, Panicum virgatum
  misc_feature: Ceres CLONE 1789615
  misc_feature: Encodes the peptide sequence at SEQ ID NO. 16586
aaaaccctcgccgccgcggtgatggatctccgccggccgccgcgctcctcatcaggcggcgtggagcccaagatccgccaggtaggattcttcaccccggacgcttccgccccatccgagcccctccccccggccgccgcggtcccggcgccgtcggcgaagcagggggcttccgcggggacgccgccggcgtcggacgacctctccccgggccggctctcccctgtaatgatccctcccccgcgccacgccgcccccggctcgccatcccccgctgcggcggatgccgtcctcgccacctcggcgccggcgcgttcgtccgcgcgtctcgacgccgcgtccgagatcgccgactacgactcctggtcccgggcaccttctgccgcggagctagaagaaaacaagcgtggtttggctgaaatacggaatgaaggtgctttggcctccattccacagaagcagaagacttcaaaggcagagaggcgtgctattcaggaggctcaacgtgctgctaaagctgcagcgaaggaggcaggaaaatctgccgctgctgctgcttcggctggtcctgtcacttccaagcaagccaagtcagcaaaaaatgctcaaaagaaagatgtgccccaagctgcaagtacagttgcttctgagaagaaggttaatgagcgccttccagaaagagaaagaaagttagatgcccctcatccccgaatgcagtttgatgatgtgcataaggtggagaaagcaaaaaaacgtgcagtagtcaaccaatcagaagctcgaaatagggttgaattgtttaggcatctgcctcagtatgtgcatggcactcagcttcctgatctcgaatcaaaattctttcaacttgaaccaatgcatccttctgtatacaaggttgggctccaatatttgtctggtgaagtatctggtggcaatggtcgttgcatagcaatgcttcttgcattcagagaggcaataaaagattacactacacctccaaataaaactctcagcagagatcttactgcaaaaatcagtagttatgtgtcatttctaattgagtgtaggcctctttcaattagcatgggcaatgctattaggtttctgaagaacaggattgccaagctaccacatacattgtcagagtctgaagccaaagctagtcttcagtctgatattgatcgttttataaatgagaagatagttcttgcagataaggctattgtcagccatgccatcacaaaggtcagagacaatgatgttttgttgacatatggttcgtcatcagttgttgaaatgattttgaattatgctcatgagcttgggaggaaatttcgcgttatagtagtagattctcgtccaaagcttgaggggcagggattactacgaagattagtggcaaagggcatcaactgcacatatacacacataaatgccatctcatacatcatgcatgaagttaccagagtcttcttgggtgccgcctcaatattgtcaaatggaacagtttattctcgagttggaacggcatccgtggctatggttgcacatgcgtttggagttccagttctggtttgttgtgaggcatacaaatttcatgagagagtgcaacttgattctatatgtgctaatgagcttggtgacccagatgtcatgttgaaagttcctgggaaggcagatgaccatcttaagaattgggcagacaatgcaaatctccaacttctaaatcttacgtacgatgccacacctcatgactatgtgtcgatgatcataacagactatggaatgcttccacccaccagtgtaccggtcattgtgagagaataccgcaaggagcagttgtggatataaattcactgcagtctgcagtatgatagcatttttggtggctcttattgcctaatggtgacttgtgataatgtttcacactgtcggcctgagaggatttttgtttgctcttgttgccttgtttaccataagatggttcatccagttttgcgatcgcctgtataacttgtaactccatgaaggccgcactttgacacccatgggatgataatggccctcttacattgctgagtcg

SEQ ID NO: 16586 - protein, 609 aa, Panicum virgatum
  misc_feature: Ceres CLONE 1789615
  misc_feature (300)..(592): Pfam Name: IF-2B Pfam Description: Initiation factor 2 subunit family
  misc_feature: SWISSPROT Homolog: EC 5.3.1.23 S-methyl-5-thioribose-1-phosphate isomerase
MDLRRPPRSSSGGVEPKIRQVGFFTPDASAPSEPLPPAAAVPAPSAKQGASAGTPPASDDLSPGRLSPVMIPPPRHAAPGSPSPAAADAVLATSAPARSSARLDAASEIADYDSWSRAPSAAELEENKRGLAEIRNEGALASIPQKQKTSKAERRAIQEAQRAAKAAAKEAGKSAAAAASAGPVTSKQAKSAKNAQKKDVPQAASTVASEKKVNERLPERERKLDAPHPRMQFDDVHKVEKAKKRAVVNQSEARNRVELFRHLPQYVHGTQLPDLESKFFQLEPMHPSVYKVGLQYLSGEVSGGNGRCIAMLLAFREAIKDYTTPPNKTLSRDLTAKISSYVSFLIECRPLSISMGNAIRFLKNRIAKLPHTLSESEAKASLQSDIDRFINEKIVLADKAIVSHAITKVRDNDVLLTYGSSSVVEMILNYAHELGRKFRVIVVDSRPKLEGQGLLRRLVAKGINCTYTHINAISYIMHEVTRVFLGAASILSNGTVYSRVGTASVAMVAHAFGVPVLVCCEAYKFHERVQLDSICANELGDPDVMLKVPGKADDHLKNWADNANLQLLNLTYDATPHDYVSMIITDYGMLPPTSVPVIVREYRKEQLWI

SEQ ID NO: 16587 - DNA, 733 bp, Panicum virgatum
  misc_feature: Ceres CLONE 1789618
  misc_feature: Encodes the peptide sequence at SEQ ID NO. 16588
atagacacctagttgttcatcgctgatcattgtcatggcggcaaacctagcacagctgttgatgcgcgagctgatggctcctcgagcatggtttctgcttctcctccctctctccctattgctcgtaggctacccattattcagcgcaaagagggcgaggaagaggcagcaggagacagacggaaatcacctaccgccttcgcctccggcgctgcccgtcctcggccacctccacctcgtcggcttccgcttcccgcacgtcactctccgcagcatcgccgagaagcacggcggggacctcatgttgctgcgcctaggcgccatgccggcgctcatcgtgtcgtcgccccgcgccgccgaggcggtgctacgtacgcatgaccacgtgttcgcgtcgcggccgccctccctggtcgccgaggtcctcatgcacggccggaacgacattggcttcgcgccgtatggggagcactggcggcaggcgaggaagctcgtcaccacacaccttctcaccgtcaaaagggtgcaatcgttccgccacgcccgacaggaagaggtcagcgcggtggtggctcaaatcgttgaggcggccgccgcgggcgcaccagtgaacataggcgaccttgtcggctcgttcacgaatgacttggcgtgccgtgccgtcatcggcaagtccttccggagtgagggccggaacaagctgatccgagaggtggtcgccgacgcatcagcc

SEQ ID NO: 16588 - protein, 232 aa, Panicum virgatum
  misc_feature: Ceres CLONE 1789618
  misc_feature: SWISSPROT Homolog: EC 1.14.13.68 4-hydroxyphenylacetaldehyde oxime monooxygenase
MAANLAQLLMRELMAPRAWFLLLLPLSLLLVGYPLFSAKRARKRQQETDGNHLPPSPPALPVLGHLHLVGFRFPHVTLRSIAEKHGGDLMLLRLGAMPALIVSSPRAAEAVLRTHDHVFASRPPSLVAEVLMHGRNDIGFAPYGEHWRQARKLVTTHLLTVKRVQSFRHARQEEVSAVVAQIVEAAAAGAPVNIGDLVGSFTNDLACRAVIGKSFRSEGRNKLIREVVADAS

SEQ ID NO: 16589 - DNA, 683 bp, Panicum virgatum
  misc_feature: Ceres CLONE 1789618-R
  misc_feature: Encodes the peptide sequence at SEQ ID NO. 16590
aaaagctatcctccttgtaagacgtgtttttggggatgggcacagcagcttcggtcatcgactacaccgtgatccagctccttcagaatccacgcgtgatgaccaagctacaagccgaggtgaggagctgcgtgctgcagcaggggcagggagaagaaaccgtcagcgaggacgacctgaaccgcatgccctacctgagagccgtcatcaacgagtcgctccggctacgccccgcgacaccgctcatcacgccgcacttctccatggccacctgcgtcatcgacgggcacgtcgtccccgcggaggtgcgcgtcctcgtcaacctctgggccatcggcagggacgcgcgcttctggggcgaggacgcggaggagttcgtcccggagaggtttctcgacggcggcggcgcggcgcatgtgagctactggggcaacgacttccagttcctgccgttcggcgccgggcgccggcagtgccccgggatcaacttcggcatggcccaggtcgaggtgatgctggccaacctcgtgcaccgcttcgactgggagctgccgccggggaaggtggcccgagacatcgacatgtccgaggacttgggcctcgtggtgaagcgcaaacacaagctcctcttgcttcccaaattgtgcgtgtagctccgatatgatatatcatctccgttttcg

SEQ ID NO: 16590 - protein, 205 aa, Panicum virgatum
  misc_feature: Ceres CLONE 1789618-R
  misc_feature: SWISSPROT Homolog: EC 1.14.13.88 Flavonoid 3',5'-hydroxylase
MGTAASVIDYTVIQLLQNPRVMTKLQAEVRSCVLQQGQGEETVSEDDLNRMPYLRAVINESLRLRPATPLITPHFSMATCVIDGHVVPAEVRVLVNLWAIGRDARFWGEDAEEFVPERFLDGGGAAHVSYWGNDFQFLPFGAGRRQCPGINFGMAQVEVMLANLVHRFDWELPPGKVARDIDMSEDLGLVVKRKHKLLLLPKLCV

SEQ ID NO: 16591 - DNA, 1601 bp, Panicum virgatum
  misc_feature: Ceres CLONE 1789625
  misc_feature: Encodes the peptide sequence at SEQ ID NO. 16592
aaaggctaaagctcaccccctccgccccccaaggccccaacgcgccccctccgccccccaacgcgcccgacctcacccaaatccccccacctccctcccacccctgctccgcggcgttctatggcatacacctcctccctccacctccccaagcacctgctcctgcccaacccccgccggaccaggcacaggtcctcctcctccgtctccttcgtccccgccgccgcggccagggccaacggcgtggacgggcgcgcgcccgagaagaagccgccgccgcccaaaggcaaggcgcgcatcaacggcgtgaacggcaagaagggggcgaacgggcacgtcaacagcaacaagggggtgaacgggcacgtcaacggcaacaagggcgtcaacggccatgccgaccggatccacctctcggtgagcacgggcggcggcggcgcgggggcacaggacggctccgggctccgcgtggcgttccagggcgcgcccggcgcgtacagcgagttcgcggccaagacggcgctgcccgggtgcgacacggtcccgtgccggaccttcgcggacgcgctggcggccgtggagcggggcgccgccgaccgcgccatcctccccgtggagtccaccatggagggcaccacgctgcggaactacgacctgctgctgcggcacggcctggtggtggcgcaggagatcaacctcttcgtgcactactgcctcctcgccatgccgggggtgcgcgccgccgaggtgcgccgcgtcatcagccacccgatggcgctcgcgcactgcggccgcgcgctggcgcgcctcggggtggaccgcgagcccgtcgaggacaccgccggcgccgtcgagatgctgcgctccaaccggatgctcgacaccgccgccatcgccagcccgcgcgccgccgacctgtacggcctcgacgtgctcgcgcacggcctccaggacgagtcctggaacgtcacgcgcttcctgctcctctccaggccgccgtcgcccgtcgcgctgcacgtcgacgccgacgccaagaccagcatggtcgtcgcgcaccggggcggctccatgatggtcctgctcaaggtgctctccgccttctcctcccgcaacatcaacctcaccaagctggaggtcatcaacaacgacggcgacgccgccggggccggcgcccgcccgccggtcatgatcctggacacgaccgcccggggcgcgcccacgctgcgcgccttcccgcacgtcctgtacgtcgactgcgcgggcgccgcgcacgacccgcgcgtccgcgaggccatccaggagatcgagaagttcgccgtgttcgtgcgcgtgctcggctgctacgccgccgactccaccgtctacgacctgcaatgagggaggggaggaggaggacaggatcgccgtggtgcggatcgggactgctggaatctatagctagttgactggcggcaatctctctgttaaaattgggccaagctatcggatctaccagcactcagtaactagctccagcgagattagttgtttcgcttgctgctgctgctgcgtaatttttatacatacagatgcaataagaatcttcctattgctgctcgatt

SEQ ID NO: 16592 - protein, 418 aa, Panicum virgatum
  misc_feature: Ceres CLONE 1789625
  misc_feature (117)..(294): Pfam Name: PDT Pfam Description: Prephenate dehydratase
  misc_feature: SWISSPROT Homolog: EC 4.2.1.51 Prephenate dehydratase
MAYTSSLHLPKHLLLPNPRRTRHRSSSSVSFVPAAAARANGVDGRAPEKKPPPPKGKARINGVNGKKGANGHVNSNKGVNGHVNGNKGVNGHADRIHLSVSTGGGGAGAQDGSGLRVAFQGAPGAYSEFAAKTALPGCDTVPCRTFADALAAVERGAADRAILPVESTMEGTTLRNYDLLLRHGLVVAQEINLFVHYCLLAMPGVRAAEVRRVISHPMALAHCGRALARLGVDREPVEDTAGAVEMLRSNRMLDTAAIASPRAADLYGLDVLAHGLQDESWNVTRFLLLSRPPSPVALHVDADAKTSMVVAHRGGSMMVLLKVLSAFSSRNINLTKLEVINNDGDAAGAGARPPVMILDTTARGAPTLRAFPHVLYVDCAGAAHDPRVREAIQEIEKFAVFVRVLGCYAADSTVYDLQ

SEQ ID NO: 16593 - DNA, 678 bp, Panicum virgatum
  misc_feature: Ceres CLONE 1789638-R
  misc_feature: Encodes the peptide sequence at SEQ ID NO. 16594
agtcaacaaatcgaataagactggctatgaatcactcttgaagatatacagagaaactgatctaagccaggagaaagtccgtgtgctaggttctttggcatcatgccctgaccctgttgttgttcgtgaagcgttggacttcatactatcacctgaggtaaggaatcaggacgctatatttttgcttagaggggtgtgttcaggggcgcacgaggtggcatggcaatggctgaaggaaaactgggactacatattaggagcctactctggaactctgctcacctacttcgtcaacataactgtctcaccgctggccactgacgagaagggtgatgaggcggaggagttcttcaagagcagaaccaaggcgagcatcgccaggaccgtgaagcagagcatcgagagagtgaggatcaacgcccaatgggtcaagagcatcaaggccgaggccgacctcggtaatgttattagggcgcacgctcacaagcagtgagacgagatgggcactttcctttctatgcccttgtagtgccgcctgggatgtaagttgtgaagtgggttaatagagtggattgataaagggttactggtgcggctttatgcttcttgtccgcctttgcgttgattactttccttggcaaaatgattttgatttcaaatagccttcacagcagttgc

SEQ ID NO: 16594 - protein, 163 aa, Panicum virgatum
  misc_feature: Ceres CLONE 1789638-R
  misc_feature: SWISSPROT Homolog: EC 3.4.11.7 Glutamyl aminopeptidase
VNKSNKTGYESLLKIYRETDLSQEKVRVLGSLASCPDPVVVREALDFILSPEVRNQDAIFLLRGVCSGAHEVAWQWLKENWDYILGAYSGTLLTYFVNITVSPLATDEKGDEAEEFFKSRTKASIARTVKQSIERVRINAQWVKSIKAEADLGNVIRAHAHKQ

SEQ ID NO: 16595 - DNA, 238 bp, Panicum virgatum
  misc_feature: Ceres CLONE 1789638
cgcctccttcggttggcactcttgttatcaggtcgagacaaaggggtgaggtacccaggaggaggattccaatggcgccacctaccagggacggtgacatggaccgcctacagagcgtaaagaaccgcatgcagtgtctccctagctccacacgccaccgagcgcgaggctgtcttcaccacgctgaaagaccttggagaggcggtgccgaagccccaccagatcaatgcttagttca

SEQ ID NO: 16596 - DNA, 1471 bp, Panicum virgatum
  misc_feature: Ceres CLONE 1789643
  misc_feature: Encodes the peptide sequence at SEQ ID NO. 16597
aaacgggaggaagccacagccgcagcagcccgccccgccattcttgccgagtcgagttcgagtccacgcccccggccgcggcgaggcggcgccccccttcggctctctcctcgggagtcgcggattggtagaggaagcgaggagattcgagcggcgcggccggccatggacacgaccaccagggccgccaagatcccgtcgctccaccagaccgagatcaactgggacaacctcgacaagaccaagctctacgtggtgggcgctggcatgttcagcggcgtcactgtggcgctttacccggtctcggtggtcaagacccggatgcaggtggcctctgggggcgccttgaggaggaacgcgctggctaccttcaagaacatcctcaaggtggacggtgtgccagggctgtaccgaggctttcttactgttatcatcggggctgtcccaactaggatcatcttcctcacagcgcttgagacagccaaagcagcctcgctcaagcttgttgagcccttcaagctgtcagagccggtgcaggccgcctttgccaatggccttgctggtctgtcagcgtcaacatgttcacaggctatttttgttccgattgatgtgataagccagaaattgatggttcaaggatattctggtaacgccaggtataaaggtggaatagatgttgctcgaaaggtcgtaaaggctgatgggattagggggctgtacagaggatttgggttgtctgttatgacctacgcaccatctagtgctgtgtggtgggcgagttatggatccagtcagcgcataatttggagcgctcttggccattggaaaaacaaagaagaggctcctagtcaaatgaaaatagttggtgttcaagcgtcatgtggagttattgctggtgcagtgacctcttttgttacaactcccatagatacaatcaagaccaggctgcaggtaatggataacgaaaataagccaaaagctgggcaagtagttaaaagattgattgctgaagatggatggaaaggtttgtacagagggttaggtccaagatttttcagttcatcagcctggggtacctcgatgatagtatgctacgaatatctgaagcgcttgtgtgctaaagatgaagaggtctgacttctgagtcgccttaaaaccaatgcaatttctacaatgctgaaagttttgtattagcacaagtgaaataatgctgtacgtcaacaacagtgacaccctcctgaagctccagttgttgctgacataggcgaaagcattaagcatggatgtttgacggtgttaaagacttaatttgatgctagacaatagtccttacaaactttggatctctggccagtattttcgaaactacaggggcccttttttttttgccctcttatgttgaatatggattaggaagattattttagatggacatataaaagagatcagatgtacacgcttctcattcttt

SEQ ID NO: 16597 - protein, 323 aa, Panicum virgatum
  misc_feature: Ceres CLONE 1789643
  misc_feature (232)..(321): Pfam Name: Mito_carr Pfam Description: Mitochondrial carrier protein
  misc_feature (125)..(217): Pfam Name: Mito_carr Pfam Description: Mitochondrial carrier protein
  misc_feature (27)..(114): Pfam Name: Mito_carr Pfam Description: Mitochondrial carrier protein
MDTTTRAAKIPSLHQTEINWDNLDKTKLYVVGAGMFSGVTVALYPVSVVKTRMQVASGGALRRNALATFKNILKVDGVPGLYRGFLTVIIGAVPTRIIFLTALETAKAASLKLVEPFKLSEPVQAAFANGLAGLSASTCSQAIFVPIDVISQKLMVQGYSGNARYKGGIDVARKVVKADGIRGLYRGFGLSVMTYAPSSAVWWASYGSSQRIIWSALGHWKNKEEAPSQMKIVGVQASCGVIAGAVTSFVTTPIDTIKTRLQVMDNENKPKAGQVVKRLIAEDGWKGLYRGLGPRFFSSSAWGTSMIVCYEYLKRLCAKDEEV

SEQ ID NO: 16598 - DNA, 539 bp, Panicum virgatum
  misc_feature: Ceres CLONE 1789656
  misc_feature: Encodes the peptide sequence at SEQ ID NO. 16599
atctcaaaattccccactccactcctcctcccctccctcacattatataaaaactccatggcctaatccctggtcacatctcgctgttgtcgccgctcaccaccaccgctcccccgttgcggatctccccctcagctccgggaggacaaacagagagatccggtcagcgccatggcgaacatcgaaatggccgcgatcctggcggacctggaccacggtgaccccgacacgcgggtgcccaaaagcaagctcgtctgcacgctcggcccggcctcccgctccgtccccttgctccagaagttgctccgagccggcatgaacttcgcgcgcttcaacttcacccacggcacgcaccagtaccaccaggagacgctcgacaacctcacgcaggccatgcacaacaccggcatcctctgcgccgtcatgctcgacactaagggtcctgacatccatactgtatttttgaaggacggtcaatcacttaatctaaaccagggtcaagaaatcactgtcaccactgattatgatgtcaagggtga

SEQ ID NO: 16599 - protein, 122 aa, Panicum virgatum
  misc_feature: Ceres CLONE 1789656
  misc_feature (22)..(122): Pfam Name: PK Pfam Description: Pyruvate kinase, barrel domain
  misc_feature: SWISSPROT Homolog: EC 2.7.1.40 Pyruvate kinase
MANIEMAAILADLDHGDPDTRVPKSKLVCTLGPASRSVPLLQKLLRAGMNFARFNFTHGTHQYHQETLDNLTQAMHNTGILCAVMLDTKGPDIHTVFLKDGQSLNLNQGQEITVTTDYDVKG

SEQ ID NO: 16600 - DNA, 1193 bp, Panicum virgatum
  misc_feature: Ceres CLONE 1789660
  misc_feature: Encodes the peptide sequence at SEQ ID NO. 16601
aattcggcactcaggctgacccggctgaccgccgaccgagcccgcgagccgagcccccgacgggcggcgacgcctggatccctaggcgaagctgctccggcttgccggcgttgatcgagcagcgcatcagcgttgaccgcggcgagcaaagaacgggcggacggcggcgggagtcccgcgccgccgcgccgccgcgcccagggccccagacaccaccgcaccagcgggtgcgtgggcggcgcgccgcttgctgccttgcgggctgcccggctgcgtctgaccgtgaccggctgtgcccctgtgcttgtgcggcattcctctgctgatagcaagacaacaaccaaggaaaggaagcatacggtcatcatggttcacttcaagaacaggtatatggtgatggaggtcttcatagatgctggcagaggtgaatctgatcctgttatcctcactcaattcaatgtaaccaaagtaatcagagacagcattcaactcaactttggggagtgtgacctagctgcatctcttggatcgttgcaagtgaagtatgttaatcctgtaacaaagctttgcataattcgggtgtcacgtgaagaccaccagaaagtatggactgcaattacaatggtcaggagcattgggaagattccagtatcgttcaacctgctggatgtgagtggaagcatcagggcatgcaggagagctgcactggagtgcgacaaagcaaagtttgagcaatacaagctggctgctgttgactgtatcacgccggagatcatcctgtccgtacagagctaatgaattggtctattccgtctcctgttttagtctagcaatctcttgtctgtgggtgaaagaaaaagaaagaaacattcagtgcattgtgtagaattgagaccttattgcctgaacaggatggaactaaggtgacaactttctcctcgtgcaatggctgtgtcatatgacggctgcttgaagtcttaagaacggcaaaggtcctctgctctggtcgcttttctttccatatttgtggcccttgtgttgtaatttgtaaagatgttttaggtggcttgggtcttgatttgttgcttctctttaattaaaacatgacgccggaagctgttataggcgtctgatttgtttcagtttagtgatcttggccctgcatctactgtaagacacaaaagtgatgcacc

SEQ ID NO: 16601 - protein, 142 aa, Panicum virgatum
  misc_feature: Ceres CLONE 1789660
  misc_feature (7)..(116): Pfam Name: RNase_P_Rpp14 Pfam Description: Rpp14/Pop5 family
  misc_feature: SWISSPROT Homolog: EC 3.1.26.5 Ribonuclease P
  misc_feature: Useful for making plants with modulated biomass
MVHFKNRYMVMEVFIDAGRGESDPVILTQFNVTKVIRDSIQLNFGECDLAASLGSLQVKYVNPVTKLCIIRVSREDHQKVWTAITMVRSIGKIPVSFNLLDVSGSIRACRRAALECDKAKFEQYKLAAVDCITPEIILSVQS

SEQ ID NO: 16602 - DNA, 1809 bp, Panicum virgatum
  misc_feature: Ceres CLONE 1789666
  misc_feature: Encodes the peptide sequence at SEQ ID NO. 16603
agggcaaaagaaaaaaaataacaagccgaaaccctcgcctcgccctgcccgtcgccgccgccgccgcagcgcccctcgtcccggccgtcctccgccccccaagcgcagccggaggcaacagatccggccggatccgatgtcgggcgggactggctcgtccgggcgtgcggccccgcggtacgcgccggacgacccgtcgctgcccaagccgtggcgcggcctcgtcgacggcaccaccggctacctttactactggaacccggagaccaacgtcacgcagtacgagaagcccacgcgccccgaggaccagctcccgccgcccccgcccccgcccccgctgcctcccccgcctccccggagccgcgaccgccgcgagaggtccagatcccgctcccgcagcccgccccggcgcgaccacagggaccgcgaccgtgaacgtgaccgtgacaggcgccacgacgagcacgcgtcgtccaaggcggcggcttcccaccgccatcctgctccggccgccgccgccgtacccgatgatccgtccaccgaggcgtaccgccgccgccacgagatcaccgtcacgggggataacgtgccgcctcccataacttcatttgaggctggtggctttccgtcagaaattctcaaggagatacaacgtgctggatttgcaagcccaacacctatccaagcccagtcatggccaattgccatgcagagtcaagatgtagtagctatcgcgaagactggatctgggaaaactcttggatatctacttcctggatttatgcatattaaacgcctgcagaacagcacaaggaatggcccgacagtgctagttttagcaccaacaagggaacttgcaacacagattctggatgaagctgtgaaatttgggagatcagcgagaatttcttgcacgtgcctgtatggtggtgctcctaaaggtcctcagttgagagatttagatagaggagttgatgttgttgttgcaacacctggaaggttaaatgacattctagagatgcgaagggtaagccttaagcaagtgtcgtatcttgttctggatgaggctgaccgtatgttggacatgggttttgaaccacaaatacggaagatagtgaaagagatacctcacagtcgtcaaacccttatgtacactgctacttggccaaaggaagtccgaaggattgcagatgatcttcttgttcaccctgtccaggtgacaattggaagtgttgatgaacttgttgctaacagtgctattactcagcatgtggaggtgataactccatcagaaaagcttcgacgtctggaacaaatattgcgatcccaggattcaggttcaaaagtattaatattttgtactacgaagaggatgtgcgaccaacttgcaaggacgctcaccagacagtttagtgcttcggccattcatggtgacaagtcccaaagcgaaagagagaaggttctgaatcactttcgatctggacggtctcctattttggttgcaacagatgttgctgcccgaggtttggacatcaaagatatcagggttgtgatcaactatgacttccccactggtattgaagactatgttcataggattggcaggacaggaagggctggagcaactggtgtagcatatacatttttctgtgatcaggactcaaaatatgcttctgaccttatcaaaattctggaaggggcaaaccaaaaggtaccccgtgatttagaggacatggcttctcgcggtggtgggcgaggtaggaagaggaaccgttgggcatcacgctctgactggggtagttctcgttc

SEQ ID NO: 16603 - protein, 557 aa, Panicum virgatum
  misc_feature: Ceres CLONE 1789666
  misc_feature (180)..(350): Pfam Name: DEAD Pfam Description: DEAD/DEAH box helicase
  misc_feature (419)..(495): Pfam Name: Helicase_C Pfam Description: Helicase conserved C-terminal domain
  misc_feature (22)..(52): Pfam Name: WW Pfam Description: WW domain
MSGGTGSSGRAAPRYAPDDPSLPKPWRGLVDGTTGYLYYWNPETNVTQYEKPTRPEDQLPPPPPPPPLPPPPPRSRDRRERSRSRSRSPPRRDHRDRDRERDRDRRHDEHASSKAAASHRHPAPAAAAVPDDPSTEAYRRRHEITVTGDNVPPPITSFEAGGFPSEILKEIQRAGFASPTPIQAQSWPIAMQSQDVVAIAKTGSGKTLGYLLPGFMHIKRLQNSTRNGPTVLVLAPTRELATQILDEAVKFGRSARISCTCLYGGAPKGPQLRDLDRGVDVVVATPGRLNDILEMRRVSLKQVSYLVLDEADRMLDMGFEPQIRKIVKEIPHSRQTLMYTATWPKEVRRIADDLLVHPVQVTIGSVDELVANSAITQHVEVITPSEKLRRLEQILRSQDSGSKVLIFCTTKRMCDQLARTLTRQFSASAIHGDKSQSEREKVLNHFRSGRSPILVATDVAARGLDIKDIRVVINYDFPTGIEDYVHRIGRTGRAGATGVAYTFFCDQDSKYASDLIKILEGANQKVPRDLEDMASRGGGRGRKRNRWASRSDWGSSR

SEQ ID NO: 16604 - DNA, 653 bp, Panicum virgatum
  misc_feature: Ceres CLONE 1789666-R
ggcatgagaaaacagccactgtctctgggtctgctcggcccaactcagggcacacagagcacaaaagccctccaaggtcgcattctgggaatgaccatacgaaccactctgaccacaaggatgaccatcacatggaagatgggaagatggaaaaggttgatcttgatcgctcacccagcccacaagatgacaaatctgctccatatagtcctgtgtacaatggcaaagccagtggttcgatgagccccaacggtcagccagtggttgatgctgaatctgttgatgcttcagaaaaacctgaccctacatctcctgtgcgcaacagcaagagcagagatgatgaagaggaaggtatcatagatgaggatggagagatagctgaggatgatcctcgatcaaatgctgcagctacacagaatggtgataactgactgtgttcgatatataatggctgtgtggctccctgcatctgcttgtgacaaccagattatctcttttatgcaagctgatcatatcaccaagttgagtatgcggatatgcatttgtatctcattaaaacatcatttcttttgtggttgtggagcatactgtggtgatacctgtgttgtttgtgaaccaaaaccagaaatctatgtcatgttatgtttgttatt

SEQ ID NO: 16605 - DNA, 1241 bp, Panicum virgatum
  misc_feature: Ceres CLONE 1789668
  misc_feature: Encodes the peptide sequence at SEQ ID NO. 16606
aatttccccgaactccgccctgcgcctttgtcgcctttccgcacgcgccgtccgattcgatcgctttgatcgaccaggcatggccgacgagaccaagcaagaagccgcacccgccgccgccgccgcggcggccgaggagaagcccgcaccggcggccgaggagacggccgtggcggcggtcgaggagaaggccgtggaggcggtcgaggagaaggccgcggaggcggactcggaggaggagaagaaggcggaggaggccctggaggcggccgcgggcgacgaggccgcggtgatcgacggcgccgggtcgttcaaggaggagagcaacctcgtgtccgacctgcccgacccggagcgcaccgcgctcgcgcagctcaaggagctcgtggccgccgcgctcgccaacggggagttcgacctgcccccgccgccgccgcccaaggaggagccggccaaggaagaggcggcgccggccaaggacgaggcgaccaaggaagaggcggcgccggtcaaggacgaggagcccaaggctgagacggcggcctccgaagagcccgccaaggaggaggccaagcttgcggccgakgagcccaaggcggakgcgcccgcagaagctgcggccgaggaggtcagggctgaggctcctgcgccagaggagcccaakgccgaggaggctgccccatcgaaggagcccaaggccgaggagcctgccaaggaggaggaggaacccwaggccgaggcggcgtccgaggagcctgccaagccatcggagccggaggagaagaccgtcgtggtggccgaggaggaaggcaccaaggcggtggaagccatcgaggagaccgtagtcccckccgcgtccgagccagccgccgccaccgctgaggccgaggcgccggcggccgagcccaaggaggagctcatctggggcgtgccgctggtgggcgackacgagcgcacggacacggtgctgctcaagttcctccgcgcgcgcgagttcawggtgaaggaggccatggccatgctcaagtcggcggtgctgtggcgcaagcgcttcggcatcgacgagctcctgggcgccgacctcggcctgccggagctggagaaggtggtgttctacckcggcgccgaccgcsagagccaccccgtctgctacaacgtctacggcgagttccaggacaaggagctctacgagaaggccttcgtcgacgaggagaagcgggagcgcttcctcaagtggcgca

SEQ ID NO: 16606 - protein, 387 aa, Panicum virgatum
  misc_feature: Ceres CLONE 1789668
  misc_feature (260)..(330): Pfam Name: CRAL_TRIO_N Pfam Description: CRAL/TRIO, N-terminus
  misc_feature (169)..(169): Xaa is any aa, unknown, or other
  misc_feature (174)..(174): Xaa is any aa, unknown, or other
  misc_feature (195)..(195): Xaa is any aa, unknown, or other
  misc_feature (218)..(218): Xaa is any aa, unknown, or other
  misc_feature (258)..(258): Xaa is any aa, unknown, or other
  misc_feature (290)..(290): Xaa is any aa, unknown, or other
  misc_feature (307)..(307): Xaa is any aa, unknown, or other
  misc_feature (347)..(347): Xaa is any aa, unknown, or other
  misc_feature (352)..(352): Xaa is any aa, unknown, or other
MADETKQEAAPAAAAAAAEEKPAPAAEETAVAAVEEKAVEAVEEKAAEADSEEEKKAEEALEAAAGDEAAVIDGAGSFKEESNLVSDLPDPERTALAQLKELVAAALANGEFDLPPPPPPKEEPAKEEAAPAKDEATKEEAAPVKDEEPKAETAASEEPAKEEAKLAAXEPKAXAPAEAAAEEVRAEAPAPEEPXAEEAAPSKEPKAEEPAKEEEEPXAEAASEEPAKPSEPEEKTVVVAEEEGTKAVEAIEETVVPXASEPAAATAEAEAPAAEPKEELIWGVPLVGDXERTDTVLLKFLRAREFXVKEAMAMLKSAVLWRKRFGIDELLGADLGLPELEKVVFYXGADRXSHPVCYNVYGEFQDKELYEKAFVDEEKRERFLKWR

SEQ ID NO: 16607 - DNA, 581 bp, Panicum virgatum
  misc_feature: Ceres CLONE 1789671
  misc_feature: Encodes the peptide sequence at SEQ ID NO. 16608
gctatctcctatcgtctcctcacttgcagcgcactaccccgttcccaatccttattgctcttctcctgaccctcggcgatccttcccccccttcaagatgccaatctttgtgactaccttgacggccaagactatcaccctcgagggggagtcctccgacaccattgataacgtcaaggcaaacatccaggacaaggagggcctccccccggatccgcctacgcttatctgctgcggcacttagctggaggatgggcatgctcttgcggactacaacatccggaaggagagtaccctccacctggtgctccgcctgaggggaggcatgcacatcttcatgaacactttgaccgccctgactatcaccctcgaggtggagtcctccgacaccattgactacgtcgaggcaaatatccaagacaaggacggcatccccccggaccaccggaggcttatcttcgccggcgagcatctggaggatggacgcactcttgcggactactccatccgcaacgagagctccctatgcctggtgctccgcctgaggggaggcatgatcatcttcgtgaagaccttgaccg

SEQ ID NO: 16608 - protein, 85 aa, Panicum virgatum
  misc_feature: Ceres CLONE 1789671
  misc_feature (6)..(74): Pfam Name: ubiquitin Pfam Description: Ubiquitin family
  misc_feature: Useful for making plants with modulated nitrogen use efficiency
  misc_feature: Useful for making plants with modulated cold sensitivity
MHIFMNTLTALTITLEVESSDTIDYVEANIQDKDGIPPDHRRLIFAGEHLEDGRTLADYSIRNESSLCLVLRLRGGMIIFVKTLT

SEQ ID NO: 16609 - DNA, 263 bp, Panicum virgatum
  misc_feature: Ceres CLONE 1789671-R
cgggcgcgcgcgcgcgagacccgcgggcagaggagcgagaagggaacccaggaggacagggcggcggccgcggggcagcaccaccccccgccccgggaacccgcccaacagcagccgggggccgggagcggggacgacgggcccgccggggcccgacgagccagccggggccaaccggcggccgggcggcaaggaaggcaccagaacgggggaagagcacagaggcgaggagcgcgacgagggggcgacgaccagggacggag

SEQ ID NO: 16610 - DNA, 735 bp, Panicum virgatum
  misc_feature: Ceres CLONE 1789682
  misc_feature: Encodes the peptide sequence at SEQ ID NO. 16611
aaacgcatcgagctcagactcagagaactgaaaagccaaagaagaacctctccctctcgtttcctgcacgaatccggcttccatccatcgatcggaacaccacacactgccagccggacgcagccgatcaagggcaatgggcgagctgatccccgggttgccggaggaagtggcgcgggagtgcctcgtccgggtgggcttcgaccagctgcccgtggtgcgccgcatctcgcgccagtggaagtcggagttggagtcgccggactaccaccgcctgcgccgggccgaggggctggcgcgcccggtgctcgcgctggtccaggcgagccccgcgccgccggccgacagcgacgcgggcacggctgcggacaagcagcgctcctcggcggcgggccccgcgaactcgtaccggatggtgctgctggacccggaggagggccggtgggcgccgctgccggcgccgcccgggccggcggggagcctgcccctgttctgccaggtggccgccgtgggcggcggcgggcaggggcggaagcggctggtggtcgtcggcggctgggacccggagacgtgggcgccggtggacgcggtgctcgtgtacgacttcctgaccggcgcgtggcgccgcggcgcgccgatgccgggcccccgccggtccttcttcgcctgcgcggccgtcggcggggccgtgtacgtggccggcggccacgacgaagagaagaacgcgctgcggtc

SEQ ID NO: 16611 - protein, 199 aa, Panicum virgatum
  misc_feature: Ceres CLONE 1789682
  misc_feature (118)..(169): Pfam Name: Kelch_1 Pfam Description: Kelch motif
  misc_feature (3)..(50): Pfam Name: F-box Pfam Description: F-box domain
MGELIPGLPEEVARECLVRVGFDQLPVVRRISRQWKSELESPDYHRLRRAEGLARPVLALVQASPAPPADSDAGTAADKQRSSAAGPANSYRMVLLDPEEGRWAPLPAPPGPAGSLPLFCQVAAVGGGGQGRKRLVVVGGWDPETWAPVDAVLVYDFLTGAWRRGAPMPGPRRSFFACAAVGGAVYVAGGHDEEKNALR

SEQ ID NO: 16612 - DNA, 2291 bp, Panicum virgatum
  misc_feature: Ceres CLONE 1789683
  misc_feature: Encodes the peptide sequence at SEQ ID NO. 16613
agagaggagagagagccaaggcgcgctgctgcgcaggtgtacatactggctggagagagaatagccttgggctgatttcatgagcaagggaagggatcgcgctctacctgcagcgcgtaacagcaatccttccacttctacacagtgagagactcaggtttgcagctgtaagtacaaggttctagaagcttctaccaggagcgaggcgccgccatgggcaacgtgtgcttctgcggcaccacgtccacctcccccgatcagcctgaagcagcatctgccaaagcgccgccacagggagccaccaagaggccggcgacgcctccgagcagtcaggggaccagccaagagccgagcccgaagccgaagccgaggcccaaggctaaccccaagcccaacctgtacgactgggcgccgccgccggggcagcagcacgcggcgtcccgcggcggcggcggggcgacggcggcgcgcgtgctggacggcgtggtgccgcaccacccgcgcctgcgcgtgacggacaagtaccacctcggccgggagctcggccgcggcgagttcggcgtcactcggctcgccaccgaccgcgccacgcgggagcggctggcgtgcaagtccatcccgaagcggcgcctccgcacggcggtggacgtggcggacgtccggcgcgaggtagccatcatggcgtcgctgcccgaccacccggcgctcgtgcgcctccgggcggcctacgaggacgccgaggccgtgcacctggtgatggagctctgcgacggcggggagctgttcgaccggatcgtggcgcgcgggaggtacacggagcgcgccgcggcggcggcggcgaggaccgtggcggaggtggtgcgggcgtgccacgcgcacggggtgatgcaccgggacctcaagcccgagaacttcctgtacgccggcaagagcgaggacgcgcagctcaaggccatcgacttcggcctctccgtcttcttcaaaccaggcgagcggttcacggagatcgtgggcagcccgtactacatggcgccggaggtgctccggcggaactacgggccggaggtggacatctggagcgccggcgtgatcctgtacatcctcctctgcggcgtgccgcccttctgggcggagacggagcagggcgtggcgcgcgccatcctccgcggcagcctggacctgcagcgcgagccctggccccggatctccgagggcgccaagagcctcgtccgccagatgctccagatggacccccggaagcgccccaccgcgcagcaggtgctcgagcacccgtggctgcagaacgcacgcaaggcgccgaacgtgccgctgggcgacgtcgtgcgcgcgcggctgcagcagttctcggccatgaacaagctgaagaagaaggcgatgcgggtgatcgcggagcacctgtcggtggaggaggtggaggtgatccgggacatgttcgcgctcatggacacggacaaggacggccgggtgacgctgcaggagctcaaggccgggctcaagaaggtcgggtccaagctcgccgagccggagatggagctgctcatggaggccgccgacgtgaacggcaacgggtacctggactacggcgagttcgtggcgatcaccatccacctgcagcggctctccaacgacggccacctccgcacggcgttcctcttcttcgacaaggacagcagcggctacatcgagcgcgccgagctggccgacgcgctcgccgacgagagcggccacaccgacgaggccgcgctcaacaacgtcctccgggaagtcgacaccgacaaggacgggcggatcagcttcgacgagttcgtggcgatgatgaaggccgggacggactggaggaaggcgtcgcggcagtactcgagggagcggttcaagacgctgagcaacagcctcatgaaggacggctcgctcggcatggcgcgctgacggaggtcgacgacggcgacgctcagaaatcgatgcgatgcgatgcttggtttttttggatgcatacaacatcaatttgatggttatatggctgcctgtctgtgtatatttgttgaaggatatctgaatctttggtagggttaagctggagtgtatgaactttgtgctgcctgtaattacgtagtagtaccgtacaaaggaatcgtaggtaccccaaaatgtccattgcagaatttgtttcgtggtgatgtggattcatttcagtataacagcagacacctctttttttttaatatagaacgcatgtttcattaagaggaaaatagcagacactctaattctgt

SEQ ID NO: 16613 - protein, 577 aa, Panicum virgatum
  misc_feature: Ceres CLONE 1789683
  misc_feature (104)..(362): Pfam Name: Pkinase Pfam Description: Protein kinase domain
  misc_feature (517)..(545): Pfam Name: efhand Pfam Description: EF hand
  misc_feature (409)..(437): Pfam Name: efhand Pfam Description: EF hand
  misc_feature (445)..(473): Pfam Name: efhand Pfam Description: EF hand
  misc_feature (481)..(509): Pfam Name: efhand Pfam Description: EF hand
  misc_feature: SWISSPROT Homolog: EC 2.7.11.1 Non-specific serine/threonine protein kinase
  misc_feature: The sequence is a functional homolog of SEQ ID NO 2 in US patent 7084323
MGNVCFCGTTSTSPDQPEAASAKAPPQGATKRPATPPSSQGTSQEPSPKPKPRPKANPKPNLYDWAPPPGQQHAASRGGGGATAARVLDGVVPHHPRLRVTDKYHLGRELGRGEFGVTRLATDRATRERLACKSIPKRRLRTAVDVADVRREVAIMASLPDHPALVRLRAAYEDAEAVHLVMELCDGGELFDRIVARGRYTERAAAAAARTVAEVVRACHAHGVMHRDLKPENFLYAGKSEDAQLKAIDFGLSVFFKPGERFTEIVGSPYYMAPEVLRRNYGPEVDIWSAGVILYILLCGVPPFWAETEQGVARAILRGSLDLQREPWPRISEGAKSLVRQMLQMDPRKRPTAQQVLEHPWLQNARKAPNVPLGDVVRARLQQFSAMNKLKKKAMRVIAEHLSVEEVEVIRDMFALMDTDKDGRVTLQELKAGLKKVGSKLAEPEMELLMEAADVNGNGYLDYGEFVAITIHLQRLSNDGHLRTAFLFFDKDSSGYIERAELADALADESGHTDEAALNNVLREVDTDKDGRISFDEFVAMMKAGTDWRKASRQYSRERFKTLSNSLMKDGSLGMAR

SEQ ID NO: 16614 - DNA, 2200 bp, Panicum virgatum
  misc_feature: Ceres CLONE 1789690
  misc_feature: Encodes the peptide sequence at SEQ ID NO. 16615
attccgtctccctcttctcttcttccagggagagctcgagctcttcctcctctcacagctccgcccagcccggcagcccccacccccgcaccgcgccgccatggcgtcctccacctcctcctgcgacgcaacggccgtgccgttcaccctcctgggcgcgctcctcaccgcgggtccggctgcctggccggcctgcgtcggcgggggccgagccttcctccgcgactacgcccagcggggcaccaacgcgctgctctgggcggtcctcctcgccgtcacctgggtccttctcctccgcgtcgcggcgctgcttcgcctctgggccctcggctcccgcatcccagggccccgcgcgctcctcgccgaccccgggctcgccgacgtcctacgcaccggcggcgacatcaccggtttcctgtcaaaattgcatagcagctatggtccagttgttcgcctatgggtaggaccctctcaactacttgtatcagttaaagaccctactctagtcaaagaggtgctaacaaaggctgaagacaagttagcattgactggtagaacatataatttagcttgcggaagacttggtctatttgtgtcctcatttgacaaggtcaaaagtacgagagaatctctgaaaatatttttgaatgagaaacttacaattggtggcggtcgaaactcattcaaagttattgatgctatcctgtatagaatcgactctagtatgtccaaggattttctggacagtagatctttctcccagcacatggcatttaacatcattggtgcaactctttttggtgatgccttcttggattggtctgacgctgttacttatgaggaacttcttatgatggttgcaaaggatggttgcttctgggcttcttatgcagtttgtccattttggaagcctagttataggaggtaccggaccctatgtgctaagctgaagatattaactgagagcatcataagaaaatcaagagaccaaaacagttcagttcatcactttgatcagagatcctatcagaaaagtgaaggaatgatgacaggccattctctccttggggctgctgaaggaccacatagttcagaagaggaattatgtggaaacaccataggtttgatgttgcatggtatttccacttctgctaacttgatcggtagcgttttaacaaggcttaccgtattcccgaaattgcaagatcagctacatgcggagattgttgcagcctgcaatgaatcacctgaactggaagttgatgatgtgcttaggatgcgacttctacttgctgctgtacgtgaatctgctcgccttttgcctgcaggacctcttctgcagaggtgttcattgaaacacgatttgactcttggcttgggcatcactgtgccagctggagcaatattggtaattcctttgcatcttatccaaatggatgcttctgtatggggcaatgatgctggccagttcaatcctcatcggttcctcaaaaaggacattgatcttggagatatattagcagcgcccagtggcttgaatgggatgaatctttccagcgactgtgctaagactgagtcatttcttccatttggttctggaagtcgagcatgtgttggccagaagtttgtgattcttgcgatatcgatattgattgccagtctgctccgcaactatgaggtacagcctcatccaagtttgtctaaagaagtgggctcagaagttgacagcagccactttcaccatcttccaaattctaagatcatcctcacaaaaagaaggatctaactggagggtttggcaaatgaaaatttgacgtgtttgctttcactatgttgttttttactggtgttacaccaggatgcgatctctagtttcctaccgtcgttagaccatgctgaagtttggaaaggcgatactttgcgatgtggaagttatatctttttttcctccatatttttgacagacccggtgtgcttcgtccgatctagtttttgttgggttttttgagcacccacgggctgttggatcacaggtgtatgctgatgtatgtgcataaacaagttggggtttttaagttggagttttctcctctctctaggaggaatgtaatgtccaatgtatcatgttgtcttatactactaatgtactagaaagccatgcgcagcgttgctgcgcagccaagttattggaccagtatgt

SEQ ID NO: 16615 - protein, 561 aa, Panicum virgatum
  misc_feature: Ceres CLONE 1789690
  misc_feature (80)..(550): Pfam Name: p450 Pfam Description: Cytochrome P450
  misc_feature: SWISSPROT Homolog: EC 1.14.14.1 Unspecific monooxygenase
MASSTSSCDATAVPFTLLGALLTAGPAAWPACVGGGRAFLRDYAQRGTNALLWAVLLAVTWVLLLRVAALLRLWALGSRIPGPRALLADPGLADVLRTGGDITGFLSKLHSSYGPVVRLWVGPSQLLVSVKDPTLVKEVLTKAEDKLALTGRTYNLACGRLGLFVSSFDKVKSTRESLKIFLNEKLTIGGGRNSFKVIDAILYRIDSSMSKDFLDSRSFSQHMAFNIIGATLFGDAFLDWSDAVTYEELLMMVAKDGCFWASYAVCPFWKPSYRRYRTLCAKLKILTESIIRKSRDQNSSVHHFDQRSYQKSEGMMTGHSLLGAAEGPHSSEEELCGNTIGLMLHGISTSANLIGSVLTRLTVFPKLQDQLHAEIVAACNESPELEVDDVLRMRLLLAAVRESARLLPAGPLLQRCSLKHDLTLGLGITVPAGAILVIPLHLIQMDASVWGNDAGQFNPHRFLKKDIDLGDILAAPSGLNGMNLSSDCAKTESFLPFGSGSRACVGQKFVILAISILIASLLRNYEVQPHPSLSKEVGSEVDSSHFHHLPNSKIILTKRRI

SEQ ID NO: 16616 - DNA, 1048 bp, Panicum virgatum
  misc_feature: Ceres CLONE 1789693
  misc_feature: Encodes the peptide sequence at SEQ ID NO. 16617
cgraaatggtccccgccgccgccatggccaccgccgcgtccgctggcatgcctccactcagcgggccccgcggccgcgcgcggcgccgcagccgcggcgccatcgtgcgctgcgccgcgktggcgggcggcccggccgaggcgccggcctccgcgggcgcgcgggtgtccgcggactgcgtcgtggtgggcggcggcatcagcgacctctgcaccgcgcaggcgctggccacgaagcacggcgtcggggacgtgctcgtcacggaggcccgcgcccgccccggcggcaacatcaccaccgtcgagcgccccgaggaagggtacctctgggaggaggggcccaacagcttccagccctccgaccccgtcctcaccatggccgtggacagcgggctcaaggacgacttggtgtttggggacccgaacgcgccgcggttcgtgctgtgggaggggaagctgaggcccgtgccatccaagcccgccgacctcccgttcttcgatctcatgagcatccctggcaagctcagggctggacttggggccctcggcatcagaccgccgcctccaggccgcgaggagtctgtggaggagttcgttcggcgcaacctcggggctgaagtctttgagcgcctcatcgagcctttctgctcaggtgtctatgctggtgatccttcgaagctcagtatgaaagctgcatttgggaaggtgtggcgcctggaagaggctggaggtagtatcattggtggaaccatcaagacaattcaggagaggggcaagaatcctaaaccaccgagggatccccgccttccaaagccaaaggggcagacagttgcatctttcagaaagggtctcgccatgctgccaaatgccattacatccagcttgggtagtaaagtcaagctttcctggaaactcacgagcattacaaaatcagatggcaagggatatgtattggtgtatgaaacacctgaaagggttgtttcagttcaggctaaaagcgttgtcatgacgattccatcatatgttgctagtgaactcttgcgtccact

SEQ ID NO: 16617 - protein, 341 aa, Panicum virgatum
  misc_feature: Ceres CLONE 1789693
  misc_feature: SWISSPROT Homolog: EC 1.3.3.4 Protoporphyrinogen oxidase
  misc_feature (33)..(33): Xaa is any aa, unknown, or other
MATAASAGMPPLSGPRGRARRRSRGAIVRCAAXAGGPAEAPASAGARVSADCVVVGGGISDLCTAQALATKHGVGDVLVTEARARPGGNITTVERPEEGYLWEEGPNSFQPSDPVLTMAVDSGLKDDLVFGDPNAPRFVLWEGKLRPVPSKPADLPFFDLMSIPGKLRAGLGALGIRPPPPGREESVEEFVRRNLGAEVFERLIEPFCSGVYAGDPSKLSMKAAFGKVWRLEEAGGSIIGGTIKTIQERGKNPKPPRDPRLPKPKGQTVASFRKGLAMLPNAITSSLGSKVKLSWKLTSITKSDGKGYVLVYETPERVVSVQAKSVVMTIPSYVASELLRP

SEQ ID NO: 16618 - DNA, 517 bp, Panicum virgatum
  misc_feature: Ceres CLONE 1789693-R
  misc_feature: Encodes the peptide sequence at SEQ ID NO. 16619
tttccaagagtgaaagtgagctggtagaagcagttgaccgtgacctcaggaaaatgctaatcaaccctagagcagtgaatcctttagtgctcggtgtccgagtgtggccacaagccatacctcagttcctggtaggacattttgatcttttggaggctgcaaaatctgccctggaccgaggtggctacgatgggctgttcctcggaggtaactatgtagcaggagtcgccctgggccgatgcgtggagggtgcctatgagagtgcctcacaaatatctgacttcctgaccaagtacgcctacaagtgatgaaagaggtggagctgctcgttattttgcataggtgagatgaaaccaggagcgacacaaagtttacgagcatttttttcccaccttatttcgtaaattgtactacttctgatccttttttttttttgtgagtaattagttagattgtagggatgtgggacattgttctattagccatcctactaaacttatttattttgacgttcgtc

SEQ ID NO: 16619 - protein, 101 aa, Panicum virgatum
  misc_feature: Ceres CLONE 1789693-R
  misc_feature: SWISSPROT Homolog: EC 1.3.3.4 Protoporphyrinogen oxidase
SKSESELVEAVDRDLRKMLINPRAVNPLVLGVRVWPQAIPQFLVGHFDLLEAAKSALDRGGYDGLFLGGNYVAGVALGRCVEGAYESASQISDFLTKYAYK

SEQ ID NO: 16620 - DNA, 2135 bp, Panicum virgatum
  misc_feature: Ceres CLONE 1789698
  misc_feature: Encodes the peptide sequence at SEQ ID NO. 16621
tcgcgtcctctttccccctccgcaacaaagcagcgaagccgctcgcctccgccgccgccgccacccccaccccaaactcacgctcgctcgccgacgactgcctccaccctcgcgccatgtaccgcgcggcagcgagcctcgcctccaaggcgcggcaagccgggagcagcgccgccgctcgccaggttgggagcagacttgcctggaccagaaactatgctgccaaggatatcaagtttggtgttgaggctcgtgctctgatgctgaggggtgttgaggaattggctgatgcggtcaaagtgacgatgggtcctaagggtcgcaatgtggttattgaacaaagctttggtgcacctaaagtcacaaaggatggtgtgactgttgctaagagcattgaattcaaggatagagtaaagaatgttggtgcgagccttgtgaagcaggttgccaatgcaactaatgacactgctggagatggtaccacatgtgcaactgttttaacaaaagcaatattcactgaggggtgcaagtctgttgcggctggaatgaatgctatggatttaaggcgtggaatctcaatggctgttgatgctgttgtgaccaatctgaagggtatggccagaatgattagcacgtcagaagagattgcacaggtgggtacaatatcagcaaacggggaaagggaaattggtgagctaattgccaaggccatggagaaggttggcaaagagggtgtaatcaccattgcggatggtaacaccctttacaatgagcttgaagttgttgagggcatgaaactcgacagaggttacatctctccgtacttcattaccaactcaaaaacccaaaaatgtgaactggatgacccattaattttgattcatgacaagaaggtttcgaacatgcatgcagtggttaaagttttagagatggcccttaagaagcagaggcctctactaattgttgcagaagatgtggaaagtgaagcattgggcactctgattattaacaagcttcgtgctggcatcaaggtctgtgccgtcaaagctcctggttttggggaaaacaggaaggcaaacttacaagaccttgctatccttactggaggagaagtcataaccgaagaacttggaatgaaccttgagaatgttgagcctcacatgttgggtacatgcaaaaaggtgacggtctctaaggatgacactgttattcttgatggagctggagacaagaagtccattgaagagagggcagagcagattagatctgcaattgagaatagcacatctgattacgacaaggaaaagctacaagagcggttggcaaagctctctggaggtgttgctgttctaaagattggaggagccagcgaagctgaagttggtgagaagaaggatagagtgacagatgcgttgaacgctactaaagcagctgtggaagagggcattgtgccaggcggcggtgttgctcttctctatgcatcaaaggagctcgataaattgcagactgcgaacttcgatcagaagattggtgtacagattattcagaatgccctgaagacccctgtgcacactattgcttccaatgctggtgtggagggagcagtggtcgtgggcaagcttttggagcaaggaaacactgaccttggttatgatgctgctaaaggtgaataggttgacatggtgaaggccggtatcattgacccacttaaagtgatcagaactgccctggttgatgctgctagcgtgtcatccctgatgaccaccacggagtccatcattgtagagatccccaaggaggagacaccggcaccggcaatgggaggcatgggtggaatggactactaaggcaccacacccaattttgagtctgcggatggaggacctctcgggagttccaaacggaaccggtgtgagaataataaacggtagctgttgagagctggagcggtagatcaaaattggattctgacaccttgtgccggactttctgcactgaaaaaccacaatttttttggcggtgggtatatcgtggatttcctttctgcttgctcttgcatcatcgaccggtgaatggatgcaaaggtggaaattctttgtgtaattttcagagtggagtttgttgaattcctcttt

SEQ ID NO: 16621 - protein, 518 aa, Panicum virgatum
  misc_feature: Ceres CLONE 1789698
  misc_feature (56)..(518): Pfam Name: Cpn60_TCP1 Pfam Description: TCP-1/cpn60 chaperonin family
MYRAAASLASKARQAGSSAAARQVGSRLAWTRNYAAKDIKFGVEARALMLRGVEELADAVKVTMGPKGRNVVIEQSFGAPKVTKDGVTVAKSIEFKDRVKNVGASLVKQVANATNDTAGDGTTCATVLTKAIFTEGCKSVAAGMNAMDLRRGISMAVDAVVTNLKGMARMISTSEEIAQVGTISANGEREIGELIAKAMEKVGKEGVITIADGNTLYNELEVVEGMKLDRGYISPYFITNSKTQKCELDDPLILIHDKKVSNMHAVVKVLEMALKKQRPLLIVAEDVESEALGTLIINKLRAGIKVCAVKAPGFGENRKANLQDLAILTGGEVITEELGMNLENVEPHMLGTCKKVTVSKDDTVILDGAGDKKSIEERAEQIRSAIENSTSDYDKEKLQERLAKLSGGVAVLKIGGASEAEVGEKKDRVTDALNATKAAVEEGIVPGGGVALLYASKELDKLQTANFDQKIGVQIIQNALKTPVHTIASNAGVEGAVVVGKLLEQGNTDLGYDAAKGE

SEQ ID NO: 16622 - DNA, 573 bp, Panicum virgatum
  misc_feature: Ceres CLONE 1789706-R
  misc_feature: Encodes the peptide sequence at SEQ ID NO. 16623
ggacaacctgccccggaccctcctcctgtaccacgccaacatcatctcctcgccggagttctacttccagacggtggcctgcaactcgcggcggttccgcaacgccaccgtgaaccacgacctgcacttcatccggtgggacaacccgcccaagcagcacccgctgcacctcaccgccagggactaccgccggatgctgctcagcggcgcccccttcgcgcgcaagttccgggagggcgacccggtgctggaccgaatcgaccgggacatcctgcgccggcgggggcccgcccagttcgcctacggcgggtggtgcgccggggacggggacggggacgccggcgcggcgctgtgcggcaacccacaggagcccgggaggaagagggccgtcagggccggcgccgggtcgcgccggctcaaggtgctgctgggcaaggcgctcgccccggggaacctacggagaaagcagtgtaggtgaaataaactgtttggaatgggctttttttatttaggaagaagcccatttttaaccatctaactattgttcaagtttaattttggttatcgaaccgc

SEQ ID NO: 16623 - protein, 158 aa, Panicum virgatum
  misc_feature: Ceres CLONE 1789706-R
  misc_feature: Useful for making plants with altered carbohydrate content
DNLPRTLLLYHANIISSPEFYFQTVACNSRRFRNATVNHDLHFIRWDNPPKQHPLHLTARDYRRMLLSGAPFARKFREGDPVLDRIDRDILRRRGPAQFAYGGWCAGDGDGDAGAALCGNPQEPGRKRAVRAGAGSRRLKVLLGKALAPGNLRRKQCR

SEQ ID NO: 16624 - DNA, 466 bp, Panicum virgatum
  misc_feature: Ceres CLONE 1789706
aatccaatccaatccatccatccatcaaaagggccaagaaactgactggttggttggttggtgggtgggtgggacgagctaaaccaccaccatcaatcggagggagctccgcacgcacccctgcacacgcacacatcaagaaaactcacccccaacagatacccacaaatcacccaccgaccctcaccttccccaacctaaaccacgaaacggtcccccccgcccctgcacagcagagcgtgaccaccctctccacgtacacctcaaccaacctcgatgataagccatccagaacacacacccccgcaaccctcgacatcgcaccctctcgcttgcacttagcccacgaatcccccaagaagcaaccaatcacacacctctcccacatccaacactcgaacaacctcagctacgcctacaacaacgaactatatccactcaacaagcacaagctgccggcgctcca

SEQ ID NO: 16625 - DNA, 1124 bp, Panicum virgatum
  misc_feature: Ceres CLONE 1789712
  misc_feature: Encodes the peptide sequence at SEQ ID NO. 16626
cttctctaatcagcttctatccatctggccattgaataatctccgatatcctgtcaaaaaaaaaactccgatagctagcagcttgcctgattgatcatcccggaagatcaagcactgaaactccaatttcagttcagttatcaccgaggacactgactgaagtagagatggcggagcgttcagagaacgcggcgggggacatgatgagcaacatcatggacgccatcgccgagaacctcccgaacaagaagtccgtcaggttcgacgacggcgagggctccatctccgaccaggccaggaagctgttcggcggcggcaggcagagcggcaagaagtccgtccaccacgtcctgggcggcggcaagtccgccgacgtgctgctgtggcggaacaagaagatctcgtcgagcgtgctgggcgcagcgacgctgtcctgggtcttcttcgagtggctcgactaccacttgctcaccatcgccagcttggcgctggtgctcggcatggccgtgcagctcgcctggtccgcgctcgcctcgaacgtgccccgcctcgaggtgccggaggaggtgttggccgacgctggcagggccgccggcgcgcaggtgaaccgggccctgggcgcgctccaggacatctcctgcgggagggacctgaggcggttcctcatcgtgatcgccgtgttcttcgcggtcgcggtcgtcgggagcttctgcaacttgctgacggtcatctacatcgggttcgtgtgcgcgcacacgctgccggtgctgtacgagaagtaccaggaccaggtggacgagttcctgtgcagcatgctgggcctgctgcagcaccagtaccagaagctcggcagcaagggcgtcctcggcaaagggaaggccaggaagagcgactagctggttggttcgatctgctctgcctgtgtaacataatctgctggggcggacggctggtccactgatacgcctgtctgcatgtacgcagccagctgcggtttcctgaaaccaactcgatgcctgtacagtgctgaaagtacttgcttgtgtaatgcactacagtaatgctttagtagcttcgaaaacagcgcattaaacgaggttcttcttgggagctgtagcgacctc

SEQ ID NO: 16626 - protein, 242 aa, Panicum virgatum
  misc_feature: Ceres CLONE 1789712
  misc_feature (67)..(241): Pfam Name: Reticulon Pfam Description: Reticulon
MAERSENAAGDMMSNIMDAIAENLPNKKSVRFDDGEGSISDQARKLFGGGRQSGKKSVHHVLGGGKSADVLLWRNKKISSSVLGAATLSWVFFEWLDYHLLTIASLALVLGMAVQLAWSALASNVPRLEVPEEVLADAGRAAGAQVNRALGALQDISCGRDLRRFLIVIAVFFAVAVVGSFCNLLTVIYIGFVCAHTLPVLYEKYQDQVDEFLCSMLGLLQHQYQKLGSKGVLGKGKARKSD

SEQ ID NO: 16627 - DNA, 2381 bp, Panicum virgatum
  misc_feature: Ceres CLONE 1789728
  misc_feature: Encodes the peptide sequence at SEQ ID NO. 16628
ctactccccccccctgctgatcacagcgcatcgcatctctctcttgctccgctcgcagaaccccgcctccggcgcggctccggcgccgcatccatctccaggagcagtcagtcccttccccgcgcggggcggtggagacggcttggttatttctcagacgtaatttggtgatgctggggctcgtttagtcatcttagtttgaagataccagctatgggtcatctgaattatagagtctctctccctctactgctctgtctacaaattttgctgccactacatccttttgctacggcagatatagcctctgagaagcaagcactccttgcttttgcctctgcagtctaccgtggcaacaagctcaattggagtccaagtataccactgtgctcatggcatggtgttacatgctcaccagatcgatcacgtatatgggcccttagggtaccaggggctggtttgattggtacaattccagctaatactcttggcaggcttgtgtccctccaagttttaagcctgaggtctaatcgtctgagtggaagtcttccatcggatgttgcctcacttccttctttacaagccatatttcttcagcacaacgaactgtcgggagacttgccttcatttttctctccaagcctcaacaccctcgatctctcttacaactcctttacaggacaaatcccattaggtttgcagaatcttacccaattatctgccctgaatttagcaggaaattccttgtctgggccaatccctgacctcaaacttccaagcctaagacagctaaatctgagcagcaatgaactaaatggttcgatccctccctttctccaaatattctcaaatagctccttcttagacaaccctggattgtgtgggccgcctctagctgtatgctcctttctatcttcacctacaccatcacaagtgcctttacttccatcatcgccacatcatgagaagaagacatgcaatggcatgataattgcggctgttgttgggggctttgtcatatttctgctagctgctgtgatgttcactatgtgcttttcaaagagaaaggacgagaaagatgaggtggcttacaacgccaaggtgactgatggtgcaaggattgagaagcgcaaagaggatgttagcagtggtgtccaaatggctcataagaacaagctggtattcttggatggatgcagttacaactttgacttggaggatttactgagggcttctgctgaggttcttggcaaagggagttatggaactgcctacaaggctatacttgaggatggcactattgtggtagtcaagaggctaaaggatgttgtggcagggaagaaagaatttgagcagcagatggagctcatagggagggtaggcaaacatgcaaacatggcacctattcgtgcttactactactcaaaggatgagaagcttgttgtttatgagtatcttcctgctggcagcttctcagctatgttgcatggtattaaaggcatttgtgagaagatcccattagactggaataccaggatgaagattatacttggaactgcatgtggaattgagcacatccattcagaaggtggctccaagttcgcccatggcaatatcaagtcaaccaatgtcctgctcgatcaagaccacaactcatatgtctcagactatggtctgagtgctttgatgagccttccaatcaacacctcccgggttgtcgccggttaccgagctccggagacctttgaatccaggaaattcacacacaagtctgacgtgtacagctttagcgtccttctcatggagatgctgactggaaaagcccccctccagtcacaggggcaggatgatgtcgttgatctaccaagatgggtgcattccgtggtccgtgaggagtggaccgccgaagtgtttgatgtccagctgatgaaatatcctaacatagaggatgagctggtccagatgctccatattgccatggcgtgcacgtcgtggtcgccagaccgacgcccaacaatggcggatgtggtccggatgatggaggagctagggcagtctgcttcccagagccgcactccctccaatggcaatcccagggagtccaatcctccatcggtgtgagtctataatttctgtgattttgatccggaattggtgaatccatgacatcgatgatatcctctattgcctttatgtggtcctgaagcttacactgttacacataggaaccacatatgctgtatgatacggcattgtatccagctgtaatgttattccctgttcatgttaaagttgttaactgggagatgttaacatttcttcctactcggatgcctaatgtctggtaacagtctcattatactatggtgttcgttgacacg

SEQ ID NO: 16628 - protein, 635 aa, Panicum virgatum
  misc_feature: Ceres CLONE 1789728
  misc_feature (339)..(609): Pfam Name: Pkinase Pfam Description: Protein kinase domain
  misc_feature (30)..(67): Pfam Name: LRRNT_2 Pfam Description: Leucine rich repeat N-terminal domain
  misc_feature: SWISSPROT Homolog: EC 2.7.11.1 Non-specific serine/threonine protein kinase
MGHLNYRVSLPLLLCLQILLPLHPFATADIASEKQALLAFASAVYRGNKLNWSPSIPLCSWHGVTCSPDRSRIWALRVPGAGLIGTIPANTLGRLVSLQVLSLRSNRLSGSLPSDVASLPSLQAIFLQHNELSGDLPSFFSPSLNTLDLSYNSFTGQIPLGLQNLTQLSALNLAGNSLSGPIPDLKLPSLRQLNLSSNELNGSIPPFLQIFSNSSFLDNPGLCGPPLAVCSFLSSPTPSQVPLLPSSPHHEKKTCNGMIIAAVVGGFVIFLLAAVMFTMCFSKRKDEKDEVAYNAKVTDGARIEKRKEDVSSGVQMAHKNKLVFLDGCSYNFDLEDLLRASAEVLGKGSYGTAYKAILEDGTIVVVKRLKDVVAGKKEFEQQMELIGRVGKHANMAPIRAYYYSKDEKLVVYEYLPAGSFSAMLHGIKGICEKIPLDWNTRMKIILGTACGIEHIHSEGGSKFAHGNIKSTNVLLDQDHNSYVSDYGLSALMSLPINTSRVVAGYRAPETFESRKFTHKSDVYSFSVLLMEMLTGKAPLQSQGQDDVVDLPRWVHSVVREEWTAEVFDVQLMKYPNIEDELVQMLHIAMACTSWSPDRRPTMADVVRMMEELGQSASQSRTPSNGNPRESNPPSV

SEQ ID NO: 16629 - DNA, 601 bp, Panicum virgatum
  misc_feature: Ceres CLONE 1789734-R
  misc_feature: Encodes the peptide sequence at SEQ ID NO. 16630
agtcttcaacaataacatctgagataaaaattaattcaacgaagtcaatgataggccattgcttaggtgcagctggtggattagaagctatagccacggtagaagctataactactggattggtgcatccgacaattaatcaatttaacccagagcatgaagttgagttcgatacagtagccaatgaaaagaagcagcatgaagtgaatgttgccatctcaaattcctttggattcggaggacacaactcggtggtagtatttgctccattcaagccgtgatccatccttgctacaaatgtatacagcctgcagcaccgtctcaccattggtaatttagagaggaatttgttagctgtagcataggatttttcctcttctttttcaccggcttcaaaggaacaagttttgattcatcgagtgatgctgtcataattggacacagctgtttagatgccaattcttttgggcgctcctgatgtatgtcctatactatacggaaaatatgaatgtaaatcaaacagtaatccatttaatatttattgttcctttgctcccaggggtggagccagggcccgtgctgcagcatgggcctagcccag

SEQ ID NO: 16630 - protein, 92 aa, Panicum virgatum
  misc_feature: Ceres CLONE 1789734-R
  misc_feature: SWISSPROT Homolog: EC 2.3.1.41 Beta-ketoacyl-acyl-carrier-protein synthase I
SSTITSEIKINSTKSMIGHCLGAAGGLEAIATVEAITTGLVHPTINQFNPEHEVEFDTVANEKKQHEVNVAISNSFGFGGHNSVVVFAPFKP

SEQ ID NO: 16631 - DNA, 147 bp, Panicum virgatum
  misc_feature: Ceres CLONE 1789734
agcgtccgaagaccccaccaaggaaaaagtttgtgatcccgggcatggagcaggtgtgcatctccggtaccgccctcacaggcttcttcgacaggtacctgaagggctatagcaggttaagatttaacaacacgcttctcaaatccc

SEQ ID NO: 16632 - DNA, 1955 bp, Panicum virgatum
  misc_feature: Ceres CLONE 1789747
  misc_feature: Encodes the peptide sequence at SEQ ID NO. 16633
cgacgggcgacgaccacccccattccttcccccaacttctcggctccccaccttcctcgccgcggaacacgcgctcccgtcccggatttgctcgttttattcgctcgagactcctccccgcggcgagtcctcgaatccaatcccatctaccgtccaatcccctcggctctgttgcggatttgtctgctgcgtggcagggtggcgtagtgcggtagccgagcgctccggccatggcgttcttccggggcctcaccgcggtctcgaggctgcgatcccgcgtggcgcaggaggccagcgcgctgggtggtgtcagatggttgcagatgcagagcgcttccgatctcgatctcaagtcccagttgcaggaactgattcccgagcaacaggatcacctaaagaagcttaaatcagagcatggaaaggtccagcttggaaacataaatgtagatatggtccttggtggaatgagagggatgattgggatgctttgggaaacatcactacttgacccagaggagggcattcgctttaggggcctctcaattccagagtgccagcaagtgctgccaacggcagttaagggtggtgagcctttgcctgagggtctcctttggcttcttttgacaggaaaggttccaaccaaagagcaagttgatgccctatcaaaggaattgctggcccgttcaagtgtcccagctcatgtctataaggcaatagatgctctccctgtaactgcacaccctatgacacagtttaccactggaataatggctcttcaggttgagagtgaatttcaaaaggcttatgacaaaggattgccaaaaacaaagttctgggagcctacttatgaagatgtcttaaatttgattgctcggcttccaccagtggcttcttatgtttaccggaggattttcaaggacgggaaatcaatagaagctgataattctctggattatgctgcgaatttttcacacatgcttggttttgacaatcccaaaatgttggagttgatgcgcctctatataacaattcacactgatcatgaaggcgggaatgtcagtgcacatactggtcatctggttggaagtgcactgtccgatccctatctttcttttgcagcggctctgaatggtttagctgggccacttcatggtctggctaatcaggaagtgcttctatggatcaaatctgtaattgaggaaactgggagtgacgttacaacagatcaactcaaagactatgtctggaagacactgaagagtggaaaggttgttcctggctttggtcatggtgttctgcgaaagacagacccacggtattcatgtcaaagggagttcgccctaaagcatttgcctgaggatccacttttccagttggtatccaagttgtatgaagtcgtgcctccaatcctcactgagcttggcaaggtgaagaacccatggccgaatgttgatgctcacagtggagttttgcttaaccactttggactatctgaagcacggtattacacagtcttgtttggtgtctcaaggagcatggggataggatctcagctcatctgggaccgtgctcttggcctaccactggagaggccgaagagtgtcaccatggagtggctggaaaactactgcaagaacaaggctgcttgaagctaaacagtggcttatttttttacacaccatgccaaatgccatctttcctgttaataagttacagtagtgttttctttcttttgcctaccccaacttgcttgggaaaaaaggctatgttgttgttgtagtgttttctttcttttggcggtccaataacaagagcaagaggctctcagacggcagaattttgtatcctccgtcactcaggacatccagatagctaatctctgtggtaccaccgggcagacgagatcagtacatgattagtctttaatacatgatggcgcatgccaattctttttt

SEQ ID NO: 16633 - protein, 472 aa, Panicum virgatum
  misc_feature: Ceres CLONE 1789747
  misc_feature (78)..(455): Pfam Name: Citrate_synt Pfam Description: Citrate synthase
  misc_feature: SWISSPROT Homolog: EC 2.3.3.1 Citrate (Si)-synthase
MAFFRGLTAVSRLRSRVAQEASALGGVRWLQMQSASDLDLKSQLQELIPEQQDHLKKLKSEHGKVQLGNINVDMVLGGMRGMIGMLWETSLLDPEEGIRFRGLSIPECQQVLPTAVKGGEPLPEGLLWLLLTGKVPTKEQVDALSKELLARSSVPAHVYKAIDALPVTAHPMTQFTTGIMALQVESEFQKAYDKGLPKTKFWEPTYEDVLNLIARLPPVASYVYRRIFKDGKSIEADNSLDYAANFSHMLGFDNPKMLELMRLYITIHTDHEGGNVSAHTGHLVGSALSDPYLSFAAALNGLAGPLHGLANQEVLLWIKSVIEETGSDVTTDQLKDYVWKTLKSGKVVPGFGHGVLRKTDPRYSCQREFALKHLPEDPLFQLVSKLYEVVPPILTELGKVKNPWPNVDAHSGVLLNHFGLSEARYYTVLFGVSRSMGIGSQLIWDRALGLPLERPKSVTMEWLENYCKNKAA

SEQ ID NO: 16634 - DNA, 1718 bp, Panicum virgatum
  misc_feature: Ceres CLONE 1789782
  misc_feature: Encodes the peptide sequence at SEQ ID NO. 16635
aggtgacggagttacctcagccaactgtttcgtcactctcctccacagatcaccagcaccagtggactcgccgcccgcgctcttcatcaattaaaaaaaagagagagaaaatcacgagccgattccattcgtccatacgctcctcgctcgttgaaagattcgcatccgatcgccagtcggatctcccctcccctttggagcgatctcgccgcgcccgaatatctggttcccgattcgattcgatccgcgccgcgcgccacccgttcgacgcaattccctcccggcgaccgccgccgccgcgctgggcaatggatgactgatcgccgccgccgagtgcccccggcgcggcgccggccatgtcgctggcctgcggcctgccgctgctcgagtgcgtctactgcctcgcctgcgcgcgctgggcctggaagcgctgcctccacaccggcgaggccgacagcgccacctggggcctcgcctctgccgccgacttcgagcccatcccgcgcatgtgccgcctcgtcatggccaactacgagcccgacctctccgcctccgcgccgctcctcttcgaccccgcctgcgtcctccgccgccgcacctacgccgacacccgcggccgcgtcaccccctacctcctctacctcgaccacgcgcacgccgacatcgtcctcgcgctccgggggctcaacctcatcaaggagtccgactacgcgctcctcctcgacaaccgcctcggcaagcgccgcttcgacggcggctacgttcacaacggcctcctcagggccgccggctgggtgctcgacgccgagtgcgacctcctcagggacctcctcgagaggtaccccgactacacgctcaccttcacggggcattccctgggcgccggcatcgccgccatgctcaccatggtcgtcgtactcaacctcgacaagcttggcaacgtcgacaggagccgaacgcgctgctacgccatggcgcccgccaggtgcatgtcgctcaacctcgccgtcagatacgccgacgtcatcaactctgtcgtcctacaggatgacttcttgccccggacagctactcctttggaggacattttcaagtcaatcctctgcttgccgtgcctcctatgtttgaggtgtttgagggatacatgtatacccgaagatgcaatgctaaaggatccaagaaggctttatgcaccaggcaggatatatcacatagtggaaagaaaaatgtgcaggtgtggaagatatccaccggtagtcaaaacagctgtgcctgtggatggtagatttgagcacattgttctttcctgcaacgccacagcagaccatgccattgtttggattgagagggaagcccaaaaggctttggatctgatgctggaggaggaggagacaatggcggttccgtcggagcagcggatggagcggaacgagaccctgcagagggagcacgtggaggagcacagggccgcgctgcgccgggccgtgacgctgtcggtgccggacgcgcgggcgccgtcgccgtacggcacgttcgacgacgacgacgccaggcggcggcggcagccggagcagccggagaggagcgagagcttcccgccggcgggggccaggcagcggatgagctggaacgacctgatcgagcgagtgttcgacaaggacgaggacggccagatcgtgctgcgcagctcggtttctccctgaacgcccccccccccc

SEQ ID NO: 16635 - protein, 448 aa, Panicum virgatum
  misc_feature: Ceres CLONE 1789782
  misc_feature (104)..(242): Pfam Name: Lipase_3 Pfam Description: Lipase (class 3)
  misc_feature (9)..(78): Pfam Name: Lipase3_N Pfam Description: Lipase 3 N-terminal region
  misc_feature: SWISSPROT Homolog: EC 3.1.1.73 Feruloyl esterase
MSLACGLPLLECVYCLACARWAWKRCLHTGEADSATWGLASAADFEPIPRMCRLVMANYEPDLSASAPLLFDPACVLRRRTYADTRGRVTPYLLYLDHAHADIVLALRGLNLIKESDYALLLDNRLGKRRFDGGYVHNGLLRAAGWVLDAECDLLRDLLERYPDYTLTFTGHSLGAGIAAMLTMVVVLNLDKLGNVDRSRTRCYAMAPARCMSLNLAVRYADVINSVVLQDDFLPRTATPLEDIFKSILCLPCLLCLRCLRDTCIPEDAMLKDPRRLYAPGRIYHIVERKMCRCGRYPPVVKTAVPVDGRFEHIVLSCNATADHAIVWIEREAQKALDLMLEEEETMAVPSEQRMERNETLQREHVEEHRAALRRAVTLSVPDARAPSPYGTFDDDDARRRRQPEQPERSESFPPAGARQRMSWNDLIERVFDKDEDGQIVLRSSVSP

SEQ ID NO: 16636 - DNA, 142 bp, Panicum virgatum
  misc_feature: Ceres CLONE 1789782-R
ccccccccccccccccgcgcctcacctgtggccccgtgtcgcagactcccagcagtagccacattcttgtgtcatttttctttttttgaaaaggacattcttgtgccattggtttagacgtttagtgtcattcattcatacc

SEQ ID NO: 16637 - DNA, 1426 bp, Panicum virgatum
  misc_feature: Ceres CLONE 1789797
  misc_feature: Encodes the peptide sequence at SEQ ID NO. 16638
gtcgctcccctgtctggctgcctgccctgcccctcccctcgcgcgctcgcctccgtctcctcgctgtgaggggacactgcccatcatctctctccctcttccctctcgcgcgtgcagttgagagagtggctcggcagcgcggcgtgcgcggacacgccaccaacggcaccggcagttactctccctccctccaggctgctcggtggcgtccaattcaatgcggccctgcacaacgggagcagggagctcttcctccattggctcgagctgcgccattgaatgcccccctctctcatcgagtcttgactgagaaacctccccctcctttaaccccccgcgctcgtcagtcgtcactgttactcgtacgtgctcgcgcacgacggttccggtaccatccctgcgtgcgtgtcactcacacacgagaggggagagggattcatcagatggtcatggagttgctctgctgagctccttgtttccttctggctgagcgtttcttggttggttctccctccctctggctccagtcagtcagcggtgagacaagatgaactacctcaggagccggagcctgaagcggctcctgtccctcggccgccggagcaacgcggacgagtccgccgaggagtgcgtcgacgccgaccctccgccgccgccgccgtacaagcccacgtggaggtgcttctcctacgacgagctccaccaggccaccgatggcttccaccaagacaacatggtgggcaagggcgggtacggcgaggtgtaccgcggcgtcctggacgacgggcgcgccgtcgccgtgaagcgcctggcgccgacggccgcggcggacgagaagaaggagaaagacttcctcacggagctgggcacggtgggccacgtccgccaccccaacgtgtgcgcgctcctcggctgctgcgtcgaccgcggcctccacctcgtcttcgagttctccacccgcggctccgtctccgccaacctccacgacttgaagctgccggtgatgtcgtggaagcagcggcacgggatcgcggtcggcacggcgcgcgggctgcgctacctccacaagggctgcgcgcgccggatcatccaccgcgacatcaaggcgtccaacatccttctcaccgccgactacgagcctcagatttcggacttcggcctcgcccggtggctgccgtcggagtggacgcaccacgccatcgcgcccatcgagggcacgttcgggtgcctggcgcccgagtacttcacgcacggcatcgtggacgagaagacggacgtgttcgccttcggcgtcttcctcctcgagctcatctccggccggaagccggtggacggctcccacaagagcctcattgcgtgggccaagccttacctgagcgacggcgtcgtgcaagggctcgtggacccgcggctcggcgacggctac

SEQ ID NO: 16638 - protein, 292 aa, Panicum virgatum
  misc_feature: Ceres CLONE 1789797
  misc_feature (58)..(289): Pfam Name: Pkinase Pfam Description: Protein kinase domain
  misc_feature: SWISSPROT Homolog: EC 2.7.11.1 Non-specific serine/threonine protein kinase
MNYLRSRSLKRLLSLGRRSNADESAEECVDADPPPPPPYKPTWRCFSYDELHQATDGFHQDNMVGKGGYGEVYRGVLDDGRAVAVKRLAPTAAADEKKEKDFLTELGTVGHVRHPNVCALLGCCVDRGLHLVFEFSTRGSVSANLHDLKLPVMSWKQRHGIAVGTARGLRYLHKGCARRIIHRDIKASNILLTADYEPQISDFGLARWLPSEWTHHAIAPIEGTFGCLAPEYFTHGIVDEKTDVFAFGVFLLELISGRKPVDGSHKSLIAWAKPYLSDGVVQGLVDPRLGDG

SEQ ID NO: 16639 - DNA, 708 bp, Panicum virgatum
  misc_feature: Ceres CLONE 1789802
  misc_feature: Encodes the peptide sequence at SEQ ID NO. 16640
ttccctcggtagcaatttgatcagcggaagcatccctgaagagatcggcaacctctcaaagctccgaagcttggacctttctgacaatctgttaggtggtagcctccctgcatcactttgcaacctcacttcgctagtcgagctcaatctcgcaggcaatgacattggaggacacatcccggaatgctttgacgggctcaagaacctgaccaagctgtccctgaagaggaatgtcctcgacggcgagattccggcagccgtcgggaacctctcggcactgtcactgctcgacgtgtcagagaacaacctcaccggtgaaattccagcctccttgagcggccttgccaacctcaattctttgaatgtgtcctacaacaatctctcaggtcccgtgcctgcggttctgtccagcaagttcaattccacctcgttcgttgggaaccttcagctctgtgggttcaacggctccgccatttgcacttccgcttcatctccgttgatgtcgccgtctcctccgctgcctttgtcggagcggcggacgcggaagctcaacaaaagggagctaatctttgcagtggggggcatcctcttgctcttcttgctcctcttctgctgcgtcctcctcttctggaggaaagacaaggaaagctcgtctcccaagaagagcgccaaggacgcgacgaccaccaagactgtcgggaagacagg

SEQ ID NO: 16640 - protein, 235 aa, Panicum virgatum
  misc_feature: Ceres CLONE 1789802
  misc_feature: SWISSPROT Homolog: EC 2.7.11.1 Non-specific serine/threonine protein kinase
SLGSNLISGSIPEEIGNLSKLRSLDLSDNLLGGSLPASLCNLTSLVELNLAGNDIGGHIPECFDGLKNLTKLSLKRNVLDGEIPAAVGNLSALSLLDVSENNLTGEIPASLSGLANLNSLNVSYNNLSGPVPAVLSSKFNSTSFVGNLQLCGFNGSAICTSASSPLMSPSPPLPLSERRTRKLNKRELIFAVGGILLLFLLLFCCVLLFWRKDKESSSPKKSAKDATTTKTVGKT

SEQ ID NO: 16641 - DNA, 713 bp, Panicum virgatum
  misc_feature: Ceres CLONE 1789816
  misc_feature: Encodes the peptide sequence at SEQ ID NO. 16642
agcttttgcttgcagctccagcaccaagcgcaggcccctcttgcattggtggctatctacgccatggccaccgtcctgagctgcaggctccgcgcgccggccagcttcatccccggcctccgcgccgccccggctcccgccgtcgccgccatgcccgccgccaagcaggttgttgcccgcggcgccaggctgcgcgcgcaggccacctacaacgtgaagctgatcacgcccgacggcgaggtggagctgcaggtgcccgacgacgtgtacatcctggaccaggccgaggaggaggggatcgacctgccctactcgtgccgcgcggggtcctgctcctcctgcgccggcaaggtcgtctccggcagcgtcgaccagtccgaccagagcttcctggaagacgaccaggtcgccggcggctgggtgctcacctgcgccgcgtaccccacctccgacgtcgtcatcgagacccacaaggaggaggagctcacctcctcctcgtaatgcttgcattattgcttatcatcgatctccgctgattacatttaatttcttggttacgtaagtgtcgtgctactatgcttaattggtttgcagttgagctataatgcatgctgtggaaatttatgtctggctgtggctggcttggcagcagagcacgatggccacccacgctgctctcgcggcgtcccgcatccccgcaggcgcccggctgc

SEQ ID NO: 16642 - protein, 145 aa, Panicum virgatum
  misc_feature: Ceres CLONE 1789816
  misc_feature (54)..(129): Pfam Name: Fer2 Pfam Description: 2Fe-2S iron-sulfur cluster binding domain
MATVLSCRLRAPASFIPGLRAAPAPAVAAMPAAKQVVARGARLRAQATYNVKLITPDGEVELQVPDDVYILDQAEEEGIDLPYSCRAGSCSSCAGKVVSGSVDQSDQSFLEDDQVAGGWVLTCAAYPTSDVVIETHKEEELTSSS

SEQ ID NO: 16643 - DNA, 1289 bp, Panicum virgatum
  misc_feature: Ceres CLONE 1789823
  misc_feature: Encodes the peptide sequence at SEQ ID NO. 16644
atccaagcgtcctgttcctccaacgcgagtactgacacctcggcggcgaccggcggcggctgcacgatcgtttagttcgcggagaaggacgcgcgcaggcaacgatgctgctcatggactcggcgcgccgcgccggctgctccccagtctgcctggacctcagcgtcggcctctcgccgtcgccaccgaagacgggcgcgggaatggcagccgaccctcccgccggcggctgcaggatggcgtcgtccatgacagatgagcaggccaggaccctggaggccaagttcacccaggtcagcgaggagaaccggcggctcagcgagaggatcgcccacctgtacgccagccagatcgccaggacgagtccggactccgcggactcgacgcgcgcctcgcaagcagcgtcgccgccgccgctggctgagagcaggaagaggaacagggacagcgtggacgacccgccgagttcgggcgacgccgacgccgacgccgacgccagcggcagggccgaggccgtcgagagcccccgccccagcgacgccttcgagttcgagggctcgtgcaggcgcatcaaggtcagcagggtctgcacccggatcgacccctccgacacctccctcaccgtcaaggacggctaccaatggcgcaagtacgggcagaaggtcacccgcgacaacccctctccgagagcctacttccgctgcgccttcgcgccctcctgccccgtcaagaagaaggtgcagaggagcgcggaggacagctcggtgctggtggccacgtacgagggcgagcacaaccaccagtgccctacgcgcgccggcgagctcccgagctgcgcggcgcggggcgggcccgtgccgtgctccatctccatcaactcctccggcccgaccatcacgctggacctcaccaagaacggggcggacggcgtgcgggtgctcgacgccaccggggcgcccgacctcaagaagctgtgccaggaggtcgcgtcggtggagttccggacggcgctggtggagcagatggcgagctcgctgacaagggattccaagttcaccgacgcgctcgccgccgcgatcctgaagcagctgccggattactagagtccggtgtccggtgtcgtagctcagaatttccgtctgcgagactgcaacagctattctttcagaaaaaaaaaaaaattggtagcagtagtgtatcagtttcaatttcaatcccaaataatattgtgcattttacaagcccattgtttgatcatgaatttaaaataaggaccgtcctcccaggac

SEQ ID NO: 16644 - protein, 332 aa, Panicum virgatum
  misc_feature: Ceres CLONE 1789823
  misc_feature (174)..(234): Pfam Name: WRKY Pfam Description: WRKY DNA -binding domain
MLLMDSARRAGCSPVCLDLSVGLSPSPPKTGAGMAADPPAGGCRMASSMTDEQARTLEAKFTQVSEENRRLSERIAHLYASQIARTSPDSADSTRASQAASPPPLAESRKRNRDSVDDPPSSGDADADADASGRAEAVESPRPSDAFEFEGSCRRIKVSRVCTRIDPSDTSLTVKDGYQWRKYGQKVTRDNPSPRAYFRCAFAPSCPVKKKVQRSAEDSSVLVATYEGEHNHQCPTRAGELPSCAARGGPVPCSISINSSGPTITLDLTKNGADGVRVLDATGAPDLKKLCQEVASVEFRTALVEQMASSLTRDSKFTDALAAAILKQLPDY

SEQ ID NO: 16645 - DNA, 1626 bp, Panicum virgatum
  misc_feature: Ceres CLONE 1789830
  misc_feature: Encodes the peptide sequence at SEQ ID NO. 16646
atctcccaccccctctctcctctccctctccccttccgcatccacacgaaccttcccgacctcggagccgacgaacctccgagccgcagccatggcgaccgttatgcagaagatcaaggacatcgaggatgagatggcaaggacacagaagaacaaagccactgctcaccatcttggtcttctgaaggctaaacttgcaaaattacggcgggagttgctcacaccaacatccaaaggtggtggtggtgcaggtgaaggatttgatgtcacgaagagtggagacgcacgtgttggtttagttggttttccctctgttgggaaatcaacattgctgaacaagttgacaggaactttttctgaggttgctgcctacgagtttacaactttaacatgcattcctggagtcatcatgtataaaggtgccaagatccagcttctagatcttcctgggatcattgaaggtgctaaagatggaaagggtagaggaaggcaggttatcagcacggctaggacatgcaatgttattttgattgttcttgatgctataaaaccaataacacacaagcgtctcattgagaaggaacttgaggggtttggcattaggttgaacaagacaccacccaatttgacattcagaaaaaaggacaagggtggaatcaactttacatcaacagtgacaaacacacacttggaccttgagacagtaaaagccatctgtagcgagtacaggatccataatgctgatgtgtccctgagatatgatgcaacagcagatgatctcatagatgtaattgaaggaagccgcatttacacaccttgcatctatgttgtgaacaagattgatcagataacacttgaagagctggaaatcctggacaagcttccccattactgcccgattagtgctcatcttgagtggaatctcgatggacttctggagaagatatgggaatacttggatttggttaggatatacacaaaaccgaaagggctgaacccagattacaaggatcctgttattgtgtcatcgaagaagaaaacagtggaagacttctgcaacagaatccacaaggatatggtgaaacaatttaaatatgctctggtatggggctccagcatcaaacataagccacaaagagttggcaaggagcatgagcttgaggatgaggatgttgtccagatcattaagaaaatataggtatacagtggaatgacagctgtttacaaaactggaaggagagatgaggattttgagtagttgcctcatgggaagaccttgaacgccgcttttgcttgctgtgatgatcatatgtccttggttcccctatgctgcgttgaacaaaagacaatgtagacatgttttcttttgccgtaagccatgtagctgtgatgttctccgttgcttggtgccatgtggagtcagtgagtcaccaatgtaccaagtgtcctgcaactaccgtcgaacacatggatagatgctctccatatctttagaggatgatgataagatgattcctgtactgcgaatgttcctgctttgttaggtgtaccttttctagtgtataacaagtgccacagattcgtctgtacgtacattttctaatggaatggtggtatgagcttatc

SEQ ID NO: 16646 - protein, 368 aa, Panicum virgatum
  misc_feature: Ceres CLONE 1789830
  misc_feature (292)..(366): Pfam Name: TGS Pfam Description: TGS domain
  misc_feature (65)..(176): Pfam Name: MMR_HSR1 Pfam Description: GTPase of unknown function
MATVMQKIKDIEDEMARTQKNKATAHHLGLLKAKLAKLRRELLTPTSKGGGGAGEGFDVTKSGDARVGLVGFPSVGKSTLLNKLTGTFSEVAAYEFTTLTCIPGVIMYKGAKIQLLDLPGIIEGAKDGKGRGRQVISTARTCNVILIVLDAIKPITHKRLIEKELEGFGIRLNKTPPNLTFRKKDKGGINFTSTVTNTHLDLETVKAICSEYRIHNADVSLRYDATADDLIDVIEGSRIYTPCIYVVNKIDQITLEELEILDKLPHYCPISAHLEWNLDGLLEKIWEYLDLVRIYTKPKGLNPDYKDPVIVSSKKKTVEDFCNRIHKDMVKQFKYALVWGSSIKHKPQRVGKEHELEDEDVVQIIKKI

SEQ ID NO: 16647 - DNA, 1803 bp, Panicum virgatum
  misc_feature: Ceres CLONE 1789848
  misc_feature: Encodes the peptide sequence at SEQ ID NO. 16648
atccaagataatcttttctgtttcctcattaagatgaggaccgatgcttacctgacacaccttatcttcttgcttctggtctctgtggctgtgttgcacgctcatgcgtcgcagcaagctcagctcgagaatgtggctgtgttgcacgctcatgcgtcgcagcaagctcagctcgagaaattcatcttgtccagaagagctagaactagcagcagtgaggctagtctacatgggtggtctggtgtcagtgtgaggagcagcctccaagtccgagcagggtacttgggctccgaccagagtgctctgaaggcggccgacaagatcccggcgctgccaggccagccggagggcgtcgacttcgaccagtacggcgggtacgtgaccgtcgacgagaagaacggccgcgcgctcttctactacttcgtggaagcgccgcaggatgcgtcgtcgaagccactcctcctgtggcttaatggagggcctggatgttcgtcccttgggtttggagggatgctagaactgggcccgttccaggtgaacaacgacaacaaaacgctcagcaggaacaggcatgcatggaacgaagtggctaatgtgatatttttggagtcgcccgctggcgttggattctcctactcgaacacatcctctgattacgatgagagcggggactcaaaaacagcagaggacgcctacatctttctcgtcaattggctcgagagattccccgagtacaagacccgtgccttctacatctccggtgagagctacgccggtcactatgtcccgcagctggccgctaccatcctaagccacaacatgcaccacaatagaacaataataaaccttcagggcattctggttggcaacccatatctagatcgttataaaaatcagaaggggcgcttcgagtatctgcacagccatgggctgttttctgatgaggttttggccaatgtcaccagtcactgcaatttcaactcttcagatgctgaagcatgcttacggacaaccgactgattttactacggccccgtcgatccctacaacatatacgcgcccatctgcatcgacgaacctgatggatcctaccattccagcagctatctaccagggtacaatgcatgtgactactatcctacagtaacatacctcaataatcctttggtgcaagaggcttttcatgctaggaagactgaatggggtagctgcacagatctaggttggaaagatgcgccagattctatggtcccaactctcaaatggctcatcaagcatgggctgcccatatggttgtttagtggagatttcgatgccatatgcccactcaccgcaacaaggtacactatccaagatctgaacctctcggtcacaaagccatggcgtccatggacagcaaacatggaggtgggaggctatgttcagcaatacactggaggtttcacatttgtatccgtgagggccgctgggcatatggttccatcattccaacctgagagaggactcatactgcttcactatttcctcaaaggggtgctcccaccttttacacaagaatagtaaattataacaactttgtacggcaggttgcttatcagtcagcaacgaagctggataacatgaggatggcgtgagggctgataggctgtcaccattcaagtcagctgtgttagtcatataatttttatgattacacaatacacccgctgctcaaagtttgcaaggcgggtacattgatattaccctaagtcggtgtctgcattgccacacaatattgagataatttaatacataacctttatg

SEQ ID NO: 16648 - protein, 328 aa, Panicum virgatum
  misc_feature: Ceres CLONE 1789848
  misc_feature (101)..(328): Pfam Name: Peptidase_S10 Pfam Description: Serine carboxypeptidase
  misc_feature: SWISSPROT Homolog: EC 3.4.16.6 Carboxypeptidase D
MRTDAYLTHLIFLLLVSVAVLHAHASQQAQLENVAVLHAHASQQAQLEKFILSRRARTSSSEASLHGWSGVSVRSSLQVRAGYLGSDQSALKAADKIPALPGQPEGVDFDQYGGYVTVDEKNGRALFYYFVEAPQDASSKPLLLWLNGGPGCSSLGFGGMLELGPFQVNNDNKTLSRNRHAWNEVANVIFLESPAGVGFSYSNTSSDYDESGDSKTAEDAYIFLVNWLERFPEYKTRAFYISGESYAGHYVPQLAATILSHNMHHNRTIINLQGILVGNPYLDRYKNQKGRFEYLHSHGLFSDEVLANVTSHCNFNSSDAEACLRTTD

SEQ ID NO: 16649 - DNA, 723 bp, Panicum virgatum
  misc_feature: Ceres CLONE 1789850
  misc_feature: Encodes the peptide sequence at SEQ ID NO. 16650
ttttgtgctctgcttcaatcattcgagcaccaaggccacgaccatggcgtcgctcccgctgcacctgctcctcttcctcccactcctcgccgccgtctcataccactggctcaaccgtgccgcgtcgcgctggcgaggcggcgacgcgcggctgcccccgtcgccgtgggcgctcccggtgatcggccacctgcaccacctcgcgggcgcgctcccgcaccgcgccatgcgcgacctcgcggcgcgccacggcccgctcatgctgctccgcctcggcgggctccccgtcgtcgtcgcctcctcggcggacgccgcccgggaggtgatgcgggcgcgcgacctcgacttcgcgacgcgccccgtgacgcggatggtgcggctggtcatccccgcgggcgccgagggcatcatcttcgcgccctacggcgagggctggaggcagatccgcaagatctgcaccgtcgagctgctcagcgcccggcgcgtccagtccttcaggcccatccgcgaggaggaggccggccggctcctccgcgccgtggcgtcggcgccgccgccgcgggcggtgaacctgagcgagctgctctccgtgtacgccgccgactcgtcggtgcgcgccatcatcggcagccggttcaaggaccgggacacgttcctggtcatgctggagcgcgggctcaagctgttcgccaagatgagcctgccggaccctcttccgtcgtc

SEQ ID NO: 16650 - protein, 226 aa, Panicum virgatum
  misc_feature: Ceres CLONE 1789850
  misc_feature: SWISSPROT Homolog: EC 1.14.13.68 4-hydroxyphenylacetaldehyde oxime monooxygenase
MASLPLHLLLFLPLLAAVSYHWLNRAASRWRGGDARLPPSPWALPVIGHLHHLAGALPHRAMRDLAARHGPLMLLRLGGLPVVVASSADAAREVMRARDLDFATRPVTRMVRLVIPAGAEGIIFAPYGEGWRQIRKICTVELLSARRVQSFRPIREEEAGRLLRAVASAPPPRAVNLSELLSVYAADSSVRAIIGSRFKDRDTFLVMLERGLKLFAKMSLPDPLPS

SEQ ID NO: 16651 - DNA, 1677 bp, Panicum virgatum
  misc_feature: Ceres CLONE 1789859
  misc_feature: Encodes the peptide sequence at SEQ ID NO. 16652
gccgcacaaactcacattttcctctccttctctctcgcgctccgaccttctccagcaggcctattccactagctaattctagctaggaacaggagccatgggcttgccatgggcagcgcagtgcgcgggcatggtcttctcagccttgtccctctgcctggttgcgctggccctggtgctcctgctcgtgcgccggtggccgtggtgcagctgccatgtctgccgggcgtacctgacggggtcctgggcgagggacttcaccaacctcggcgactggtacgcgcacctgctccgggagtcccccaccggcaccgtccacgtccatgtcctcggctgcaccatcaccgccaacccggccaacgtcgagtacatgctcaagaccaacttcgacaacttccccaagggcaagaccttcgccgcgctcctcggggacctcctcggcggcggcatcttcaacgtcgacggcgacgcctggcgccaccagcgcaagatggccagcctcgagctcggcagcgtcgccgtgcgctcctacgcctacaagatcatcgcccaggaggtggaggcccgcctcatgccgctcctcgccgacgccgccgacagggacgccgtcgtcgacctgcaggacgtgttccggcgcttcgccttcgacaccatctgcaagatctccttcggcctcgacccgggctgcctcgagcgggaaatgcccatgtccaagctcgccgacgccttcgacacggcgacgcggctctgcgccatgcgcggcgccgcggcgtcgcccctgctgtggaggatgaagcgcctgctcaacatcgggtccgagcgggagctcaagaaggccatcaggctcgtcgacgagctcgcggccgcgatgatccggcagcgccggaagctgggcgtcgccaacagccacgacctcctgtcccggttcatggcctccgccggcgacgcccacgccgtggacgacaagtacctccgcgacatcgtggtcagcttcctcctcgccgggcgcgacacggtgtcctccgcgctcaccacgctcttcatgctcctgtccaagaacccggaggtggcggccgccatacgcgccgaggccggggacggctcggcgccggtcacctacgagcacctcaagggcctgcactacacccacgcggtgctgtacgagaacatgcgcctgttcccgccggtgcagttcgactccaagttctgcgccggccccgacgtgctcccggacggcacctacgtctccggcggggcgcgcgtgatgtaccacccctacgccatgggccgcatgccgagcatctggggagccgaccatggcgacttccgcccggaccggtggctcactggacccggcgggtccttcgtgccggagagcctgtacaggtaccccgtgttccaggcgggcctccgcgtgtgcctcggcaaggagctcgcggtcaccgagatgaaggcggtgggcgtggcggtggtgagggcgttcgacgtcgaggtggtcggggagagtggcagcggcgcctgcgcgccaaagttcgtgtcggggctcaccgcgtccatcagcggcgggctcccagtcaggattaggagagttagaaattagagattcaaggtttcagagaaaagaggttagatagagttgtttcacaaaaacggctatgaaatgtacatagactaatt

SEQ ID NO: 16652 - protein, 500 aa, Panicum virgatum
  misc_feature: Ceres CLONE 1789859
  misc_feature (28)..(493): Pfam Name: p450 Pfam Description: Cytochrome P450
  misc_feature: SWISSPROT Homolog: EC 1.14.13.98 Cholesterol 24-hydroxylase
MGLPWAAQCAGMVFSALSLCLVALALVLLLVRRWPWCSCHVCRAYLTGSWARDFTNLGDWYAHLLRESPTGTVHVHVLGCTITANPANVEYMLKTNFDNFPKGKTFAALLGDLLGGGIFNVDGDAWRHQRKMASLELGSVAVRSYAYKIIAQEVEARLMPLLADAADRDAVVDLQDVFRRFAFDTICKISFGLDPGCLEREMPMSKLADAFDTATRLCAMRGAAASPLLWRMKRLLNIGSERELKKAIRLVDELAAAMIRQRRKLGVANSHDLLSRFMASAGDAHAVDDKYLRDIVVSFLLAGRDTVSSALTTLFMLLSKNPEVAAAIRAEAGDGSAPVTYEHLKGLHYTHAVLYENMRLFPPVQFDSKFCAGPDVLPDGTYVSGGARVMYHPYAMGRMPSIWGADHGDFRPDRWLTGPGGSFVPESLYRYPVFQAGLRVCLGKELAVTEMKAVGVAVVRAFDVEVVGESGSGACAPKFVSGLTASISGGLPVRIRRVRN

SEQ ID NO: 16653 - DNA, 1436 bp, Panicum virgatum
  misc_feature: Ceres CLONE 1789862
  misc_feature: Encodes the peptide sequence at SEQ ID NO. 16654
acctcttctccccgcaagagtcgcaagacccggtgtgtcggcgtgccagcgcctccacccgtctgacggtagccggcggcggagcagcagtgccttctccttcaacgggcaacaaggccgctccttcggcaccgcgagctatctcctcccttcgctcgcccagcgccgccgccctccacgtggtcggcccgtgcgcccccttccaccctcccctgcccagctgcagctcgactccggctggtgcggcagcatcctcccttcccacgactactccgttctttctctcggcctcggtcttcctttcctcgcggcgacgacagggcgagttgcgctgcccgttgttcgtcgagcgacaggcgcttcgccggcgacgagcatccgacagggtatatgaccatgtcctatactgggtccgctcctgtgaaccagcacaaggaggaggatgccttgagaggtcgcgcggtcaaaaaccagaaggcaatatgggacaagaccctggagatgagattcctgctgcagaaggcgttttccacttctaacaagctgccccaggaacccatcaaaacaaggttttgcaaccatgataagcagatagagcaagcctatgaggacttgctgaattcatcaaagcagactctggcaagcatgacagaactgcaggaggctttgatggagagtaaccaggctgtaaaggatgctgatgaaattccttctgcctccaatggagagaatgacgagtggtcagaagtacagagattgcagacaaggataacaacatttagaaatacagagatcgataaatggcagaggaaaatacaggtgacgacgggtgctgctgcactgaaaggaaagctacatgcatttaatcagaacataagtgaccaagttgctggttacatgagagatccaagccgaatgattaacaggatgtacttgaccaaatctgctgttggtgtatttggagaggatgcgggagaacctggagcagctgaggaggggcgcattgtggaaggtgatcctgaacttattgatgattctgagttttatcaacaacttctcaaggagtttctcgagtcatgtgatagaggatcatcagactcagcattttacgctctgcaaaagcagcaggtgaaaaagagaaagcttgttgatcgccgcgcttcaaagagcagaaagataaggtatcatgttcacgaaaagatcgctaatttcatggccccggtacccatggctgttcctccaatggctccgaagttgtttgagaatttgtttggcacgagcaactagaaatccaccaaagcatgaattcaaatttcacataacatgtagtgatttttgtaatttaaaattgtagcatactagcatgtatgatgttgctgtagacttgaaactgtgaatsggacattttcatgatctgatcagttttgtgcatcgrc

SEQ ID NO: 16654 - protein, 296 aa, Panicum virgatum
  misc_feature: Ceres CLONE 1789862
  misc_feature (217)..(292): Pfam Name: TRAUB Pfam Description: TRAUB (NUC102) domain
MSYTGSAPVNQHKEEDALRGRAVKNQKAIWDKTLEMRFLLQKAFSTSNKLPQEPIKTRFCNHDKQIEQAYEDLLNSSKQTLASMTELQEALMESNQAVKDADEIPSASNGENDEWSEVQRLQTRITTFRNTEIDKWQRKIQVTTGAAALKGKLHAFNQNISDQVAGYMRDPSRMINRMYLTKSAVGVFGEDAGEPGAAEEGRIVEGDPELIDDSEFYQQLLKEFLESCDRGSSDSAFYALQKQQVKKRKLVDRRASKSRKIRYHVHEKIANFMAPVPMAVPPMAPKLFENLFGTSN

SEQ ID NO: 16655 - DNA, 699 bp, Panicum virgatum
  misc_feature: Ceres CLONE 1789867-R
  misc_feature: Encodes the peptide sequence at SEQ ID NO. 16656
ctcgtggaccggtggctctggccgggccgggcgccgagcgcgtcgcggggcggccgcgtggtgctggccggcgacgcgtggcaccccatgacgcccaacctcggccagggcgcgtgctgcgcgctcgaggacgctgtcatcctggcacgccgcctcgcggccgcgggcgccacgggccgcgcggacggcgtcgaggcggcgatgcgcgcgtacgaggcggagcgttgggcgcgcgtgttcccgctgacggcgcgcgcggggctcgtgggcgcgctggtgcagtgggagaaccccgcggtgtgcgcagcgcgcgacggcgtggtgatcccgaggctcgtcaggctgggtccgttcctggagcacaccaacttcgagtgcgacctaatcgagccggcgccgcagtcgccatgatcggaactcgaaaggctgcagcttttcccatggccatgtagataattagttggctcaaagaaaaaatatcagtaggatgtgcgaaaaatattcgcatattttcttccagttcataatattgaaaccttttgaaattatttattatttacttcaacggtttttgttttaaatttggggattcaccttgtttttattggccgtgtttggttccccgttaaggaattctataacgtggaatcttttatgcatgtgggctaaatgaaatctatttgtaaaatctatttacgg

SEQ ID NO: 16656 - protein, 136 aa, Panicum virgatum
  misc_feature: Ceres CLONE 1789867-R
  misc_feature: SWISSPROT Homolog: EC 1.14.13.90 Zeaxanthin epoxidase
LVDRWLWPGRAPSASRGGRVVLAGDAWHPMTPNLGQGACCALEDAVILARRLAAAGATGRADGVEAAMRAYEAERWARVFPLTARAGLVGALVQWENPAVCAARDGVVIPRLVRLGPFLEHTNFECDLIEPAPQSP

SEQ ID NO: 16657 - DNA, 667 bp, Panicum virgatum
  misc_feature: Ceres CLONE 1789867
ccctgctcaagaaactcctgccatggccatggccatggcactggccacctccacctccctctgctcacctccactcccctgtccacgccgtccccgcctccgccgccggtacagtaccgccgcgcccaccgtcaccgccgaggcggtgacgcagcggtcggatgagaacatcgtcatcgtgggcgcgggcgtcgcgggcctggccaccgcgctcgccctgcgccggctcggcgtgggcgcggccgtgctggagcagggcgcggccctgcgcgcgggcggcacgtccctgacgctgttcaagaacgggtggcgcgtgctggacgccatcggcgtcgccgacgagctccgcgccaagtacctgcgcatccaggggatgaggatgcggtcgccggcggcgggagggcgggatctgcgcgagttctccttcgaggaagaagcccccgggcaggaggtgcgagcggtggagaggagagtgcttctcgagacgcttgcttcaaagctgccaccaggcacgatatcattctcatccaaactgaaatcgattgcagagcaagggcctgatggcaccctgctggaactcgaggatgggcgacaaattctctccaagattgtgatcggctgcgacggcgtgaactcgtcgatcgcgaggtggatgggcttctcagag

SEQ ID NO: 16658 - DNA, 2015 bp, Panicum virgatum
  misc_feature: Ceres CLONE 1789871
  misc_feature: Encodes the peptide sequence at SEQ ID NO. 16659
aaaagcttcgataaaaaggagaggaggagacgaggcgtgccgtccgaacccaagcaacttccccccaccacccccctcccctcccctcccatgcccgcatcgagatcttaagcgggacagcgagaggagaggcgacgcgggcgcgggcgacccccgatccgtcctcgccgccgccgccgaccgaccgaccgggggaggaggaggggaggggaggacggacgccatggaggccgactccgggaagctctttgtcggcggaatctcctgggagacggacgaggaccgcctccgcgagtacttcggccgcttcggggaggtcaccgaggctgtcatcatgcgggaccgcaacaccggccgcgcccgcggcttcggcttcgtcgtctttgctgactccgccatcgccgagcgagttatcatggataagcatatgatcgacgggcgcatggtggaagccaagaaggctgttcccagggacgaccagagtatcgcaagcaagaacaatggcagcagcatagggtcacctggaccaggacgtactagaaagatctttgtgggaggcctggcatcaaatgttaccgaggttgaattcagaaggtactttgagcaattcggtgtgataaccgatgtggtcgtgatgtacgaccacaacacgcagaggcctaggggatttggtttcatcacctatgactcagaagacgcagtggataaggctctgcacaagaacttccatgagctgaatggtaaaatggttgaggtcaagagggctgtcccaaaggagcagtctcctggaccaattgcacgttcgcctgcaggagggcagaactatgctatgagcagagttcataacatcctgaatggcttcaaccagggttacaacccgaaccctattggtggttatggcatgagggtcgatggaaggtacggtctccttacaggtgcacggaatgggttctcttcgtttggtccaggttttggaatgggcatgaatattgaaggtggaatgagtggaaattttggtgcaggctctggtttcatcaatagctccaatgggaggcaaataggttcttactacaatggtagttcaaacagattaggtagtcctattgggtatgttggccttaatgacgattcaggatcaatactgagttcaatgtcaagaaatgtatggagtaatggaaatctgaactacacggtcaatcctacaaacatgaatgctttttgtccacctggaagtggtgggggcattcctggtgatggtattagttggggaggccttacttctgctcatgggatgggcaacatttcaagccttggttcgggaaaccttggccgtggaactggagataacaacttcggcttgccttctggcaactatgtgaggagcaattcaactggtaccattggcgagccattttctgcatcagccaatgcatatgaatcgaacaatccaggtgcatatggcagcagctctatttatggtgacacaacctggaggttcacctcatctgaggtagacatgcctccttttggtcatgatcttggaaatgtcgatccggatatcaaatcagaaatatcagcaggttatatgggcaactatactgttaataataatcagacaagcagaggtatcacttcctagggagagtactattatattcatatatgacttgggataggtgaaacacccactactatatcaggctttcaggtgcatgactgtgaattggtgatgtcagattaatatatgggttagttgcttgtttctaggtaaccagaggtgtggtttacgaacaccaaaaatgctagaggagcggatacaaacattttgtgaagctttcagattttagtttaatttctacgtgtattaggtctttgttttttgaatgagatgtgcagtgttgattgcggcacatacttagaagtgttccaacataagctggaaatctgtcatacggaaggataaacttgtataccaaaggaatgctgtattatccttgcccatttatggctacatt

SEQ ID NO: 16659 - protein, 471 aa, Panicum virgatum
  misc_feature: Ceres CLONE 1789871
  misc_feature (108)..(178): Pfam Name: RRM_1 Pfam Description: RNA recognition motif. (a.k.a. RRM, RBD, or RNP domain)
  misc_feature (8)..(77): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MEADSGKLFVGGISWETDEDRLREYFGRFGEVTEAVIMRDRNTGRARGFGFVVFADSAIAERVIMDKHMIDGRMVEAKKAVPRDDQSIASKNNGSSIGSPGPGRTRKIFVGGLASNVTEVEFRRYFEQFGVITDVVVMYDHNTQRPRGFGFITYDSEDAVDKALHKNFHELNGKMVEVKRAVPKEQSPGPIARSPAGGQNYAMSRVHNILNGFNQGYNPNPIGGYGMRVDGRYGLLTGARNGFSSFGPGFGMGMNIEGGMSGNFGAGSGFINSSNGRQIGSYYNGSSNRLGSPIGYVGLNDDSGSILSSMSRNVWSNGNLNYTVNPTNMNAFCPPGSGGGIPGDGISWGGLTSAHGMGNISSLGSGNLGRGTGDNNFGLPSGNYVRSNSTGTIGEPFSASANAYESNNPGAYGSSSIYGDTTWRFTSSEVDMPPFGHDLGNVDPDIKSEISAGYMGNYTVNNNQTSRGITS

SEQ ID NO: 16660 - DNA, 1765 bp, Panicum virgatum
  misc_feature: Ceres CLONE 1789875
  misc_feature: Encodes the peptide sequence at SEQ ID NO. 16661
aatagtactagaaagccggcaccatgaaggacaagctgcttctcgccgtcgccaccgccgtggtgctcgtcgtcctctcctggaggttcatcatcaggccttcgctcgccgcgaagccgaagctcaacctgcctcccggcccgcggatgctgccggtgatcggcagcctccaccacctggtcagcagcccgctgctcttccgggtcctgcgcgagctcgcgaagaagcacggcccgctcatgatgctccgcctcggcgaggtgcccgcgctggtggcgtcgtcgatggaggccgcacaggcgatcctgaaggtgcacgacaccagcttcgccgaccggtacaccccggccaccagcgcgacgatcgcctacgggggcactgacctgatactctcgccctacggcgagcggtggcgccatctccgcaagatcgtcgtgcaagagatgctcaccgccacccgggtgcagtccttcaagtacatccgcgaggaggaggtggcgcggttcctgcaggccatggccgcggccgccgccaccggcactgctgtggacttctccacagcggtcgctaagctcgttaatgacgccttcctgagggagtgcgtcggcagccggtgcaagtaccaggacgagtacctcgatgccgtccacacggtgacgcaactggcgtcagggataaccattgccgacctctacccgtcttccaggatcatgcagatgctcggcacggcaccacgcaagggtctcgcgtaccgccaaaggatcgatcgcatactcaagcagatcatccaggaggccaaggaagcaatggagtgcgaggacgagacagcccatgagagcttcgttagcctgctgctcaggctccagaaggacggaagcatgcccatccctctcacaaatgaaaccatcattgctctcatgtttgacatgttagctgcgggcagcgacacctcctctaccatactgaactgggccatgacagaactgatccggtcgccggctgcgatggccagggcacaggctgaggtgcgagaagccttcaaagggaagagcatcatcaccgacgatgacatcgccgagtccgggatcagctacctcaagctagtgttcaaagaaaccctaaggctgcatcctacttcaccactccttatcccacgtcagtgtcgcgagacatgtcaagtcatgggctatgatatccccaagggcatggccgtgttcgtgaacgtatgggcaattggtagagacccttcgtactgggacgatcctgaggagtttaagccagaacggtttgagactaataacctagattttcgagggacaaactttgagttcatcccatttggttctggtcgtcgtatgtgtcccggcattaaccttgggctggccaacatagagcttgcactggcaagccttctctaccactttgattggaaacttcctaagggaatggagcctaaggatgtcgacatgcgggaggctgtaggaatagttgcaagtaaggaaactagccttattgtgcaccccgttactttcattcctctaacggtggcggcgtaaattaaggtactcatgcataaaatggggtatggacaagtatggcaagaatcatgcatgcacacagtctatgttaagtgcaagaccatgtattacatactcccaatctatgctatataagttttatacattccgggtgtaaaagttaattgttagacctatatacccaatctatgttatacaataaagtatatgttgcctcttgaaagttc

SEQ ID NO: 16661 - protein, 510 aa, Panicum virgatum
  misc_feature: Ceres CLONE 1789875
  misc_feature (37)..(498): Pfam Name: p450 Pfam Description: Cytochrome P450
  misc_feature: SWISSPROT Homolog: EC 1.14.13.68 4-hydroxyphenylacetaldehyde oxime monooxygenase
MKDKLLLAVATAVVLVVLSWRFIIRPSLAAKPKLNLPPGPRMLPVIGSLHHLVSSPLLFRVLRELAKKHGPLMMLRLGEVPALVASSMEAAQAILKVHDTSFADRYTPATSATIAYGGTDLILSPYGERWRHLRKIVVQEMLTATRVQSFKYIREEEVARFLQAMAAAAATGTAVDFSTAVAKLVNDAFLRECVGSRCKYQDEYLDAVHTVTQLASGITIADLYPSSRIMQMLGTAPRKGLAYRQRIDRILKQIIQEAKEAMECEDETAHESFVSLLLRLQKDGSMPIPLTNETIIALMFDMLAAGSDTSSTILNWAMTELIRSPAAMARAQAEVREAFKGKSIITDDDIAESGISYLKLVFKETLRLHPTSPLLIPRQCRETCQVMGYDIPKGMAVFVNVWAIGRDPSYWDDPEEFKPERFETNNLDFRGTNFEFIPFGSGRRMCPGINLGLANIELALASLLYHFDWKLPKGMEPKDVDMREAVGIVASKETSLIVHPVTFIPLTVAA

SEQ ID NO: 16662 - DNA, 711 bp, Panicum virgatum
  misc_feature: Ceres CLONE 1789878
  misc_feature: Encodes the peptide sequence at SEQ ID NO. 16663
gccgccggcggcgagctgctcgagaagtcggtcaacacgatccggttcctggccatcgacgccgtggagaaggccaactccggccacccggggctccccatgggatgcgcgcccatgggacacatcctctacgacgaggtcatgcgctacaaccccaagaacccctactggttcaaccgcgaccgcttcgtcctctccgccggccacggatgcatgctccagtacgccctgctccacctcgccggatacgacagcgtcaaggaggaagacttgaagcaattcaggcaatggggaagcaggactcccggtcaccccgagaactttgagactccaggagttgaagttaccactggaccccttggtcagggtattgccaatgctgttgggttggcacttgccgagaagcacctggctgctcgcttcaacaagcctgacagtgagattgtcgaccactacacgtatgctattttgggagatggttgccaaatggagggtattgccaatgaagcttgctccttggctggacattggggtcttggcaagctgattgctttctacgatgacaaccacatttccattgatggagatacagagatcgcgttcacagaggatgtgagcacccgttttgaggctcttgggtggcatacaatctgggtcaagaacggaaacaatggctatgatgacattcgtgcagccattaaggaagcaaag

SEQ ID NO: 16663 - protein, 236 aa, Panicum virgatum
  misc_feature: Ceres CLONE 1789878
  misc_feature (6)..(235): Pfam Name: Transketolase_N Pfam Description: Transketolase, thiamine diphosphate binding domain
  misc_feature: SWISSPROT Homolog: EC 2.2.1.1 Transketolase
  misc_feature: Useful for making plants with modulated biomass
AAGGELLEKSVNTIRFLAIDAVEKANSGHPGLPMGCAPMGHILYDEVMRYNPKNPYWFNRDRFVLSAGHGCMLQYALLHLAGYDSVKEEDLKQFRQWGSRTPGHPENFETPGVEVTTGPLGQGIANAVGLALAEKHLAARFNKPDSEIVDHYTYAILGDGCQMEGIANEACSLAGHWGLGKLIAFYDDNHISIDGDTEIAFTEDVSTRFEALGWHTIWVKNGNNGYDDIRAAIKEA

SEQ ID NO: 16664 - DNA, 1455 bp, Panicum virgatum
  misc_feature: Ceres CLONE 1789883
  misc_feature: Encodes the peptide sequence at SEQ ID NO. 16665
aacgaaaccaaacgtcaggaatggccaccaccaccccatccctccgctcccgcctcctcatcctcccaccgccgccggcgtccaccaccgccgtctccctccgtttccgcccatgcgcctccgtactcccctcctcttcccggaggaggaacctccgcctcgcggcacgtgcggcgccgcccggcggcgcggtggcccctgcgtcgtcgtcgtcggcaccggcggcggaggaggagaaggatgggaacggcgggggcgaggggctgtcggcggccgacgcggagaggctgtgcgagttcctccgcgccgacctgccgcacctgttcgacgacgtgggcatcgaccggtccgcgtacgacgaccgcgtgcggttccgtgaccccatcacccggcacgacaccatcgacggctacctcctcaacatccgcctcctcaagctcctcttccgccccgacttctacctccacgccgtgaagcagacagggccgtacgagctcaccacgaagtggaccatggtgatgaagtttatgctcctgccgtggaagccggagctggtcttcaccggcctgtcgatcatgggcctcaacccgcagaatctcaagttcaacagccatgtggatctttgggattcgatcgaaaataatgaatacttctctttcgaaggattatgggatgttttcaagcagctacggttttacaagaccccggacatagaaacaccaaattaccttattctaaagaggacgacacattatgaggttagaagttattcaccattcttaatagttgaagcaaaaggagataaactgacaggatcttcaggattcaataatgtaactggatatatatttggcaagaatgcttcatctgaaaagattccgatgactacacctgtcttcactcaagcttctgatggcacactttcagatgtatccatccagatagttctgccgatgaacaaagacttgaacagtttaccagctccaaatacagaagcggttactttgcggaaggtagaaggaggcattgttgcagtaaaaaaattcagtggacgaccaaaagaagaaattgtgctccagaaggaaaaggatctacgctcccaattacttaaagatggattgaagcctcaacaaggctgtttgcttgcacgttataatgatcccaggacaaagagcttcctaatgaggaacgaggtgctgatacggctaaatgagttcacactggagttgtaatcatcatagctggcaacagatttatgtaacactaggctttgggcttggatatttcagcgcatcattagaaagggcaaatcttgttaacgggtggatgtgctttatgtaaatgtgaaattctgaaaggtaataagctacatgataaaacaatagatcactctattatgtttatacaccagattttgaattgacagaaaaaagtattagaatgaaggtagatcag

SEQ ID NO: 16665 - protein, 403 aa, Panicum virgatum
  misc_feature: Ceres CLONE 1789883
  misc_feature (230)..(397): Pfam Name: SOUL Pfam Description: SOUL heme-binding protein
MATTTPSLRSRLLILPPPPASTTAVSLRFRPCASVLPSSSRRRNLRLAARAAPPGGAVAPASSSSAPAAEEEKDGNGGGEGLSAADAERLCEFLRADLPHLFDDVGIDRSAYDDRVRFRDPITRHDTIDGYLLNIRLLKLLFRPDFYLHAVKQTGPYELTTKWTMVMKFMLLPWKPELVFTGLSIMGLNPQNLKFNSHVDLWDSIENNEYFSFEGLWDVFKQLRFYKTPDIETPNYLILKRTTHYEVRSYSPFLIVEAKGDKLTGSSGFNNVTGYIFGKNASSEKIPMTTPVFTQASDGTLSDVSIQIVLPMNKDLNSLPAPNTEAVTLRKVEGGIVAVKKFSGRPKEEIVLQKEKDLRSQLLKDGLKPQQGCLLARYNDPRTKSFLMRNEVLIRLNEFTLEL

SEQ ID NO: 16666 - DNA, 1692 bp, Panicum virgatum
  misc_feature: Ceres CLONE 1789889
  misc_feature: Encodes the peptide sequence at SEQ ID NO. 16667
gtcatattcccccacctcgatcaatccccatccatcgccgtggagcacgaaactttccatcctctccatcgtaccagctatttgacgcgtcaagggctgcagcggggagcatctgcctctgccaagccatggataaggggctctttgccaacgacggctccttcatggagaggttcaagcagatgcagcaggagcaggagaaggccgccgccgccgccgccgcagcctcatcggcggcgcccaagcctgccaaccccaagcagggctttgccgttgcggcaaacaagaggccgttcgagctgaagaaggctgggccggtcgccacgggcggaaagctggccttcagcctcaagaaggccaaggtcgcaatagcacctgttttcgctcccgaagatgatgaggaagaggatgcggcagatgttgacagagacgaacctgccaagcgccagaaatctgtgaaagctgatactcctgcggtggctgccccgaccggggctgttgccccaccaccaccaaatgatatgacagtgaggcaagtggctgacaaattagcaagctttgttgccaaaaatgggagacagtttgagaatattacacgacaaaggaatcctggagatacaccatttaagtttctatttgacaagcactgtccagactacaaatattatgagtttcgccttgctgaagaggaaaagattcttgcccaatcaaaagaggctgaagcatcaagaaatgcaaacattgcaagctccaaagcaccggttggtctgcacagaagctcatttgaacaaaagcctagctatcaaacacctgcatcagctttgtatggggcatatgagggtagttcttcccaaggaagctcatctagttatgcaggtgatacggctgtgccctcagatcctgtagcgttgatggaattctacatgaagaaggctgcacaggaagaaaggaagagaccaccaaggcagtcaaaagatgaaatgccgccacctccttctctgcaaggtcctcctaagaagggacaccacatgggtgactttatacctctagaagaacttgaaaagttcatggcacgttgtaatgatgctgaagcacaaaaggctaccaaagaagctgctgagaaggctaagattcaagcagacaacattgggcacaaacttctatctaagatgggctggcgggaaggtgagggtcttggtagtgagagaagaggccgtgcagatcccattatggctggagatgtgaagaaggatcatcttggtgttggtgctgtccagcctggtgaggtcacatctgaagatgacatctacgagcaatacaagaagcgaatgatgcttggctaccgttataggccaaacccactgaacaatccaagaaaagcatactactgatgcaagcgagttcatctgggggaagataaaatccaagaagttcacttgttcaggatataacttgtagtgccaacagatctaaggcttctgggtgttctgctgcagctttgttctttgtttagtgttgatgcatatattttcaaatacacttgtgttgaattgtagataggtttcaaactgtgatgtattgctttctttatggatgactattttcctgattattcaactttggttgttattattttggagatatttggtaaggataagccacaaaattaatgcaagagttctatcttttcag

SEQ ID NO: 16667 - protein, 420 aa, Panicum virgatum
  misc_feature: Ceres CLONE 1789889
  misc_feature (337)..(382): Pfam Name: G-patch Pfam Description: G-patch domain
  misc_feature (138)..(183): Pfam Name: Surp Pfam Description: Surp module
MDKGLFANDGSFMERFKQMQQEQEKAAAAAAAASSAAPKPANPKQGFAVAANKRPFELKKAGPVATGGKLAFSLKKAKVAIAPVFAPEDDEEEDAADVDRDEPAKRQKSVKADTPAVAAPTGAVAPPPPNDMTVRQVADKLASFVAKNGRQFENITRQRNPGDTPFKFLFDKHCPDYKYYEFRLAEEEKILAQSKEAEASRNANIASSKAPVGLHRSSFEQKPSYQTPASALYGAYEGSSSQGSSSSYAGDTAVPSDPVALMEFYMKKAAQEERKRPPRQSKDEMPPPPSLQGPPKKGHHMGDFIPLEELEKFMARCNDAEAQKATKEAAEKAKIQADNIGHKLLSKMGWREGEGLGSERRGRADPIMAGDVKKDHLGVGAVQPGEVTSEDDIYEQYKKRMMLGYRYRPNPLNNPRKAYY

SEQ ID NO: 16668 - DNA, 1709 bp, Panicum virgatum
  misc_feature: Ceres CLONE 1789890
  misc_feature: Encodes the peptide sequence at SEQ ID NO. 16669
acacaaacactctccctctcttcccctctcttgctcccttcccaacagtcagctcaaggactcccttcagccggttcaacagctagcctcgcggcgcacggattcgtttattattagggacgaacggttttacgagagacaatcaatcaatggttctgccgatgtctcgcgcgacgagagccgcgtcaaggctggtgccggagatcccgctgctgaggcggggcagcaagcagcagcagcaggcggccgaggaggaggtggcggtgccggcgcacttcgtgtgcccgatctcgctggacctgatgcgggaccccgtcacggcgcccacggggatcacctacgaccgggagagcgtggagggctggctggcgcgcgggggcgcgcggtgccccgtcaccggccgcccgctgcggctcgccgacctggtccccaaccacgccacgcgccggatgatccaggactggtgcgtcgccaaccgcgccagcggggtccagcgggtgcccacccccaaggtgccgctcgccgacgccgacgccgccgacgcggtggccgccgtgtcgcgcgccgcgggccgcggggacgtggccgcgtgcggggcggcctccgccagggcgagggcgctcgccaaggagagcgaccgcaaccgccgctgcctggcagcggcgggcgccgcgcgcgcgctggcgacggcgttcgggcggctcgcgggggagcgcgtcgagggcgccggcgctgcagccgagggcgctgcgctgggcgagatcctggccgccgcgaccgcgttcttcccgctcgacgacgaggcgcgccgctgcattgcctcgccggcctcgctcaagtcgctcgcctccgtgatgacccacagcggggagctcgcggcgcgggccagcgccgccgtcgtgctccgcgagctcgcgtcgtcggccgacgggcgcaccctcgaggccgtggcgcggaccccggggatgtgcgacgcgctcgtccgcctcgtccggagccccgtctccgcgccggccaccaaggccgctctcgtcacggcctactacctcgccgccgcctccgaccgcgcggcggcccgcctcgcggaggtcggcgcggtgccggccctcgtggagctcctcgtcgacgccgacaagggcacgagcgagaaggcgctggccgcgctcgacgccgtcctgggcgccgacgccgggctcgcggccgcgcgcgcgcacgcgctggccgtgccagtcctcgtcaagaagatgttccgcgtctccgacatggccacggagttcgccgtctccgcgctctggcgcctctgccgcgcgggcgacgccggcgccgccgcgtgccgcgccgaggcgctgcgcgtcggcgcgttccagaagctgctgctgctgctccaggtcggatgcggcggcgtcaccaaggagcgcgccagcgagctgctcaagatgctcaacggctccaggggcagcatcgagtgcatcgagaccgtcgacttcaaggggctcaagaggccattttgatcagcctagggagaggaaattctagcatttccttctcatttttgtgaagattgattcgacacttagatcagatgtgtggataacagatactcatacaggatgattagtcttaggaaattttttgacactgtaattgcacattcatatacaaagagatgaacacacaggaaaactttaacattacattttgttcttgac

SEQ ID NO: 16669 - protein, 453 aa, Panicum virgatum
  misc_feature: Ceres CLONE 1789890
  misc_feature (38)..(112): Pfam Name: U-box Pfam Description: U-box domain
MVLPMSRATRAASRLVPEIPLLRRGSKQQQQAAEEEVAVPAHFVCPISLDLMRDPVTAPTGITYDRESVEGWLARGGARCPVTGRPLRLADLVPNHATRRMIQDWCVANRASGVQRVPTPKVPLADADAADAVAAVSRAAGRGDVAACGAASARARALAKESDRNRRCLAAAGAARALATAFGRLAGERVEGAGAAAEGAALGEILAAATAFFPLDDEARRCIASPASLKSLASVMTHSGELAARASAAVVLRELASSADGRTLEAVARTPGMCDALVRLVRSPVSAPATKAALVTAYYLAAASDRAAARLAEVGAVPALVELLVDADKGTSEKALAALDAVLGADAGLAAARAHALAVPVLVKKMFRVSDMATEFAVSALWRLCRAGDAGAAACRAEALRVGAFQKLLLLLQVGCGGVTKERASELLKMLNGSRGSIECIETVDFKGLKRPF

SEQ ID NO: 16670 - DNA, 3095 bp, Panicum virgatum
  misc_feature: Ceres CLONE 1789898
  misc_feature: Encodes the peptide sequence at SEQ ID NO. 16671
actgactgcaagagcgaagaggagatctccgagagccggcgcctcgcgatttccggcgataaggttcgattttgatcccacccccaggttccccaccccggttcgcccccatcccagccgctgcttccggtggagcactggagaaaaagatcccgtttttccttttctccagttgcagttcgtggcgccgctgccgctcccgcgttgcgtgtctccgattcggcagttgctggactgaggcgagttggtgctgtgggattcgggttcggatctgcggagggggcaggtctcttgctccaattcggccagcaatgagggcccctgaatcttgttgacgcgcggccagatgcgggaggcatattgggagaaggtttcttgaaatcttcgtctgggcttcgtggagtgaggtccctctccgggatcgcccggtcgtcctatgggctgtgtcagttccaagcaattccatggcggggacgagcatggggacggcaagccgcgccggcggccctcgagcaactcgctgaagcgcctggttagttacagttccagcaagaggcatgaggacctggaagaggaggatgaggaaaggacggttgtggcagccacgtcctctagcgccagccgccgcactgggaacgacgccagcactgcgaggctgatccggaaggctccagcaccggtggttgaggctgtggcggcattgccggaggaggccgccactttggcgataggtgtcgttgatgcggagagggcagttgctgctgcagctggcaattgggagcggactccagcggatgtccaagttaatggcgcggcagagcaagagcccaggagtgcaggtcctaggactgagggggaggcaaaaccaaggatcaggggtgtgcccaatagagtccagggggagcatgtggcagcagagtggccgagatggctaacggaggtggcggcagaggcggttcgcgggtggcagcctcggagatcggaatctttcgagaagttggacaagataggtcaaggtacatacagcagcgtttacaaggcacgtgatcttgagaatggaaaaattgtggctctgaagaaagttcggtttgccaatatagaccctgagagtgtccgatttatggcaagggaaattcacatcttaagaaggcttgatcatccaaatgttgtgaagcttgaaggtttggtgacgtcgcgcatgtcaagcagcttgtatcttgtatttgaatacatggagcacgaccttgcaggacttgcagctacacctggcttaaaatttacagaacctcaggtcaagtgttacatgcgacaactactttctggacttgaccattgtcataaccgtggtgttttgcaccgggatataaagggtgcaaatctcctacttgacaataatggcattcttaaaatagcagattttggtctagctacattctttaatcccaaccaaaagcaacatttgacaagtcgtgtggtaacattgtggtaccggcctcctgagcttttgttgggtgccactaactatggcgctgctgttgatctctggagtgccggttgcattcttgctgagttgctgtcaggcaagcctatcatgccaggacgaactgaggtggaacagttgcacaagatatttaagctttgtggttcaccgtcggaggagttttgggctaatctgaagttgtcccgagctaccatattcaagcctcagcatccatatcgccgatgtgtgaatgatgtatataaggacttccctactacagctttagctctactggaccgtctacttgctgtagaacctggtaataggggtactgctgcatcggcccttgacagtgaattcttcacaacaaagccttatgcctgcgatccatcaagtctacccaaatatcctccaagcaaggaatatgatgctaagcttcgagatgaagaagctaggaggcaaagagccgctgctaaaggacaggaagctgaagctggacggaggaagcaacttcctgcacctgatggcaacagtggattgcagcaacgccgagttcaggtgaatcccaaaagtagcagttacaagttcactccaaaggaggatgctgtttctggttttccaattgatccgccagcaggagctgcagacaatggttaccctcagcgtgttcctttgatgcatgctggccgttcatcctccactctgggcagatcaagcggagtggatccaaaggcccaaagatttcacacctctcaaattgttgctgctgatatgtccaaccaatctactgcacctgggcagcgtggcaatgctcctaagatgtctaaccttggggaaagtgccaggagacaatatttgagagagcatcggtccagctcaagatacagtcagctcactgctgctgacccttctgacaggcctgaatggactcatcaattccaagaaagaccgtcttcttcccataggaaggatgatgtggtggcaaataaagagcccacagtggttaatggtacaaagaagaacagaatccactattctgggccattgatgcctcctggagtgaacatggatgagatccttagagagcatgagcgacagatccaacaagcggtacgaagagcccgtcttgacaagggaaaggggaagcacaacggcgagagagaccagtcagaggcactgctgtatacaactgggaatatcagggctgatcgctgaatagtttggttgggtttggtgtggatcccagtttgagcaatcatcaaaagcattgaaaatggtgttggatcccttttatttttctgtccctcaagcagagaggtttttgttttgccagaaacttcactcctgatgtggtttggtacccatgaggaagctgcgaaagaaaacctgttcatgtagagatttaccgcccgagtttagcataggctgtctgaaatattttctgaagatttgttggttatccatagtcttcaattgtatatctcaagagcacactccctgaaaattgattcatacacctgttttggcatatgacaagaggaatacaaatcaaattacaggccattgctatcctctgaactctgatttatgatgcttgagtgatgtatttcctccc

SEQ ID NO: 16671 - protein, 752 aa, Panicum virgatum
  misc_feature: Ceres CLONE 1789898
  misc_feature (185)..(469): Pfam Name: Pkinase Pfam Description: Protein kinase domain
  misc_feature: SWISSPROT Homolog: EC 2.7.11.22 Cyclin-dependent kinase
MGCVSSKQFHGGDEHGDGKPRRRPSSNSLKRLVSYSSSKRHEDLEEEDEERTVVAATSSSASRRTGNDASTARLIRKAPAPVVEAVAALPEEAATLAIGVVDAERAVAAAAGNWERTPADVQVNGAAEQEPRSAGPRTEGEAKPRIRGVPNRVQGEHVAAEWPRWLTEVAAEAVRGWQPRRSESFEKLDKIGQGTYSSVYKARDLENGKIVALKKVRFANIDPESVRFMAREIHILRRLDHPNVVKLEGLVTSRMSSSLYLVFEYMEHDLAGLAATPGLKFTEPQVKCYMRQLLSGLDHCHNRGVLHRDIKGANLLLDNNGILKIADFGLATFFNPNQKQHLTSRVVTLWYRPPELLLGATNYGAAVDLWSAGCILAELLSGKPIMPGRTEVEQLHKIFKLCGSPSEEFWANLKLSRATIFKPQHPYRRCVNDVYKDFPTTALALLDRLLAVEPGNRGTAASALDSEFFTTKPYACDPSSLPKYPPSKEYDAKLRDEEARRQRAAAKGQEAEAGRRKQLPAPDGNSGLQQRRVQVNPKSSSYKFTPKEDAVSGFPIDPPAGAADNGYPQRVPLMHAGRSSSTLGRSSGVDPKAQRFHTSQIVAADMSNQSTAPGQRGNAPKMSNLGESARRQYLREHRSSSRYSQLTAADPSDRPEWTHQFQERPSSSHRKDDVVANKEPTVVNGTKKNRIHYSGPLMPPGVNMDEILREHERQIQQAVRRARLDKGKGKHNGERDQSEALLYTTGNIRADR

SEQ ID NO: 16672 - DNA, 2171 bp, Panicum virgatum
  misc_feature: Ceres CLONE 1789913
  misc_feature: Encodes the peptide sequence at SEQ ID NO. 16673
aaaagaaaacaaagggggagagatatttcagcttgctcttcttgcagcttctgccgttcgcaactctctctggaacgaccacagctcaagcaaagcttgaaagctcaccaatttccctcgctgttcagcaggtccgcactctgttgcctaccaagagcgctggtggacttccgcaccctgtgtgctcatgttaagggttgaggctccagcgtactacttgattacaagacctaggtggaaactatatgcgtgtagaaacgtattgcaagaagctgcctcacatgatgcaaaggtgaattcctatagctatagtgagaggaggaaccggaaaaaggagggtgcttacattgacaaagatggtgtagcaagaaccttcgatcgaaagaaaatatccagaaagagagggggtgctatcaaaggccgaggttggaagtacggctctgggtttgttgatggagttttcccagtgctcagtccaatggcacaggatatcctagaatttgtgcagaaagggaccgacgttgccaaagtatgggagtcactggacaacattcctcgtgcacacgatctttgggatgacattgtcaatgtcgctgtccagctccgtctgaatcgacaatgggaacccatcatcacagtttgtgagtggattctgtaccggagttcgttccggcctgacatcatctgctacaacctgctcatagatgcatatggccgaaagcgtgagctgagcaaggcagaatccatttacatggctcttctggaggccaattgtgtgcctacagaggacacctatgctcttctcttgcgtgcttactgcaatgctggacaactgcaccgagcagagggcgtgatttcagagatgcaggagaatgggattcctccaagtacaactgtatataatgcctaccttgacggcctactgaaagcaaggtgtactgaaaaggcggtcgaagtgtaccaaaggatgaagaaggagcgctgcagaactaacaccgagacttacacgctgatgatcaatgtatacggaaaggcaaagcaaccaatgtcatcgttaaaagtcttcagcgagatgaaggcgatcgggtgcaagcccaacatctgcacctacactgcgctggtgaacgcgttcgctagggaaggcctctgcgagaaggcagaggaggtgtttgaggagatgcagcaggctgggcatgaacctgacgtgtacgcctacaacgccctgatggaagcttacagtcgagcggggttcccgcaaggcgcatccgagatcttctctttgatggagcacatggggtgtgagcctgacagagcctcatacaacatcttggtggatgcttatggaagagctggtcttcatcaagaggcggaagctgcgttccaagaactgaagcaggtgggcatgcggccgacgatgaagtcgcacatgctgctcctgtccgcgcacgccaaggccggcaacgtgtccaggtgcgaggaggtgatggcgcagctgcacaagtccgggctgcggccggacaccttcgccctcaacgccatgctcaacgcgtacggcagggccgggcggctcgacgacatggagcggctcgtcgcggccatggaggggcttgacggcggcggcggcgccgccccggacatcggcacgtacaacgtgctggtgaacgtgtacgggcgcgcggggtacctggacaggatggaggcggcgttcggcgcggcggcggccaggggcctcgccgccgacgtggtgacgtggacgtcgcgcatcggcgcgtacgcgaggaagaaggagtacgggcggtgcctggagatcttcgaggagatggtggacgccgggtgctacccggacgccggcacggcgaaggtgctcctcgcggcgtgctccgacgagcggcaggtggagcaggtcacggccatcgtcaggtccatgcacaaggacgccaagatgctcttcaaactatgagatcaaaactagctgatgcatgtcattattatgttgtacacataacctaacctcttgtgaacaagtgactagagtagtggaagtctagtgtttggataataagtactcgcccacttacaaattggaacatataactggtatcacaatatttgttgtaattttgctatactttacatacaagattaataattccttgatctaattttattgt

SEQ ID NO: 16673 - protein, 590 aa, Panicum virgatum
  misc_feature: Ceres CLONE 1789913
  misc_feature (306)..(340): Pfam Name: PPR Pfam Description: PPR repeat
  misc_feature (271)..(305): Pfam Name: PPR Pfam Description: PPR repeat
  misc_feature (341)..(375): Pfam Name: PPR Pfam Description: PPR repeat
  misc_feature (520)..(554): Pfam Name: PPR Pfam Description: PPR repeat
  misc_feature (376)..(410): Pfam Name: PPR Pfam Description: PPR repeat
  misc_feature (201)..(235): Pfam Name: PPR Pfam Description: PPR repeat
  misc_feature (166)..(200): Pfam Name: PPR Pfam Description: PPR repeat
  misc_feature (236)..(270): Pfam Name: PPR Pfam Description: PPR repeat
MLRVEAPAYYLITRPRWKLYACRNVLQEAASHDAKVNSYSYSERRNRKKEGAYIDKDGVARTFDRKKISRKRGGAIKGRGWKYGSGFVDGVFPVLSPMAQDILEFVQKGTDVAKVWESLDNIPRAHDLWDDIVNVAVQLRLNRQWEPIITVCEWILYRSSFRPDIICYNLLIDAYGRKRELSKAESIYMALLEANCVPTEDTYALLLRAYCNAGQLHRAEGVISEMQENGIPPSTTVYNAYLDGLLKARCTEKAVEVYQRMKKERCRTNTETYTLMINVYGKAKQPMSSLKVFSEMKAIGCKPNICTYTALVNAFAREGLCEKAEEVFEEMQQAGHEPDVYAYNALMEAYSRAGFPQGASEIFSLMEHMGCEPDRASYNILVDAYGRAGLHQEAEAAFQELKQVGMRPTMKSHMLLLSAHAKAGNVSRCEEVMAQLHKSGLRPDTFALNAMLNAYGRAGRLDDMERLVAAMEGLDGGGGAAPDIGTYNVLVNVYGRAGYLDRMEAAFGAAAARGLAADVVTWTSRIGAYARKKEYGRCLEIFEEMVDAGCYPDAGTAKVLLAACSDERQVEQVTAIVRSMHKDAKMLFKL

SEQ ID NO: 16674 - DNA, 1541 bp, Panicum virgatum
  misc_feature: Ceres CLONE 1789928
  misc_feature: Encodes the peptide sequence at SEQ ID NO. 16675
atcgctcttgctccctagcttcaacactgaacactccgatcctccccctccccgtccttctgtaaaagagagtggcgtgggggctccggccggcggcaaaggcaccatgggggagatcaccaacgtcatggagtaccaggccatcgcgaagcagaagcttcccaagatggcctacgactactacgcctccggcgccgaggacgagtggacgctcaaggagaaccgggaggccttctccaggatcctgttccgccctcgcatactgatcgatgtgtccaagattgacatgaccacaagtgttctgggcttcaagatcccgatgcccattatgattgctcccactgcctttcagaaaatggctcacccagatggggagtatgcaactgcacgggcagcatcagcagcaggaactatcatgacactgtcgtcatgggctacttcaagcgtcgaggaggtcgcctcgaccgggccaggaatccgtttcttccagctatatgtgtacaaggacaggaaggtggtggagcagctggtgagaagggccgagagggccgggttcaaggcgatcgcgctcaccgtggacaccccacgcctcggccgacgcgaagccgacatcaagaacaggtttgttctgccgccacacctgacgctgaagaactttgagggcctggacctcggcaagatggaccaggccaacgattctgggcttgcgtcgtacgttgccgggcaaattgaccgcaccctgagctggaaggatgtcaagtggctgcagagcatcacctcgctgccgatcctggtgaagggagtcgtcacggcagaggacgcgaggctggccgtccactccggcgcggcgggcatcatcgtgtcgaaccacggcgcgcgccagctggactacgtgccggcgaccatcagcgccctcgaggaggtcgtgacggcggcgcaggggcgcatcccggtgtacctcgacggcggcgtccgccgcggcaccgacgtgttcaaggcgctcgccctcggcgcctccggcattttcgtcgggaggccggtggtgttcgcgctggcggcggagggcgaggcgggcgtccggaacgtgcttcggatgctgcgggaggagttcgagctgaccatggcgctcagtggctgcacgacgctggccgacatcaaccgcagccacatcctgaccgagggcgaccgcctccgccccacgcccaggttgtgagcggagagcgccgccgccgccacctcatcacctcgcctatcaatcaatcgatcgatcaacgatggtaccccgacggccggggagctcgatcgccgcgcaccgaataatcccctacctccatggtaaaataagaatgttaaagattagcaccagatcccgtgcgtgtccggcaggtccacgagacgacgacaccttataatttccggtcgtgtttgcatcgtccgtgaacaatacaaacaaacaaacttattattcgatcatctatttgattattctgtatatccgttcaaactgtgctgttaatttgagtatcgtctgaaaattttac

SEQ ID NO: 16675 - protein, 368 aa, Panicum virgatum
  misc_feature: Ceres CLONE 1789928
  misc_feature (14)..(357): Pfam Name: FMN_dh Pfam Description: FMN-dependent dehydrogenase
  misc_feature: SWISSPROT Homolog: EC 1.1.3.15 (S)-2-hydroxy-acid oxidase
MGEITNVMEYQAIAKQKLPKMAYDYYASGAEDEWTLKENREAFSRILFRPRILIDVSKIDMTTSVLGFKIPMPIMIAPTAFQKMAHPDGEYATARAASAAGTIMTLSSWATSSVEEVASTGPGIRFFQLYVYKDRKVVEQLVRRAERAGFKAIALTVDTPRLGRREADIKNRFVLPPHLTLKNFEGLDLGKMDQANDSGLASYVAGQIDRTLSWKDVKWLQSITSLPILVKGVVTAEDARLAVHSGAAGIIVSNHGARQLDYVPATISALEEVVTAAQGRIPVYLDGGVRRGTDVFKALALGASGIFVGRPVVFALAAEGEAGVRNVLRMLREEFELTMALSGCTTLADINRSHILTEGDRLRPTPRL

SEQ ID NO: 16676 - DNA, 1679 bp, Panicum virgatum
  misc_feature: Ceres CLONE 1789930
  misc_feature: Encodes the peptide sequence at SEQ ID NO. 16677
gccataggaacactaagccacggcgagctcgctggctttgttcggtctaaccagtcaaaagcttagctagcttgcttccaaattaacaccctagcaatgcaagccaagctaagctagccaacccaccatggcgtccacggagttgtgggctggccttggatcagctctggtgttcttgctcggccttgttgctgcggcaatgaaccacgtaaagatcaaattgtggctgaacaaggtcggcgcctacttcagctcatacatccaaatcaccatcccagagtacggcgccgatccttcccaacgcagagacttcttcgtcgctgtcgagacctacctctctgagtactgcatccacggggtgcgcaagctcaaggccgagcttggcagggacagcaagaaaccccaggccgctgttgatgatgatcaggagatcattgacaccttcgtcgatgacgtcggcgccaagatccagatctggtggtatgcctatacggagcatccaaggtcccagatcatcatgttccatccggctgatgaaaagcgccgcttctaccgacttgtcttccacaaaaagttccgcggccccgtcctcgactcctatctgccccaagtcattgaaaagggccgcgccgtcatcgccacgaaccgcaagcatcgcctcttcaccaacatcccaaggagaggggagggggcgactttctggagccccgtggcgttccagcacccggccacgtttgaaacgcttgccatggaccccacggagaaggaggccatcatcgatgacctcgacgccttcaagcaggggaaggactactacaccaagatcggcaaggcatggaagcgaggctacctgctgttcgggcccccaggcaccggcaagtccacgatgatcgccgccatagctaagcgtcttgaatatgatgtctatgacctggaactgacggcggtcaagaacaacaccgagttgcggatgctcttcgtcctgacgacggagaagtccatcatcgtcatcgaggacatcgaccgctctgtcgaccttaccacaaagcgcagcagggacaacaagccccacaagaagtccggcggcgagagcagcaacatgaccttgccgccgaaagaggatgacaaggacgacgacgaggacaccaagctgacactctctgggctgctcaacttcattgacgggctatggtcggcatgcgccggcgagcgcatcatcatcttcaccaccaacaacaaggacaagctcgacccggcgctgatccggcgaggcaggatggacaagcacatcgagatgtcctactgccgctacgaggcattccagctgctggcccgcaactacctggacacaaacatattgaacgagagccagttcttccacctgtttggcgagatacagaggctgctggcggaggtcgacatgtctccggcggatgtcgccgagcacctgatgcgcaccgagaagaggggtgccgccgcgtgcctcgagggtctcgttgtggctctgagaaacgccaaggacgacaaagcaaaagcaaaggaacaagttgtagaaatcgtccatgataaataacacaagacaagacagccgctcatgttacatccgtttatttgttggtcgcctcaactttataactgtcactgaaatcaatgagaatttgagcgtttttcatgttatc

SEQ ID NO: 16677 - protein, 481 aa, Panicum virgatum
  misc_feature: Ceres CLONE 1789930
  misc_feature (240)..(450): Pfam Name: AAA Pfam Description: ATPase family associated with various cellular activities (AAA)
  misc_feature: SWISSPROT Homolog: EC 3.6.4.6 Vesicle-fusing ATPase
MASTELWAGLGSALVFLLGLVAAAMNHVKIKLWLNKVGAYFSSYIQITIPEYGADPSQRRDFFVAVETYLSEYCIHGVRKLKAELGRDSKKPQAAVDDDQEIIDTFVDDVGAKIQIWWYAYTEHPRSQIIMFHPADEKRRFYRLVFHKKFRGPVLDSYLPQVIEKGRAVIATNRKHRLFTNIPRRGEGATFWSPVAFQHPATFETLAMDPTEKEAIIDDLDAFKQGKDYYTKIGKAWKRGYLLFGPPGTGKSTMIAAIAKRLEYDVYDLELTAVKNNTELRMLFVLTTEKSIIVIEDIDRSVDLTTKRSRDNKPHKKSGGESSNMTLPPKEDDKDDDEDTKLTLSGLLNFIDGLWSACAGERIIIFTTNNKDKLDPALIRRGRMDKHIEMSYCRYEAFQLLARNYLDTNILNESQFFHLFGEIQRLLAEVDMSPADVAEHLMRTEKRGAAACLEGLVVALRNAKDDKAKAKEQVVEIVHDK

SEQ ID NO: 16678 - DNA, 1763 bp, Panicum virgatum
  misc_feature: Ceres CLONE 1789937
  misc_feature: Encodes the peptide sequence at SEQ ID NO. 16679
cacccgacgccattgattgaacagggagaggcaagggaaaggagaaaggggaagggggcaacaggcgcgtgctaattcttgccggatccgcggtgactgcgctcgccggcggggaagaggagggggcgcaggcggcgagccctccatccagtctttcttcacctccgtgctctccggatcttcggccagggcgaggacaaggacgagatggccacgcacaaccgcaacgccgccgccgccgccgccgccgccgctccgccgcttcaccatcgcaaccgaggtggtgttcccgctctgggaaagcagaaggccgtcgcggtcgcgaccggccgagctggcgccatgaaccgccgagcccccctgggcgacatcggcaacttcgtcagcgtccacgcggccgaagggaagccgcaggtcaaccgccccatcacaaggagcttcgctgctcaactagtgaagaacgcaaaggcgaatgccgccgcaaacaagcagaatgcggcaatcccaccggcgaggcctgcgccgaggctggagaggaaggctccttccaagccgcctcctcctgagaatgtcgtagagatcagctccgaatctgaccagagcaagacgcagtccgagagcagcgccagctccgtccgctcgaggaagaaggtcatcaacacccttacctctgttctctcggttcgctcaaaggctgcctgtggaatcactgataagcctcgagaagtgattgaagacatcgacaagttggacgtcaacgatcagctcgcagtcgtggaatatattgaggacatttacaccttctacaagactgccgagcatgagagccggccatgtgactacatggcagctcaggtggaggtcagcccaaatatgagggctatcctggccgattggataattgaagtacaccacaagtttgaactgatgcccgagactctctacttgactatgtacatcatcgaccaatacctctcgttgcaaccagtcctgcgaagggagctgcagcttgtgggcgtttcagccatgctgatcgcctgcaaatacgaagagatttgggcccccgaggtgaatgagctcatcctgatagcagatagtgcatacagtagggagcagatcctttcaatggagaagggaatactaaataggctggagtggaacttaactgttcctacatcatacatgttccttgttcgctttatcaaggcggcatgttcgggtatcaaaactgacaaagagatggagaacatggtcatcttcttcgcggagttatcgctgatgcaatatggcttggtgacacacctgccttcaatggttgctgcctctgctgtctatgcggcaaggctcactctcaagagggctccactttggactgacaccctcaagcaccacacaggcttcagagagtcagagctcatggaatgcacaaaaatgctcgtgagcgcacatgtggcagcaccggagagcaaattcagggtcgtctacaagaagtattccagcgagaagtatggaggggtcgcactacgtccaccagcaaaggagatatgcaaataaacgaagataacttcgtcttgctttgctttcgagagtcttacatttgctaggttttattcttgtttggagtcaagaaagtttgaacagttgagatagtcaagaataggttttatttgtttgctgggctgttctcatggaggagtcaggaatgtgcatacgccttggtgtatattcctgtcgtcagaatttatcaatagcaagttattcac

SEQ ID NO: 16679 - protein, 448 aa, Panicum virgatum
  misc_feature: Ceres CLONE 1789937
  misc_feature (195)..(320): Pfam Name: Cyclin_N Pfam Description: Cyclin, N-terminal domain
  misc_feature (322)..(447): Pfam Name: Cyclin_C Pfam Description: Cyclin, C-terminal domain
MATHNRNAAAAAAAAAPPLHHRNRGGVPALGKQKAVAVATGRAGAMNRRAPLGDIGNFVSVHAAEGKPQVNRPITRSFAAQLVKNAKANAAANKQNAAIPPARPAPRLERKAPSKPPPPENVVEISSESDQSKTQSESSASSVRSRKKVINTLTSVLSVRSKAACGITDKPREVIEDIDKLDVNDQLAVVEYIEDIYTFYKTAEHESRPCDYMAAQVEVSPNMRAILADWIIEVHHKFELMPETLYLTMYIIDQYLSLQPVLRRELQLVGVSAMLIACKYEEIWAPEVNELILIADSAYSREQILSMEKGILNRLEWNLTVPTSYMFLVRFIKAACSGIKTDKEMENMVIFFAELSLMQYGLVTHLPSMVAASAVYAARLTLKRAPLWTDTLKHHTGFRESELMECTKMLVSAHVAAPESKFRVVYKKYSSEKYGGVALRPPAKEICK

SEQ ID NO: 16680 - DNA, 2105 bp, Panicum virgatum
  misc_feature: Ceres CLONE 1789941
  misc_feature: Encodes the peptide sequence at SEQ ID NO. 16681
atattattcctcccgtccccggcttgtgggctgcctgccttgccttgtcccttcttccacggttccacctccccccaacggcacgagcccgacccctccagcgcacgcgctctccaaatagcggagcggaaggggacagaagccacgagtccaccacctctcccccgtcgcgtcgcgtcgcgtcgcgtcgcgcgagcgcactccgagagccgaatcggagcgcgaagcagcacccccggggcggatcgagcctagggctaggacatgggcggaggggacgccgacgccgccggcgagcccgcggccgctcaggcgacgctgcacatccggtgcaccaacggctccaagttcgccgtgcgggccgacctgggcgccaccgtcggcgccttcaaggcgatcgtcgccgagagctgcgacgtgccggccccgcagcagcggctgatctacaagggccggatcttgaaggacgagcaaaccctagccagctacggtgtagagacagatcatacgattcacatggtacgaggtgctgtgccaccaccagcatcaactgcacctgcagctaaccaagaaacttccactactgctcctgccagttccccagcagcaggattgggtggcttgttgccaggtcttggtgctacaggggctgctaatagtcgagggttggatttgtttggatctggcctcccagaattagaccagatgcaacaacagctagccgacaaccccaatttgatgagggaaataatgaatatgccactcatgcagaatttattgaatagtcctgatctcatacgcaatataataatgaataatcctcaaatgcgttagctcattgatcgcaatccagatcttgcccatgtcctcaatgatccaagcatcctgcgccagactgttgaagcagctaggaatcctgaacttatgagggagatgatgcggaacacagatagagccatgagcaacattgaatcttctccagaaggtttcaacatgctccgtcgcatgtatgaaactgtccaagagccttttctgaatgcaacaacaatgggtggtgagggtgatcgaaatgcaaacccatttgcagctcttctaggaaatcaggggactaaccaaccaagggacccagccgcaaatgcaccaactacagcttcagaccctgcagcagggtctccagctccagctccaaatactaatccacttccgaatccctggggctcaaatgcaaggccccctcctgctagcaacaccaacacaaggactgctacagcaggtggtctaggagggttgggttcagcagatctgggaggtgtgcttggtggtggtgctgatgcttccttcttgagtcaggttttgcaaaacccaactatgatgcaaatgatgcagaatattatgtctaatcctcagtccatgaatcagttgcttaatatcaacccaaatgtacgtaatatgatggaatcgaatactcaactaagagaaatgtttcagaatccagaatttcttcgccagttgacatctcctgaaacattgcagcaattaatttcattccagcagtccttgatgtcacaacttggccaacaacaaactggacaggagcatacacgatcaggcactagtgcaggcaatgtcaacctcaacaccttgatgaacatgttcaccgggcttggtgctggtggtggcctaggtgttccaaatgcccctaatgtgcctccagaagagctgtatgcaacacagctagctcagctccaagaaatgggtttctttgacacacaggagtacctccgagccttgattgcttccgctggaaatgttcatgctgcagtggagcgacttctcgggaatttgggccaatagaatgtgataactgtactcccatcctatgacctgtaattggcattgtaagatcctgtttggtccattggttttacacccggtgagatttgagaggcggcatctatattctgtgttctaagacgaataaacgagtgtgccagtggaaccttgcatataaatgggctctggtgtcattgttaaaattggtgttgttgatacccttgggttgttgtacatacatactattgaattaccgggtctcactgcaatgc

SEQ ID NO: 16681 - protein, 189 aa, Panicum virgatum
  misc_feature: Ceres CLONE 1789941
  misc_feature (22)..(90): Pfam Name: ubiquitin Pfam Description: Ubiquitin family
MGGGDADAAGEPAAAQATLHIRCTNGSKFAVRADLGATVGAFKAIVAESCDVPAPQQRLIYKGRILKDEQTLASYGVETDHTIHMVRGAVPPPASTAPAANQETSTTAPASSPAAGLGGLLPGLGATGAANSRGLDLFGSGLPELDQMQQQLADNPNLMREIMNMPLMQNLLNSPDLIRNIIMNNPQMR

SEQ ID NO: 16682 - DNA, 2209 bp, Panicum virgatum
  misc_feature: Ceres CLONE 1789966
  misc_feature: Encodes the peptide sequence at SEQ ID NO. 16683
aagtgacactgacactgtgggagagtgaccgtcaccgtccgtccccgagcagctaactgcagctagctaccgacggccgcagggagcccggccatggagagcggcgacctgcggggagcggcggcggagtacgcgcaggacgggtccgtggacctgcgcggcaaccccgtgctccgctccaagcgcggcggctggacggcctgctccttcatcgtcgtgtacgagctgttcgagcggatggcgtactacgggatcgcgtccaacctcatcatctacctgacggacaagctccaccagggcaccgtggaggcctccaacaacgtcaccaactggtccggcaccgtcttcctcacgccgctgctcggcgcctacgtcgccgacgcgtacctcggcaggtactggaccttcgtcgtcggctccgccatatacttcatggggatggtgctgctggtgctgtcggtcaccctgccggcgctgaaaccgccgccgtgcgacgcgggcgtctgcccgaaggcctcagcactgcagctcggggtctacttcggcgggctgtacatcgtggccttcggcaacggcggcaccaagcccaacatctccaccatcggcgccgaccagttcgacgagttcgacccgcgggagaagatgcacaagctctccttcttcaactggtggatgttcaccatcttcctcggcatcctcttctcctccaccgtcctcgtctacctccaggacaacgtcagctggtccatcgggtacggcatccccacgctgggcctcctggtctccatcgccgtcttcctcgccggcaccaagctgtaccgccacagggtgccgcagggcagcccgttcacgagcatgggcagggtgctcgccgccgcgctcttcaagtggaacgtccccgtcccgaccgacgccaaggagctgcacgagctggacctcgaggtgtacacgaggaagcgcaagttccggatggactcgaccaactccatgaggttcctgaacaaggccgccgtgaaggacgacggcggcagctcgccggcgaggtggagcctgtgcacggttacccaggtggaggagacgaagcagatcatcaagctggtgccgctcctcgtgacaacgttcgtgccgtgcacgctgatcgcgcagaccaccaccttgttcgtgaagcagggcgcgaccatgaaccggcacatggggctgcacttccagatcccgccggcgagcctcggcgcgttcgtcacgctgaccatgctcatcgccatcgtggtgtacgaccgggtcttggtcagggccgtgcggcggtacacgaagaacccgcgagggatcaccatcctgaagcggatgggcatcggcatgttcctgcaggtggtgacgatggggatcgcgtcggcgaccgagagccggaggctggcgtacgcgcggagccatggcctggacaagaccggcggcgagctcgggctcaccatcttcgtgctgctcccgcagttcgtgctgatgggcctcgccgacgcgttcctggtggtgggcaatatcgagttcttctacgaccaggcgccggagagcatgaagagcctgggcacggccatgtcgctgacggcgtacggcatcggcaacatcctcagcagcttcctgctgtccaccgtgacgcgcatcacccgcgagcgggggaacgcctgggtcaccaacaacctcaacgcctccaacctcgactactactacgccttcctcaccgtgctcggcggcatcaacttcctggccttcctcgcgctcagccgcgtgtacaggtacaaggccgagtccaccgagacgatcgacattgtcatgggcctggagaccgagaaagccaagctgcaggcggagccactgggttgatgaagcagggcaggagaagggccgccgccatgacgcgatccgtcgtgttcatgcctacagctttgcggctccactgttccactgttgtgaaaaaatcacaggatttctacaagtagtttccgtatgaccgcatgaacagatcaggaaaaagaataccaaaagttgtgtgcgagaaatgtctgacaacaaaggtcctgcttgaacacttaaacttggttagaggttgcagttagtttctaattctaaagtatctctcaacaaactctagccaaaaaagcatttggatataagggttagattgatattaaatgcactttaccaatcatttatctccttt

SEQ ID NO: 16683 - protein, 592 aa, Panicum virgatum
  misc_feature: Ceres CLONE 1789966
  misc_feature (102)..(503): Pfam Name: PTR2 Pfam Description: POT family
MESGDLRGAAAEYAQDGSVDLRGNPVLRSKRGGWTACSFIVVYELFERMAYYGIASNLIIYLTDKLHQGTVEASNNVTNWSGTVFLTPLLGAYVADAYLGRYWTFVVGSAIYFMGMVLLVLSVTLPALKPPPCDAGVCPKASALQLGVYFGGLYIVAFGNGGTKPNISTIGADQFDEFDPREKMHKLSFFNWWMFTIFLGILFSSTVLVYLQDNVSWSIGYGIPTLGLLVSIAVFLAGTKLYRHRVPQGSPFTSMGRVLAAALFKWNVPVPTDAKELHELDLEVYTRKRKFRMDSTNSMRFLNKAAVKDDGGSSPARWSLCTVTQVEETKQIIKLVPLLVTTFVPCTLIAQTTTLFVKQGATMNRHMGLHFQIPPASLGAFVTLTMLIAIVVYDRVLVRAVRRYTKNPRGITILKRMGIGMFLQVVTMGIASATESRRLAYARSHGLDKTGGELGLTIFVLLPQFVLMGLADAFLVVGNIEFFYDQAPESMKSLGTAMSLTAYGIGNILSSFLLSTVTRITRERGNAWVTNNLNASNLDYYYAFLTVLGGINFLAFLALSRVYRYKAESTETIDIVMGLETEKAKLQAEPLG

SEQ ID NO: 16684 - DNA, 2284 bp, Panicum virgatum
  misc_feature: Ceres CLONE 1789968
  misc_feature: Encodes the peptide sequence at SEQ ID NO. 16685
attattagatttttcctttccgcctgcgtgagatcccaatctccgacggaccgtcgccgcccagcaaagcaaacccaatcgatttcgatcgtctccgccgatccaagtccgatccaccaccaaatcctcttcctgccgctacttataggctagtatttaacaaataaacctcgatctggatctacaataatacttacaatctgccctgaaaatccaatcccatccaaccaggttcgccgccatgttggaggagctgctcatcttcacgcggggcggcctcatcctctggtcctcgtgccgggcgctcggcgccgccgccctcaagggctcgcccatcgacgccctcatccgatcctgtctcctcgaggaccgctccgccgacgccagcttctcccaggacaactacgccctcaagtggaccttccacaacgacctcggcctagtctttgtcgccgtctaccagaagattctccatctcctctacgtcgatgatctcctcaccgccgtccgcaaggacttctcccagatttatgatcccaagcgcaccaactatgacgacttcaccgacatattccgccagctccatctcgaggcccaagcgcgtgccgaggacatgaacaagtccaagcaggccatttcgtcccgtccgctaccagccgtctcccacaagactgctcccaaggctcgcggcgctggcacccgtgctacgaccaagggtggcgcctctaggaaggatgactctgatggggaatcatccagcaaggaccaccacgctctggcaaatggtagccacgagaatgctgctcccaaggacagctctcatacccgccctgctgttgttaagggcaaggagaacgggggccccaaagacaacggggccttcgatgtaactaaactacagaggttgcgaaagaatgataggaaaaacactggtgctgacaacgcaaccaagcagctgaccaaacctgacacaaagaagaaagggaagcaagacagggtgtgggatgacaaaccttctaacaagaagttggatttcacagacccagccgatgagagaggggatgaggtgacagaacatgtggcactcaaccagggagatagcatgatggataaggatgagaacctcagcagcgacagcgaggaggaagtggtcgaagatggaccgaagaagagaggctggttctcctcaatgtttcagagtattgctggtaacaatgtattggagaagtctgatttgcaacctgctctcaaggctctcaaagatagactgatgacaaagaatgtggcagaggaaattgcggagaagctttgtgaatctgttgcagctagccttgagggcaagaagctaggatcattcacaagaatatcatctacagtccagacagctatggaggaggctcttcttcgcattttgaccccaaggcggtctattgacatactgagggatgtacacgctgccaaggagcgtgggaagccatatgtcattgtttttattggggtgaatggagttggcaaatcaaccaatcttgcgaaggttgcttattggcttcttcagcataacctcagtgtaacgcttgcagcatgtgacaccttcagatctggtgctgttgagcagctgcggactcatgcacgcaggcttcagatacctattttcgagaagggttatgaaaaagatccagcaagtgtagcgagggaagctattcaggaagcaagccgaaacaaatcagacgttgttcttgttgatactgctggacgtatgcaggataatgagccactcatgagggcgctctccaagctcatcaatcttaacagcccagatttagttttgtttgttggagaagcattggttgggaatgatgctgtcgatcagctcactaagttcaaccagaaattagcagacctgtctgctgttcctactgctagattaattgatggtatcctgctcaccaagtttgacaccattgacgacaaggttggggcagcgctttccatggtgtatatatctggagctccggtcatgttcgtcggttgtggccagtcctacacggacctgaagaagctgaatgtgaaatccatcgttaagaccctcctgaagtgaaggaaatgcattgtgttgagctgtaccgcacaattctgttccatctttatatccccagtgaccttgtcatgttcatgttggacgtcgtggatctgtgatactgctgtacttatgtatgagtaactcttgtcatgtgtacttgtgtttacttggtcgtcttgcttcaataatacaacgtatgagttc

SEQ ID NO: 16685 - protein, 618 aa, Panicum virgatum
  misc_feature: Ceres CLONE 1789968
  misc_feature (411)..(618): Pfam Name: SRP54 Pfam Description: SRP54-type protein, GTPase domain
  misc_feature (27)..(308): Pfam Name: SRP-alpha_N Pfam Description: Signal recognition particle, alpha subunit, N-terminal
MLEELLIFTRGGLILWSSCRALGAAALKGSPIDALIRSCLLEDRSADASFSQDNYALKWTFHNDLGLVFVAVYQKILHLLYVDDLLTAVRKDFSQIYDPKRTNYDDFTDIFRQLHLEAQARAEDMNKSKQAISSRPLPAVSHKTAPKARGAGTRATTKGGASRKDDSDGESSSKDHHALANGSHENAAPKDSSHTRPAVVKGKENGGPKDNGAFDVTKLQRLRKNDRKNTGADNATKQLTKPDTKKKGKQDRVWDDKPSNKKLDFTDPADERGDEVTEHVALNQGDSMMDKDENLSSDSEEEVVEDGPKKRGWFSSMFQSIAGNNVLEKSDLQPALKALKDRLMTKNVAEEIAEKLCESVAASLEGKKLGSFTRISSTVQTAMEEALLRILTPRRSIDILRDVHAAKERGKPYVIVFIGVNGVGKSTNLAKVAYWLLQHNLSVTLAACDTFRSGAVEQLRTHARRLQIPIFEKGYEKDPASVAREAIQEASRNKSDVVLVDTAGRMQDNEPLMRALSKLINLNSPDLVLFVGEALVGNDAVDQLTKFNQKLADLSAVPTARLIDGILLTKFDTIDDKVGAALSMVYISGAPVMFVGCGQSYTDLKKLNVKSIVKTLLK

SEQ ID NO: 16686 - DNA, 1816 bp, Panicum virgatum
  misc_feature: Ceres CLONE 1789988
  misc_feature: Encodes the peptide sequence at SEQ ID NO. 16687
ctcccagctcccactacttcttgtgagttccttgctgctgcggctgcttgcttccctcatctctagtctgtacactggttggagtggttgctacttgctagtgtccgagttcgacccacttgttcctctcaatcccctctcatggatgtgcatacatcctcttcatcttctggtggttgcttgcttcttctggcttgaagttgaaggccttcgcctcgcctgggggaaagcttccgtttcgcgttccgttcctggtgccactacccactgctgtggtataaaggcggaagcttgagccatcttttgaagaaatcccggcggaagattgctccgccgctgcggtttcgcggcgactgtggccggttgccgcattcgccacgctggattacggtggaagggggcggcgtcgtgaggaaatcttgctctgcgatcaatcgctcagctgccccccttgctttctgggcggttgtcggtgctgccttttgcagtaaagagtgggatcttgcggccggcggtggcatcattgctggatcgagcaatcttcgacggcgacctccatatctgcgcgaccgatctgtgcgcggttggtcatctcttccccggcattgcgaggcgagctcgccgggtggtgtggattgccgcgtgagaagagcagaagagcggagctctgcgctgtgatccaagcgggctcctgcacgccaggtgtttgctgaaaggcccaagtgagcgagccatgagggacttcccgtcctgcttcggcgagagcggcgtccagatcgcggatgcgtcgtcttcgtcgtccagcgccggcaagggtgccgcgcagaacctggtgacctgcctctaccagacgcagttctcgggccgggcctgcgtgatctcggtcacgtggagcaagagcctcatgggacagggcctcagcatcggcgtggacgatctgtccggccagtgcctgtgcaaggcggacatcaagccgtggctcttctccaagaagaaggggtctaagagcctcgacgttgaggatggcaagattgagatcttctgggacctgtcgggcgccaagtttggtgctgggccagaaccagtggaggggttctatgttgcagtggtgttcgaccttgagcttgtgctcttactcggtgacatgaagaaggatgcttacaggaagactggagccaaccggtcgatgctgaatgctgcgttcgtggcgagaagggagcacatatatggcaagaaggtctactctgctaaggcgcaattctgtgacaaaggccagttccatgacattgttatcgagtgcgataccatcggcctgaaggatccatgtctcgaaataagggttgataagaagcccgtgatgcaggtgaagcgcctggcatggaaatttaggggaaatcatacaattctcgttgatggtttgcctgtggaggttttctgggatgtccacagttggctctttggatcgacggcaagcaatgcagtgttcatgtttcatacatgccaggcacctgagaagtcgctgccatggtcatactcgcagatttttagggagtcccagttgcaaggtcttggtttctcgttgatcctgcatgcatggaagcttgaataggtttttgcaggatcacaattttgcttctgcacctgcctccttttctttagtgctaacaaaaaatgttttgttgaagtgtctgttcatcagaatgctatggaggctctccaatatatgttctttcatttcattttgtttttgttttgccatttttttataaacgctttgtttgaatgattggcaagattatgtgatatccacttcggc

SEQ ID NO: 16687 - protein, 291 aa, Panicum virgatum
  misc_feature: Ceres CLONE 1789988
  misc_feature: Useful for making plants with modulated nitrogen use efficiency
MRDFPSCFGESGVQIADASSSSSSAGKGAAQNLVTCLYQTQFSGRACVISVTWSKSLMGQGLSIGVDDLSGQCLCKADIKPWLFSKKKGSKSLDVEDGKIEIFWDLSGAKFGAGPEPVEGFYVAVVFDLELVLLLGDMKKDAYRKTGANRSMLNAAFVARREHIYGKKVYSAKAQFCDKGQFHDIVIECDTIGLKDPCLEIRVDKKPVMQVKRLAWKFRGNHTILVDGLPVEVFWDVHSWLFGSTASNAVFMFHTCQAPEKSLPWSYSQIFRESQLQGLGFSLILHAWKLE

SEQ ID NO: 16688 - DNA, 1704 bp, Panicum virgatum
  misc_feature: Ceres CLONE 1790013
  misc_feature: Encodes the peptide sequence at SEQ ID NO. 16689
tttgtatggttgtaaagctgccgatcttgtccgtggagtgggtggaggacggggagctgtggccgtgcgggtgcttgggcggagatgaagccggcggcgaggagcaagaagggcaggggggccttctgcaacctcccgctgctgctcctcattggggccatccagttcttggtcatctactcccccgccattgatcggtacatggtgatgatcacaaaaggcaagcctgggttcccatcgctgctgctggatggcaggagaggattcaaattggtggtggaggagttcgtcccggagccccgcgtggcgtgcgacttcgcggacccgaggtcggacgtgtgcgagctggagggcgccatccgcatccgcgggagcacgtcggaggtgttcgtggtggccccgggcggtgccggcgcgggcatgaacgcgacgcagtggacgatccagccgtacacgcgcaagggcgaggcccgcgtgatgcgcggcatcgcggagctgacggtgcgcgtggtgggcgccggcgaggccccggcgtgcacggtgcggcacgacgtgccggcggtggtgtactccaacggcgggtactgcggcaactactaccacgacttcaacgacaacatcatcccgctgttcatcacgtcgcggcacctgggcggcgaggtgcagctgctggtggcgcagaagcagcggtggtggttcgacaagtaccgggagatcgtggacgggctgaccaactacgaggcggtagacctgggcggcgacggcggcgaggtgcggtgcttccggcgcaccaccctggggctgcgcagccacaaggagctgagcatcgacccgcgccgcgcgccgcgcaacctgtccatggtggacttcaagcgcttcctgatgtggcggtacgcgctgccgcgggagcacgccatccggacggaggaggacgagggggcggcgaggccgcggctgctgatcatcgcccggcggtcgcggcggcggtttgtgaacctgccggagatcgtggcgctggcggaggaggtcgggttcgaggtgacgacgtcggacgtgatgtcgccgccgaagcagaacaagaagggtgctttagctgcagctggtgacgaggggcacgcgcgcatggcggacgcgtcggcgctggtgaactcgttcgacgcgatggtggcggtgcacgggtccgggctgacgaacctggtgttcctgccgatgaacgcggtggtggtgcaggtggtgccgctggggcggatggaggggctggccatggacgagtacggggtgccgccgcgggacatgaacatgcggtacctgcagtacaacatccacaagcagagctggtcgctcgtcaaggacatctacctcggccagcaggacgtcaggctcgacctgcgccgcttcaggcccgtcctcgagaaggccatccgcctgctccggtgaccggcggaaaaggcctcaactgacactgattgcttgctttgcttgcctgcctgacccggcggcggctcctccatgcgagttgtgactacaggaacaggaagatacagtgatcgacagacagacaccatgtttcttttcctttctttttttctctcctcttggaatttcatcacacgacaagggcatgtaaaatttcagatgctgtacaaccaattagtagagagtccccgttgttgctcaaagcaaaagcggcgacgattttgctgt

SEQ ID NO: 16689 - protein, 450 aa, Panicum virgatum
  misc_feature: Ceres CLONE 1790013
  misc_feature: Useful for making plants with altered carbohydrate content
MKPAARSKKGRGAFCNLPLLLLIGAIQFLVIYSPAIDRYMVMITKGKPGFPSLLLDGRRGFKLVVEEFVPEPRVACDFADPRSDVCELEGAIRIRGSTSEVFVVAPGGAGAGMNATQWTIQPYTRKGEARVMRGIAELTVRVVGAGEAPACTVRHDVPAVVYSNGGYCGNYYHDFNDNIIPLFITSRHLGGEVQLLVAQKQRWWFDKYREIVDGLTNYEAVDLGGDGGEVRCFRRTTLGLRSHKELSIDPRRAPRNLSMVDFKRFLMWRYALPREHAIRTEEDEGAARPRLLIIARRSRRRFVNLPEIVALAEEVGFEVTTSDVMSPPKQNKKGALAAAGDEGHARMADASALVNSFDAMVAVHGSGLTNLVFLPMNAVVVQVVPLGRMEGLAMDEYGVPPRDMNMRYLQYNIHKQSWSLVKDIYLGQQDVRLDLRRFRPVLEKAIRLLR

SEQ ID NO: 16690 - DNA, 1415 bp, Panicum virgatum
  misc_feature: Ceres CLONE 1790017
  misc_feature: Encodes the peptide sequence at SEQ ID NO. 16691
ttactgttgcacatacaactgtgcggcatttgattccctggaaagaaaagactataaaagaatcacagatgacatctcgagccccattgcggcgcacatcctggacttctgcgacgatggcagcggcggggacctcttcgcggccgtgaacgcggcgtcggacatgttcacggcgtcctccgaggacgcctcgtcgtcgtccgtgacgacgcctcccgcgccctgcagccacggcgacaacgtgtcgtcgggcgccacggcggccttctcccccatgccgtccctggactccaccctgtcggcgctcctcgaggaagacgatccaccagttcccgacaccgaactcctccccatcgattatcagttcgcggcagcggtggccggggatgagccaccccagccggagcagcagtttggccaggttccggtggcgctcccaatggcctccgcggcggagcaaccggcggctctgcagacgcagatgagcagcacggcgtcggagctcatgcacctcacctcctccgggtacagcgacgagtgcttcgcggcggcgatggccggcggagggtacgtgggcctggaagaggctttgtgccagcagcagcagccgccgccgcagcccggcgcgttgctccccgccggcgtcatggaaaccgccgcgcaggggtgcttcttcggcaaggacgcggcggcgcaaggtggcttcttcgggactggctgcaccggcatggggacgtccatgatggggatggaggagatcggcgagtaccagcggatgatggagaccgcgagcgccgcgctggccgccacgcgcagccccgacgcggactccgccgccgcggcgcagatggcgttcgctggcaacgccggggaaatgcagatgggcggcggcatgagcccggggcggctgccggcagccgcggcggcgacggaggcgtcgagcctggaggacgcgagcttcaagaccgcaaaaatcagcgtggaggagagacgggagaagatccacaggtacatcaagaagcggaacgagcgcaacttcagcaagaagatcaagtacgcctgcaggaagaccctggcggacagcaggcctcgcgtgcgcggcagattcgccaagaacgacgactacggcgagccgtcgagggcgcttcagaaccacgacgagtatgaccagattgcgggcatgaaggaggaagacatgctcgacaccgacgccctgcaggcgcacctcagcgggatgaattcctacatgtacaaccacacggtcgagtcctggatgtagtgcaagcgagacatggctaacgtttcccgtttctgtttccaaattttgtgcagaattcaacagtatttttgttatttggtcccatggaataatttatactttataggtttataaagtgcagggcgaagcttgagtt

SEQ ID NO: 16691 - protein, 425 aa, Panicum virgatum
  misc_feature: Ceres CLONE 1790017
  misc_feature (330)..(374): Pfam Name: CCT Pfam Description: CCT motif
YCCTYNCAAFDSLERKDYKRITDDISSPIAAHILDFCDDGSGGDLFAAVNAASDMFTASSEDASSSSVTTPPAPCSHGDNVSSGATAAFSPMPSLDSTLSALLEEDDPPVPDTELLPIDYQFAAAVAGDEPPQPEQQFGQVPVALPMASAAEQPAALQTQMSSTASELMHLTSSGYSDECFAAAMAGGGYVGLEEALCQQQQPPPQPGALLPAGVMETAAQGCFFGKDAAAQGGFFGTGCTGMGTSMMGMEEIGEYQRMMETASAALAATRSPDADSAAAAQMAFAGNAGEMQMGGGMSPGRLPAAAAATEASSLEDASFKTAKISVEERREKIHRYIKKRNERNFSKKIKYACRKTLADSRPRVRGRFAKNDDYGEPSRALQNHDEYDQIAGMKEEDMLDTDALQAHLSGMNSYMYNHTVESWM

SEQ ID NO: 16692 - DNA, 643 bp, Panicum virgatum
  misc_feature: Ceres CLONE 1790022-R
  misc_feature: Encodes the peptide sequence at SEQ ID NO. 16693
aacatctctgcttgcaaaggcaaaggaaaagggtgtctcccttatgttgccaactgatgttgtcattgctgataagtttgcccctgatgctaacagccagactgttccagcatcttcaattcctgatggttggatggggctggacattggccccgattctattgcttcattcaatgcagccctggacacaacccagacaatcatctggaacgggcccatgggtgtttttgaattcgacaagttcgctgttggaactgaggctgttgcgaagaagttggcagaacttagcggcaagggtgtcacaaccatcattggaggtggagactccgttgcagccgttgagaaggtgggagttgctgatgttatgagccacatttcaacgggaggtggtgccagcttggaattgttggaaggaaaggagcttcctggagttgttgcgttggatgaagccgccactgtgactgtatgaagctaagttttcaatttgtttcaccttcatcttcgtgtaccgtgtaaacttgctacattcttgctcgctccttgtcagccgctcgaaatgtaagagatcaatgctttatagagctactggaaattgtttgaataactacacaaataatatgtgtttacctgagtcataactcat

SEQ ID NO: 16693 - protein, 155 aa, Panicum virgatum
  misc_feature: Ceres CLONE 1790022-R
  misc_feature (1)..(147): Pfam Name: PGK Pfam Description: Phosphoglycerate kinase
  misc_feature: SWISSPROT Homolog: EC 2.7.2.3 Phosphoglycerate kinase
TSLLAKAKEKGVSLMLPTDVVIADKFAPDANSQTVPASSIPDGWMGLDIGPDSIASFNAALDTTQTIIWNGPMGVFEFDKFAVGTEAVAKKLAELSGKGVTTIIGGGDSVAAVEKVGVADVMSHISTGGGASLELLEGKELPGVVALDEAATVTV

SEQ ID NO: 16694 - DNA, 303 bp, Panicum virgatum
  misc_feature: Ceres CLONE 1790022
cctctttctttaccaccccctcgcgccgcctgcggacctggacctctttttccgcccacccaccccactccctatacgacagtcgccgccgcaatccttgttgacatctagatggcgtccgcggacgcacacccggcctctctctccctcacctgttgtgaggtctgcaggggcgccgctgcagaagcagaggccccgctgcgccggtagggcctcgcggccgcctgccattgggcgcggtgattggctttctcggctggggacgcgcggctcgccgtttacgatcgcgtcgcggggacaaac

SEQ ID NO: 16695 - DNA, 692 bp, Panicum virgatum
  misc_feature: Ceres CLONE 1790025
  misc_feature: Encodes the peptide sequence at SEQ ID NO. 16696
acgaagccagcgaaaatccagtagagagagagaggggcagaggggagggaggcagccggcagccattactcccaccagctagcaccaccaccgctgctgctggggacgcctgcagcaagtacaggcggatatccgcttccattactgtgtctcgcggcggcggaccagcggcggcagagggttcgcttcggcggccgcaataaattccgccccccccccccatggcacggagggccgcctcctcgctcgtctcccgctgcctcctcgccagcagggccgcctcggcaggcgccgcgcccgctgtcccctccgcgctccgcaggccagatgggacgcgcggattgttgccaggggtccttcaaaggttcagcactgcagcagcagcagaggagcccatctcgcccccagtccaagtgaactacacaaagctcctcatcaatggcaactttgttgattccgcatccggcaagaccttcccaacactggaccctcgtacaggggaggtaattgctcatgtggctgaaggtgacgcggaggatgttaaccstgccgtccctgcagcacgcaaggcttttgatgaggggccgtggccsaaratgactgcatatgagaggtcccttatcctgctacggtttgctgatttgatcaagaagcacaatgacgagattgctgctttggagacatgggacaat

SEQ ID NO: 16696 - protein, 156 aa, Panicum virgatum
  misc_feature: Ceres CLONE 1790025
  misc_feature: SWISSPROT Homolog: EC 1.2.1.3 Aldehyde dehydrogenase (NAD(+))
  misc_feature (109)..(109): Xaa is any aa, unknown, or other
MARRAASSLVSRCLLASRAASAGAAPAVPSALRRPDGTRGLLPGVLQRFSTAAAAEEPISPPVQVNYTKLLINGNFVDSASGKTFPTLDPRTGEVIAHVAEGDAEDVNXAVPAARKAFDEGPWPKMTAYERSLILLRFADLIKKHNDEIAALETWD

SEQ ID NO: 16697 - DNA, 696 bp, Panicum virgatum
  misc_feature: Ceres CLONE 1790025-R
  misc_feature: Encodes the peptide sequence at SEQ ID NO. 16698
caacaagatcttgcgctacattagttctggtgtcgacagtggagctacccttatgacaggtggtgataggttgggtgacaaaggtttctacatccagccaacgattttctcagatgtacaggacggcatgaagattgctcaagaggagatattcaggcctgttcagtcgatcttgaaattcaaagatctgaatgaggttatcaagagggcaaatgcgagccaatatggattggctgctggtgtgttcaccaagagcttggacacggccaacaccctgacacgcgctctcagggtcggtaccgtctgggtgaactgcttcgacgtctttgacgccgggatccccttcggcgggtacaagcagagcggcatcgggagggagaagggcatcgacagcctgaagaactacctgcaagtgaaggccgtcgtcacacctatcaagaacgccgcatggttgtaggtgtcgcatctgtgaccctctgggcatggactgcagacgttcatttcctctctacatcccaaacaatgtgaagatggcgatgatcggatcgaagacgatgaagaagatgaagatcagctctaataagattcccccaataagcctttggttggtgcctatcttgtgtaatttggttcctcccttttgctttgagatgagactgttatattgtagcagcagaaaaagaagttggaagtgcc

SEQ ID NO: 16698 - protein, 151 aa, Panicum virgatum
  misc_feature: Ceres CLONE 1790025-R
  misc_feature (1)..(141): Pfam Name: Aldedh Pfam Description: Aldehyde dehydrogenase family
  misc_feature: SWISSPROT Homolog: EC 1.2.1.3 Aldehyde dehydrogenase (NAD(+))
  misc_feature: Useful for making plants with altered carbohydrate content
NKILRYISSGVDSGATLMTGGDRLGDKGFYIQPTIFSDVQDGMKIAQEEIFRPVQSILKFKDLNEVIKRANASQYGLAAGVFTKSLDTANTLTRALRVGTVWVNCFDVFDAGIPFGGYKQSGIGREKGIDSLKNYLQVKAVVTPIKNAAWL

SEQ ID NO: 16699 - DNA, 2028 bp, Panicum virgatum
  misc_feature: Ceres CLONE 1790031
  misc_feature: Encodes the peptide sequence at SEQ ID NO. 16700
gaccctcgcgcgcactgccgtcacgacccagagatggcggcggcggcgaggcgtgccgctggccttctccctgtcctcctctcttcgccgtccgctgctcgcacacccctccgccgggcgctgtccctgatctgtccgcatcgctcttatcgcctcctctcgcaccccgctaggcccttctccacctcccccttctccgccaccgcccccgcatcgaatggcgcggctgcggagagaacccgcgagctacacctgtacaacacgaagtcgaggaagaaggagcgttttcggccgcgagctcctaacggggaggtcggcatgtacgtatgcggagtcacgccctacgacgacagccacatcggccatgcccgcgcgtacgtcgcctttgacgtcctctacaggtacttgcgttatttggactatgaagttcgctatgttcggaacttcactgacattgatgacaagataattgctagagcaaatcagctgggggaagatccttttagcttaagcaaaaggttctctgatgatttcctgtcagacatggctaatcttcaatgtttaccaccatctgtggagccccgtgtttcagatcatattgatcagattataaatatgattaaacagatccttgataacaattgtgcatacgtagtgggtggggatgtctatttctctgttgacaattttcctgaatatggagagttatctggtcgaaaacttgatgataatagggctggtgaaagggttgcggttgatgagaggaagagaaacccagctgattttgctctatggaaggctgcaaaagatggggagccatggtgggagagcccttggggccctggaaggccaggttggcacatcgaatgcagtgccatgagtgcacattatttgggtcattcttttgacatacatggtggtggggaagacctcatctttccgcaccatgagaatgagatagcacaaagccgtgcggcatgttgcgacagtagcatcaattactggatacacaatggttttgtcaatgtaaatagtcaaaaaatgtctaaatcgcttggtaacttcgtcaccatacgcaaggttatagagatgtaccacccacttgccttgagaatgttcttacttggcacacactacaggtctccaatcaactacacaatagaacaactcaatgttgcgtcagatagattgtattacacgtatcagacgttacgagattgtgaagagagttgccagcaacaacacaagaactctggagattccttgcctgctgataccctgaattatatccagaaacttcatgatgaatttgagacttcaatgtcagatgatctccacacttcagtagcattggctgctatttctgaaccactgaaagtcatgaatgatttgttgcacactcgtaagggaaagaagcaggaaaaacggttggaatcacttgctgccttggaagagaaaataagagtagtgctctctgttctaggattgctgccttcaagttatcacgaggctctgcaacaactgcgggagaaagcattgagaagaacctccatcactgaggagtatgtgctgcagaagatcgaagagaggactgcagcaaggaaggctaaggagtacgaaaaatctgacgagatccggaaagaattggcagctgttggaatcgccctcatggattgtcctgacggaacgacttggagaccatctgtgcctctttctgaggaggaaactgtggttgtgaagacatgatctgcgcaacttctttgggagacccatgtacacccagttctctgttggtcgtgcttggttgcagtattgtgcaggtactgcgacgagatgaacggagtttcagagagagaagattaatttgcacgatcctgtgctcccgcgagggctactctagttatgtgcatgtcagtaaatgactaaatgtggaacgaaaagatagctagtttgacagtcattactgcaagttttgtggatcatattgctgaatatttgaactagtataccagctataccgtttgcctc

SEQ ID NO: 16700 - protein, 570 aa, Panicum virgatum
  misc_feature: Ceres CLONE 1790031
  misc_feature (85)..(384): Pfam Name: tRNA-synt_1e Pfam Description: tRNA synthetases class I (C) catalytic domain
  misc_feature: SWISSPROT Homolog: EC 6.1.1.16 Cysteine--tRNA ligase
MAAAARRAAGLLPVLLSSPSAARTPLRRALSLICPHRSYRLLSHPARPFSTSPFSATAPASNGAAAERTRELHLYNTKSRKKERFRPRAPNGEVGMYVCGVTPYDDSHIGHARAYVAFDVLYRYLRYLDYEVRYVRNFTDIDDKIIARANQLGEDPFSLSKRFSDDFLSDMANLQCLPPSVEPRVSDHIDQIINMIKQILDNNCAYVVGGDVYFSVDNFPEYGELSGRKLDDNRAGERVAVDERKRNPADFALWKAAKDGEPWWESPWGPGRPGWHIECSAMSAHYLGHSFDIHGGGEDLIFPHHENEIAQSRAACCDSSINYWIHNGFVNVNSQKMSKSLGNFVTIRKVIEMYHPLALRMFLLGTHYRSPINYTIEQLNVASDRLYYTYQTLRDCEESCQQQHKNSGDSLPADTLNYIQKLHDEFETSMSDDLHTSVALAAISEPLKVMNDLLHTRKGKKQEKRLESLAALEEKIRVVLSVLGLLPSSYHEALQQLREKALRRTSITEEYVLQKIEERTAARKAKEYEKSDEIRKELAAVGIALMDCPDGTTWRPSVPLSEEETVVVKT

SEQ ID NO: 16701 - DNA, 1593 bp, Panicum virgatum
  misc_feature: Ceres CLONE 1790050
  misc_feature: Encodes the peptide sequence at SEQ ID NO. 16702
ccaacgaactgaattctcttcccttcccttccttcccgtcgtcaggcgtcggcactttgggctctgcaccgtgctcttcttcctcccccttccctcccctgcttctgattcctcctcccaccaaatccgcccccttccctcacgccttgctgtgtctcgtcatcggcggcctcaccgccggcgacgggaggcagcaaccgcgtaccccttccgcagcagccgtccctcgccgaggcgcggagatccaccccgtcaggtgctccattggtttcatcgtttgctggagcgtgtcagggcggggccagggttcggggattttctcggtcggggaagccgaggcttcttcttaagttaataccggtggggcggtctttccccacccggccgagttttttctttgaacaggagcaatatggatgagattgtccctgctttggctaccagccaagcttcaaccgatgtcctgacagagcagcctttgaatgtgtacatatgggacatggatgagacactaattttgctcaagtcgcttctggatgggtcttatgctggggcctttgacggtctcaaggaccgtgagaaaagtgttgaaattgggaaacgctgggagaacctcattcttgaactctgtgatgagcacttcttttatgaagagattgagaactacaatgaaccctatctcaatgctttaagtgaatatgatgatgggagagacttgacctcatatgattttgaggctgactgttttagttcaccctatgatgatgtgaacaaaaagaagcttgcttacaggcatcgtgctataggagagaaatatgcaaagggtctggaaaaaattctggaccagcacatggtcaaagtctggaatgatctgtatagtttgactgataagtataccgatggctggctgtcttcagctcataaattattggaagaagcattgggcaaatcagcagctacacctactaccaactcttcaagcatcaactgcatagttacgtcagggtcgctgattccaagccttgccaaatgtttgctgtatcgcctggatgatgtggtctcggctgagaatgtttacagctcatgggaagtggggaagctgcagtgtttcaaatggatcaaggagcggtttgatggtccaaatgttcgcttctgtgcgatcggagatgggcatgaagaatgcagcgccgcacaggttatgaagtggccattcatcaagattgagttccaacctgacgctcctcacaggttcccaggcctagacatggccacagtccagacgtacatggatgtgatatatgagtcatcaagcaaggatggttgaccaacaattcaagttggttgggttttctcctccgacctccagtgcccatggaggtctggtctgaggaaattgtaagcaaagagatgtcgtgggaagaaagaaacatgttgtcctctctcgacctttaccctggcgaattaggaggctggtgccataaataagagcctgactagttcttccatgttccagagcatgtcatagctagattgcctatcttgtgttgccattttactatgattcaggcaaattatctgttgtgtccgggcgtt

SEQ ID NO: 16702 - protein, 303 aa, Panicum virgatum
  misc_feature: Ceres CLONE 1790050
  misc_feature: SWISSPROT Homolog: EC 3.1.3.48 Protein-tyrosine-phosphatase
MDEIVPALATSQASTDVLTEQPLNVYIWDMDETLILLKSLLDGSYAGAFDGLKDREKSVEIGKRWENLILELCDEHFFYEEIENYNEPYLNALSEYDDGRDLTSYDFEADCFSSPYDDVNKKKLAYRHRAIGEKYAKGLEKILDQHMVKVWNDLYSLTDKYTDGWLSSAHKLLEEALGKSAATPTTNSSSINCIVTSGSLIPSLAKCLLYRLDDVVSAENVYSSWEVGKLQCFKWIKERFDGPNVRFCAIGDGHEECSAAQVMKWPFIKIEFQPDAPHRFPGLDMATVQTYMDVIYESSSKDG

SEQ ID NO: 16703 - DNA, 1933 bp, Panicum virgatum
  misc_feature: Ceres CLONE 1790058
  misc_feature: Encodes the peptide sequence at SEQ ID NO. 16704
acgcgcacctcgacacgacacacctccccacctcccacgccagcgccaccgccaccgcgctcgaaaccccccttcccctcccgcccgcacccacccgagatctccgcgccgacgctctccgcccgacagcaccaccgcccgcccgtcccgcgcggcgcgcgagcgggacgcgtgccgggagcggatctccactcgacagcgccgagcgggattccctgcgcgcgcgcgagcgcggtgaccaggcagacggagacggggctagatccgcgagatcccgtccccgcgttcccgcaccttccgtgagcctgcgggattatttatcagcggccgcagctacacggtggggctgctgatcctggttggtcggaggagatgcagaggaatggcgtgctggaatgcagcgtttgtcgctccaaggtggcggttccgagccccaggagtgtgtcaagggcatacgacaagcaccgcagcaaggtgtcatccaagtaccgtgcacttaatgtgcttctcgtgtctggggactgcatcttggtcggcctccagcctatcttagtcttcatgtcgaaggttgatgggaagtttcagttcagtcctatcagcgttaactttttgacagaagttgcaaaagttatttttgccattataatgctaataattcagtctagaaaacaaaaggtgggggaaaagcctcttctgtcactttcaacctttgtacaggcagctcgtaataatgtgctcttagctgttcctgctctcctatatgccatcaacaactacctaaagtttatcatgcagttatacttcaaccctgcaactgtgaagatgctaagcaatctgaaggtgctggtcatagctgttctcctaaaaattataatgagaagaaaattctctataatccagtgggaagcccttgccctattactgattggaatcagtgtcaatcaactacgctcgatacctgcgggcaccaatgcttttggtcttcccgtcactgctgttgcatatgcatatacactaatttttgttaccgtcccatcgtttgcctctgtctacaatgagtatgctctaaaaagccagtttaatacaaccatctaccttcagaatttgttcttatatggttatggtgcaattttcaacttccttggcatcttagggaccgtcatatttcaaggtccagagagttttgatatccttcgagggcattcaagggcaacaatgtttctcatttgtaacaatgcagcacaaggcattctctcctctttcttctttaagtacgcagataccattttgaagaagtattcatcaacagttgccacaatttttacgggtttagcttcggctgcatttttgggacaacccttgactgttaactttcttctaggcatctcaatagtatttatttcaatgcaccagtttttctctccactagccaaggtcaaagatgaaaaaacagcaggaacagtggagctaggagattcacaaaatcataggtcctctgagtcttcttttgtaaatatgactgctggtgccgctgacgatgcaagccatcttagcgcaactgacgagagaaaaccgctgctgcccatttaagattacatattttgaggtagatatagaagaaattctttttgcggagagtagaacaattgccattgtagactttacaagcaaaagaaatatcatatatatgcagaattcatttcaggccaccttgttccactgttttcttgttttatactccgagcttagagctttggggtcaacatatggcagtaggcccctgttatgcagtatacacaacaaatgtaatgcgtatcacataccgtaattgtcccctatttttggggcaaaatgtacttgtgtcgatgattgttgtaccatcacatagttgctgatctatcgacgagcttggtccctgttcaacttttcttcc

SEQ ID NO: 16704 - protein, 405 aa, Panicum virgatum
  misc_feature: Ceres CLONE 1790058
  misc_feature (105)..(341): Pfam Name: Nuc_sug_transp Pfam Description: Nucleotide-sugar transporter
MQRNGVLECSVCRSKVAVPSPRSVSRAYDKHRSKVSSKYRALNVLLVSGDCILVGLQPILVFMSKVDGKFQFSPISVNFLTEVAKVIFAIIMLIIQSRKQKVGEKPLLSLSTFVQAARNNVLLAVPALLYAINNYLKFIMQLYFNPATVKMLSNLKVLVIAVLLKIIMRRKFSIIQWEALALLLIGISVNQLRSIPAGTNAFGLPVTAVAYAYTLIFVTVPSFASVYNEYALKSQFNTTIYLQNLFLYGYGAIFNFLGILGTVIFQGPESFDILRGHSRATMFLICNNAAQGILSSFFFKYADTILKKYSSTVATIFTGLASAAFLGQPLTVNFLLGISIVFISMHQFFSPLAKVKDEKTAGTVELGDSQNHRSSESSFVNMTAGAADDASHLSATDERKPLLPI

SEQ ID NO: 16705 - DNA, 1338 bp, Panicum virgatum
  misc_feature: Ceres CLONE 1790068
  misc_feature: Encodes the peptide sequence at SEQ ID NO. 16706
agcccggcagccgcaaccgaaaccccacgcagtctcgaacctacccgcttttccggccgacggccggccggcaggccgtcccccgccgttcgttctccacgcagtttggaatctcgaaccgccgctggccgtcgctgtctcgcgatcaaaacccccacgcgaccacggcgctcaccggtctctgcctgtcccccatttaatacccgtgctccgtccgttaatgccgtctcgagtctcgtcccttcttcgcgcatctagcctcaaccgccagccaaccgccagtccgccgccaccgcagcccgggagagagagagagagagagcagagcacgagggcgggggcggatggcgagctcccagtgctgcgataacccgccgacgctgaacccggccggcggggcgggcaaggtcgtggacagcttcggcgggctcaaggcctacgtcgccggccccgaggactccaaggccgccgtcgtcctcgtcgccgacgtcttcgggtttgaagcgccgaatctgaggaagatagccgacaaggttgctctgtcaggatactttgttgtggtaccagatttcttccgtggggatccttacgcaccagagaatactgagaggcccattcctgagtggctaaagtcgcatactccggaaaaagggtttgaagatacaaaacctgttattgctgctctaaaggagaagggagtgtctgctgttggagctgcaggttattgctggggtgcaaaggttgttgttgagttggcaaaagctaaggagatccaggctgctgtactgttgcacccgtcgtttgtttctgttgatcatatcaaagaggtcaaatgcccgatttctgtactgggagctgagattgacaaaatgtccccgccagaattagtcaagcaatttgagcaggttctttctgccaattcaggggttggtcacttcgtcaagattttccctggtgtgtctcatggatggagcgtgaggtacagcgaagatgatacggctgctgtgaagagtgctgaggaagccctggcggacatgatcgactggttcaacaagaacctgaaatgaactctggagtggcactctgccttgtaataaagcacatcctagtgcagtagtgcgcttgtcgtcggagtattgtgggattatcagctgtgttagtgttagggcctgcttcgtcaggtcattgtagttctcacggtctatgtgcttgtacacgttcgccgtagactggttgtgctcaatccgtaataaaaaggtaaattacgaggacgatatgtgtccataacaaatacttctttggatatttatcgaaaaaatatatttcatgcttgagagc

SEQ ID NO: 16706 - protein, 240 aa, Panicum virgatum
  misc_feature: Ceres CLONE 1790068
  misc_feature (29)..(239): Pfam Name: DLH Pfam Description: Dienelactone hydrolase family
MASSQCCDNPPTLNPAGGAGKVVDSFGGLKAYVAGPEDSKAAVVLVADVFGFEAPNLRKIADKVALSGYFVVVPDFFRGDPYAPENTERPIPEWLKSHTPEKGFEDTKPVIAALKEKGVSAVGAAGYCWGAKVVVELAKAKEIQAAVLLHPSFVSVDHIKEVKCPISVLGAEIDKMSPPELVKQFEQVLSANSGVGHFVKIFPGVSHGWSVRYSEDDTAAVKSAEEALADMIDWFNKNLK

SEQ ID NO: 16707 - DNA, 1638 bp, Panicum virgatum
  misc_feature: Ceres CLONE 1790077
  misc_feature: Encodes the peptide sequence at SEQ ID NO. 16708
agctgctcgcaggctcacagccagccagggcctcctccaccttcctctcccactcctccctgcgagcgagaacacgacgcgaccgtcaccgcacgttgagagatccccgcctctcgggcccgctccccctgctcgatggtctccgccagcacgccgccgccgctgccgccgccgtccgacgcggccgggtcgggggaggacgccagcaagaaggtgcggaagccgtacaccatcaccaagtcgcgggagaactggacggagcaggagcacgacaagttcctcgaggccctgcagctctttgaccgtgactggaagaagatagaggcttttgttggctccaagactgtcatacagataaggagccatgcacagaagtactttttgaaggttcagaaaaatggaaccagcgaacatgtcccacctccacggccaaagcgaaaagctgctcatccatatcctcagaaggcctctaagaatgaaccaaactatggacttaagacagattcatcttccatccataggaactctggcatgaatgtgactgtttcttcatgggctgttagttccatcccaccagccgttgcctcgtcgatgatgaaagatttgggtcctggaactctgggtccaaacaatttttgctcaagcagtactgaagtccctccaaggacgtggcaacctggtgaagcaaatgatcaaataaatcaaattccgtcacttcgccttatgccggattttgcgcaagtgtacagcttcttaggtagtgtttttgatccaagcacgagtggtcatttgcagaaacttaaggagatgaatccaattgatgttgaaacggcattgttgttgatgaggaatctctccatcaatttgaccagtcctgattttgaagatcaaaggaagttgctgtcctcatatagcacttctgatggacttgagctagggagttccaggagttcagctctagcgacgagtagacctttcatgattaaaggtgaatagtacagctaggtctctcggcgtataatttcagtttgacagaccctctggatggtgctctgccgtagcaccgatgagcaatgaaggcacttgcacggttgcacctatgtgcttcctgcgcttcaggccttcggctgaagatcgtgtaaaggtgcagccgtgacctgtgtagagaaggcttccgaaaggtgagattggcctgtggcctgatgtgtatatataatttttgccctgaagcgtgtacccttcctatcctattgctaccccaaaagctcggccatatagattcctgaatgctgctttagtaatggaaagagcaatgggaattttgagtgtaccgattgctcccttatccctccattgagttctgttactgatatcagttcggttttctggctgccatctggtatggagcttctgcccgatgtggccatctcaacctgagcaagcatgtctgtgacttccacttgaggtgatcatagtgctgtaaagcggtttaccttccccattcaaatgtttcttgttcctatgtattatgtattttgcatcaggtgttagcccatgtgtaagagggggaaaattcaaaatgtaaaggagacttgtacactagcattaccatttaaattctatatgtgtaaaggtgtc

SEQ ID NO: 16708 - protein, 286 aa, Panicum virgatum
  misc_feature: Ceres CLONE 1790077
  misc_feature (37)..(82): Pfam Name: Myb_DNA-binding Pfam Description: Myb-like DNA-binding domain
  misc_feature: The sequence is a functional homolog of SEQ ID NO 146 in the 10/412,699 US patent application
  misc_feature: The sequence is a functional homolog of SEQ ID NO 392 in the 10/666,642 US patent application
  misc_feature: Useful for biocontainment applications
  misc_feature: The sequence is a functional homolog of SEQ ID NO 1049 in the 11/479,226 US patent application
  misc_feature: The sequence is a functional homolog of SEQ ID NO 454 in the 10/412,699 US patent application
  misc_feature: The sequence is a functional homolog of SEQ ID NO 1752 in the 10/412,699 US patent application
  misc_feature: The sequence is a functional homolog of SEQ ID NO 1974 in the 10/374,780 US patent application
  misc_feature: The sequence is a functional homolog of SEQ ID NO 337 in the 11/479,226 US patent application
MVSASTPPPLPPPSDAAGSGEDASKKVRKPYTITKSRENWTEQEHDKFLEALQLFDRDWKKIEAFVGSKTVIQIRSHAQKYFLKVQKNGTSEHVPPPRPKRKAAHPYPQKASKNEPNYGLKTDSSSIHRNSGMNVTVSSWAVSSIPPAVASSMMKDLGPGTLGPNNFCSSSTEVPPRTWQPGEANDQINQIPSLRLMPDFAQVYSFLGSVFDPSTSGHLQKLKEMNPIDVETALLLMRNLSINLTSPDFEDQRKLLSSYSTSDGLELGSSRSSALATSRPFMIKGE

SEQ ID NO: 16709 - DNA, 1587 bp, Panicum virgatum
  misc_feature: Ceres CLONE 1790095
  misc_feature: Encodes the peptide sequence at SEQ ID NO. 16710
aacaccgcggcgaagggaggaatacgaagcaagcacggcaccgggaaggaaatggccacgcggccactcgccaccgcgctcaccctctccaaaaccccacgcgccccctcctcctcctcctcctccggctcccaccactccccacctgccctcgtccgccgcctccaaaccctagcccgcgcgctcgcgtcctcgtctccccagaccatggcgtcggccccggcccccaagaaggtgctggtccccatcgcgaacgggacggagccgatggaagcggtcatcaccatcgacgtgctccggcgcgcgggggccgacgtcgccgtcgcatccgtcgagccggcctccgcgaccgtcgcggcggcgtggggcgtcaagctcgccgcggacgcgctcctcgccgacatcgccgacgccgaattcgacctcatctctctccccggagggatgcctggggcttccaattttagagactgcaaacttttggagaatgtggttagaaaacatgtagagaagggcaagctttatgctgcgatatgtgctgcaccagctgtggctctaggaacttggggtttgctcaatggcttaaaggcaacatgtcatccttcgttcatggataaacttccttcagaggtgcatgctgtggaatcaagggtgcagattgatgggaagtgtgttaccagccgtgggccaggaacagccatggagtattctattgttttggttgagcaactatatgggaaggaaaaggctgaagaagttgctgggccgatgattatgcgccctcagcatggtgtggaattctctacgaaagagctgaattcaactagttggaatgttggtgaaacacctagtattcttgtaccaattgctaatgggacagaggagatggaggcaactatgatcattgacattctgtgcagggcgaaagcaaatgttgtggttgcctcgttggaagacaagttggaggttgttgcatcccggaaagtgaagatggttgctgatgtgatgttagacgatgctcttaagcagcaatatgatctcattctgctacctggtggtcttggtggtgctgaagcctatgcaaaatctgataaactgatgggtctgatcaagaagcaagctgaggcaaacaaattgtatggcgctatatgtgcatctcctgcaatcgctcttgaaccacatggcctcctaaagggaaagaaagctacatcatatcctgctatgtggaacaaacttgcggaccaaagtgagtgcaagaacagagttgtcgtcgacggcaacctgatcacaagccaaggtccaggcacttctatggaattctctcttgccatagtggagaaactctttggccgggagaaggtccgtgagcttgccaaaaccatggttttcgtttgagttcagcaacttcagttggtatatattaggtccctggagtaccaactttttgtgaatgtgaggcatgctatgttttccccttgtgtcgaatgtactctaaggccctttttagcaacaataacatgacaccttgtaatgagtttaatatgcaaataaagttgatgcgaacatgcatatagatgtttcctgatc

SEQ ID NO: 16710 - protein, 395 aa, Panicum virgatum
  misc_feature: Ceres CLONE 1790095
  misc_feature (242)..(380): Pfam Name: DJ-1_PfpI Pfam Description: DJ-1/PfpI family
  misc_feature (36)..(176): Pfam Name: DJ-1_PfpI Pfam Description: DJ-1/PfpI family
MASAPAPKKVLVPIANGTEPMEAVITIDVLRRAGADVAVASVEPASATVAAAWGVKLAADALLADIADAEFDLISLPGGMPGASNFRDCKLLENVVRKHVEKGKLYAAICAAPAVALGTWGLLNGLKATCHPSFMDKLPSEVHAVESRVQIDGKCVTSRGPGTAMEYSIVLVEQLYGKEKAEEVAGPMIMRPQHGVEFSTKELNSTSWNVGETPSILVPIANGTEEMEATMIIDILCRAKANVVVASLEDKLEVVASRKVKMVADVMLDDALKQQYDLILLPGGLGGAEAYAKSDKLMGLIKKQAEANKLYGAICASPAIALEPHGLLKGKKATSYPAMWNKLADQSECKNRVVVDGNLITSQGPGTSMEFSLAIVEKLFGREKVRELAKTMVFV

SEQ ID NO: 16711 - DNA, 593 bp, Panicum virgatum
  misc_feature: Ceres CLONE 1790099
  misc_feature: Encodes the peptide sequence at SEQ ID NO. 16712
gtcaccactgaacagcggaaacgtcttggaagcttcccgtttccagatctccaccaaaaccctaacccactgaagcttctagaacctcctccctcccgtcccccgcatggacgggctagcggcgccgtccccgtccctctccggcgccacctccggcggcggggcctcccaccgcaagcggaagctcccgccatcgtcgctctacgacgccaccgccgacgaggacgacgacaccactgcgccatcctccccctcatcggccccttcctctccttcccgcccgtcctccccgtcctcatcccactctgacgacgacgaccaccactcgctgcacaccttcactgccgcgcgcctcgacggagcgcctggagggggctccgcctccggacagccccataaggctgattcctcttcctcgtctgccgcagcggcagctgctgcggaggcgggaccgaaggcagagcccggctctgccgacgctggcaacggcaaggaggactccaacgggctgttcactgataacctccagagcagatgcgcgtacagcgaccgcgaggagggcctcaagcgcgaggaagactcaggaaggctga

SEQ ID NO: 16712 - protein, 162 aa, Panicum virgatum
  misc_feature: Ceres CLONE 1790099
  misc_feature: SWISSPROT Homolog: EC 2.3.1.48 Histone acetyltransferase
MDGLAAPSPSLSGATSGGGASHRKRKLPPSSLYDATADEDDDTTAPSSPSSAPSSPSRPSSPSSSHSDDDDHHSLHTFTAARLDGAPGGGSASGQPHKADSSSSSAAAAAAAEAGPKAEPGSADAGNGKEDSNGLFTDNLQSRCAYSDREEGLKREEDSGRL

SEQ ID NO: 16713 - DNA, 2313 bp, Panicum virgatum
  misc_feature: Ceres CLONE 1790100
  misc_feature: Encodes the peptide sequence at SEQ ID NO. 16714
tcaccacgcagcaagcatataccatccctcaagtggcgtccgcccggtctcggctaagcagctcgacttcccttccatccccggacgtccaggccggggccggtttcctcgccccgccccgccccgcccccgtctcgcaagccgtcccttcagctcgttggtttcgcggatcctcttcagcacaattggaggcaataaggttctgaactacaagttccgatgacaatctgcagcagcgatgagatcattgatgagtttgagttgctaacgcgtgatgctgggtgcgtgcagcaggatacgctgagaaagattcttgaacttaatgccgattctgagtatctgaatcgcttcaatcttgaaaggagaacagattccaagagcttcaaatcctgcattcccctatgtgtgcatagtgacatagagtcctacatccaacggatagctgatggagacaactcactggtgctaactgggaagcccatcacttctctctccgtaagttctggtacgacacagggaaaacccaagttgttgccattcaatgacgaattgcttgagagtacaattcaaatattccgaacctcatatgcttttagaaaccgtgaatatcctattggtaatggaaaagctttgcagtttgtttacgggagcaaacaagtctttacccaagggggcattcttgctacaactgcgacgacaaatttgtacaggagttggcgtttcaaggaagccatgaaggatatcatgtctcagtgctgcagtcctgatgaagtcatctttggtcccgactttcatcagtctttgtactgccatctattatgcgggttgatgtactcagatgaagttcagtttgttttttcaccatttgcacacagccttgttcatgcatttcataccctcgaggaggtatgggaagatctatgtgctgatataagacatggtgttctctcaaagcgaattaccacaccatctatccgtcaagctgttttgaaaatcttgaggccaaatccggagcttgctagtgccatttacaataagtgccagaatttgagtagttggtatggggtaatcccagcactgtggccaaatgcgaagtacatctatggcatcatgacagggtccatggagccataccttaagaaattgagacattatgctggacacttaccactgatgagtgctgactacggtgcatccgaaggatgggttggctctaatgtaaacccgaccctgccacctgaggaggtgacatatgccgttcttccgaatattgcttattttgagttcattcctttggaaaaaccaaaaggggaggaaatggagaacagttcatctattcactacatagagtcagaacctgtaggcttaactgaagttgaggttggcaaaatttatgaagttgtaataaccaactttgcaggtctataccgatacaggctgggagatattgtgaagatagcgagcttccacaactcaacaccagagctccagttcatctgtcgcagaagcctagtcctgagcatcaacatcgacaagaacacggagaaagacctgcagctggccgttgaagaggcggagaagctcttggccgaagagaagctcgaggtggtggacttcacgagcctcgtggacagagcaagcgacccagggcactatgtcatcttctgggagctgagctccggtaacgccagcgaggagctcctgagcagctgcgcgaacagcatggaccttgcctttgtggatgccgggtacgtcggctcgaggaagatcaagaccatcggcgccctcgagctgcgcgtcctccgcaagggcacctttgggcaggtcatgaaccactacctgagcctcggtggcgccgtgagccagttcaagacgccgcggttcgtgagccagtccaacagcaaggtgctgcagatactgaacaggaacgtcacccagagctacttcagcactgcgtatgggatctgatcgttgctatacacacgtgtactgatagctgaaattcagttatcttcttattatcgtctttgatcctttgatctctttatctggtcaggtgaaagtatttcgtggacgatccatcagtttgaggccttgcttgggggtagcacaactgatagatgtatattgtcagtaggtcttatgtaaaaatagctgtttgacagtgtaatatagctgtgatgtatggctgctgcatttagcatgcagccgttatcactcaggaaaattcaaaaagatagcttgtgttctgaagcamaaaaattgtacttgtactagaagccaattcagtgggtcccgccacacttctccatg

SEQ ID NO: 16714 - protein, 582 aa, Panicum virgatum
  misc_feature: Ceres CLONE 1790100
  misc_feature (8)..(566): Pfam Name: GH3 Pfam Description: GH3 auxin-responsive promoter
  misc_feature: Useful for making plants with modulated light quality sensitivity
MTICSSDEIIDEFELLTRDAGCVQQDTLRKILELNADSEYLNRFNLERRTDSKSFKSCIPLCVHSDIESYIQRIADGDNSLVLTGKPITSLSVSSGTTQGKPKLLPFNDELLESTIQIFRTSYAFRNREYPIGNGKALQFVYGSKQVFTQGGILATTATTNLYRSWRFKEAMKDIMSQCCSPDEVIFGPDFHQSLYCHLLCGLMYSDEVQFVFSPFAHSLVHAFHTLEEVWEDLCADIRHGVLSKRITTPSIRQAVLKILRPNPELASAIYNKCQNLSSWYGVIPALWPNAKYIYGIMTGSMEPYLKKLRHYAGHLPLMSADYGASEGWVGSNVNPTLPPEEVTYAVLPNIAYFEFIPLEKPKGEEMENSSSIHYIESEPVGLTEVEVGKIYEVVITNFAGLYRYRLGDIVKIASFHNSTPELQFICRRSLVLSINIDKNTEKDLQLAVEEAEKLLAEEKLEVVDFTSLVDRASDPGHYVIFWELSSGNASEELLSSCANSMDLAFVDAGYVGSRKIKTIGALELRVLRKGTFGQVMNHYLSLGGAVSQFKTPRFVSQSNSKVLQILNRNVTQSYFSTAYGI

SEQ ID NO: 16715 - DNA, 758 bp, Panicum virgatum
  misc_feature: Ceres CLONE 1790105
  misc_feature: Encodes the peptide sequence at SEQ ID NO. 16716
acagaggaaaagaaatcgcaacgagaacatcgtttcttcttcctccctcccttagcttcgcccccaagcgagcgccgcgggcgaaaccctagcctccccctccccaccaccacctcgctgggaacccagcgccgagcaggcggcggcgccggcggccgcgggggagaggggcaagatgatgaacggccagaagaagcgcgggccgaagatcgagcccttccgtcacaaggtcgagaccgaccccaagttcttcgacaagtcgtggcggaagctccacgacgccatccgcgagatctacaaccacaacgccagcggcctctccttcgaggagctctacaggactgcttataacatggtactgcacaagtttggtcctaagctctatgaaaaactcacagaaaacatgaaagagcatcttgaagagatgcgtacatgtgtagaggcagcacaaggtggtttgttcctggaagaattagagagaaaatggaatgaccataacaaggcattgacaatgattagagacattctgatgtacatggacaggacatatattcccactaataaaaagacacctgtctttgatcttggattggagctttggagggataccatagttcgatctcccatgattcaggggaggttgcttgacacacttcttgaactcatacatagagaaaggaccggtgaagtgataaatagatgcttgatgaggactacgactaaaatgcttatgaatctagggtcttctgtttatcagg

SEQ ID NO: 16716 - protein, 194 aa, Panicum virgatum
  misc_feature: Ceres CLONE 1790105
  misc_feature (30)..(194): Pfam Name: Cullin Pfam Description: Cullin family
  misc_feature: Useful for making plants with modulated biomass
MMNGQKKRGPKIEPFRHKVETDPKFFDKSWRKLHDAIREIYNHNASGLSFEELYRTAYNMVLHKFGPKLYEKLTENMKEHLEEMRTCVEAAQGGLFLEELERKWNDHNKALTMIRDILMYMDRTYIPTNKKTPVFDLGLELWRDTIVRSPMIQGRLLDTLLELIHRERTGEVINRCLMRTTTKMLMNLGSSVYQ

SEQ ID NO: 16717 - DNA, 1597 bp, Panicum virgatum
  misc_feature: Ceres CLONE 1790106
  misc_feature: Encodes the peptide sequence at SEQ ID NO. 16718
tccctgccccgacctctctttcgcttcctcctctgacaaaacgcaacgcgaacgtgacgagagccacaccaatccatcagggcacgcgccccgtcgtcccgcgaggcgctccttccctctcctcccgcccgcgtctcccgcgccgtgcacgacagagagagggcgcgatgaggccgggcgggccgccgaactcgcgggcgctgcagccgccgcagcagccgggcacgccggggcggtcgcgccggcgcccggatctcacgctgccgctgccgcagcgggacctgacctcgctcgcggtgccgctcccgctgcctctcccgccgtcctcggcgccgtcgtccacgtcgtcgtcaggggcgatgtcggggccggcgtcgctcggcgcccccaccccgccgacctcggccggctccgcgccgccgaacccgccgccgctgtgcgagctggagcgcgtgcgccgcatcgggagcggggccggcgggacggtgtggatggtgcgccaccgccccacgggccgcgcctacgcgctcaaggtgctctacggcaaccacgacgacgccgtgcggcggcagatcacgcgcgagatcgccatcctccgcaccgccgagcacccggccgtcgtgcgctgccacggcatgtacgagcaggccggtgagctccagatcctcctggaatacatggacggcggctccctcgagggccaccgcatcgccgacgagggattcctcgcgcacgtggcacgccaggtgctctccggcatcgcctacctccaccggcgccacatcgtgcaccgcgacatcaagccctccaacctcctgatcgactccggccggcgcgtcaagatcgccgacttcggcgtgggccgcatcctgaaccagaccatggacccctgcaactcctccgtgggcaccatcgcgtacatgagccccgagcgcatcaacaccgacctcaacgacggcgcctacgacgggtacgccggcgacatctggagcttcggcctgagcatcctcgagttctacctgggccgcttccccctcggtgagaacctcggcaagcagggcgattgggccgcgctcatgtgcgcgatctgctactccgactcgccgcaggcgccgcgcaccgcctcgccggacttcaagaacttcatcagcctatgcctccagaagaacccagcgaaccggccgtccgcgatgcggctgctgcagcacccgttcgtggcccagccgcagccgcagcccctggccgccccgccgccgtcatgatgactcgccccaaatccacaattcccaccgattgattggttcccgtcctgatccgaccgggtggattgatcacggatggaaggttggttgcctgattggttggcaagcaatgagatgtgggatctagggacgttccccctagccattttgggaattcaagccaccgccacagcaaccatcatcagcacatccattgttgtcacagttgctccaggaattaaagttcgcgtcttagcacttgtttatttttttcttctcttccccctctttctctacttcattgttgttcctggtcctccaaatgataatcataaaatatgggttgttaagaaagt

SEQ ID NO: 16718 - protein, 364 aa, Panicum virgatum
  misc_feature: Ceres CLONE 1790106
  misc_feature (93)..(350): Pfam Name: Pkinase Pfam Description: Protein kinase domain
  misc_feature: SWISSPROT Homolog: EC 2.7.12.2 Mitogen-activated protein kinase kinase
MRPGGPPNSRALQPPQQPGTPGRSRRRPDLTLPLPQRDLTSLAVPLPLPLPPSSAPSSTSSSGAMSGPASLGAPTPPTSAGSAPPNPPPLCELERVRRIGSGAGGTVWMVRHRPTGRAYALKVLYGNHDDAVRRQITREIAILRTAEHPAVVRCHGMYEQAGELQILLEYMDGGSLEGHRIADEGFLAHVARQVLSGIAYLHRRHIVHRDIKPSNLLIDSGRRVKIADFGVGRILNQTMDPCNSSVGTIAYMSPERINTDLNDGAYDGYAGDIWSFGLSILEFYLGRFPLGENLGKQGDWAALMCAICYSDSPQAPRTASPDFKNFISLCLQKNPANRPSAMRLLQHPFVAQPQPQPLAAPPPS

SEQ ID NO: 16719 - DNA, 1800 bp, Panicum virgatum
  misc_feature: Ceres CLONE 1790107
  misc_feature: Encodes the peptide sequence at SEQ ID NO. 16720
atagcctcctactctgaactgtaccaccacgcgacgccattgattgaacagggagggggcaagggaggagaaagagggaagaggaggggatccgcggtggctaagctcgccggcggggaagaggggacgcgggcggcgcgcctccagtctttcttcacctccgtgctctccgggctctttggacagggcgaggacgaggaagagatggccacgcgcgaccgcaacgccgccgccgctgccgctccgcagcttcaccatcacaaccgaggtggtgttcctgctctgggaaagcagaaggccgtcgcggccggccgagctgacgccatgaaccggcgaccccccctgggcgacatcggcaacttcgtctgcgtccgcgcgaccgaagggaagccgcacgagcatgtcaaccgccccatcacgagaagcttcggtgctcaacttgtgaagagcgcgcaggcgaatgccgccgcaatcaagcagaatgcggcgatcccacctgcgaggcctgcgccgaggcaggagaggaaggtttggaccaggccgcctcctcccgagcatgtcatagagatcagctccgactccgaccagagcaacacgcagtctgagagcagcgccagctccgtccgctcgaggaagaaggtcattaacaccctcacttctgttctctcggctcgctcaaaggctgcctgtggaatcactgacaagcctcgagaagtgattgaagacatcgacaagttggacgccaataatgagctcgctgtcgtggagtatattgaggacatctacaccttctacaggactgcacagcacgagagccggccatgtgactacattgaagctcaggtggagatcaactcaaagatgagggctatcttggccgattggataattgaagtacaccacaagtttgaactgatgcccgagactctctacttgactatgtacatcgtcgaccaatatctctcgctgcaaccagtcctgcgaagggagctgcagcttgtgggcgtttcagccatgctgatcgcctgcaaatacgaggagatttgggcccccgaggtcaacgatttcatcctgatatcagatagtgcatacagtagggagcagattctttcaatggagaagggaatactaaataggcttgaatggaacttaactgttcctacatcatacatgttcctcgttcgctttctcaaggcggcgtcttcgggcatcaaaactgacaaagagatggagaacatggtcttcttcttcgcggagttatcactgatgcagtacggcttggtgacgcacctgccttcgatggttgctgcctctgctgtctatgcggcaaggctcactctcaagagggctccactttgaactgacacgctcaagcatcacacaggcttcagagagtcggagctaatggaatgcacaaaaatgctcgtgagcgcacatttgactgcaccggagagcaagttgagggtcgtctacaagaagtattccagcgagaagtatgggggggtcgcactacgtccaccggcagaggagatctgcaaataaacgaagataaattcgtcttgacattcgctaggttttatgcttgtttgaagaaaatttgaacacttgagacagtcgtttgtttgctgggttgttctcagggaggagtcagtaatgctatctgacttgtattggcaattaggatttgggatgttctgctactatcttgtgttaccttggtgtatattccagtctgtcagaatttatcagtaacaagttattcataaatatgaatgatgaattggaatgtttgctgattgg

SEQ ID NO: 16720 - protein, 384 aa, Panicum virgatum
  misc_feature: Ceres CLONE 1790107
  misc_feature (192)..(317): Pfam Name: Cyclin_N Pfam Description: Cyclin, N-terminal domain
MATRDRNAAAAAAPQLHHHNRGGVPALGKQKAVAAGRADAMNRRPPLGDIGNFVCVRATEGKPHEHVNRPITRSFGAQLVKSAQANAAAIKQNAAIPPARPAPRQERKVWTRPPPPEHVIEISSDSDQSNTQSESSASSVRSRKKVINTLTSVLSARSKAACGITDKPREVIEDIDKLDANNELAVVEYIEDIYTFYRTAQHESRPCDYIEAQVEINSKMRAILADWIIEVHHKFELMPETLYLTMYIVDQYLSLQPVLRRELQLVGVSAMLIACKYEEIWAPEVNDFILISDSAYSREQILSMEKGILNRLEWNLTVPTSYMFLVRFLKAASSGIKTDKEMENMVFFFAELSLMQYGLVTHLPSMVAASAVYAARLTLKRAPL

SEQ ID NO: 16721 - DNA, 722 bp, Panicum virgatum
  misc_feature: Ceres CLONE 1790108
  misc_feature: Encodes the peptide sequence at SEQ ID NO. 16722
tcctttgcaccgctagtactgctcctccttgcgctcttcgcgcagcaagacatagaagaatcccctactactcatgcatgagcaccgcctcctcgcgccgcatatgaatcagacatgaataagggccacagcagcagctcctcgaagctcatcaacgagaagcttgaggaacaccggatctccaccgccaagcactgcccccactgcggtgagaaaatcgacagcaagccggattgggtggggctgccggccggagtcaagttcgatccaactgaccaggagctgatcgagcacctcgaggcgaaagtgaaggatgaaggctcgagatctcaccctctcatcgacgagttcatacccacaatagatggggaggacggtatatgttacacccaccccgagaaacttccaggtgtgaccagggatggcctgagcaagcacttcttccaccggccatccaaggcctatacgacgggcacgaggaagaggaggaagatacagacggagtgcgacgtccacaagggcgagacgaggtggcacaagaccggaaagacgcggccggtgatggtgaacggccggcagaaggggtgcaagaagattctggtgctgtacaccaacttcggcaagcaccgcaagccggagaagacgaactgggtgatgcaccagtaccacctcggcgacctcgaagaggagaaggagggggagctggtggtgtgcaagatctt

SEQ ID NO: 16722 - protein, 202 aa, Panicum virgatum
  misc_feature: Ceres CLONE 1790108
  misc_feature (44)..(187): Pfam Name: NAM Pfam Description: No apical meristem (NAM) protein
  misc_feature: The sequence is a functional homolog of SEQ ID NO 1710 in the 10/374,780 US patent application
  misc_feature: The sequence is a functional homolog of SEQ ID NO 542 in the 10/666,642 US patent application
  misc_feature: The sequence is a functional homolog of SEQ ID NO 1713 in the 10/374,780 US patent application
  misc_feature: The sequence is a functional homolog of SEQ ID NO 318 in the 10/374,780 US patent application
  misc_feature: The sequence is a functional homolog of SEQ ID NO 848 in the 10/225,066 US patent application
  misc_feature: The sequence is a functional homolog of SEQ ID NO 210 in the 10/666,642 US patent application
  misc_feature: Useful for making plants with altered carbohydrate content
  misc_feature: The sequence is a functional homolog of SEQ ID NO 562 in the 11/435,388 US patent application
MNKGHSSSSSKLINEKLEEHRISTAKHCPHCGEKIDSKPDWVGLPAGVKFDPTDQELIEHLEAKVKDEGSRSHPLIDEFIPTIDGEDGICYTHPEKLPGVTRDGLSKHFFHRPSKAYTTGTRKRRKIQTECDVHKGETRWHKTGKTRPVMVNGRQKGCKKILVLYTNFGKHRKPEKTNWVMHQYHLGDLEEEKEGELVVCKI

SEQ ID NO: 16723 - DNA, 911 bp, Panicum virgatum
  misc_feature: Ceres CLONE 1790112
  misc_feature: Encodes the peptide sequence at SEQ ID NO. 16724
acaaatcgacagccaagcgaggtagctcccagttccgcagttcccgttccacgctcggcatggctccgcaggcgtggattgtggaggagaagggcgaggacctccaagggcccaaggagttcctgcccctctccaagcttgaagatattggtgtgctttattggcagttggatcctaagaagtctgaaagcgaagaagagcttgcaaaaatccgcaaagaaagaggatacagttacatggaccttattgagatatgtcctgacaaactggagaactatgaggagaagctgaagaacttcttcactgagcacatgcacgctgacgaggagatccgctactgcttggaaggcagtgggtactttgatgtccgtgacaaggatgacaagtggattaggatttggataaaagaaggagacatgatcatcctgcctgctggaatttatcatcggttcaccctcgacagcgcaaattatgtgaagctcatgaggctcttcatcggggaaccagtctggactgcgctgaaccggcctcaggagggccaccccgcaaggcaggagtacgtgaagaatgtgatgggaaacactggattcgctctagcagcacactgaacctgccgttgccgttcgttcagcgagatacaaacatacaatttcttgaactcttttacatcacggcatatatggaccaagagtcggatgcgaaaacattgctgtgttgtgatggaacatcatgccgcacttgcttgtacacgtagaagatactgcatctgcatcctatggtaacgtacgatgtactagtattttccgttgtgtctgcttgatacagatacccttggatgtacgtggttgcagcagcagctgccaacaatgctttatttatgtatcttactagcacagtgtccgtgcattgcc

SEQ ID NO: 16724 - protein, 182 aa, Panicum virgatum
  misc_feature: Ceres CLONE 1790112
  misc_feature (4)..(153): Pfam Name: ARD Pfam Description: ARD/ARD' family
MAPQAWIVEEKGEDLQGPKEFLPLSKLEDIGVLYWQLDPKKSESEEELAKIRKERGYSYMDLIEICPDKLENYEEKLKNFFTEHMHADEEIRYCLEGSGYFDVRDKDDKWIRIWIKEGDMIILPAGIYHRFTLDSANYVKLMRLFIGEPVWTALNRPQEGHPARQEYVKNVMGNTGFALAAH

SEQ ID NO: 16725 - DNA, 2071 bp, Panicum virgatum
  misc_feature: Ceres CLONE 1790123
  misc_feature: Encodes the peptide sequence at SEQ ID NO. 16726
gtccatgtctatctctcacaccttgcgtcccataccgctggcttaacggcctgacctctcctcgcccccgccgccgcccgtcccgctactgatcgcgtccgcccccgcctccgccccccatgctgccgcgctcgccgccgtccgccgcggcaggcgacatggtgcccggcgtgggcggcgtcgagccggccgtgacgctggaccaggtgccgcgctggagcgacccggaccagcgcatcttccccgccgcctccacctccggcgaggcctccgcggagggcggcgaatccgagccgcccgcagcgctcggcttcctctccttctccgacccgctcaccggcgacgacgccggcggcgggggccgcgggggcgcctcgcagttccccgtcgaccaggagatcaactccaggatctacctctggcgcgggcacccctggaaccttgaggtcgacgccgtcgtcaattccaccaacgagagcttggacgaggcgcacagtagtcctgggctgcacggtgcagcagggacagggcttgcggaggaatgtgccaccttgggtggatgccgaaccggtatggcgaagatgaccaatgcctatgatctgcctgcaaggaaggttatccatactgtgggccccaaatatgctgtcaagtatcacacagctgccgagaatgcacttagtcactgttacaggtcctgtttggaactgctcattgagaatggtcttgaaagcatcgcaatgggttgcatatacaccgaagctaaaaactactctcgtgaacctgctgctcatgtggcaataagaactgttagacgttttctggagaagcaaaaaggcaatatagctggtgttgtgttttgtactacatcttcatctgacacagagatatacaaacggttgctccctctatatttccctcgggacaagcaggaggaagagattgccatatcaaaactcccagctgatgtcggggatgagaatggtgagacagtaattgatgaaaggaaaataagaataagacctttgcctgctggtgcagtagacagaacagtgacttcaactcctctagatctacctctttctgatcctgggtcggcattgaagagggtttctttcaagttggattcatatttggatccatcatttatgtcaataattaaagatccagatatgcggcgcaaggagcagtgggaaaaatctgctcaagctcacaagggatttaattatgctaggttacttggatatggcgatcttggttgcccttcattatctgcagcagaggaatattcacttcattcccgataccttgctaaagcaaattctctgaatctttcagagattgctgaaatgaaaataatttatcgtggtggagttgatattgaaggacgcccagttatggtggttgttggtgcacactttcttcttcgttgccttgatcttgaacggtttgttctacatgtagtgaaggagtttgaacctctgattcagaagccttatacaattgtatatttgcactctgcagcgtcattacaaccgcaaccagatttaggattcatgaagcgattacaacaaatactaggacggaaacataagtgcaatcttcatgcgatttatatcctccacccatcattgggattgagaaccgctgttttagccatgcagatgtttgtagatggagaggtctggaaaaaagttgtatatgtggataggctcgtgcagttgttcaaatacgtaccacgtgagcaacttacaatgcctgattttgtctttcagcatgatctggaggtgaatggtgggaggggcctaatcgttgacccaagaacaaagcacatttatcagagggcgtccagttgatgacttgacgtgacagttctgcgttctgaagttcattagttcttgcactgtaccattctgatgttcgcttcttgtaactttattccgtgttgatgtttctttctgtatctagttaagttggtctattccattcgttcgtttttctgcgtttttctcgcctgtatttgttgatttgtataactgaataaatgtagtctcagtctagatgtttaatcttt

SEQ ID NO: 16726 - protein, 564 aa, Panicum virgatum
  misc_feature: Ceres CLONE 1790123
  misc_feature: SWISSPROT Homolog: EC 2.4.2.30 NAD(+) ADP-ribosyltransferase
MVPGVGGVEPAVTLDQVPRWSDPDQRIFPAASTSGEASAEGGESEPPAALGFLSFSDPLTGDDAGGGGRGGASQFPVDQEINSRIYLWRGHPWNLEVDAVVNSTNESLDEAHSSPGLHGAAGTGLAEECATLGGCRTGMAKMTNAYDLPARKVIHTVGPKYAVKYHTAAENALSHCYRSCLELLIENGLESIAMGCIYTEAKNYSREPAAHVAIRTVRRFLEKQKGNIAGVVFCTTSSSDTEIYKRLLPLYFPRDKQEEEIAISKLPADVGDENGETVIDERKIRIRPLPAGAVDRTVTSTPLDLPLSDPGSALKRVSFKLDSYLDPSFMSIIKDPDMRRKEQWEKSAQAHKGFNYARLLGYGDLGCPSLSAAEEYSLHSRYLAKANSLNLSEIAEMKIIYRGGVDIEGRPVMVVVGAHFLLRCLDLERFVLHVVKEFEPLIQKPYTIVYLHSAASLQPQPDLGFMKRLQQILGRKHKCNLHAIYILHPSLGLRTAVLAMQMFVDGEVWKKVVYVDRLVQLFKYVPREQLTMPDFVFQHDLEVNGGRGLIVDPRTKHIYQRASS

SEQ ID NO: 16727 - DNA, 2215 bp, Panicum virgatum
  misc_feature: Ceres CLONE 1790130
  misc_feature: Encodes the peptide sequence at SEQ ID NO. 16728
tccgaggaaaaaggagatggcgaggtgtggtccgccgatgcctcatgcctgcaacaactgtgaagatttcagggagcattagggaattatactgttgggagggctgcgttgcaactctgttgaagtgcaagttagaccgtggagaagctctacaacacaagtcttgcctggaagggagaaattttgaaggtttttagcaaggagaaatgttaaggagatgggcaagaaaggaaactggtttactgcactcaagaaggccttcacctccagccccaaggagaagccatcaaatgtgcatcagctggtagcgcagtacccgccgccgcacgggcacgcgagggagaagaagcgatggggcggattcgggcggtcgcggccctacgcggagccggcgtcgccggcggcgggcgcgctgatcaacatcccgctgtaccgcgagccgagcagcatcgagaagatcctcggcgacgaggagatggatcagcagcgccagtactacgccgccaccagggcgcagtaccagatcacggccgccagacccgccgccgtcgccgttagcgctgcttcagctgccgcgccgctgccacagccggtggcaacggcgcgtgagcgcgagcgcgagcgccgcagagacgacaagccggccgccgtggtgctcccgctgcccccgccgtccccgccgccgctgatcaggaggttcgaccacgacagagagcagcagcagaagctgcagcagctccaacagcacagcagggccgagacggagtggcgccatcagcagccgccgaggcggcaccgcgcggcgaggcagcgcgccgcgccgccggaccgcgcgcgcgccgcggccgtggcgatccagtccgcgttccggggctacatggcgcggcggaactaccagtcgctgcgcgggctgatccggctgcagggcgtgatgaggggcgccagcgtgcggcggcagacggcgcatgcgatgcggtgcgtgcagacgctggtgcgcgtgcaggcgcaggtgcgcgccagccgcgtcgaggccatggagcggcgcaaccggcagcaccacggcgccatgctcagggacggcggcaggtggcgcgccggctcgcaggacggcggcatctgggacgacagccggctgacgccggaggaggcggacgcgcggacgaagcggaaggtggaggccgtgatcaagcgcgagagagccctcgcctacgcctactcgcatcagctgctgaaggcgacgccgatggcggcccacgcgatcctggcggacctgcagtcgggccggagcccctggtggtggacgcccatcgagcgccgccacgagccggaggcggcctaccgccccgtcgatcccgccagcaagccccggccggctctcgccaccgcccaccgcgggatgatgacgccgacggcgatgacgacggcggcggcgacgccggcccggtcggtggtctcggcctactccaactccaagccgcggtccacgaggcccgcgcccgccaaggggacggggagcgtgagcatccgcgacgacgagagcctgacgagctgcccgtcgttcggcggcgtgcccaactacatgacgccgacgctgtcggcctccgccaaggcgcgggcgcgggcgcagctcctgctccagcagcagaaggcggcccaggagaagcccaggttctcgttcgggctgggccagggcatcgggagctgggccaagagcccgttctggaaggcgccgtcgtcgcgggtcggcacgccggcggcgtcggcggccggcgggcgccaccggccgacgcggtcgatcagcgggctcagcgtcgactccaccgtgtccatgccggccgggatcggcaggaggcccttcaagtagatacgtgtccaagtccaaccgtgggttgcattcttcttcttcttcctccagcttctctcggacttggatttgtaacgtgattggtggtgtgctttggtgtgggtttccaacacgtttggtggtggttcgttgtgctttacgagcaggctgctctggtcgctggctcctttgtctcgagcccctcgtgtgtttgaggggccagtgagctgttgtggcatgtaaaaactcggagactccaccgaacaatcgttccgtgcgtcaagttcgttcgtgcattgctttgtcagtgggcctctttcacctaggcttcgtgcagagaaattcttacaaaacattttcaccacttttttt

SEQ ID NO: 16728 - protein, 548 aa, Panicum virgatum
  misc_feature: Ceres CLONE 1790130
  misc_feature (207)..(227): Pfam Name: IQ Pfam Description: IQ calmodulin-binding motif
MGKKGNWFTALKKAFTSSPKEKPSNVHQLVAQYPPPHGHAREKKRWGGFGRSRPYAEPASPAAGALINIPLYREPSSIEKILGDEEMDQQRQYYAATRAQYQITAARPAAVAVSAASAAAPLPQPVATARERERERRRDDKPAAVVLPLPPPSPPPLIRRFDHDREQQQKLQQLQQHSRAETEWRHQQPPRRHRAARQRAAPPDRARAAAVAIQSAFRGYMARRNYQSLRGLIRLQGVMRGASVRRQTAHAMRCVQTLVRVQAQVRASRVEAMERRNRQHHGAMLRDGGRWRAGSQDGGIWDDSRLTPEEADARTKRKVEAVIKRERALAYAYSHQLLKATPMAAHAILADLQSGRSPWWWTPIERRHEPEAAYRPVDPASKPRPALATAHRGMMTPTAMTTAAATPARSVVSAYSNSKPRSTRPAPAKGTGSVSIRDDESLTSCPSFGGVPNYMTPTLSASAKARARAQLLLQQQKAAQEKPRFSFGLGQGIGSWAKSPFWKAPSSRVGTPAASAAGGRHRPTRSISGLSVDSTVSMPAGIGRRPFK

SEQ ID NO: 16729 - DNA, 1153 bp, Panicum virgatum
  misc_feature: Ceres CLONE 1790131
  misc_feature: Encodes the peptide sequence at SEQ ID NO. 16730
atcgacgcgaggccccatcggtcgcgttcccgtcggcgagagcgagcgcagcatccgcaccgcgccagcagcatggccgcgccgccgctgctccggcattggccccgcctcgccgtgatcggcgccgtcctcgcgctccacctcgccgccgccgccgcgcagtcgccagcgacgcctgccgcgcccacgaccccggccgcgccgacgacaccggctgcacccacgacccccgctgcgccgaccacccctgctgcacccacgacaccggctgcacccacgacaccggctgcgccgacaacacctgctgcgcccacgacaccggctgcaccgacgacgccggcaacgaccgcgcccaccgcgaccccggccgcgccagcaaacccgccgccgaccccagcggcgcccgcgcccgccgccaccccggtcccgccgtcgaagccgccgccggccgcgcccgctgtcgcgccggccaagcccccgccggtggtgacgcctccccccgcagcgacgccgcctccctcgacgccgccgcctccctcgacgccgccgcccgccacgccgcccgcggtgctcccgccggcggccgcgcctccgccgacgaccactcccccgacagaggcgcccgcgacgctgccccccgccgcgaccccgcccgtggccgaggcccccgcgacgctgccgccggccgaggcgccgtccaagggcaagaacaagcacaagaggaggaagaagcagcacggcaagaaggaggcccccgcggaggcgccgcagccgctgagcccgccggcgcccgccgcgccgtcgcccgccgatctcgaggacgtgtccggccccgcgccgtcggcgttcgatgtgaacgcgagcagccggcagcaccagcactggggcgtcctcgtcctgcagaccgccatggctgcgcttttgctatcgctagcatggtaaatcccagagagattcttcatacatatatcagtgtaccagatgatgatttaattctttccgctgttgctgttcgtgttgtggcatcatagaccggtgagactacctgcgggacctgtcataggaaccattggattctggcttgtgataaatttttgacatgttttgtatccatttttttcgtttatcttggaataaaggctcacatttggtc

SEQ ID NO: 16730 - protein, 289 aa, Panicum virgatum
  misc_feature: Ceres CLONE 1790131
  misc_feature: Useful for making plants with altered cell wall content and/or composition
MAAPPLLRHWPRLAVIGAVLALHLAAAAAQSPATPAAPTTPAAPTTPAAPTTPAAPTTPAAPTTPAAPTTPAAPTTPAAPTTPAAPTTPATTAPTATPAAPANPPPTPAAPAPAATPVPPSKPPPAAPAVAPAKPPPVVTPPPAATPPPSTPPPPSTPPPATPPAVLPPAAAPPPTTTPPTEAPATLPPAATPPVAEAPATLPPAEAPSKGKNKHKRRKKQHGKKEAPAEAPQPLSPPAPAAPSPADLEDVSGPAPSAFDVNASSRQHQHWGVLVLQTAMAALLLSLAW

SEQ ID NO: 16731 - DNA, 1950 bp, Panicum virgatum
  misc_feature: Ceres CLONE 1790133
  misc_feature: Encodes the peptide sequence at SEQ ID NO. 16732
actggaccagaccacgcgtccacgccagttccgcggttccgccatggccacctccaccgccgcgctccacccgcaattccggccaccgctgcgcgctcccgcccgtcgccgcccgctcccacactcctcgtattcctcgttcgcccgcgctcgccctcgcactaccatccgagcctcagcggcgtccgcttccgcgcccgcgcagcaggaggccgtcgcgggcgtcccgtggggctgcgagatcgagtccctggagagcgcggcgtcgctggagcggtggctcatagactcgggcctcccagagcaacgcctggctatccagcgcgtggatgtcggcgagcgcggccttgtcgctctcaagaacatccgcaagggggagaagctgctcttcgtgccgcctgccctcgtcatcactgccgattcggagtggagccgcccagaggtgggggaggtgatgaagaggaacgccgtgcctgactggccgcttattgccacttacctcataagcgaagccagtttagagggatcgtcgaggtggagcagctacatagcagctttgccaaggcagccttactcgcttttgtactggactcgtgcagagctagatgcatacctggtggcttcgccaatcagggaacgtgcagttcagaggataactgatgtgattgggacatacaacgaccttcgagatcgtatattttctaaacattcagatttattccctgaagaggtatataacatagagacatttctatggtcctttggcattctcttctcacgcctggttcgtttgccatcaatggatggaagggttgcactagttccttgggcagatatgcttaaccatagccctgaggtggaaacattcttggacttcgataagtcatcgcaaggaatagttttcaccactgaccgtgcatatcaaccaggtgagcaggtttttatatcttacgggaagaaatccagtggtgagctattgctttcatacggttttgttccaaaagaggggacaaacccaaatgattcagttgagttactggtgtctattgataaatctgacaagtgctacaaagagaagctaaaagcactaaagcggaatggtttgtcagcatctgaaagtttcccattgcgggttactgggtggccagttgagctgatggcttatgccttccttgtggtcagtcctcctgacatgagtcaacgctttgatgagatggctgttgctgcatcgaataaaaattcaaccaaacctggatttaattatcctgaattggaagaacgggctcttcagtttatcctggactgctgtgaatctaatatatcaaagtattccaagtacctagagggtggcaatggctctccacagggttcaataaatgcaaagcaagccaacaggaccttactgctaaaacagctagcaaaagatctgtgcatcagtgaacggagaatcttgtatcgtacacaatatatactgcgtagaagattgagggacatgagaggtggtgaacttagagctttgtcattgttcaatgggctcagaaagctcttcaaataaatgcatcggctacatttctaggtggattggatcttattggatagttttggtttccctgattcaggtgcattgaccttgcagctggagcctccgatgtttcattaccagatcagattgcagtctcagccacaaatttcttatctggagaagcatcaaaatgctagaaaggagcttcggttcaacaaaggatagttgtgaattgtaattgaacagcccaaagcttggcatatatgtaagagtaaattctacatgtagcctgtaaagacagattttacgagaggagctggccggtcgttctgctctgatccctgctatgtagtctaccatatctgatgtttatgtcgtccaaactgtaatccatggtatctgcaactgctgaaaatagttgtgcctac

SEQ ID NO: 16732 - protein, 503 aa, Panicum virgatum
  misc_feature: Ceres CLONE 1790133
  misc_feature (82)..(310): Pfam Name: SET Pfam Description: SET domain
  misc_feature (335)..(470): Pfam Name: Rubis-subs-bind Pfam Description: Rubisco LSMT substrate-binding
  misc_feature: SWISSPROT Homolog: EC 2.1.1.127 [Ribulose-bisphosphate carboxylase]-lysine N-methyltransferase
MATSTAALHPQFRPPLRAPARRRPLPHSSYSSFARARPRTTIRASAASASAPAQQEAVAGVPWGCEIESLESAASLERWLIDSGLPEQRLAIQRVDVGERGLVALKNIRKGEKLLFVPPALVITADSEWSRPEVGEVMKRNAVPDWPLIATYLISEASLEGSSRWSSYIAALPRQPYSLLYWTRAELDAYLVASPIRERAVQRITDVIGTYNDLRDRIFSKHSDLFPEEVYNIETFLWSFGILFSRLVRLPSMDGRVALVPWADMLNHSPEVETFLDFDKSSQGIVFTTDRAYQPGEQVFISYGKKSSGELLLSYGFVPKEGTNPNDSVELLVSIDKSDKCYKEKLKALKRNGLSASESFPLRVTGWPVELMAYAFLVVSPPDMSQRFDEMAVAASNKNSTKPGFNYPELEERALQFILDCCESNISKYSKYLEGGNGSPQGSINAKQANRTLLLKQLAKDLCISERRILYRTQYILRRRLRDMRGGELRALSLFNGLRKLFK

SEQ ID NO: 16733 - DNA, 1495 bp, Panicum virgatum
  misc_feature: Ceres CLONE 1790135
  misc_feature: Encodes the peptide sequence at SEQ ID NO. 16734
cccctctcctcccccctcccggcctcctcccatctcgccctcctcccccctccagccctccgccggctagggttacggccaccgcctcccccccggctccccgtcggcggaggagtaggggcgcggcggcggagatggacccggacttctcgcccgggggcggggggcccagcttcgagttcgccttcaacgaggtcaacttctccgaccgggagctgcggatcgaggtcgtcccgggggaagacgacgcgccgggatccagcggcgccggcgcaggaggtggggggctcgccgactgggcgcgccaccgcaagcgccggcgcgaggagctcctcaaggagaaagaatctacaactcacatgtcagaccagacgaattgcaatgaagttgaagcagaagaatgtgatgcatatgaagaaaatcaagaggaacctgtagcaatgatagaagaatctccacctgatgttggtcaagatggtgatgatggacaaggtattgattcgtcttggactgttgtgggtacgccagttttacgagtaaagacgatttatatcagctcagcaattcttgctgcgaagagtcctttctttttcaagcttttctcaaacggcatgaaagaatctgatcagagacatgcaacccttagaattactgattcagaggaaactgccctcatggagcttttaagctttatgtatagtggaaagctgacaactactgagcccactgttctgctggatatcctgatggcagctgacaaatttgaggttgtttcatgcatgaggtactgcagccaattgctcacaagcttgcctatgactacagagtctgcactactctacctagatctcccgtgctccatttcaatggccgctgcagttcaacctctgacagatgcagccaagaatttccttgccgtaaaatacaaggatttgactaagttccaggatgaagtgatgaacatccctcttgctgggatcgaagccatcttgtcaagtaatgaccttcaggtggcatctgaagataccatctatgacttcttgctcagatgggcccgtgcgcaatacctgaaaccagaggagagacgtgagatcttgagctctcgtctgctccctcttgtgcgattcagtcacatgacctgtaggaagctgcggaaggtcctaacatgcactgatatcgaccatgagcaagcaaccaagtgtgtcactgaggcacttctatacaaggctgatgcaccgcacaggcaacgagttcttgcagcggacacagtaacatgtcggaaattcgccgagcgggcttacaagtacagacctctgaaagtcgttgagtttgatcggccctacccgcagtgcatagcatacttggatctcaagcgtgaggagtgctctcggctcttcccttcaggccggatatactcgcaagcattccatcttgcagggcagggcttcttcctctcagctcactgtaacatggagcagcagagcacgttctactg

SEQ ID NO: 16734 - protein, 453 aa, Panicum virgatum
  misc_feature: Ceres CLONE 1790135
  misc_feature (121)..(223): Pfam Name: BTB Pfam Description: BTB/POZ domain
  misc_feature (236)..(344): Pfam Name: BACK Pfam Description: BTB And C-terminal Kelch
MDPDFSPGGGGPSFEFAFNEVNFSDRELRIEVVPGEDDAPGSSGAGAGGGGLADWARHRKRRREELLKEKESTTHMSDQTNCNEVEAEECDAYEENQEEPVAMIEESPPDVGQDGDDGQGIDSSWTVVGTPVLRVKTIYISSAILAAKSPFFFKLFSNGMKESDQRHATLRITDSEETALMELLSFMYSGKLTTTEPTVLLDILMAADKFEVVSCMRYCSQLLTSLPMTTESALLYLDLPCSISMAAAVQPLTDAAKNFLAVKYKDLTKFQDEVMNIPLAGIEAILSSNDLQVASEDTIYDFLLRWARAQYLKPEERREILSSRLLPLVRFSHMTCRKLRKVLTCTDIDHEQATKCVTEALLYKADAPHRQRVLAADTVTCRKFAERAYKYRPLKVVEFDRPYPQCIAYLDLKREECSRLFPSGRIYSQAFHLAGQGFFLSAHCNMEQQSTFY

SEQ ID NO: 16735 - DNA, 121 bp, Panicum virgatum
  misc_feature: Ceres CLONE 1790135-R
acaggaaacgcggagccagcccaaggcagacaaccaaggccgacgacagccccaacccaacgacgggaggcagcaccggagagcggagcggacgagaaagcaacccaagagcgacacggca

SEQ ID NO: 16736 - DNA, 731 bp, Panicum virgatum
  misc_feature: Ceres CLONE 1790141
  misc_feature: Encodes the peptide sequence at SEQ ID NO. 16737
gccgcccgcccgtgcgttttccttcccttgtctcttgcttgcctgctcgcgaggctttgcgtcacccgccgatcgagttctccagactccaggctcctccgttcctagctccggaggccggggcgatcggcgcgcagcttcggatagagtactagagaatggccgacgaggatattcagcctattgtgtgtgacaatggcactggaatggtcaaggctggttttgccggtgatgatgcaccaagagctgtctttcccagcatcgtgggaaggccacgccataccggcgtcatggttggcatgggccagaaggatgcctatgtgggcgatgaagctcaggcgaagagaggtatcctgacactgaagtacccaattgagcacggcatcgtcaacaattgggatgacatggagaagatctggcatcacaccttctacaacgagctccgtgtagcgcccgaagaccaccctgtactgctgaccgaggcccctctcaaccctaaggccaacagagagaagatgactcagatcatgtttgagacctttgaatgtccggcaatgtatgttgcaatccaggccgttctatccttgtacgctagtgggcgaacaacagggattgtgctggactctggtgacggtgtgagccacactgttccgatctatgaaggatacacacttcctcatgctattctccgtttggacctcsccggccgtgaccttactgatcacctaatg

SEQ ID NO: 16737 - protein, 190 aa, Panicum virgatum
  misc_feature: Ceres CLONE 1790141
  misc_feature (3)..(190): Pfam Name: Actin Pfam Description: Actin
  misc_feature: SWISSPROT Homolog: EC 2.7.10.2 Non-specific protein-tyrosine kinase
  misc_feature: Useful for making plants with modulated biomass
  misc_feature: Useful for making plants with modulated flowering time
  misc_feature (182)..(182): Xaa is any aa, unknown, or other
MADEDIQPIVCDNGTGMVKAGFAGDDAPRAVFPSIVGRPRHTGVMVGMGQKDAYVGDEAQAKRGILTLKYPIEHGIVNNWDDMEKIWHHTFYNELRVAPEDHPVLLTEAPLNPKANREKMTQIMFETFECPAMYVAIQAVLSLYASGRTTGIVLDSGDGVSHTVPIYEGYTLPHAILRLDLXGRDLTDHL

SEQ ID NO: 16738 - DNA, 650 bp, Panicum virgatum
  misc_feature: Ceres CLONE 1790141-R
  misc_feature: Encodes the peptide sequence at SEQ ID NO. 16739
tcagaaaggttcaggtgccctgaggtgctcttccagccatctctcgtgggcatggagtctcctggcatacatgaagctacatacaactccatcatgaagtgcgatgtcgatatcaggaaggatttgtatggtaatgttgtgctcagtggaggatctactatgttccctgggatagctgatcgtatgagcaaagagatcacgtccctggctcctagcagcatgaaggttaaagtgattgcgccacctgaaaggaaatacagtgtctggattggtggctctatactggcatctctcagcacttttcagcagatgtggatctccaaggcagagtatgacgaaaccggtcccggcattgtccacatgaagtgcttctaagtgtctgggagaagcttgacatggcacatccaagaaggttgccgcctggtcagcccgttgccctggagcaatgcagaagaggcagccgcagagtatcaagtggacagaaataaacagtacccgtgtacactagtacgtgttgctccgtgtcgtattgaatggtttgttcatatatctggtttgctgtttcgtatcatacctagtttgcgttttggttccggctgatgtctatgcgagtctgaggtaataatacagtaatctgcataatttcccgg

SEQ ID NO: 16739 - protein, 124 aa, Panicum virgatum
  misc_feature: Ceres CLONE 1790141-R
  misc_feature (1)..(124): Pfam Name: Actin Pfam Description: Actin
  misc_feature: Useful for making plants with modulated biomass
  misc_feature: Useful for making plants with modulated flowering time
SERFRCPEVLFQPSLVGMESPGIHEATYNSIMKCDVDIRKDLYGNVVLSGGSTMFPGIADRMSKEITSLAPSSMKVKVIAPPERKYSVWIGGSILASLSTFQQMWISKAEYDETGPGIVHMKCF

SEQ ID NO: 16740 - DNA, 1664 bp, Panicum virgatum
  misc_feature: Ceres CLONE 1790152
  misc_feature: Encodes the peptide sequence at SEQ ID NO. 16741
aactacaacgtgccaccgcgaaactacagtctacattacaatccgaagtggcaaaagcaaagcttgccattttccagcacctcgccggtagtgcagccatgaaggtagagcgcgacctccacatgagccgtggcgacggcgagaccagctacgcctccaactccaggcttcaggagaagtcgatactgaagacgaggcccgtgctccacgaggccgtggcggccgcgcgcgcatcggcgtcgctctcctccgccgccgcgatggtcgtcgcggacctcggctgctcgtcggggcccaacacgctcctcgtcgtctccgaggtgctcggcgcggtcgccaccggcggccgccgggaggcggaggagctgcggctggtgacgggcggccagcaaccgcagccgccggcgcagcacgtgcagttcttcctgaacgacctccccgggaacgacttcaacctcgtcttccagtccctggagctgttcaagaagctggccgccagggacaagcgggactccttgccgccgtactacgtcgccgggctgccggggtccttctacaccaggctcttccccgaccgctccgtccacctcttccactcctcctactccctcatgtggcgatccaaggcacgcacagatttaaccaatcaacatttaagtgatgaagtgactttgccaccggcctgatgctgcagttctgatcgatacagcttcatatatgtgtgtgtcgtgtgtctctaggtacctgaggagctcgcgagaggcacggttctgaacgagggcgacatctacatctgggagtccacgccgccgccggtggtgaagctgtacaggaagcagttccaggaggacttctcgctgttcctcaagctgcgtcacaaggaactcgcgtccaacggccagatggtgctggcgttcctgggcaggaagaaccaagacgttctgcgtggcgaagtcagctacatgtgggggctgcttgcgcaggctcttcagtcccttgtaaaagagggccttgtggagaaggagaagctggactccttcaacctcccgttctacgcgccttcggtggacgaggtgcgggacgtgatcaggcagagcgaggcgttcgacatcaaccacatccacctcttcgagtccaactgggatccccaagacgacctggacgacggcgacctcgtgctcgacagcgcccagagcggcgccaacgtcgcccagtgcatcagggctgtgatcgagcccctggtcgcgcaccattttggcgagcacatactcgacgatctcttcgagatttatgcgcggaacgtcgcggcgcacctccggaaagtgaagaccaagtaccctgtcatcgtcctgtccttggcggcgaggcgcgcgcccaagtaccaaacgaatggcgattgctattcgcttttcacacgaggccagttaatgtagaaatgactaataatttgggacagagggagtatataaaatgcagctacagaatatatatagttcgtggactattagtagcagagaatagttcctccactgcttcctttggatttaactggttcagcatttccaaaatgtcaatctatcaggttaaatatgtaccgtaatcttaagtgtctaggtaatgccttgtgctgtacgtaatctcgagttaatatattgaaaagttcc

SEQ ID NO: 16741 - protein, 195 aa, Panicum virgatum
  misc_feature: Ceres CLONE 1790152
  misc_feature (36)..(193): Pfam Name: Methyltransf_7 Pfam Description: SAM dependent carboxyl methyltransferase
  misc_feature: SWISSPROT Homolog: EC 2.1.1.141 Jasmonate O-methyltransferase
MKVERDLHMSRGDGETSYASNSRLQEKSILKTRPVLHEAVAAARASASLSSAAAMVVADLGCSSGPNTLLVVSEVLGAVATGGRREAEELRLVTGGQQPQPPAQHVQFFLNDLPGNDFNLVFQSLELFKKLAARDKRDSLPPYYVAGLPGSFYTRLFPDRSVHLFHSSYSLMWRSKARTDLTNQHLSDEVTLPPA

SEQ ID NO: 16742 - DNA, 2545 bp, Panicum virgatum
  misc_feature: Ceres CLONE 1790169
  misc_feature: Encodes the peptide sequence at SEQ ID NO. 16743
atccgcctccccactccagccgagcatttcctccattgcgacggggcgggcaggctcgctcggttcatccatgcacgggatgggtgtcttgttcctctaatccctgagaataatatcgccgcccttacatgatccgtctcccccggtgatgtttacgcgagaggaattctagcccgcccgtgatcgttgtcacctcgccgcgagattctccgtccaaacgccagaaccagggtccccttttaaagccagggagctcctgctcccgagttcccccaaacacttcaccagctagcttgctagctagccatggaggcctcggcagccgtcgagtcgtcggccaccgtgtccgcattcgaggtatccaggcgcccggacacggccaagctcgtgctcaacagccccggcccgctgagcctgcgcgaggagctcgccgccgtggtcggcaaggcgttccggccacgggcctccggcggcggccgggcgccgcggtgcgcgtgggtcctcacggcgctgcagtgcgtgttcccggtgctgcagtgggggaggagctacaacctcaagtccttcaggagtgacatcatggccggcctcactctcgccagccttggcatcccgcagagcattggatacgccaatcttgccaaactggaccctcagtacggcctttacacgagcgttgtgccgcctctgatctacgctgtcatggggacgtcgagggagatcgccatcggccccgtcgccgtggtctcgctgctgctgtcgtcgatgatccagaacatcgtcgacccggccgccgacccggcgacctaccggtcgctcgtcttcacagtgactttcctcgccggggtcttccaggtgtccttcggcctgttcaggctgggatttctcgtcgatttcctgtcacacgctgccatcgttgggttcatggcaggcgcggccatcgtcatcgggctgcagcagctcaagggcctccttgggctcagccatttcacaaacagcaccgacatcgtctcggtgatcaaggctgtgtgctcggcgctacacgacccgtggcacccgggcaacttcttcatcggatgctccttcctcatattcatcctcgccacgcggttcatcgggaggaggtacaagaagttgttctggctttctgcgattgcacctttgatctcggtgattctgtccactactgtggtctacgctacaagagctgacaagcatggcgtgaagatcatacagaaggtgcatgcaggggtgaacccaagctcggtcaagcagatacaactgaatggacctcatactgcagagtgtgccaagattgccatcgtctgtgcagtcatcgcacttacggaagctattgccgttggacggtcttttgcttcgataagagggtacaaacttgatggaaacaaggaaatgctcgccatgggattttcaaatgttgctggatctcaatcctcatgctatgtcgcaacaggttcattctcccgtacagcagtgaacttcagcgcaggcgccaggtcaacgatgtcaaacatcatcatgtccatcactgtgttcatcaccttagagttgtttatgaagttcctatactacacacccatggcggtgctcgcctccatcattctatcagctcttcccggactgattgacatcaaagaagcttgcaacatatggaaagttgacaagatggatttcctcacatgccttggcgcattcgttggtgttttatttggttcggtggagatcggccttgcagttgcaattgccatttccttcgcaaagatcatcatacattcactccgacctcaagtagagattcttggcaggctacaagggacaaatatcttctgcagcatcaggcaataccctgtggcttgccgaactccgactgtactgacgatacgcattgacacatccttcatgtgtttcatcaatgccactttcatcaaagaaaggatcataaattgggtccgggaagaagtggaggcatcagatggaaagggcaaagagaggatacaagcagtggtccttgatatgtcaagtgttgtaaacactgacacttcagggctaacagcactagaagacatacacaaggagttggtgtctcttggcatacagatggctatagctggtccaggatggaatgcagtacagaagatgaaagtgtcacgggtcgtggacagagtaggagaagattggatattcctgacagtaggtgaagcagtggaggcctgtctaagtgcacataagggaacggctctcgaatgttgagcgagcgcgtgctaatcattagaaataatcccataagtgatgcagatctgcatcctatgaaggtgttactgcaatgtttgcacatgatgagcaggcatgttgtggctggtggctggtggggaacaaaaccccgccgtgctacaaagagtcatgtttggtgttctggtcatttactcaacctagtatgtctctggatgttatttcttcctaaacaaggatgaatcgaccctagaaacgtagtactcctagcaagagctacaggaaatttagaacc

SEQ ID NO: 16743 - protein, 654 aa, Panicum virgatum
  misc_feature: Ceres CLONE 1790169
  misc_feature (186)..(497): Pfam Name: Sulfate_transp Pfam Description: Sulfate transporter family
  misc_feature (520)..(639): Pfam Name: STAS Pfam Description: STAS domain
MEASAAVESSATVSAFEVSRRPDTAKLVLNSPGPLSLREELAAVVGKAFRPRASGGGRAPRCAWVLTALQCVFPVLQWGRSYNLKSFRSDIMAGLTLASLGIPQSIGYANLAKLDPQYGLYTSVVPPLIYAVMGTSREIAIGPVAVVSLLLSSMIQNIVDPAADPATYRSLVFTVTFLAGVFQVSFGLFRLGFLVDFLSHAAIVGFMAGAAIVIGLQQLKGLLGLSHFTNSTDIVSVIKAVCSALHDPWHPGNFFIGCSFLIFILATRFIGRRYKKLFWLSAIAPLISVILSTTVVYATRADKHGVKIIQKVHAGVNPSSVKQIQLNGPHTAECAKIAIVCAVIALTEAIAVGRSFASIRGYKLDGNKEMLAMGFSNVAGSQSSCYVATGSFSRTAVNFSAGARSTMSNIIMSITVFITLELFMKFLYYTPMAVLASIILSALPGLIDIKEACNIWKVDKMDFLTCLGAFVGVLFGSVEIGLAVAIAISFAKIIIHSLRPQVEILGRLQGTNIFCSIRQYPVACRTPTVLTIRIDTSFMCFINATFIKERIINWVREEVEASDGKGKERIQAVVLDMSSVVNTDTSGLTALEDIHKELVSLGIQMAIAGPGWNAVQKMKVSRVVDRVGEDWIFLTVGEAVEACLSAHKGTALEC

SEQ ID NO: 16744 - DNA, 2562 bp, Panicum virgatum
  misc_feature: Ceres CLONE 1790174
  misc_feature: Encodes the peptide sequence at SEQ ID NO. 16745
tttcctgatgcgaggaagagaggaggttgtgagggcgctgctcgctgtggtggtggtggctggactgtcgctgttgtcggcgggggcggaggctgatggcggcagcctccggcggaggtcgctccaccagccgttcttccccatcgactccacgccgcccccggggtccgatgactcgatcgtgccgcctcctcccccgccggatgcctcggcggcggcggcggcggccaagggcggcgggcggtcctcgcccagcgtgacgaacgccgtcgccatcgcgctcgccacgggcctcgtcgcgctcgcggtggcgttctactcgtgcttcctcctgtggcggcgccgctccggcggggccggcgacagcggcagcgtcctccgtgccgcgaagccggcgcggcccgacgccggcgccgcggccgtgagggttgccagcgacctcgggagcagcgcgcggcaccagaggtcgccgccgccgagctcgacggcgtccgacgcgatatacctcgacccgctaacgaccatggtggaggtgggcctccaccggccgccgagcccggacctccgcccgctcgcgctcgtgaagcagccgagccccgacctccggccgttgccgccgctgaagcggccggcgtcgcagcccccgcccccgccggcgtccacgcctccgatgaccaccacgggggattcctccgatgaggaggaccaggccacgttctacaccgcgccgaagaccgccaagtcctggttcagccggagcacgagccagcgcagcgccctggagcaaactgctcctcaaccgcccgcgcctgttcccgtgcccgtgcagtccacaccaccgcctccgccacagtccaatcccccacggcctgttcgtccgccgccgcccccaccgccgccgaggcagaggctgctgcgaccgatgcccacggagtccccgtctcccgccgtcctcgccagtttggcgctaaccaatccccctgagccctctgttgaggacagaggaggcgagaatcccgacggccacggtgggaaagcgcggccgccgaagcccccgagcctgaagccgctgcactgggacaagctgcgcgccatttccggccgcaccaccgtctgggaccaggtcaataactccgactcgttccgcgtggacgaggcggcaatggagagcttgttcctgaataacaccggcggcgcggggaattccgatcagacggcgaggaggggaggcgccgggaagcaggagagccggttgctcgacccgaaacggctgcaaaacgtcgcgatcatgctcaaggcgctcaatgtgacgtcggataatgtgattggagcactcatgcacggaagtggagatttggggtctgagttctatgaaacgctagctaagatggcacccaccaaagaagaagaattgaaattaaaagattatactggtgatatatcaaaacttgatccagcagagcactttctgaaagacgtacttgatgttccttttgccttcaaaagagtagacgcattgctgtacagagcaaactttgatactgaagtggattatttgaagaattcttttggtaccctggaggcagcctgtgcagatctgagaagcagcaagttattcatgaagttgctagatgcagttctgaagactgggaaccgcatgaacgatggaactaatcgaggcgaagccagggccttcaaacttgacactctcctaaagcttgcagacatcaagtcgacagatggaaaaacaacagtgctccatttcgtggtacaagagatcatccgatcagaaggcttaagttctgatcaaacagcagtagtaaattctggcatcgccagcaaggagcagttcaagaaggacggccttaaagtacttgctgggctcagcagtgagctctcaaacgtgaagagggcggccgcattggagatggatacgctgattggcaatgtctcgaggctcgaaaccgacctcgagaaggtgaagcttgtcatgcagctcaaggagacatgtcctgatcaggactcaagcgagaagttcttcgacgagatggacgcgttcctcggaagatctcgggtggagatcgagagcgtgaaggcggccggggagagcgcgcagcagcgcgtgaaggagaccacagagtacttccacggcgacgccaccaaggaggagcctcatccgctgaggatcttcatggtggtaagcgacttcctgtcgacgctggaccgtgtgtgccgggatgtcggtaggacgccggagagggtgatgatggggtccggcaagtcgttccgtgtctcggcgggcacgtccttgccgccgcgccggcacgagcagcggagggagccgagctcttccgacgaggatagctcgtcgtcttaagcagaactactaggaaaccatttttttgatgcataggatagttgtccggatttgagggctgtgattcttgcagaattgagcatgtgtagtcgatgtcagaactcaggacataaagtcactgtgtaatagctttacaaaggttaaaagatagacatacagtatataagacagaggcttctcactcc

SEQ ID NO: 16745 - protein, 789 aa, Panicum virgatum
  misc_feature: Ceres CLONE 1790174
  misc_feature (343)..(739): Pfam Name: FH2 Pfam Description: Formin Homology 2 Domain
MRGREEVVRALLAVVVVAGLSLLSAGAEADGGSLRRRSLHQPFFPIDSTPPPGSDDSIVPPPPPPDASAAAAAAKGGGRSSPSVTNAVAIALATGLVALAVAFYSCFLLWRRRSGGAGDSGSVLRAAKPARPDAGAAAVRVASDLGSSARHQRSPPPSSTASDAIYLDPLTTMVEVGLHRPPSPDLRPLALVKQPSPDLRPLPPLKRPASQPPPPPASTPPMTTTGDSSDEEDQATFYTAPKTAKSWFSRSTSQRSALEQTAPQPPAPVPVPVQSTPPPPPQSNPPRPVRPPPPPPPPRQRLLRPMPTESPSPAVLASLALTNPPEPSVEDRGGENPDGHGGKARPPKPPSLKPLHWDKLRAISGRTTVWDQVNNSDSFRVDEAAMESLFLNNTGGAGNSDQTARRGGAGKQESRLLDPKRLQNVAIMLKALNVTSDNVIGALMHGSGDLGSEFYETLAKMAPTKEEELKLKDYTGDISKLDPAEHFLKDVLDVPFAFKRVDALLYRANFDTEVDYLKNSFGTLEAACADLRSSKLFMKLLDAVLKTGNRMNDGTNRGEARAFKLDTLLKLADIKSTDGKTTVLHFVVQEIIRSEGLSSDQTAVVNSGIASKEQFKKDGLKVLAGLSSELSNVKRAAALEMDTLIGNVSRLETDLEKVKLVMQLKETCPDQDSSEKFFDEMDAFLGRSRVEIESVKAAGESAQQRVKETTEYFHGDATKEEPHPLRIFMVVSDFLSTLDRVCRDVGRTPERVMMGSGKSFRVSAGTSLPPRRHEQRREPSSSDEDSSSS

SEQ ID NO: 16746 - DNA, 1757 bp, Panicum virgatum
  misc_feature: Ceres CLONE 1790185
  misc_feature: Encodes the peptide sequence at SEQ ID NO. 16747
actttgtgctctgcttcaatcattcgagcaccaaggccacgaccatggcgtcgctcccgctgcacctgctcctcttcctcccactcctcgccgccgtctcataccactggctcaaccgtgccgcgtcgcgctggcgaggcggcgacgcgcggctgcccccgtcgccgtgggcgctcccggtgatcggccacctgcaccacctcgcgggcacgctcccgcaccgcgccatgcgcgacctcgcggcgcgccacggcccgctcatgctgctccgcctcggcgggctccccgtcgtcgtcgcctcctcggcggacgccgcccgggaggtgatgcgggcgcgcgacctcgacttcgcgacgcgccccgtgacgcggatggtgcggctggtcatccccgcgggcgccgagggcatcatcttcgcgccctacggcgagggctggaggcagatccgcaagatctgcaccgtcgagctgctcagcgcccggcgcgtccagtccttcaggcccatccgcgaggaggaggccggccggctcctccgcgccgtggcgtcggcgccgccgccgcgggcggtgaacctgagcgagctgctctccgtgtacgccgccgactcgtcggtgcgcgccatcatcggcagccggttcaaggaccgggacacgttcctggtcatgctggagcgcgggctcaagctgttcgccaagatgagcctgccggacctcttcccgtcgtcgcgcctcgccatgctcgtcagccgaatgcccggccggatgcagcggcaacggcaggaatcggtggcgttcatggacgccatagtccgggagcacgaggagagcagggtagccgacgacggcaaggaggacctgctcgacgtgctcctgaggatccagagggagggtgatctgcaggttccgctcaccgctgacaacatcaagtcagcggtcggagacctgttcgctggaggcaacgagacggcggcgacgtcgctgcaatggaccatggccgagctcatgaggaccccgagagtgatgcggaaggtacaagacgaggtctggcaagcacttgccggacggcctacagtgacggaggatgaccttggcgatctgcgttacatgcggctagtgatcaaggagtctctccggctacacccacccgtgccacttctacttccacgagaatgcaggaacacatgccgggtcctagggttcgacgtgccggtgggcaccatagtgttcgtgaacgcatgggcgatcgcgagggaccccaactactgggagaagccggaggaattcgtgccggagaggtttgagaacagcaaggttgatttcaaggggacggacttcgagtacctgccgttcggggccgggcggaggatgtgcccgggaatggtgtttgggcttgtgcacctggagctcgcgctcgccggcctcctctaccattttgactgggaaatgccgtcaggaatgaaggcggcggatctggacatgactgaggaaatgggggtcacaacccggcggcttcatgacctccggcttgttcccgtcgtccgagtgccggtgccggtggagtagtggtccgggtgtggtgcttttgtgtttcttggtgcaccagcaatggcggcgtttggagacatgcacttctcatatgaacatgagacccgccgaaactactaataaggtccctgtatatttgtacgagtaaagtccctggagttatgcattcggaactgcatgtcctaatatattaatgacttattttatcagtgg

SEQ ID NO: 16747 - protein, 505 aa, Panicum virgatum
  misc_feature: Ceres CLONE 1790185
  misc_feature (38)..(494): Pfam Name: p450 Pfam Description: Cytochrome P450
  misc_feature: SWISSPROT Homolog: EC 1.14.13.68 4-hydroxyphenylacetaldehyde oxime monooxygenase
MASLPLHLLLFLPLLAAVSYHWLNRAASRWRGGDARLPPSPWALPVIGHLHHLAGTLPHRAMRDLAARHGPLMLLRLGGLPVVVASSADAAREVMRARDLDFATRPVTRMVRLVIPAGAEGIIFAPYGEGWRQIRKICTVELLSARRVQSFRPIREEEAGRLLRAVASAPPPRAVNLSELLSVYAADSSVRAIIGSRFKDRDTFLVMLERGLKLFAKMSLPDLFPSSRLAMLVSRMPGRMQRQRQESVAFMDAIVREHEESRVADDGKEDLLDVLLRIQREGDLQVPLTADNIKSAVGDLFAGGNETAATSLQWTMAELMRTPRVMRKVQDEVWQALAGRPTVTEDDLGDLRYMRLVIKESLRLHPPVPLLLPRECRNTCRVLGFDVPVGTIVFVNAWAIARDPNYWEKPEEFVPERFENSKVDFKGTDFEYLPFGAGRRMCPGMVFGLVHLELALAGLLYHFDWEMPSGMKAADLDMTEEMGVTTRRLHDLRLVPVVRVPVPVE

SEQ ID NO: 16748 - DNA, 667 bp, Panicum virgatum
  misc_feature: Ceres CLONE 1790187
  misc_feature: Encodes the peptide sequence at SEQ ID NO. 16749
acaccacagtggtggaaggaaaggaaacgagatggagagagaggacccccccccccaccccccccgatctcctcctccgcccaccccgatcgcccgaccgatcgccgctccgtgaagcttccgggtaccctccccgccgcccgcgacgccatggagccgccgcacgccgaggaggccgccgccgcgggaggaggaggcggagagggcggccgcgcgagcccgggcaccggcctcgaagggccgatgctgagggtggggcttgacggcggcgggggcggggaggacggggagcgggaggcggacgcggaggcggacgcgcggctgccggagcgcccgggcgaggcggactgcggctactacctccgcacgggcgcctgcggcttcggggaccgctgccgctacaaccacccccgcgatcgcggcggcactgagtttggaggaggtgccaagaatggagcagcatcagactttccagagagacagggtcaacctgtatgcgagtattatttgaagactggtacttgtaaatttggttccaattgcacataccaccatcctaaacaagatggatcagtgcaatctgttatattggacaacggtggattccctctacgcccgggtgagaaagaatgctcctactatatgaagactggggcatgcaagtttg

SEQ ID NO: 16749 - protein, 172 aa, Panicum virgatum
  misc_feature: Ceres CLONE 1790187
  misc_feature (62)..(88): Pfam Name: zf-CCCH Pfam Description: Zinc finger C-x8-C-x5-C-x3-H type (and similar)
  misc_feature (111)..(137): Pfam Name: zf-CCCH Pfam Description: Zinc finger C-x8-C-x5-C-x3-H type (and similar)
MEPPHAEEAAAAGGGGGEGGRASPGTGLEGPMLRVGLDGGGGGEDGEREADAEADARLPERPGEADCGYYLRTGACGFGDRCRYNHPRDRGGTEFGGGAKNGAASDFPERQGQPVCEYYLKTGTCKFGSNCTYHHPKQDGSVQSVILDNGGFPLRPGEKECSYYMKTGACKF

SEQ ID NO: 16750 - DNA, 202 bp, Panicum virgatum
  misc_feature: Ceres CLONE 1790187-R
gcggggaccgcggggcaggggaggcccgaaaggggaaaaagaaggaagggcaggaaacggcaggagcgacagcaagaagggcaaagcggcgagacccagggccacccacgcgggaaaaaaagcccaggcaaggaaaccaccgggggaacaggaaaaacggcacaggcagagggaccgggggcaccccgccacagcaccaaag

SEQ ID NO: 16751 - DNA, 1899 bp, Panicum virgatum
  misc_feature: Ceres CLONE 1790190
  misc_feature: Encodes the peptide sequence at SEQ ID NO. 16752
agcaacggcgccccattttatctcttcccacctccagcttccccaccgcccattcccacgcgccgtcgccgtcgccgccacggccatggccgccgccgcctcctgctctcgcccgcccttcagccccgccgcgtctctacaccaccaaccccacgacgcccgccgctgcggcttctccccgctgccgacgccaccgccgccgccgcagcgagcgctcctctggcggcggccgcggcggctggcgcccaccacgttctgctccgctccgtcgctgccccgcctgggacgcgtcggctggccgcgcagggaggggaacgcctggctgctctcgttccgcggcgacaccgccgcggcgccgagccccgcgttgggggtgggggacccctcgaaggcgctctccgcgctgctcccgcttgtcgtcgccgccaccgccgtcgcggcgctcgggaaccccgccaccttctcctgggtctcaaaggattactacgcgccggcgctcgggggcatcatgctgtccattggcatcaagctctccgtcgacgacttcgctctcgccttcaagaggcctgtgccactctccattggttatgccgcacagtacgtgctcaagccactactgggcgtgatggttgcaaaggtattcaggatgccatcagcattcttcgcgggcttcatgcttacttgctgcgtctcaggcgctcagctgtcaagctatgcaagcttcctcagcaaaggggatgtggccttgagcattttattgacaagttgctcaacaatatcttcggtggtcgtgacacctgttctcaccggattgttgatcggttcagtggtcccggttgatggaattgcgatggcaaaatctattcttcaggtggtgcttgttcctgtgacgctaggccttctcctgaatacctatgcaaagggagttgtgaatgtaatacaaccagcaatgccatttgttgctatggtgtgcacatctctgtgtattggcagcccacttgctatcaataggagcaagatcctctctccagaaggattcttcttacttctccccatagttgctttccacattgtttcatttgttgcgggttactgggtctccaagttgccacaatggaggcaagatgagcctgtttgcaggacaatttccgtttgtactgggatgcagagctccacccttgctggacttcttgcgacacaatttctcggaaccagtcaagcagttcctgcggcatgttctgttgtcatcatggccatttttggtttgactcttgcatcatactggggtagtggctcgcgaataagagatgtcgctgggggatttttaccacaagccaccgcaagtttgagcccgtgacaggcagcagcacgccagatggtgatttttccatggatccccttgagagttgagagaccaattccagaaattcatctgccaaatgagactggagctacaatgaagtcgtccttcagcacaattttgcatgaggtatgccatggctacaaaagagaactacagattgtgggctttttgataataaggatcaagggctcaaggcgaacaaccttatgacaagaggcacttgtacaagatgctgagtttgcagtcatactcacacatcatacagtatattgtaggtttggttagttgtctcttagcagctccttgtagatatagataccactagacacgatcgaggatgctcatatattagaggtgtagtgcaatacatatgtctctgcaatatcattggcgcttacgccccattgttcttaaaatgaatcccacgatcagattttatttttcttttcggcaatgctctttctttgctgcgcgatgaactcatactcttaaagagtggagcattatatcatggctagagcttcgttttctgcttg

SEQ ID NO: 16752 - protein, 423 aa, Panicum virgatum
  misc_feature: Ceres CLONE 1790190
  misc_feature (135)..(315): Pfam Name: SBF Pfam Description: Sodium Bile acid symporter family
MAAAASCSRPPFSPAASLHHQPHDARRCGFSPLPTPPPPPQRALLWRRPRRLAPTTFCSAPSLPRLGRVGWPRREGNAWLLSFRGDTAAAPSPALGVGDPSKALSALLPLVVAATAVAALGNPATFSWVSKDYYAPALGGIMLSIGIKLSVDDFALAFKRPVPLSIGYAAQYVLKPLLGVMVAKVFRMPSAFFAGFMLTCCVSGAQLSSYASFLSKGDVALSILLTSCSTISSVVVTPVLTGLLIGSVVPVDGIAMAKSILQVVLVPVTLGLLLNTYAKGVVNVIQPAMPFVAMVCTSLCIGSPLAINRSKILSPEGFFLLLPIVAFHIVSFVAGYWVSKLPQWRQDEPVCRTISVCTGMQSSTLAGLLATQFLGTSQAVPAACSVVIMAIFGLTLASYWGSGSRIRDVAGGFLPQATASLSP

SEQ ID NO: 16753 - DNA, 3100 bp, Panicum virgatum
  misc_feature: Ceres CLONE 1790191
  misc_feature: Encodes the peptide sequence at SEQ ID NO. 16754
accacctgacgcggccacacctgtcccggcctccgccttaccatgtccccccacctgcagctccccctcctcccctcccgccccgcacgccgctgcgcgctcccatgccgccgccgcagccgcagcgccggctccatggcttcctctccctgctcctcctcctgtccctgctgctcgcgaggtggaggcccgcggcggcgtccgcgctctcgaccttcgcgctggccaaggcaggcgacgcgaccatagtgtgcggcctcctgccgtccgcgtcctcgccgctgctggcggacctcaactgcacggcggcgggcggcgaccacgcgcgccaggagacgtacccgtcgtcgcaccccttcgcggcgctggcgggtggcgaggacttcctctgcgccgtggggccctccggggagcgcgccgacgccgtcaacatgcgctggtgggacctgtcgcccggcgcgcccggccgcgccaagcgggtctactccggtccgccgctcagcgcgctcgccgccggggagtaccgcgtctgcggggtgctcgacagcggggagctccactgctggcggtggcgcgggctgggcatccccgcggacctccgcttcgtcgccgcggccgtcggggacggcttcgtgtgcggcatcctccgggacgccgcgtccatccgctgcttcgggaacgacacggcggacgcggccgtcgccgacgcgccggcgggcgggagctacgacgtggtggcggcctgcagcacccgcgcgtgcgcgctctccacggcgggggagctcacgtgctggggccgcgggaggcctgagctcgcggtcgacggcgcggccgccgggtacgccgcgctggcattgggcgaggacggcgtctgcggcctgcgcaccaacggcaccatccgctgcttcggccgcggcgtcgcctcgccgccgggcagcctcgccggcgcgcagtacctcgacgtcaaggcgcagggcaaggcgttctgcggcgtcctcatggccaactactccctcgtctgctggggcggccgcgagttcaacgacaccaaccgcctcgtcttccgccgcgtcatgccgggcccctgcgcgcccatgtcctcctgcaaatgcggcgtcctcgcgggctccgccaacatctgcgccgcagggagctgcgtctgcatggactgcgccttccagttcaacctcgccgtgcccagcgcgccgcagggcgcctggaagggtggccggaggagcaggagggccgtgtggatcgccatcgcggcgggggccgctggtctcctcgcgctcctggtggcattgcagttcgcgctgctcctgtggtgccgccgccgcgggaacgagcaggatgccgtcggcgacgtgcagcagtcgctgatccggccgcggctcgggtcgagcaggagcaagggcccgggcagcgtggtggagcacttcacgctggagatgctccacgccgcgacggacgacttctccgacggctcccggatcgggacggggagcttcgggtccgtgtaccgcggcacgctcgccgacgggcgcgaggtggcgatcaagcgcgccgaggactcggccaatgcgtcgagctcggcggcggcgcggccggcgcggcggcgcgaccgggagacggcgttcaactcggagctgaccgcgctggcccgcgccaaccacaagaacatcgtgtgcctgctgggctgctgcgccgacgccggcgagcgcgtgctcgtgtacgaattcatggcgaacggcacgctgcacgaccagctccacagccgcaccccaatggcccccgccgtggcgtcgtggcgcggccgcctcaccatcgcgctcgacgccgcgcgtggcatcgagtacatgcacgtctacgccgtgccgcccatcatccacctcgacgtcaagtccgccaacatcctcctcgacgacgcgtggacggccaagatcgccgacttcgggctgtcctccgtgctggaccccgccgccggcgcctgcggtgacgacgccgccgccggcggcaccccgcgggagccgctctacaccggcggcacggtggggtacatggacccggagtactaccggctgcagcacctgacggacaagagcgacgtctacagcttcggcgtggtgctgctggagctcatgtccgggtgccgcgtcgtgcagcgctacgccgagagcgtgacgcccaagaacgtcgtcgagttcgccgtgcctcacatcctcgccgacgacgtcgcgcgggtcctcgacccgcgcctgccggcgccgacgcccgacgaggccgaggcgctggcctacatgggctacctcgccgccgactgtgtgggccccatcgggtgcgaccgcccgtccatgaccgaggtcgtggacgccctggagcgcgccctcgccgcctgcggcgcggccccgctctcccgcgccggcaccggccgccgccccgtgctctcccgctccggcaccgaccagttcgacctcaccgacaccgactagcccgccgccgccgtcgccattgctgacgaaacgtagccgttcgcatcgcgtcaccgggcacttccacgcaccctagtgcccgccaactgcaaaccgacgcacgcgcgtcgccattggggacacctgatcgtcctgtccctggaccatggcttctccattgacaaaggaaaaggcaatcaggcaataggggaatcagaagccacagatccgacgccgacatcttccccggcgccgctgcgaaatcaacggtctgatttcttcctcgtgggacaaaccttggttcgattgactcgcgaacaacctctccacagcgacgcggcaccgggtccggcatggccgtcgtgcgggtgaaacgaattgacgggacccggcacgacgactggaaagatcattcattctttctttctttctttcccctttttcttcctcgctgtattcgttgcgtctctgctttcgacatttccctctccgggcggtttccagattctttaccaatgtgaatagatagatcagtgactgagattgagaaaaatagaattacgatttacactggcttcagttttttttctcaatgaagattactaggacttgttcatgtccgttattcattg

SEQ ID NO: 16754 - protein, 794 aa, Panicum virgatum
  misc_feature: Ceres CLONE 1790191
  misc_feature (457)..(757): Pfam Name: Pkinase Pfam Description: Protein kinase domain
  misc_feature: SWISSPROT Homolog: EC 2.7.11.1 Non-specific serine/threonine protein kinase
MPPPQPQRRLHGFLSLLLLLSLLLARWRPAAASALSTFALAKAGDATIVCGLLPSASSPLLADLNCTAAGGDHARQETYPSSHPFAALAGGEDFLCAVGPSGERADAVNMRWWDLSPGAPGRAKRVYSGPPLSALAAGEYRVCGVLDSGELHCWRWRGLGIPADLRFVAAAVGDGFVCGILRDAASIRCFGNDTADAAVADAPAGGSYDVVAACSTRACALSTAGELTCWGRGRPELAVDGAAAGYAALALGEDGVCGLRTNGTIRCFGRGVASPPGSLAGAQYLDVKAQGKAFCGVLMANYSLVCWGGREFNDTNRLVFRRVMPGPCAPMSSCKCGVLAGSANICAAGSCVCMDCAFQFNLAVPSAPQGAWKGGRRSRRAVWIAIAAGAAGLLALLVALQFALLLWCRRRGNEQDAVGDVQQSLIRPRLGSSRSKGPGSVVEHFTLEMLHAATDDFSDGSRIGTGSFGSVYRGTLADGREVAIKRAEDSANASSSAAARPARRRDRETAFNSELTALARANHKNIVCLLGCCADAGERVLVYEFMANGTLHDQLHSRTPMAPAVASWRGRLTIALDAARGIEYMHVYAVPPIIHLDVKSANILLDDAWTAKIADFGLSSVLDPAAGACGDDAAAGGTPREPLYTGGTVGYMDPEYYRLQHLTDKSDVYSFGVVLLELMSGCRVVQRYAESVTPKNVVEFAVPHILADDVARVLDPRLPAPTPDEAEALAYMGYLAADCVGPIGCDRPSMTEVVDALERALAACGAAPLSRAGTGRRPVLSRSGTDQFDLTDTD

SEQ ID NO: 16755 - DNA, 307 bp, Panicum virgatum
  misc_feature: Ceres CLONE 1790195
  misc_feature: Encodes the peptide sequence at SEQ ID NO. 16756
gaggtgatcaagatggactacgtcaacacggcgatggagcggctcgagaagaacgacgtccgctaccggttcgtcatcgatgtcgccggcagccttggctccgccacctaggcatagctccatcaaagcccagataaattcaggttcttattgtgggtttgtggctctgatagtttggcgtgcaaataagagagacatggtgttccactctttgcttgagtacatgtaaactgaacaatataagttactctgatttgttgtttttctgaacataatactaatgtagatactttgttaatctttatct

SEQ ID NO: 16756 - protein, 36 aa, Panicum virgatum
  misc_feature: Ceres CLONE 1790195
  misc_feature (1)..(31): SWISSPROT Homolog: EC 1.1.1.195 Cinnamyl-alcohol dehydrogenase
  misc_feature (1)..(32): SWISSPROT Homolog: EC 1.1.1.255 Mannitol dehydrogenase
  misc_feature: Useful for making plants with altered cell wall content and/or composition
  misc_feature: Useful for making plants with altered lignin content
  misc_feature: Useful for making plants with altered carbohydrate content
  misc_feature: The sequence is a functional homolog of SEQ ID NO 2 in US patent 7288696
EVIKMDYVNTAMERLEKNDVRYRFVIDVAGSLGSAT

SEQ ID NO: 16757 - DNA, 977 bp, Panicum virgatum
  misc_feature: Ceres CLONE 1790201
  misc_feature: Encodes the peptide sequence at SEQ ID NO. 16758
tgccaaacgacacaaagcgaaggcgtcgtcgtgcggcctcgacatcccgcgccgcgttccggcaagctcccgagctccacatcctcaagcccactaccctcgagcagtcccgcggataaggacctcagggtcgccgcctccggcggcgggttcttttcttgcttccggtggtgggagcacgcgtgggcgatggcgggggaccgcgggctcctgctcctcttcctcctctcggccgccgccctggccggggtcgcctctgccgccgctcctttcttgtccgacggcgtgttccaggtgaccgctggatccacggggaggagcttgttgcaggccaagaaggattgccctgtgagctttgagttccaaaactacacaatcatcacaagcaagtgcaaagggccgaaatttcctgctagccaatgctgcgctgctctcaaggaatttgcctgcccattctatatgtacctcaatgatgacagcaacagctgtgcgtcgaccatgttcacctacatcaacctcaacggtaagtacccaccaggcctgttctccagcgagtgcaaggaaggcaagttggggctttcttgcgaaaatgtcccccaaagagatatttccactgcaaatggtggggaacgcgctcaacgcagcttccttgcatggattgtcttgagtgtggcagtagcgtcgttgttccattgaatgatagctccattcatttgcccgaaatatagggtgtttcaactgttgaggctttgagtttgatcattgcaccttatggtgctcctggtgggttagctgccagattcttcgttttgtgtgtaaaatctcttctaatataatttatgatgtattgtgtattttctggaatttgacttgtcaatgccggtgtttagctcaaactcagctcaactcagcggtatcattgtattgtcactgttgcattacactatgatgcttatgtatcaattatcattcatatg

SEQ ID NO: 16758 - protein, 168 aa, Panicum virgatum
  misc_feature: Ceres CLONE 1790201
  misc_feature: Useful for making plants with altered carbohydrate content
  misc_feature: Useful for making plants with altered cell wall content and/or composition
MAGDRGLLLLFLLSAAALAGVASAAAPFLSDGVFQVTAGSTGRSLLQAKKDCPVSFEFQNYTIITSKCKGPKFPASQCCAALKEFACPFYMYLNDDSNSCASTMFTYINLNGKYPPGLFSSECKEGKLGLSCENVPQRDISTANGGERAQRSFLAWIVLSVAVASLFH

SEQ ID NO: 16759 - DNA, 718 bp, Panicum virgatum
  misc_feature: Ceres CLONE 1790204
  misc_feature: Encodes the peptide sequence at SEQ ID NO. 16760
agtgcagcagcgagcctatcccaccagccccccactccccagtcccccctcactcgcaacccgcgcgcgcacgccctccagcaattcacgccgatggcctcgccggcgacggtcccgctgcggcagctcttcgtcgacggcgagtggcgcgcgcccgcgcagggccggcgcctccccgtcgtcagccccgccacggaggcccacatcggcgagatcccggcgggcacggcggaggacgtagaggccgcggtggccgccgcgcggacggcgttcaagaggaaccgcggccgcgactgggcgcgcgcgccgggggccgtccgggcaaagtacctccgcgccatcgccgccaagataattgagaggaaagctgagctggctaagctagaggtacttgattgtgggaagccttatgatgaagcagcatgggacatggatgatgttgctgggtgctttgagtactttgcggatcaagcagaagccttggacaaaaggcaaaattccccagtttctcttccaatggagaattttaaatgccatcttcggagagagcctatcggagttgttgggcttatcagcccttggaactatcctctcctaatggctacatggaaggtagctcctgctctggctgctggttgtacagctgtgctgaaaccatctgaattggcatctgtaacttgcttagagctcgctgatgtctgtaaagaagtcggtcttc

SEQ ID NO: 16760 - protein, 208 aa, Panicum virgatum
  misc_feature: Ceres CLONE 1790204
  misc_feature (18)..(208): Pfam Name: Aldedh Pfam Description: Aldehyde dehydrogenase family
  misc_feature: SWISSPROT Homolog: EC 1.2.1.8 Betaine-aldehyde dehydrogenase
MASPATVPLRQLFVDGEWRAPAQGRRLPVVSPATEAHIGEIPAGTAEDVEAAVAAARTAFKRNRGRDWARAPGAVRAKYLRAIAAKIIERKAELAKLEVLDCGKPYDEAAWDMDDVAGCFEYFADQAEALDKRQNSPVSLPMENFKCHLRREPIGVVGLISPWNYPLLMATWKVAPALAAGCTAVLKPSELASVTCLELADVCKEVGL

SEQ ID NO: 16761 - DNA, 665 bp, Panicum virgatum
  misc_feature: Ceres CLONE 1790204-R
  misc_feature: Encodes the peptide sequence at SEQ ID NO. 16762
acttgaagagggttgcagacttggaccagttgttagcaaaggacagtatgagaagattaagaagttcatatcaaatgctaaaagcgaaggtgctactattctgaccgggggtgttagaccagcgcatcttgagaaggggttctatcttgaacccacaatcattgctgatgttagcacatcaatggaaatttggagggaggaagtctttggtccagtcctgtgcgttaaagaatttagtactgaagatgaagccattgaactggccaatgatacacattatggcttggccggtgctgtaatttccagagatcgtgaacgctgccagagattatccgaggagatcaacgctggatgcatctgggtaaactgctcgcaaccctgcttctgccaggctccctggggcgggaacaagcgcagtggctttggtcgcgagcttggagaagggggtattgataactacctgaccatcaagcaagtcacggagtacacctctgatgagtcgtgtggatggtaccagtcccccgccaagctgtaagctggcacaagaaaacttccatctgtttcgctacaataaaatcgattccatacaaaatgaacctgtgtatcaaattaatgacattttgaagcgctgcatctgcataataaattgagtgggagttgagttt

SEQ ID NO: 16762 - protein, 177 aa, Panicum virgatum
  misc_feature: Ceres CLONE 1790204-R
  misc_feature (1)..(159): Pfam Name: Aldedh Pfam Description: Aldehyde dehydrogenase family
  misc_feature: SWISSPROT Homolog: EC 1.2.1.8 Betaine-aldehyde dehydrogenase
LEEGCRLGPVVSKGQYEKIKKFISNAKSEGATILTGGVRPAHLEKGFYLEPTIIADVSTSMEIWREEVFGPVLCVKEFSTEDEAIELANDTHYGLAGAVISRDRERCQRLSEEINAGCIWVNCSQPCFCQAPWGGNKRSGFGRELGEGGIDNYLTIKQVTEYTSDESCGWYQSPAKL

SEQ ID NO: 16763 - DNA, 1238 bp, Panicum virgatum
  misc_feature: Ceres CLONE 1790205
  misc_feature: Encodes the peptide sequence at SEQ ID NO. 16764
aatacttcacccgccggcgcctcccccctcccctcctccctcgccggggcgcccccctccgaaatggcggccaccgccagcaccgccaccgccgtggccatggccaccatctcacccaccacccccataccgaccgcacccttcccatcgctccccctcggcttccgcttccgcctccgcccccaacccctcctcctctccgcctcccgccgcctcctcctcgtccccgtccccagggcctcctcctgggacgaatccggccccgaggaggaaggcgaggcggaggagtccgaggaatccgccgccgccggggacgaggaggacgaggacgaggacgagaagccgcggccggagccggtgtcctcggccgagttccagttcgcggcgccccccgagggctacgtggagcccgcggcgttcgacgagctcccgccggagtcccccgaggacgtggccgcggcgtacgagtcgctctacgggccggcgttcagcggcgagaccgtgctggggaacaacgtcttcgaggtcaaggtggtcgaccccatcgacatggaccgggagcagcgccccaacgacgacttcagcgagcgcgtcgtgcaggtcaaccgcgtcaccaaggtcgtcaagggagggaggcagctctcctaccgcgccatcgtcgtcgtcggcgacatgaaggggcacgtcggggtcggcgtgggcaaggccaaggaggtcaccgaggccatcaccaaggctgccatgaacggccgccgcaatcttgttacggtgccgctcaccaagtactccaccttcccgcacagagctgatgcggactttgaagcagccagagttatgctgaggcctgcttgccctggatctggtgtcattgctggtggggctgtgagggttgtgctggagatggctggggttgaaaatgctctggggaagcagctgcggagcaagaaccccctgaacaatgcgagagctaccatcaaggcgacgcagatgatgaggcagttcaaagacgtctcagaggagcgcgggatcccaatggaggagctatggaaatgatagaaacactttcaaactaaaacccccttctgtagcattctctctctttttttgctgtatttttcgagttcatttctgatgtatctatctatggaatagggataatcccacctcacgatttggcttcgcaaatctcttgtggaatcagtgagtactaccaacatttacacgcaaccttaagagat

SEQ ID NO: 16764 - protein, 329 aa, Panicum virgatum
  misc_feature: Ceres CLONE 1790205
  misc_feature (172)..(238): Pfam Name: Ribosomal_S5 Pfam Description: Ribosomal protein S5, N-terminal domain
  misc_feature (248)..(321): Pfam Name: Ribosomal_S5_C Pfam Description: Ribosomal protein S5, C-terminal domain
MAATASTATAVAMATISPTTPIPTAPFPSLPLGFRFRLRPQPLLLSASRRLLLVPVPRASSWDESGPEEEGEAEESEESAAAGDEEDEDEDEKPRPEPVSSAEFQFAAPPEGYVEPAAFDELPPESPEDVAAAYESLYGPAFSGETVLGNNVFEVKVVDPIDMDREQRPNDDFSERVVQVNRVTKVVKGGRQLSYRAIVVVGDMKGHVGVGVGKAKEVTEAITKAAMNGRRNLVTVPLTKYSTFPHRADADFEAARVMLRPACPGSGVIAGGAVRVVLEMAGVENALGKQLRSKNPLNNARATIKATQMMRQFKDVSEERGIPMEELWK

SEQ ID NO: 16765 - DNA, 942 bp, Panicum virgatum
  misc_feature: Ceres CLONE 1790209
  misc_feature: Encodes the peptide sequence at SEQ ID NO. 16766
aaaaaaaatcatctcgcagttcacgatccgatcccattcctcgccatggacgcggcggggggcgagcagctgagcctggccgcggtgcgggacgcgctggtccggctggaggactcggtggtgttcgcgctcatcgagcgcgctaggcacccgcgcaacgcggcggcctacgcgcctggcgccggtggcggggcgggagggcgctctctcgtcgagttcttcgtccgggaagcagaagccctcaatgcaaaggctggacattatcaaaagccagaagatgttccattcttccctcaagatctcccctcgcctttctttcctaccaggagttccccaaaggttttgcaccctttagcctctttggtcactgtgaatgatgcaatatggaaaatgtattttgatgaattgctccccttgttcactgttgatggtgatgatggtagctatgcagaaacagttgcgttggattttgcatgtcttcaggttctatcaagaagaatccatattggcaaatatgttgctgaggtgaagttccaagacgctcctcaggattatagtccactgatacaagcaaaggacagcaattctctgatggatctgctcacattcaaggcagtcgaagagaaggtcaagaagagagtagagaagaaagccaggacgtttggacaggacgtcaccttggaggacaatgccggcaagccacaagtcacttccagtgacagcgaatgcaaggtcgatcctacagttgtctccaagctttatgaccagtgggtgatgccattgacgaaggacgtcgaagtcgagtatctcctctgccgtctcgactgaccgcaaatcgctgcaaatattatgcgtgatttccagttgtgtcatcagaatgttgtgccttttgtcactgctatattcaaactcaattatcagagaatgctacacattcgcgcc

SEQ ID NO: 16766 - protein, 260 aa, Panicum virgatum
  misc_feature: Ceres CLONE 1790209
  misc_feature: SWISSPROT Homolog: EC 5.4.99.5 Chorismate mutase
MDAAGGEQLSLAAVRDALVRLEDSVVFALIERARHPRNAAAYAPGAGGGAGGRSLVEFFVREAEALNAKAGHYQKPEDVPFFPQDLPSPFFPTRSSPKVLHPLASLVTVNDAIWKMYFDELLPLFTVDGDDGSYAETVALDFACLQVLSRRIHIGKYVAEVKFQDAPQDYSPLIQAKDSNSLMDLLTFKAVEEKVKKRVEKKARTFGQDVTLEDNAGKPQVTSSDSECKVDPTVVSKLYDQWVMPLTKDVEVEYLLCRLD

SEQ ID NO: 16767 - DNA, 1620 bp, Panicum virgatum
  misc_feature: Ceres CLONE 1790227
  misc_feature: Encodes the peptide sequence at SEQ ID NO. 16768
aatatccgggcccgtctgcgacacggagctttcggccacttctactgcttggacttgcacggcgggcgctgctgcccggccctgttggacgcgggtgggtggggactgctcgtgggatccaatccatggacggaggcaagaaggctgagcagccgcacggcgatgtcgccgaggaggacccaggccgccagcagcgttctatggtggatgaagccgacggcgacgagaaggcgcctcgccggagcaagcgggttgcttccctcgacgtcttccgcggcctcaccgtcgctctgatgatactggtggacggcgccggcggcgagtggccggtcatcgggcacgcgccgtggaacggctgcaacctcgccgacttcgtcatgcccttcttcctcttcatcgtcggcatggccattcccctctccctcaagagaattcctgaccgtggtcgagctgtgaggagagtagtcattaggacattgaagctgctcttttggggaatcctgttgcaaggaggttactctcatgctccggataacctgacatacggagttgacatgaagcacgtaagatggggtggaattctccagaggattgctcttgcatacttggtagtggcagttctagagattgttacaaaagatgcaaagattcaggatcggtcaagttcgggcttctctatcttcagaatgtacttttcccaatggattgttgcatgctgcattctagtggtttacctgtcccttgtttatgggatctatgttcctgactgggaattcagagtgcaaaatactgacagctcaaactacggcaaagttttaacggtgacgtgtggtacaagggggaaattaaatcccccttgcaatgctgtaggttacattgaccgcaaaatccttggcatcaatcacatgtaccagaaaccagcatggagaaggcactgggcctgtactgatagttccccacatgagggaccttttaagaacgatgccccggcatggtgtgttgcaccattcgaacctgaagggatactaagctcattttctgcggtgttgagtacaatcataggtgtccactgcgggcatgtacttgtccatataaagagtcatacagacaggctgaggcagtgggttgccatgggcatagcgcttcttgttcttgggatcattctacatttttcacatgcaattccgcttaacaagcagctctacacattcagttacatctgtgtcactgccggcgctgctggaatcgtgttctccttactctacgtcctggttgacatcctgaacctgcactacgcgttcgcgcccctgcgatggatcggcatgaacgcgatgctggtgtacgtgatggccgcggagggcatcttcgaggggtttctcaacgggtggtactacgagggcaccaacaacacgctggtttactgggtgaggaagcacgtgttcgtgaaggtgtggcactccaccagggtcggcatcctcctctacgtcctcttcgcgcagatcctcttctgggctctcgtctccggcgtcctccaccgcactggcctctactggaagctctagcgaggaccgaacagcttactgtacagacactgtgcttccatttgttcagaattgtgtg

SEQ ID NO: 16768 - protein, 478 aa, Panicum virgatum
  misc_feature: Ceres CLONE 1790227
  misc_feature: SWISSPROT Homolog: EC 2.3.1.78 Heparan-alpha-glucosaminide N-acetyltransferase
MDGGKKAEQPHGDVAEEDPGRQQRSMVDEADGDEKAPRRSKRVASLDVFRGLTVALMILVDGAGGEWPVIGHAPWNGCNLADFVMPFFLFIVGMAIPLSLKRIPDRGRAVRRVVIRTLKLLFWGILLQGGYSHAPDNLTYGVDMKHVRWGGILQRIALAYLVVAVLEIVTKDAKIQDRSSSGFSIFRMYFSQWIVACCILVVYLSLVYGIYVPDWEFRVQNTDSSNYGKVLTVTCGTRGKLNPPCNAVGYIDRKILGINHMYQKPAWRRHWACTDSSPHEGPFKNDAPAWCVAPFEPEGILSSFSAVLSTIIGVHCGHVLVHIKSHTDRLRQWVAMGIALLVLGIILHFSHAIPLNKQLYTFSYICVTAGAAGIVFSLLYVLVDILNLHYAFAPLRWIGMNAMLVYVMAAEGIFEGFLNGWYYEGTNNTLVYWVRKHVFVKVWHSTRVGILLYVLFAQILFWALVSGVLHRTGLYWKL

SEQ ID NO: 16769 - DNA, 625 bp, Panicum virgatum
  misc_feature: Ceres CLONE 1790237
  misc_feature: Encodes the peptide sequence at SEQ ID NO. 16770
tagctgtgcgcacgcacgtagctatagctagctagctggtgatatggagtcgataatggagaagccggtggcggtggacgccgcggccggcggcggcggaggagggggtgccggtggacgccgccgccgccgccgcgaaccctcgccaatctccgtcctccgggttgtgggggcccgcatggcgctccggaggctgctgcatgggagcgtcctgccgcgggtgtccggccgggcctttgccccggccgtggcgcccttctccacggaggctggggagaccgtccgccccacgctcttcccgggtgacggcatcgggcctgacatcgccgagtccgtccaccaggtattcaatgttgcacgtgtaccactagaatgggaagaaccttatgttggcacccaagttgatcccagaccagacagtttcctgacatgggaaagcctggactccgtgcgtagaaacgaagttggcttaaaaggacctctggctcctcctattggacagggccatcgatcattgaatcttacattaacgaaagagcttggtctttacgcccatgtctcatcttgcaacaccctcccaggctacaagaccagatatgatcatgttacccctgtgataattcgt

SEQ ID NO: 16770 - protein, 193 aa, Panicum virgatum
  misc_feature: Ceres CLONE 1790237
  misc_feature: SWISSPROT Homolog: EC 1.1.1.85 3-isopropylmalate dehydrogenase
MESIMEKPVAVDAAAGGGGGGGAGGRRRRRREPSPISVLRVVGARMALRRLLHGSVLPRVSGRAFAPAVAPFSTEAGETVRPTLFPGDGIGPDIAESVHQVFNVARVPLEWEEPYVGTQVDPRPDSFLTWESLDSVRRNEVGLKGPLAPPIGQGHRSLNLTLTKELGLYAHVSSCNTLPGYKTRYDHVTPVII

SEQ ID NO: 16771 - DNA, 647 bp, Panicum virgatum
  misc_feature: Ceres CLONE 1790237-R
  misc_feature: Encodes the peptide sequence at SEQ ID NO. 16772
gacgcttgtgaagaatcctggtcttttcgatgtattagtgatgccaaatctttatggtgacattatcagtgatctatgtgctggtttggttgggggtttgggcctaacaccaagttgcaatattggtgaaggtggcatttgtctggcagaagctgttcatggttctgctcctgatattgctggcaagaacctcgcgaacccgactgctcttatgctgagtgctgtcatgatgttgcgccacttgcaattcaatgacaaagcggaccggatccacaatgccatcctccagaccattgcagagggaaagtacaggactgctgatcttggcggaaaggcatcaacatcagaattcacaaacgctgtctgcgatcacatctgagaatcagatgtagttttttttcattctgattgttttcatctgcctaatttttttttgtcacatattgagagaagctttagctttttaagaggttaactggcagcacctcaaccaagtggtcgcttaacacgggttcaggccgtaaaataatttttgtcacatttcttgctgttcagaaattctttctactctgcaaccgagccaaagaattgcatgtaataatcccgtcagcattatagcagatagtatttatttcatttgcgttctt

SEQ ID NO: 16772 - protein, 125 aa, Panicum virgatum
  misc_feature: Ceres CLONE 1790237-R
  misc_feature (1)..(121): Pfam Name: Iso_dh Pfam Description: Isocitrate/isopropylmalate dehydrogenase
  misc_feature: SWISSPROT Homolog: EC 1.1.1.41 Isocitrate dehydrogenase (NAD(+))
TLVKNPGLFDVLVMPNLYGDIISDLCAGLVGGLGLTPSCNIGEGGICLAEAVHGSAPDIAGKNLANPTALMLSAVMMLRHLQFNDKADRIHNAILQTIAEGKYRTADLGGKASTSEFTNAVCDHI

SEQ ID NO: 16773 - DNA, 1971 bp, Panicum virgatum
  misc_feature: Ceres CLONE 1790240
  misc_feature: Encodes the peptide sequence at SEQ ID NO. 16774
accagaactctgagcaactaggcagctcctctcttccacacgtgccagtgtccaagcttctcccatggagacggcaaccagttgcaacggtgcagccgaagctggtcttgttgcgcaccaaagtgtacctgttcttgggctcatatcttttgtgtctctgttcagcgcatttctgatatacttctatgcgcccttctggcgtgtgaggagagttccgggtccaccaaccaggttccctgtaggccatcttcatcttcttgccaagagtggacctgatgtctttcgtgcgattgcaaaggagtatggtccaatcttcaggtttcacatgggtaggcagccactggtgattgtggccaatgccgagctgtgcaaggaggttggcatcaagaagttcaaggacatccgcaacaggagcaccccgcccccgaccatcggctccctgcaccaggacgccctcttcctcaccagggactcgacatggtcggcgatgaggaacacggtgatcccgctgtaccaaccggcacggcttgccaggctgatcccggtgatgcagttttacgtggatgcgctggtggcaaatatcgccggctgcccggaccaggactgcatccccttctgccagctctcgctgcggatggccatcgacatcatcggcaagacggccttcggcgtcgagttcggcctgtcaaagaattccgccgcggacagctgttgcggcagcgagactcacggtggcgagggcgacgacgacgtcagggagttcctgaaggagtacaagcggtccatggagttcatcaagatggacctgtcgagctcgctgtccaccatcctcggcctcttcctcccgtgcgcccagacgccgtgcaggcggctgctgcgccgggtgcccggcactgcggactacaagatggacgagaacgagcgccggctgtgccgccgcatcgacgcaatcatagctggccggcggcgagaccgggccgcgcgccggcgtggcggcgacggcgacgccgccgctcgatccgccccgctggacttcatcgcggcgctgctggacgcgatggagaacggcgggaaggacttcgcgctggaggacaggcacgtccgcgcgctggcgtacgagcacctcatcgccgggacgaagacgacggcgttcacgctgtcgtcggtggtgtacctggtgtcgtgccacccgcgcgtggaggagaagctgctccgggagctggacggcttcacgccgccgcgcgggcgcgcgccgaccgccgacgagctccagagcaggttcccctacctcgaccaggtcatcaaggaggccatgcggttccacctcgtgtcgccgctcatcgccaggcaaacctccgagcgcgtcgagatcggcggctacgtcctcccgaagggcgcgtgcgtgtggctggctcccggggtgctggcccgggacgcggcgcagttcccggagccggaggagttccggccggagcggttcgcggcggaggccgaggaagagcgggcgcggcacccgtacgcgcacatccccttcggcatcgggccgagggcgtgcatcggacacaagttcgcgctgcagcaggtgaagctcgccgtggtggagctctaccgccggtacgtgttccggcactcgccggccatggagtcgcccatccagttcgacttcgacctcgtcctcgccttccgccacggcgtcaagctcagggccatcaggagggagtgagactgaactggcttgcttggggccgcgtggggaactgcatccgtgatggcgccatggtttgtcttctcgtgtgtgaattgtacttcatcatagtataggtattgcatcaaaatatcgatagcatataggctgaaattgtattacatacaaatagctgaagaagactgtaacgcattgaaccgtttgtaaatgacctaaatgtgttgcggatacaatgggtatgatgaaatgggttttctccacttcct

SEQ ID NO: 16774 - protein, 552 aa, Panicum virgatum
  misc_feature: Ceres CLONE 1790240
  misc_feature (51)..(546): Pfam Name: p450 Pfam Description: Cytochrome P450
  misc_feature (322)..(551): SWISSPROT Homolog: EC 1.14.14.1 Unspecific monooxygenase
  misc_feature (49)..(202): SWISSPROT Homolog: EC 1.14.13.68 4-hydroxyphenylacetaldehyde oxime monooxygenase
  misc_feature: Useful for biocontainment applications
  misc_feature: Useful for making plants with modulated biomass
METATSCNGAAEAGLVAHQSVPVLGLISFVSLFSAFLIYFYAPFWRVRRVPGPPTRFPVGHLHLLAKSGPDVFRAIAKEYGPIFRFHMGRQPLVIVANAELCKEVGIKKFKDIRNRSTPPPTIGSLHQDALFLTRDSTWSAMRNTVIPLYQPARLARLIPVMQFYVDALVANIAGCPDQDCIPFCQLSLRMAIDIIGKTAFGVEFGLSKNSAADSCCGSETHGGEGDDDVREFLKEYKRSMEFIKMDLSSSLSTILGLFLPCAQTPCRRLLRRVPGTADYKMDENERRLCRRIDAIIAGRRRDRAARRRGGDGDAAARSAPLDFIAALLDAMENGGKDFALEDRHVRALAYEHLIAGTKTTAFTLSSVVYLVSCHPRVEEKLLRELDGFTPPRGRAPTADELQSRFPYLDQVIKEAMRFHLVSPLIARQTSERVEIGGYVLPKGACVWLAPGVLARDAAQFPEPEEFRPERFAAEAEEERARHPYAHIPFGIGPRACIGHKFALQQVKLAVVELYRRYVFRHSPAMESPIQFDFDLVLAFRHGVKLRAIRRE

SEQ ID NO: 16775 - DNA, 1683 bp, Panicum virgatum
  misc_feature: Ceres CLONE 1790241
  misc_feature: Encodes the peptide sequence at SEQ ID NO. 16776
ctctcttttccgccctccaccctcgcgagccgctccaatccacacgacccacctcctccccggcggcggcggcggctgcggtggcgatgcagatggcggcgaccaccaccgactcccaggcggccgtgccgcctcaccaccctcacgcgcacccccatgcgcctccacagcacgcgcctccgcaccaccacatgccgcagccgcggtgggtcgtcataccgtacccgccgccgccgcccatggtggccgcgccaccgccgccaccgcagttcgccaagcacttcgccgctgggccgcccccgccgccacaagctgcggcagggcgccgcacgccgaccccgcccgtggccggatccggcgggaacggatgcgaggagaataagacgatttgggttggcgacctccagtactggatggacgagaactacctccacagctgcttcgggcccagcggcgaggtagtgacaataaaagttatccggaataggcaaactgaacaatcggaggggtatggatttgtggagttcttttctcacgcatctgcagaaaaagctcttcagaattttactggtcatgtgatgcctaacaccgatagagcatttaagttaaactgggcatcatatagtatgggtgaaaagcgatctgaagtagcttctgatcactcgatatttgttggtgatctagctgctgatgttactgatgaaatgctgatggagctttttgctagcaagtaccgatcggtgaaaggagctaaagttattattgatgcaaacacaggccgctctaggggctatggatttgttaggtttggagatgataacgacaaatctcacgcaatgtctgaaatgaacggtgtatattgctctactaggcccattcgcattggacctgctactcccagaagatcttcaggtgattctggctcctcgactcctggtcattcggatggcgattcttctaacaaaacggtatatgttggtgggcttgacccaaatgttagcgaagatgaacttaggaaagcctttgccaaatatggcgatcttgcctcagtaaaaattcctctaggaaagcagtgtggctttgttcaatttgttagcagaactgatgctgaagaagcactacaaggattgaatggatcagtcattggaaagcaggcagttcggctttcatggggccgtagcccatcacataagcagtctaggggtgactccggcaacaggaggaacatgtactatggcacaccattctacggaggatacggctacgcctccccggtgccgcacccaaacatgtatgcccctgcatatggcgcgtacccgttctatggcggcaaccagcagctggtgagctagatatgagctagagcgcctctctccgttccgtcccctccgacgggaaacaaggttttggtccggtgagcatagtagcgtcaggtgagaaggaggttatagccttataggttgtcctaaaaagtgggcgagatatgttgctgaacggatggtatggtgcctgtagttgttgttgtgtgtgcgtcgcaagaactggatggaactcgtggcttgtagtacaccagggagtcgtgtcggtattctttcaagaaattttgactttgtaataataaattaaactattgtgtgtgcgtccaattttcgccacctctcgattgtgcgtggcaatccgttc

SEQ ID NO: 16776 - protein, 421 aa, Panicum virgatum
  misc_feature: Ceres CLONE 1790241
  misc_feature (295)..(360): Pfam Name: RRM_1 Pfam Description: RNA recognition motif. (a.k.a. RRM, RBD, or RNP domain)
  misc_feature (194)..(266): Pfam Name: RRM_1 Pfam Description: RNA recognition motif. (a.k.a. RRM, RBD, or RNP domain)
  misc_feature (101)..(172): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: The sequence is a functional homolog of SEQ ID NO 536 in the 10/666,642 US patent application
  misc_feature: The sequence is a functional homolog of SEQ ID NO 1484 in the 10/666,642 US patent application
  misc_feature: The sequence is a functional homolog of SEQ ID NO 278 in the 10/714,887 US patent application
  misc_feature: The sequence is a functional homolog of SEQ ID NO 278 in the 11/435,388 US patent application
MQMAATTTDSQAAVPPHHPHAHPHAPPQHAPPHHHMPQPRWVVIPYPPPPPMVAAPPPPPQFAKHFAAGPPPPPQAAAGRRTPTPPVAGSGGNGCEENKTIWVGDLQYWMDENYLHSCFGPSGEVVTIKVIRNRQTEQSEGYGFVEFFSHASAEKALQNFTGHVMPNTDRAFKLNWASYSMGEKRSEVASDHSIFVGDLAADVTDEMLMELFASKYRSVKGAKVIIDANTGRSRGYGFVRFGDDNDKSHAMSEMNGVYCSTRPIRIGPATPRRSSGDSGSSTPGHSDGDSSNKTVYVGGLDPNVSEDELRKAFAKYGDLASVKIPLGKQCGFVQFVSRTDAEEALQGLNGSVIGKQAVRLSWGRSPSHKQSRGDSGNRRNMYYGTPFYGGYGYASPVPHPNMYAPAYGAYPFYGGNQQLVS

SEQ ID NO: 16777 - DNA, 2028 bp, Panicum virgatum
  misc_feature: Ceres CLONE 1790242
  misc_feature: Encodes the peptide sequence at SEQ ID NO. 16778
agtctcgagcttgcacttgcacatccaggcatccagctaactagttaagcaaaagcatcctctgtcgccgcgctccagctctgcccccctccacctccaccaacgctttcccctttccccctccagcgccggcagcccccaacaccaagaaagagaagctcccggctccaaatcagacttacctgcgcgctgcgccttccggcctcctaccctccccggcgaggtttttatttccacacccaagattagcatccagctcaaccccaaatcattcagtctccatggaggccgatggcgccgctgccaagcttcggatcatcaacgacgcggtggaggaggtgcgccgcagaagcgtccgcgagaggggctggaccatcgagcaggcgatggaggacatgcgcagcgtgacgtgggagcggcgtcgcaggctctaccgcaagctgcaggccatcgctgaggttgacccatgggatctcccgccgcgattcgccatgccgacacattctgggtactggaaagagaaagaagatgagttcatcgcgatccgctccgagggaggaggacaaggctcgtcctcggcttccagtagctcgccgtgctacgaaggggttaggaggaccctggagttttacgagcacaacggcaccaagacggactgggtcatgcacaagtacaacgtgctcaatgacgacatgtttctgcagaccaacaacgatcaccgcgtgcgcttgatgctatgattggtaggatgttgtcagtgtcctttgaatggatggaggagcatatgagtggttgtgaagaagcaggatctgagtgtggggagtttccaaccccgtctgctgatccagatggagaatcatcagacgatgtttggcagcacttcaccagaataaacaccaaacatcccgatgagatgtacgcagtgtgccaccactgtgacagggtgctcaaggctccttccaagaatggcacatctcatctcagaaggcaccgtaagactaagacatgtacatgcaacaacaatccatcatccactgccgaagacctagagatcttgcgtaagctctgcgcaaaccgcgatctctacaagcaggggaagatggagcgatgtgttgaatctgtagtggaaccgtgcgatgttcccaccgcaggctactacacgagcttgctaagcttgaagacgcatcaggggtgctggaaggagattaagagtaatgacaagctcatcgccatccgcatcggtcaattgccggtgccgcagtacgccgggctgaagaggaccctccaatttcaccatgacaatggcaccaagatggactgtatcatgctcgagtaccacctggtcgatgagtacaacacccacgacctgcttcttgaggggattatggtgtttcgcaaagtcatccaagttttcaaagatgcgattaaagagttggaaaagatgtggaatggggacgatgacgataaagagtgctacattgatgagcgtgaagaagaggtgaaggcgtgcatgagcaccttgctccatgactgcttgctcggtgaggttcctcaaggtgatcaatcaggggttagaaagcgcaagagaactggtggtacggagggtggatcaaaagtttggctgtacttcactaagatttacaccacagatcctaagcaggtgtatgcagtgtgccactgttgtgacaggtgttacaagggtcactcgaagaatggcacctctcacctcaaaaggcacaacgagacatgctcaagcaagcaccggaaagtgtaggggaagatgaagctcagagaacaggagaagagagaatgtgccgaagctaggaacgaaaaggatgaccataagctgtctttctttagtaaaaattgtagtgtcagtaaggcaagtcgtcgagttctatcggaggtctttttatatttaggtacaatgatacctgggccacctaatctatgatttggatattggaggagtaaatcttctgaatgtaaaaggtggaggtgggttttatagtaagatgtatttgatgg

SEQ ID NO: 16778 - protein, 152 aa, Panicum virgatum
  misc_feature: Ceres CLONE 1790242
  misc_feature (42)..(134): Pfam Name: NAM Pfam Description: No apical meristem (NAM) protein
MEADGAAAKLRIINDAVEEVRRRSVRERGWTIEQAMEDMRSVTWERRRRLYRKLQAIAEVDPWDLPPRFAMPTHSGYWKEKEDEFIAIRSEGGGQGSSSASSSSPCYEGVRRTLEFYEHNGTKTDWVMHKYNVLNDDMFLQTNNDHRVRLML

SEQ ID NO: 16779 - DNA, 1629 bp, Panicum virgatum
  misc_feature: Ceres CLONE 1790253
  misc_feature: Encodes the peptide sequence at SEQ ID NO. 16780
accatatcactccattagtgctctgctctcgactcgctcccctcccctagctaagaaagggccaaattaagctcgccgccgacggcagcagcagctacttgctagacagagagcctggagtgatggacctgatgaagccgctggccgtggtggtggctctgctggccgtgtgcgccgccgcggcggagggattcgacatcctccagatcctgggcaagcacgacgagttctcgcagttctgcaagctgctcaatgagacgcacctggccggcgacatcaatcgggaccgcaccatcaccgtgctcgccgtggccaacggcgacatgggacacctcaccagcggccactactcgctcgggaccatccgccacatcctcgagctgcacgtcgtcgccgactactacgacgagaagaagctcaagcagctgtcgcacggcgccaccgccgcatccacgttgttccagcgatccgggtttgcccccggcatggcggggtacgtcaacattacgcagcaccgcggcggcaaggtgacatttatcgtcgatgacgcagccgactccgtgaagccggtcaccttcgtcaagcagatcgaaagccaccgctacgattactcggtgctccaggtcagcagtgtgctctcctccccggaggccgaggcgcccgtggccccgccggctcccgtcaacctcaccgacctcctctccaagaagtactgcaagagcttcgcgggccttcttgctgccgacggcaaggccttcgacaccatcaacggaaccaaggacaccgcgctgacgctcttttgccctgtcgacaccgccgtggcctccttcttgcccaagttcaagaacctgacggccaaggccaagacggccatcctgctctaccacgccgtgccggactactactccatgcagttcctcaagtccaataaaggcaaggtgaccacgctcgccaccaccagcgtcgccaagaaggactacacctacgaagcgcagaccgaggctgacaccgtcacgctggacaccacggtcaccatctccaccatccaggccaccgtcagggacgacgacccgctcgccgtctacgccgtctccaagttcctgcagcccaaggagctgttcaagtccacaaccaaggacctcgcgccggcgcccacgccagagggacccaagaagaagaccaagaaaaagcccagccgcacctcggcggctgccgcaccctcggacgacgaagccgcggatggcccgtctgcggatgactcagttgacgacgcggacaaagccgccggcgccgagcggtccctgctcgcccggtgggtcaccgcggctgcgacgttggcagctgcgctggcgctggcggcctaaggtgggtgctgatatgttatgtttttcttttaatttattggaccctcttcttttctttgtccaattcgtgtcccttgttggtgaagaaaataagaagggccattttactttatttttatatttattgctgcattctcatggaaaaggggaaaaaagagaggaaaacttagaggtgtgtcggatcatgtagctctttggattgttttgttgggttgtggtgatcattttgtaatgacagtgatcaatggaattgaagagtgtgttt

SEQ ID NO: 16780 - protein, 413 aa, Panicum virgatum
  misc_feature: Ceres CLONE 1790253
  misc_feature (197)..(329): Pfam Name: Fasciclin Pfam Description: Fasciclin domain
  misc_feature: Useful for making plants with altered carbohydrate content
MDLMKPLAVVVALLAVCAAAAEGFDILQILGKHDEFSQFCKLLNETHLAGDINRDRTITVLAVANGDMGHLTSGHYSLGTIRHILELHVVADYYDEKKLKQLSHGATAASTLFQRSGFAPGMAGYVNITQHRGGKVTFIVDDAADSVKPVTFVKQIESHRYDYSVLQVSSVLSSPEAEAPVAPPAPVNLTDLLSKKYCKSFAGLLAADGKAFDTINGTKDTALTLFCPVDTAVASFLPKFKNLTAKAKTAILLYHAVPDYYSMQFLKSNKGKVTTLATTSVAKKDYTYEAQTEADTVTLDTTVTISTIQATVRDDDPLAVYAVSKFLQPKELFKSTTKDLAPAPTPEGPKKKTKKKPSRTSAAAAPSDDEAADGPSADDSVDDADKAAGAERSLLARWVTAAATLAAALALAA

SEQ ID NO: 16781 - DNA, 727 bp, Panicum virgatum
  misc_feature: Ceres CLONE 1790256
  misc_feature: Encodes the peptide sequence at SEQ ID NO. 16782
cttttgctcctctggccgctttgggttggggtttaagcgagtgtgcgggaggccggaggcgacgacgacggcgccggcgtcggagaagaagaagcagccagctctcgtgtatatgtcttcttgccccttctccgatctggtggtcgttgcgctcatcgtcgccgtcctcctccgcgccctcgcctgctccagccgatctatgcgcaaggggctcaacggctggaacaaatcctcgtcgatgctcagggacgggttcgggatgaagtattccggattcctccacataaggccgtgtggcttctgtcgaggagactgacagatttggtcgatttcgcccggctccgtccaatttttgcacccatcggaggaagtttcttctttttagagtttttccccttcagttttggcaattttggcttcaagttttggagtccttcccggcacaagagatagaagagagatggctccgttgaaccaccagcagattctcatcaagaaggccctggcgaagaagcccaagagcaagaggatctccgggtttggccttaaaccctccgcttctctcctcaaggccaggccgcagcagcagccaccggcgcctgtcatgccgaggcgccgcgtccgcgtcctctttgaggaccctgacgcgacggactcggactcagacgacgaaggcgaggccggcacggccaggtccaagcgcttctcttttgagatgttcgtcggc

SEQ ID NO: 16782 - protein, 88 aa, Panicum virgatum
  misc_feature: Ceres CLONE 1790256
  misc_feature: The sequence is a functional homolog of SEQ ID NO 1191 in the 10/374,780 US patent application
  misc_feature: The sequence is a functional homolog of SEQ ID NO 1383 in the 10/412,699 US patent application
MAPLNHQQILIKKALAKKPKSKRISGFGLKPSASLLKARPQQQPPAPVMPRRRVRVLFEDPDATDSDSDDEGEAGTARSKRFSFEMFV

SEQ ID NO: 16783 - DNA, 538 bp, Panicum virgatum
  misc_feature: Ceres CLONE 1790270-R
  misc_feature: Encodes the peptide sequence at SEQ ID NO. 16784
tgctcttcatgcattgagcgattcaatgagggttgaactaagaagcttcggcatcaatgtgatgattgttgccccgggaggaacaaaatcgaatcttggggataaatctgcggctaagtatgatcaaatcaatgagtggaagtactacaagaagtacgaggagtcgctccgagccaggacggacgtttcccagggccctgggtccactccagccgaggagcttgcaaaaaaggtggttgcgctggctctgaagaaaaaccctccagctctgttcgcttacggccagttcactgctattctgtccatgctgtattacacgccgctatggtttagagactacttctacaggctggtcatgaaatgctagtgcctggaggtataggaaatatagctgctcaggcccagttcagtccgtagttctcacatacagtagtatttagtatatttgtaacagaaattcatacacgttgatttatttgtagctatacgctgtatacttttttggttgcaaatgaaaagctctcctggtttctgtgtc

SEQ ID NO: 16784 - protein, 121 aa, Panicum virgatum
  misc_feature: Ceres CLONE 1790270-R
  misc_feature: SWISSPROT Homolog: EC 1.1.1.105 Retinol dehydrogenase
ALHALSDSMRVELRSFGINVMIVAPGGTKSNLGDKSAAKYDQINEWKYYKKYEESLRARTDVSQGPGSTPAEELAKKVVALALKKNPPALFAYGQFTAILSMLYYTPLWFRDYFYRLVMKC

SEQ ID NO: 16785 - DNA, 703 bp, Panicum virgatum
  misc_feature: Ceres CLONE 1790270
aaccttggtcactgctcggcacggtcaggttcgcccccgcacctcgcacccccgatctgattgaatccgagcaggagcagcgccggcggcggcgatgggcggcgaccatggcggcgggcacgggggcggcgacttccgccagaaggtgtggagcatgacgggagggccctactgccgccccgtccactggcgccgcaacacagccatcaccatgttcggtgtcttcctcgtctgcatccccatcgccatgaaatccgccgagcttgagcaacgcccccatcatccggtccggccaatcccatcgcaactgtggtgcaaaaactttggcaagaaggagtactgaagaagcttccagctagcatggagtggggcacgttgcttttgccttctttttgtcaaaacttgtgctcagataatgctggatgaagtgttatgagcatattctagaacgcttcatgtaatgtcttctaacttttttgtttattatgccgtgaggagtgcatgctggactcaaataaactgtgattcataagcctcagataatttacttaaggttgatgctatgaatgttgacatggcagtttggccttgcacacttactgttgaagttcctaccttctcttcatcaaaatccacggatatataaatccacgggatttgccttcttctcttcgtcaaaatcaaaatccacgggatttctggg

SEQ ID NO: 16786 - DNA, 747 bp, Panicum virgatum
  misc_feature: Ceres CLONE 1790272
  misc_feature: Encodes the peptide sequence at SEQ ID NO. 16787
aatcgaacagcaacagcaatctcttgtcaccgggaagacaatcggagcgaagcgagctggcaacggagagatggttctgacgcacgttgaggagctcgacgatgccgccgccgcgtcggccgtcgtcttcgcctcgagatacgtccaggagccgctcccgaggtacgagctggggcagaagtccatctccaaggacgcggcgtaccagatcatccacgacgagctgctgctggacagcagcccgcggctgaacctggcgtccttcgtcaccacgtggatggagcccgagtgcgacaggctcatcctcgagggcatcaacaagaactacgccgacatggacgagtaccccgtcaccaccgagctccagaaccggtgcgtgaacatcatcgcgcggctgttcaacgcgccggtgggcgacggcgagaaggccgtcggggtcggcacggtggggtcgtcggaggcgatcatgctcgccgggctggccttcaagcggcggtggcagcaccggcggcgggcggcggggaagccctgcgaccggcccaacatcgtgaccggcgccaacgtgcaggtgtgctgggagaagttcgcgcgctacttcgaggtggagctcaaggaggtgaggctccgggaagggcgctacgtgatggaccccgacgaggccgtggcgatggtcgacgagaacaccatctgcgtcgccgccatcctcggctccacgctcaccggcgagttcgaggacgtgaagcgccc

SEQ ID NO: 16787 - protein, 225 aa, Panicum virgatum
  misc_feature: Ceres CLONE 1790272
  misc_feature (30)..(225): Pfam Name: Pyridoxal_deC Pfam Description: Pyridoxal-dependent decarboxylase conserved domain
  misc_feature: SWISSPROT Homolog: EC 4.1.1.15 Glutamate decarboxylase
  misc_feature: Useful for making plants with modulated nitrogen use efficiency
MVLTHVEELDDAAAASAVVFASRYVQEPLPRYELGQKSISKDAAYQIIHDELLLDSSPRLNLASFVTTWMEPECDRLILEGINKNYADMDEYPVTTELQNRCVNIIARLFNAPVGDGEKAVGVGTVGSSEAIMLAGLAFKRRWQHRRRAAGKPCDRPNIVTGANVQVCWEKFARYFEVELKEVRLREGRYVMDPDEAVAMVDENTICVAAILGSTLTGEFEDVKR

SEQ ID NO: 16788 - DNA, 647 bp, Panicum virgatum
  misc_feature: Ceres CLONE 1790272-R
  misc_feature: Encodes the peptide sequence at SEQ ID NO. 16789
accagttcctccgattaggcttcgaggggtaccggaatgtgatggagaactgcatggagagcgcgcggatcctgcgggaggggctggagcgcacgggccggttcaccatcatctccaaggagcggggcgtgccgctggtggccttcacgcccaagggcggcgaggagggcgcctcgctggcgttccggctgtcgtcggagctgcgccggttcgggtggatcgtgccggcgtacacgatgccggcggacctggagcgcatggcggtgctccgcgtcgtggtgcgggaggacttcggccgcccgctggcggagcggttcctggcccacgtgcggatggcgctggacgcgctggacgacgaggccaggggcgggcccgtgccgaggatgcgggtcaccatcgagctcggccccgccgccaagggctccggcgaggaggcctccgccacggtcgtcaagcgggagtccgtcgtcgcggtgcagcggagcgtgtcggtggccggcgggaagaccaagggcgtctgctgagctgaggtcggtcagtcggtggccggaactcccggtggttgtacgcgtacctgaataaacacctgtctgtgtccacgaaggcagtatcttcttcgatgaatgaaaaattggaatggaatcgtc

SEQ ID NO: 16789 - protein, 173 aa, Panicum virgatum
  misc_feature: Ceres CLONE 1790272-R
  misc_feature: SWISSPROT Homolog: EC 4.1.1.15 Glutamate decarboxylase
QFLRLGFEGYRNVMENCMESARILREGLERTGRFTIISKERGVPLVAFTPKGGEEGASLAFRLSSELRRFGWIVPAYTMPADLERMAVLRVVVREDFGRPLAERFLAHVRMALDALDDEARGGPVPRMRVTIELGPAAKGSGEEASATVVKRESVVAVQRSVSVAGGKTKGVC

SEQ ID NO: 16790 - DNA, 632 bp, Panicum virgatum
  misc_feature: Ceres CLONE 1790280-R
  misc_feature: Encodes the peptide sequence at SEQ ID NO. 16791
tcgaacagatgggttttctggttcagatattgctgtttgtgtgaaggatgtgttatttgaacctgtccgcaaaacacaggatgccatgttcttctttaaggcagatggtgacatgtggatgccctgtggaccaaagcagcagggtgccatccagaccaccatgcaggagctcgcatccaagggccttgctgcaaagattcttccaccaccgatctccaggacagattttgaaaaggtcctgtcaaggcagaggccgacagttagcaagaaggacctggaggtgcacgagaggttcaccaaggagtttggcgaggagggctgatacaccgctcgaggacactcacccatgcacagctgcgccacagaaatgtatattgtttatgactttgattgttctgcatgcaagttggattcacaggattgtacattcggtagcccaactaaagttgatcatggctgcggctttatcatgtgttgggctatcgatgtgcgtctgttgtcatcttatttcgattttacacatacttggaatttttccacaggtgtattaatgaataataattcttaacgtggagtccttgtggtgcagtctgtatgtacagatgttttcttaatggtcggatattttccac

SEQ ID NO: 16791 - protein, 106 aa, Panicum virgatum
  misc_feature: Ceres CLONE 1790280-R
  misc_feature (38)..(103): Pfam Name: Vps4_C Pfam Description: Vps4 C terminal oligomerisation domain
  misc_feature: SWISSPROT Homolog: EC 3.6.4.3 Microtubule-severing ATPase
RTDGFSGSDIAVCVKDVLFEPVRKTQDAMFFFKADGDMWMPCGPKQQGAIQTTMQELASKGLAAKILPPPISRTDFEKVLSRQRPTVSKKDLEVHERFTKEFGEEG

SEQ ID NO: 16792 - DNA, 100 bp, Panicum virgatum
  misc_feature: Ceres CLONE 1790280
cctcgagtctttctagctcatcctgttctttgtggagcctgcgcactgcttattctacgataacatcggtcagctccacttctacctcgactccgtgttc

SEQ ID NO: 16793 - DNA, 702 bp, Panicum virgatum
  misc_feature: Ceres CLONE 1790281
  misc_feature: Encodes the peptide sequence at SEQ ID NO. 16794
acgcactacttgtgctctccctaggccaaaaccaaacccacccgctccacccctcctcttccccttctccatccccatcgccgccgtccccgatctcctccggcctctcgggaatgggcagcctggcgtcggagaggacggtggtggggtgggccgcccgggacgccaccgggcacctctccccctacacctacaccgtcaggtacgaacccgccggccatggccatctcgatcgaccgctccgccgccgccacccttcgatcccttcctgctcgattacctaccacatctgctgttccagtcacaggcacgcaccactaagctcgaatcaggctgagaaagccgaaaataaagccacaaccttcgttttcattcagtacatataggttctacagtgcaatatattaatatggcagacagggagcatcccatcgactgcatatttacactcctttttcaggaggagttcccatgtttacattccttcgatcgagagaagaatcttgctaacgctttcctttttttttttgttaaaaaaaacaagaaaactaacactgttcttatgccgccgtgactcgtgagccattgtctttttctttgaaccgaagtccgccattatctaatattctaattgtctcaaagcatgcgcctcctgcctgcaagaatcaactactgcttgtctgcttttctatatatgggttt

SEQ ID NO: 16794 - protein, 90 aa, Panicum virgatum
  misc_feature: Ceres CLONE 1790281
  misc_feature: SWISSPROT Homolog: EC 1.1.1.195 Cinnamyl-alcohol dehydrogenase
MGSLASERTVVGWAARDATGHLSPYTYTVRYEPAGHGHLDRPLRRRHPSIPSCSITYHICCSSHRHAPLSSNQAEKAENKATTFVFIQYI

SEQ ID NO: 16795 - DNA, 346 bp, Panicum virgatum
  misc_feature: Ceres CLONE 1790289
  misc_feature: Encodes the peptide sequence at SEQ ID NO. 16796
tgtcatttgcctggaggattacaaagacaaggatgtgctggggatactgaaatgcaaccatgacttccacgccgattgcatcaagaagtggctgcagacgaagaattcatgcccggtgtgcaaagcagccgctgcttaggataccagtggagcaccaattgtgctcctcgatccattgattttaggctcaggtcatattatcccattctattcttttgcccctagcaatgtaaataaatgctaaggtgatgaatcaattattgcatgggttgcagtaagcccaaattcttttgttgtagtgtaacaatcaagttaaagtaaattaaccatcaagtggttacatgct

SEQ ID NO: 16796 - protein, 45 aa, Panicum virgatum
  misc_feature: Ceres CLONE 1790289
  misc_feature (1)..(40): Pfam Name: zf-C3HC4 Pfam Description: Zinc finger, C3HC4 type (RING finger)
  misc_feature: The sequence is a functional homolog of SEQ ID NO 406 in the 10/666,642 US patent application
  misc_feature: Useful for making plants with altered lignin content
  misc_feature: Useful for making plants with altered alkaloid content
  misc_feature: The sequence is a functional homolog of SEQ ID NO 90 in the 10/666,642 US patent application
VICLEDYKDKDVLGILKCNHDFHADCIKKWLQTKNSCPVCKAAAA

SEQ ID NO: 16797 - DNA, 1652 bp, Panicum virgatum
  misc_feature: Ceres CLONE 1790292
  misc_feature: Encodes the peptide sequence at SEQ ID NO. 16798
atgatcaccctgggccctttgtaaattgcccctccaactgcagatctcctctccatctccctgcagcttatatgcatcatctatccctgatctcttccttctttccccccagcgcttgctacctctctagctagctagatctctctcctctacatgtctaccatctacatgagccaactgtctactctccctctaatggagcgagagcaggatcaggggctctttccggccttccatgtcacgaaggacccacctatcttattcccgttcatgatcaacaaccctgtggatcagctccaagggcaaagtagctatggagatcaacgcttgaggcatcaagttttggctgaatctactcatcaacaggttaggggccgggatcataattttggtatggatagcatcaaaggatagctatatatcttagcatgcttgatgctcttttagtcttagcagctccatgccatgtttaattagtcttccttttctcttttgtatatatgcagttcactgatcgcatgatgatgatgagcggaggatcagacgtcttccctaggccatcaccgttccggccgactattcaaagcatcgatggtgacatgatccagcggtccgcgtatgatccatacgatatcgagaacaagcgtgccgtcgatggatcgatcagtggctgggcagcggcggcggcaccgccggcgaagatgaagatcatgaggaaggcgatggcgagtgagtatcccgagggcggggcagcgagaaagccaaggagaagagcccaagcacaccaggatgagagccagcagctgcagcagcaggctgctatgggtgtcgttagggtgtgctccgactgcaacaccaccaagacccccttgtggaggagtggtccttgtggccccaagtctctttgcaacgcatgcggcataaggcaaaggaaggcgcgtcgggcgatggcggccgccgccggtgccagcaacggaggcgctccacaggtggccagtgtcgccgcacaggcaaagccggcgtccaagaaggagaagagggcggacgtcgaccagtcgctgccgttcaagaaacggtgcaagatggttgccgtggatcacgctgtcacggcggccaaggagacgccgacagtcgctgctccgtccaaccgggatcaggatctggatcacgtctccagtgacaaggttgtgagtctgcagagcaaggtcgtcgccactcctgatccgccggcgatgtcgttccacgccttccccgccgacgagatcaccgacgccgccatgctgctcatgacactgtcctgtgggctcgtccgcagctagctagcgagctatatacagcttctactagcagctgatagcgagatcactggtagacactgatgagttcgacacgttttgcaactaagtaccctaccccggccctatcatattgcttgtttgatcaagtgttgaggaagagcaagtaagatcaccaggagagatagagtgatcacatgcatggccaaggcaaaataataataagccaaaaactctggttagcctaccaggatttgctataagagtgagttttttaatttgttttaccttttttcccagctgtggctaattattcaagccactatatatatatgctatgcaactttgttcatttgt

SEQ ID NO: 16798 - protein, 272 aa, Panicum virgatum
  misc_feature: Ceres CLONE 1790292
  misc_feature (114)..(149): Pfam Name: GATA Pfam Description: GATA zinc finger
  misc_feature: The sequence is a functional homolog of SEQ ID NO 1032 in the 10/666,642 US patent application
MQFTDRMMMMSGGSDVFPRPSPFRPTIQSIDGDMIQRSAYDPYDIENKRAVDGSISGWAAAAAPPAKMKIMRKAMASEYPEGGAARKPRRRAQAHQDESQQLQQQAAMGVVRVCSDCNTTKTPLWRSGPCGPKSLCNACGIRQRKARRAMAAAAGASNGGAPQVASVAAQAKPASKKEKRADVDQSLPFKKRCKMVAVDHAVTAAKETPTVAAPSNRDQDLDHVSSDKVVSLQSKVVATPDPPAMSFHAFPADEITDAAMLLMTLSCGLVRS

SEQ ID NO: 16799 - DNA, 2453 bp, Panicum virgatum
  misc_feature: Ceres CLONE 1790294
  misc_feature: Encodes the peptide sequence at SEQ ID NO. 16800
gcaaagtccacggcccacccctccaccatttcctcctcggctccggttcccccaaacttttttgcctcccctccccaccaccaccaccaccaccactgcctccccgcccctcctgcccgacgaacacggcaccacgagccccctcccggatttagccatcctcccaccgcggctgcattcctctcctttggtaggtggtggtcgtcgttcccgtcaacccctcggccctgcgtgctgatttcgtccccgtttgtgctgtttgcatacagtatttcaatgaaggcaaatatgggtacaaaagctcgtcctccaccagctgatgcagacaaaggggagattggcgaaatagatacaagggctccttttgaatctgttaaagctgcagttagcttatttggtgaagtccggttttcatctgacaaatcagctgcgagaaaacccaaggctcctcaagcagagagggtgttagctaaggagacagagctgcacctagcccagaaagagttgaataaatacaaggaacagctgaataatgctgagacaacaagagtacaggccctctctgagcttgagaaagctaaaaaaactgttgaggagctaaccaccaagcttgatgcaatcaacaagtctaaagagctagccattcaagcaacagcggatgcgaagactcgaaccaaacagcttgaaggtggcagctcaaatgaaggtcttggcacagatggtcctctgaagcaggaactggaaagtgcaagggagcagtatgctgttgctttggcagaccttgatgcagcaaaacaggagcttagaaagctcaagaaagattttgaaacctcattggatatgaggttgtctgctgctcagcaggaagaggaatcactgcacacaactgaagccaacaaggaaaaagctaatcaacttcgtagtgagattgcagaaattcaagagtcgcttatgcacgttaaggcagctacacagcaagcacatgaggaggaggcacagatccgtactgagaaggatgttgctaggaccacatacaaacaagctttggaagaaacacagaagaagttgtcatctttgaggaatgattttgatcctgctgcttatgaaagtctcaaggagaagttagaccaaaccaattctgagattgcatctatgcagaaaaagatagaagatgctcgggctcgggatttagagtctgttgctattgtcagcacagagttggatgatgctaaggaaatgttgcagaaagtagcagaggaggaaagttctcttcggggtttagtcgaatcactgaaagttgagttagaggctgtaaagcaggagcacaatcagctcaaagagaaggacacagaaactgaatcaattgttggggatctacatgttaagcttcagaaatgcaagtccgagcttgaggcagctgtagctgctgagtccaaagcaacatcagcttctgatgacttgatgttggcccttcagcagctgtcttctgagtcaaagagtgccctgcaggaagctgagatgatgcagaagagtgcggcagagctaagagatgaagctgaaaaagctcgggttgaattagctgaggccgagcaaaggttgcagcttgctttgaaggaagcagaagaggccaaagcagctgaagcaagggcccttgatcatatcaaggaactctcagatcgagcaagtgctgcacgagcctcaacttcagagtctgcagcaaatatcacaatctcaaaagatgagtttgattctctaagccgaaaggtcgaggagtcagagaaactgagtgagatgaaagttgctgcagctatggctcaagtggaagccgtcagagccagtgagaacgaggcaatcaagaaactggaagctgcccgtaaggagatggaggacatggaattggcaacagaagaggcactgaagagggcagagatggcagaggcagccaaaaaggctgtagaaggcgagcttaagagatggcgcgagaaggagcagaagaaaactgcagagatgcagccttccacaggagcacaagaagttgcaggtgcatctccacctgtaccacagggttctgctgggaaagcgactgagaagaacgagggccaccaaaggaataccaggacgctattgaggaagagctttatgctgccaaacatcacgagcatgttccacaagaagaagagccatgctggcagcagttctccgtcgtaccttcctggcgaaaaatctgtgtaatctatctgaagctcttgtttgagttgaaatttccaaactagaatgcatggtcagatactataatctgtataatatgctcgtagttgcttgcgccttgcagtaaattactgacataattttatatatgtatgttctgtctgtttcttcaacatttgctggacctcttatgagtacctctgtaactctgttatatttaagccagtgtccaaagcacgttctag

SEQ ID NO: 16800 - protein, 647 aa, Panicum virgatum
  misc_feature: Ceres CLONE 1790294
  misc_feature: SWISSPROT Homolog: EC 2.7.11.1 Non-specific serine/threonine protein kinase
MGTKARPPPADADKGEIGEIDTRAPFESVKAAVSLFGEVRFSSDKSAARKPKAPQAERVLAKETELHLAQKELNKYKEQLNNAETTRVQALSELEKAKKTVEELTTKLDAINKSKELAIQATADAKTRTKQLEGGSSNEGLGTDGPLKQELESAREQYAVALADLDAAKQELRKLKKDFETSLDMRLSAAQQEEESLHTTEANKEKANQLRSEIAEIQESLMHVKAATQQAHEEEAQIRTEKDVARTTYKQALEETQKKLSSLRNDFDPAAYESLKEKLDQTNSEIASMQKKIEDARARDLESVAIVSTELDDAKEMLQKVAEEESSLRGLVESLKVELEAVKQEHNQLKEKDTETESIVGDLHVKLQKCKSELEAAVAAESKATSASDDLMLALQQLSSESKSALQEAEMMQKSAAELRDEAEKARVELAEAEQRLQLALKEAEEAKAAEARALDHIKELSDRASAARASTSESAANITISKDEFDSLSRKVEESEKLSEMKVAAAMAQVEAVRASENEAIKKLEAARKEMEDMELATEEALKRAEMAEAAKKAVEGELKRWREKEQKKTAEMQPSTGAQEVAGASPPVPQGSAGKATEKNEGHQRNTRTLLRKSFMLPNITSMFHKKKSHAGSSSPSYLPGEKSV

SEQ ID NO: 16801 - DNA, 747 bp, Panicum virgatum
  misc_feature: Ceres CLONE 1790297
  misc_feature: Encodes the peptide sequence at SEQ ID NO. 16802
ggcaatccctacatccccgatgggcgcacaaatatcaacgaatgtagtggtacaaggaatggtccttgtggcatgtatagcacgtgcgaggatacagatggtgattatatttgcaaatgcaaatttaaccgcaaaggagatggtaaaagcgaatttggatgttatgagtatatatttccgccatatgccattgctgccgtagcaacaattcttgccgttgtcatggcatgtttggcgattattttgcttatgagacgaaagcataggaaactttcccacaagaacggtggcgatattctgaagggggtgggcatcatcatcttcaccgaacgggagctgaagacgatcacaaagaaatacagtaaacccattggtggaggcttctttggcgaagtctacaaggggacccggaccatcaacggcacccaagctcaggaggtagcggttaaacgcacagtggcaaaaaaccaggcgcgccaccggcaaaacacgctcctacaggagccgccgcagcacgagcaggaggagttctggaaggatgggttcgtgaaggagatcaccttccagttccagattaggcacccaaatgtggtacgcctcattgggtgctgcctagagacagaagtccccacattggtctttgagttcgtccgcaagggaagcctcgaagatgtccttcatggtggtggcgacaagctctgcgctctctcgctgcagaagcgcctggacattgccattggctccgcg

SEQ ID NO: 16802 - protein, 248 aa, Panicum virgatum
  misc_feature: Ceres CLONE 1790297
  misc_feature: SWISSPROT Homolog: EC 2.7.11.1 Non-specific serine/threonine protein kinase
GNPYIPDGRTNINECSGTRNGPCGMYSTCEDTDGDYICKCKFNRKGDGKSEFGCYEYIFPPYAIAAVATILAVVMACLAIILLMRRKHRKLSHKNGGDILKGVGIIIFTERELKTITKKYSKPIGGGFFGEVYKGTRTINGTQAQEVAVKRTVAKNQARHRQNTLLQEPPQHEQEEFWKDGFVKEITFQFQIRHPNVVRLIGCCLETEVPTLVFEFVRKGSLEDVLHGGGDKLCALSLQKRLDIAIGS

SEQ ID NO: 16803 - DNA, 1582 bp, Panicum virgatum
  misc_feature: Ceres CLONE 1790298
  misc_feature: Encodes the peptide sequence at SEQ ID NO. 16804
ctccctctgtttctcttctccgacctttcccttctctcgaagagaaactctctcctttcctggcggcgacgactgggcgagcggtggcccagccctttgccggcgacgagtgcatcctccagaacaagaattatcgggtgtacatgtgtacaccaatgtcctatgctgggtccgcccctgccatataggactttaaattgaaaccgaggagtgggtgctttttatctttccaatgtccaaaagaagcctcccttcttggatgggttcttctaaagatggagaggacgattcaggcaagaagaaacatacaggcacctcccagaaggctcagaaagggcctgatttctccaaacttttggatggggtcgtctttgtgctgtcagggtttgtgaatccggagaggagcacactgcggtcacaagcattggatatgggagctgagtatctgcccgattggacatcagattgcacccttcttgtttatgcatttgctaacacacccaagtttcgacaagttcaagctgataatggaaccattatctcaaaggattggatctctgaatctcacatgcaaagaaaacttgtggacattgaaccttatcttatgcatgctggaaaaccatggcggaaaaataaggagacagttgaatctgatcaaggtcctgctgatttagatcagaaggagatgcgtaaagagcataaaaagcaagttcaacggtctcacatcaagtcatctgtctctgctaccacagaggcgggacattcagactctggaaacatacacttttctccctcaaaaataaaacaatgggcaatggatgatttgacgcagactgtgtcatggttgaagagccaagaagagaagccagagccaagtgaactgaaggcaattgctgctgaaggagttattacttgtctgcaagatgccatcgaatccctcgagcaaggcaatgatattaaaggagtggcggagcagtggagcttcgtcccccatgttgtcaacgaactattgaaactggatggaagcagaaaagatgcatctttgcctaaagaacagctcttgcaactagcaatcaagtgtaagaagatttatcaggccgagtttgctcgcatggacagtgacgacaagaaggggacgaaggggcagagcagctcgcctgtaactaagcatcgcaggaagaccaagtcggatgatgattgctacgacagcgacgccacgatagaaatgacagaggaagagattgatctggcgtgcaggcagctccctgggctatgttgataagctaggttagtagaggcgtgcgtgtgtcccactgccccctcagaactgaagaggaagaatgctggatggccatctccaatcttttcctgctgccacccaaataaaccgtatgagaattaggttgttaggcaaattgacgagcccaaggttgtaatatggattttaatctatactagtggttatgcacgtgcccaggcacgtgtttatttagtggttttgcacatttcgagtcccaatgtttaaaactaactctgtataactctatgaagctacataatatactctatggtgtaagagttc

SEQ ID NO: 16804 - protein, 339 aa, Panicum virgatum
  misc_feature: Ceres CLONE 1790298
  misc_feature (28)..(103): Pfam Name: BRCT Pfam Description: BRCA1 C Terminus (BRCT) domain
MGSSKDGEDDSGKKKHTGTSQKAQKGPDFSKLLDGVVFVLSGFVNPERSTLRSQALDMGAEYLPDWTSDCTLLVYAFANTPKFRQVQADNGTIISKDWISESHMQRKLVDIEPYLMHAGKPWRKNKETVESDQGPADLDQKEMRKEHKKQVQRSHIKSSVSATTEAGHSDSGNIHFSPSKIKQWAMDDLTQTVSWLKSQEEKPEPSELKAIAAEGVITCLQDAIESLEQGNDIKGVAEQWSFVPHVVNELLKLDGSRKDASLPKEQLLQLAIKCKKIYQAEFARMDSDDKKGTKGQSSSPVTKHRRKTKSDDDCYDSDATIEMTEEEIDLACRQLPGLC

SEQ ID NO: 16805 - DNA, 1674 bp, Panicum virgatum
  misc_feature: Ceres CLONE 1790303
  misc_feature: Encodes the peptide sequence at SEQ ID NO. 16806
aactcaaacagcccagccgcaaagccgcccgggtttcagcagctccggcacgatcgccttcgcccagtgagggaggagaggacaggaaaaaaaattcccccgtcgcgcccgcccattacgacggcgccggccgagcagacgccgccgccacgatgtcgcccgccaccggcgccgtcgcatccgccgcggcgggagaggaatctcccgccgccgccgccacggttctcctcggcaggtacgagctcggcgacctcctcggccgcggcgcgtccgccaaggtgtaccgcgcgcgggacctcctcaccggccgctccgtcgcgatcaagtcattccccaacccccgcgccgccggggccgagaaggggcgccgccccgtggccattgagcgcgaggcggccatcctccgccgcctgcgccaccgccacgtggtgcgcctccacgagatcctagccacgcgcaagaaggtccatttcgtcctcgacctcgccgccggcggcgagctcttctcgctcgtcgacgcctccggccgcatgacggaggacctcgccaggcactacttccggcagctcatctccgccgtgcgctactgccacgcgcgcggcgtgttccaccgcgacatcaagccggagaacctgctcctcgatgaggcaggcgagctcaaagtcgccgactttggcctaggcgccgtggccgacggcaacctccgccacacgctctgcggcaccccggcgtacgtggcgccggagatcctgtcgaggaagggctacgacccggccaaggtggacatctggtcctgcggcgtggtgctgttcgtgctcgccgccggctacctccccttcaacgacgccagcctcgtcaacatgtaccgcaagatctacgcgggcaggttccggtgcccgagctggttctcgccggcgctgcgcgacctgctgcgccgcttgctggacccgaacccggactcccgcaccgacgcggacggcatcgtgggccacccgtggttctgccacggcgccggcgacgaggagctggcgcgcctcatgcgcggccacgaggaagagccctggttcaagcccgagttcaaggaggaggacatggcgagggagatgacggcgttcgacatcctgagcttctccgccgggtccgacctgtcggcgctcttcggcgccgggccgggcaaggagcgggtgttcgtgagcgagcccgccgccgcggtgctgagccgcgtggaggcggctgggcggaaggaagggtaccgcgtgaggagggaagggaagcggggcaccgggccggtctacctggaggaggagagcggcggcggcatcgtggccaaagtgagcgtcttcaagctcgccgacgcggtgtcaatggtggaggtcgtcaagggcgacggcgcggaggcggcactcttctggaccgagcggctcgagccggccgtgaagcccccagtgctgagctgagctgtaagctgatcggggccgccgccgagggttcctgctctgctcctgggaggcgccgccgctgccgcttgccgggaacgggattcgtttcctgttgttgtgatggtaaattcatttggttctttggccgtgtgtctgttgtatggtgcctggcacgctcagcgagcagagcactaagcgagcgagatttgttgccgggtcggcgaaaatcatcagc

SEQ ID NO: 16806 - protein, 434 aa, Panicum virgatum
  misc_feature: Ceres CLONE 1790303
  misc_feature (29)..(283): Pfam Name: Pkinase Pfam Description: Protein kinase domain
  misc_feature (314)..(371): Pfam Name: NAF Pfam Description: NAF domain
  misc_feature: SWISSPROT Homolog: EC 2.7.11.1 Non-specific serine/threonine protein kinase
  misc_feature: Useful for making plants with modulated biomass
MSPATGAVASAAAGEESPAAAATVLLGRYELGDLLGRGASAKVYRARDLLTGRSVAIKSFPNPRAAGAEKGRRPVAIEREAAILRRLRHRHVVRLHEILATRKKVHFVLDLAAGGELFSLVDASGRMTEDLARHYFRQLISAVRYCHARGVFHRDIKPENLLLDEAGELKVADFGLGAVADGNLRHTLCGTPAYVAPEILSRKGYDPAKVDIWSCGVVLFVLAAGYLPFNDASLVNMYRKIYAGRFRCPSWFSPALRDLLRRLLDPNPDSRTDADGIVGHPWFCHGAGDEELARLMRGHEEEPWFKPEFKEEDMAREMTAFDILSFSAGSDLSALFGAGPGKERVFVSEPAAAVLSRVEAAGRKEGYRVRREGKRGTGPVYLEEESGGGIVAKVSVFKLADAVSMVEVVKGDGAEAALFWTERLEPAVKPPVLS

SEQ ID NO: 16807 - DNA, 1837 bp, Panicum virgatum
  misc_feature: Ceres CLONE 1790305
  misc_feature: Encodes the peptide sequence at SEQ ID NO. 16808
ctttttttcctttgcccaacccaactcgtctcgtcttcgttcccctttcctcctccgcatcccgtcttctcctcaccgcgtcaaaccccagcaccaagcaaccgccccgccgccccttccctcccctcccgaatctgccgccgcggtgcctaatccggccgatcccccctccgatccgcgggtgcccgccgcaaaggcggcgcctttgggcctcctccgatgtataacaacttcaaggagcaggcgatcgagtacgtcaagcaggcggtccaggaggacaatgccggcaactatgtcaaggcgttcccgctctacatgaacgcgctcgagtacttcaagacccacctcaagtacgagaagaaccccaagatcaaggaggcaatcaccgccaagttcaccgagtacctccgccgcgccgaggagatccgggccgtcctcgatgacggcggcgcggggcccggggccaacggcggcgacgcagccgtcgccacgcgccccaagaccaagggcaaggacggggacggcggcaacggcggggacgactccgagcagtccaagctgagggcggggctcaattccgccatcatcaccgagaagccgaacatcaagtggaacgacgtcgccggcctcgagagcgccaagcaggccctgcaggaggccgtcatattgcctgtcaagtttccgcagttcttcacgggcaagcggaagccttggagggcttttcttttgtatggcccccctggaacaggaaagtcttatttggcaaaagctgttgcaaccgaggctgattcaacatttttcagtatatcttcatcagatctggtttcaaagtggatgggtgaaagtgagaaattagttgcgaaccttttccaaatggctcgtgaaaatgccccttcaattatctttatcgatgaaattgattctttatgtggtcaacgtggagaaggcaatgaaagcgaagcttcaaggagaatcaagactgaactacttgtgcaaatgcagggtgttggccataatgatgataaagttctcgttcttgctgctacaaatacaccatatgctctggaccaggctgtgcggcgaagatttgacaagcgtatctacattccgctacctgacttgaaagcaaggcagcatatgtttaaggtccatcttggggatacaccccacagcttaacagaaagtgattttgagagcttggcccgtcgaacagatgggttttctggttcagatattgctgtttgtgtgaaggatgtgttatttgaacctgtccgcaaaacacaggatgccatgttcttctttaaggcagatggtgacatgtggatgccctgtggaccaaagcagcagggtgccatccagaccaccatgcaggagctcgcatccaagggccttgctgcaaagattcttccaccaccgatctccaggacagattttgaaaaggtcctgtcaaggcagaggccgacagttagcaagaaggacctggaggtgcacgagaggttcaccaaggagtttggcgaggagggctgatacaccgctcgaggacactcacccatgcacagctgcgccacagaaatgtatattgtttatgactttgattgttctgcatgcaagttggattcacaggattgtacattcggtagcccaactaaagttgatcatggctgcggctttatcatgtgttgggctatcgatgtgcgtctgttgtcatcttatttcgattttacacatacttggaatttttccacaggtgtattaatgaataataattcttaacgtggagtccttgtggtgcagtctgtatgtacagatgttttcttaatggtcggatattttccac

SEQ ID NO: 16808 - protein, 435 aa, Panicum virgatum
  misc_feature: Ceres CLONE 1790305
  misc_feature (167)..(352): Pfam Name: AAA Pfam Description: ATPase family associated with various cellular activities (AAA)
  misc_feature (367)..(432): Pfam Name: Vps4_C Pfam Description: Vps4 C terminal oligomerisation domain
  misc_feature (5)..(73): Pfam Name: MIT Pfam Description: MIT (microtubule interacting and transport) domain
  misc_feature (118)..(353): SWISSPROT Homolog: EC 3.6.4.3 Microtubule-severing ATPase
  misc_feature (7)..(73): SWISSPROT Homolog: EC 2.7.11.1 Non-specific serine/threonine protein kinase
MYNNFKEQAIEYVKQAVQEDNAGNYVKAFPLYMNALEYFKTHLKYEKNPKIKEAITAKFTEYLRRAEEIRAVLDDGGAGPGANGGDAAVATRPKTKGKDGDGGNGGDDSEQSKLRAGLNSAIITEKPNIKWNDVAGLESAKQALQEAVILPVKFPQFFTGKRKPWRAFLLYGPPGTGKSYLAKAVATEADSTFFSISSSDLVSKWMGESEKLVANLFQMARENAPSIIFIDEIDSLCGQRGEGNESEASRRIKTELLVQMQGVGHNDDKVLVLAATNTPYALDQAVRRRFDKRIYIPLPDLKARQHMFKVHLGDTPHSLTESDFESLARRTDGFSGSDIAVCVKDVLFEPVRKTQDAMFFFKADGDMWMPCGPKQQGAIQTTMQELASKGLAAKILPPPISRTDFEKVLSRQRPTVSKKDLEVHERFTKEFGEEG

SEQ ID NO: 16809 - DNA, 665 bp, Panicum virgatum
  misc_feature: Ceres CLONE 1790313-R
  misc_feature: Encodes the peptide sequence at SEQ ID NO. 16810
cgcgctcgtcgccgcgctctccggcgtctggctgcacacccacgaggaggagctcgagctcgcgcagttcttccacaagaaggactacctgaaacgcgacgacaacaatgactacgagaactacaattactacggcatagcggcgcagatcgtgttcatcttcctcatggcggtcatcgtgttccagatcatgatacccatctcgctctacatctccatggagctcgtcaggctcggccaggcctacttcatgatccgggacaccaagctgttcgatgagtcctccaacacgaggttccagtgtcgggctctcaacatcaacgaggacctaggccagattaagtgcatattctctgataagaccggcacgctcacgcagaacaagatggagttccggtgcgcgagcattgacggtgtcgattacagtgacattgcacgacagcaacctgctggtagggtagtttctcccttatccccatcaattcttttgaataggattataggaaagccattgttggcaattgattgcttttgattcgtagcagagggtgatcggatttgggcgccaaagatatcggtgaacaccgatcaggaactggtcaagttgatcagggatgggggtgacacagagcaagggaggcagacccgagagttcttcctcgccc

SEQ ID NO: 16810 - protein, 177 aa, Panicum virgatum
  misc_feature: Ceres CLONE 1790313-R
  misc_feature: SWISSPROT Homolog: EC 3.6.3.1 Phospholipid-translocating ATPase
ALVAALSGVWLHTHEEELELAQFFHKKDYLKRDDNNDYENYNYYGIAAQIVFIFLMAVIVFQIMIPISLYISMELVRLGQAYFMIRDTKLFDESSNTRFQCRALNINEDLGQIKCIFSDKTGTLTQNKMEFRCASIDGVDYSDIARQQPAGRVVSPLSPSILLNRIIGKPLLAIDCF

SEQ ID NO: 16811 - DNA, 722 bp, Panicum virgatum
  misc_feature: Ceres CLONE 1790313
acacacgaaagtctacgagctctctctcccctcatacagatggtgccgtcgtcctcaccaacgccccctgccagattttaagcgccatggccaaaccatctcggcttgcatttctccctttcttcccgtctctgcgcttcgcttcctcctcctccttcctttttttcttttgaataaactcctccttcctccccggcctgcgggggacgacggagtaaacgggccctggtgaatccaatctttaatgcgccagtcaccgtagttactcccaggcgtccaacctcggccaaccacccacgcctcctcctactcgcttgcctctgccttgccttgctttgcctgccaaaacccaactcgtcctgtgctcgtgagctcgccttcccctcccctcccctcccctgttctctcagcccgagcgcggcgagtgccgctcggccccgatcccccgcctctaaaaaccccggctttcacgcgcgctccgggagcgccatgcccgggaacacgggagcccggggttcggggcgccgtgccgtctgactccgcgccggtcggccgcctcccgcccgcgccccggccccgccccgccgtcatagccgaggaccacgggtcgtcgcggcacatgtcggcgtcgcagaaggagctgggcgacgaggacgcgccgggtggtgcgcgtgggcgacgccgcgcgcaccacgagcgcctcgacttcgcgggcacgccgt

SEQ ID NO: 16812 - DNA, 1956 bp, Panicum virgatum
  misc_feature: Ceres CLONE 1790322
  misc_feature: Encodes the peptide sequence at SEQ ID NO. 16813
aagacgagcagaagaggaggtgccggccggcccgctccaagacgagcagaagaggaggtgccggccggcccgctcccagaatctcccaccactgcaacccctaggtgtttccctttgtcgtctccctctcctccgccgttggagtccaactactccctagtcagcagcctcagccatgggggcggaggaggccaacggcctcgtcgtggtgccggagccgcgcccgcgcaagggcctgacctcctgggcgctcgacctgctcgagtccgtcgccgtgcgactcggccacgacaaggccaagccgcttcactggctatcaggcaactttgcccccgtcgtcgacgagactccgccggcacctgacctccccgtccgcggacacctcccggagtgcttgaatggagagtttgtcagggtcgggcctaatcccaagtttgtcccagtcgcagggtaccactggtttgatggagatggaatgattcatgccatgcgtattaaagatggaaaagctacctatgtatcaagatatgtgaagacggctcgcctcaagcaggaagagtattttggcggagcgaagtttatgaagattggagatctaaagggattctttggattgttcatggtccaaatgcaacaacttcgtaaaaaattcaaagtcttagattttacctatggagttgggacagctaatactgcacttatatatcatcatggtaaactcatggccttatcagaagcagataagccctatgtagttaaggtccttgaagatggagacttgcagactcttggtttgttggattatgacaaaagtctgaaacattctttcaccgcccatccaaaagttgatccatttacagatgaaatgttcacttttggatactcacatgagcctccttactgtacataccgtgtaattaccaaagatagggctatgcttgatcctgtgccaataacaataccagaatctgtaatgatgcatgactttgccatcaccgagaattattctattttcatggatctccctttattgttccgaccaaaggaaatggtgaagaatggtgagtttatttacaagtttgatcctacaaagaaatctcgttttggtattctcccacgctatgccaaggatgacaaactcataagatggtttgaactccccaattgcttcatattccacaatgctaatgcttgggaagagggtgatgaagttgttctcattacctgccgccttgagaatcccgatttggacaaggtgaacgggcatcagagtgacaagcttgagaacttcgggaatgagctgtacgaaatgagattcaacatgaaaactggagctgcttcacagaagcaactgtcagtttctgctgtagattttcctcgtgttaatgagagctatactggcaggaagcagcgttatgtatactgcactatacttgacagcatcgcaaaggtgactggcatcataaaattcgatctgcatgctgaaccggagagtggtaagaaggaacttgaagtaggaggaaatatacagggcatatatgacctgggacccgggagattcggttcagaggcggtttttgttcccaagcagccaggtgtatctggagaagaagacgatggctatttgatattctttatgcacgatgaaaatacagggaaatctgaagtgaatgttatagacgcgaagacaatgtctgctgatccagttgcagtggttgagcttcctaacagggttccgtatggattccatgccttcttcgtaaccgaggaacaactggcgcaacaagcagaggggcggtaacatatatgtagcacctgcagcagattctgcacacgccggccggtgatacacagctttaccaagtcctgttattgttatagcatgatacatacaacattaattatatgtattattgcaagattacaatgcaagatggtatatatacataatatagt

SEQ ID NO: 16813 - protein, 541 aa, Panicum virgatum
  misc_feature: Ceres CLONE 1790322
  misc_feature (34)..(531): Pfam Name: RPE65 Pfam Description: Retinal pigment epithelial membrane protein
  misc_feature: SWISSPROT Homolog: EC 1.13.11.51 9-cis-epoxycarotenoid dioxygenase
MGAEEANGLVVVPEPRPRKGLTSWALDLLESVAVRLGHDKAKPLHWLSGNFAPVVDETPPAPDLPVRGHLPECLNGEFVRVGPNPKFVPVAGYHWFDGDGMIHAMRIKDGKATYVSRYVKTARLKQEEYFGGAKFMKIGDLKGFFGLFMVQMQQLRKKFKVLDFTYGVGTANTALIYHHGKLMALSEADKPYVVKVLEDGDLQTLGLLDYDKSLKHSFTAHPKVDPFTDEMFTFGYSHEPPYCTYRVITKDRAMLDPVPITIPESVMMHDFAITENYSIFMDLPLLFRPKEMVKNGEFIYKFDPTKKSRFGILPRYAKDDKLIRWFELPNCFIFHNANAWEEGDEVVLITCRLENPDLDKVNGHQSDKLENFGNELYEMRFNMKTGAASQKQLSVSAVDFPRVNESYTGRKQRYVYCTILDSIAKVTGIIKFDLHAEPESGKKELEVGGNIQGIYDLGPGRFGSEAVFVPKQPGVSGEEDDGYLIFFMHDENTGKSEVNVIDAKTMSADPVAVVELPNRVPYGFHAFFVTEEQLAQQAEGR

SEQ ID NO: 16814 - DNA, 1109 bp, Panicum virgatum
  misc_feature: Ceres CLONE 1790331
  misc_feature: Encodes the peptide sequence at SEQ ID NO. 16815
agttcctttgctgctcctcgatttgattgcttgcgttcatcctcgattgattcctccctgaggcgaaggcaggctggtcaccatgggatctaaggcacctttcttcctcttgctcctcttgctgctcgtcgcccgggcacctgcacaagccagggatcctgctgatcacagccctgtcgacaaggaacatattcctgcccatctcaagagcagcagcccgatatgctctgcttgtgaaaacttagcgagtggtgctgtcacttatctaagtgagaaacaaacacaagataagatcatggaattacttcatcatgcttgttcgcagtcattctccttggaacagaagtgtgttgaattgatggactcctatgtaactctgctgtttgccaagatttcggagatcaagccagaagagttctgcaaacagtatggcctgtgcagggataccacctttttctctggtgtgggtagtgacagcacttgtgtgttttgccaccaccttcttgatgaaattatgtccaaactgaaagatccagatgcggagtttgagataattcaaattctcatcaaggagtgtaacaagatcaaaggtcatgtccagcagtgcaagagattggtcctgcaatacgttccccttatcatggtaaatggcgagaagttccttgagaagaatgatgtgtgcgcactcgtacaagcgtgtccagctaatcaaaagactacaatcagctcattcttggacgatggattggtgagcgatgcatgaagatttacaaaaatcgccgtggattggtgagcgatgcatgaagattggaagattacaaaaagcgcacggcgatggtgaaaatagtattattccttgtacataaggcgataaaccaagggcttctgtattgtgcccatgtacttatattgtggatgcaattgttttacgatacaacaacatagtcttttgtcccaagcaagttggggtaggctaaattgttttacgatagcagtctgttaatattctgggagctgaaagaaatatcatgtgctaggctacggatgctgtcaataacttgtcaagaaatatttcagatgtagccaaataaaacagcaagattgtttgt

SEQ ID NO: 16815 - protein, 226 aa, Panicum virgatum
  misc_feature: Ceres CLONE 1790331
  misc_feature (45)..(84): Pfam Name: SapB_1 Pfam Description: Saposin-like type B, region 1
  misc_feature (131)..(169): Pfam Name: SapB_1 Pfam Description: Saposin-like type B, region 1
  misc_feature (86)..(119): Pfam Name: SapB_2 Pfam Description: Saposin-like type B, region 2
  misc_feature (172)..(206): Pfam Name: SapB_2 Pfam Description: Saposin-like type B, region 2
MGSKAPFFLLLLLLLVARAPAQARDPADHSPVDKEHIPAHLKSSSPICSACENLASGAVTYLSEKQTQDKIMELLHHACSQSFSLEQKCVELMDSYVTLLFAKISEIKPEEFCKQYGLCRDTTFFSGVGSDSTCVFCHHLLDEIMSKLKDPDAEFEIIQILIKECNKIKGHVQQCKRLVLQYVPLIMVNGEKFLEKNDVCALVQACPANQKTTISSFLDDGLVSDA

SEQ ID NO: 16816 - DNA, 927 bp, Panicum virgatum
  misc_feature: Ceres CLONE 1790336
  misc_feature: Encodes the peptide sequence at SEQ ID NO. 16817
agagagagagggagagggaggagaaaaaagcagaacaggcacgccaatcacccctagccacaacgaggagagctccacggttccaccctcccggaatcttccccggtctcctgccaagaaccgcgcgcaccacgcttctcctctccaacgatgcaggcggcggcggcggcgtcggcagctgtggcgtgggcgccgggcccgtcgccgtccacctcctcctcgcctccccccttcagggtgggggttgcgtcgacggccgtgccggcttcttccgcgcccaggctggtcgccgcgtccgcgcccctgggtcgtcggcggcggcggcaagtggttcaagctgttgccaacccagaccctgcgatcgagctgccgctgacatctgaaaatgttgagatggttttggatgaagtaaggccatatcttatggcagatggaggaaatgttgcattgcatgagattgacgggaatgttgtgaggttaaagctgcaaggagcatgtggctcatgcccggcttcagtaacaacgatgaagatgggtatcgagcgacgcttgatggagaaaataccagagattgtagcagttgaacccatcgctgatgaggagactgggcttgagttgacccaagagaacattgacgggaagggcgggcctggtgcagcggtagagcctaccgtctgtaaccggaaggtcccgggttcgagccccagcctctgcacatttgtgtgggtaaggtttatggcttaaaaaacaacccttccccagaccccgcacattgcgggaagcctacggcactgggtacgcccttttgttgcctgaatacttcgattagtaaagattattggatgcttatggaatattgaagcaacccaggctttatattgttgactaattggaatgaatattcctaaaataagatcagtttcttct

SEQ ID NO: 16817 - protein, 197 aa, Panicum virgatum
  misc_feature: Ceres CLONE 1790336
  misc_feature (80)..(147): Pfam Name: NifU Pfam Description: NifU-like domain
MQAAAAASAAVAWAPGPSPSTSSSPPPFRVGVASTAVPASSAPRLVAASAPLGRRRRRQVVQAVANPDPAIELPLTSENVEMVLDEVRPYLMADGGNVALHEIDGNVVRLKLQGACGSCPASVTTMKMGIERRLMEKIPEIVAVEPIADEETGLELTQENIDGKGGPGAAVEPTVCNRKVPGSSPSLCTFVWVRFMA

SEQ ID NO: 16818 - DNA, 724 bp, Panicum virgatum
  misc_feature: Ceres CLONE 1790339
  misc_feature: Encodes the peptide sequence at SEQ ID NO. 16819
acgtgtctcagccggtcacccctcaaactcctctccctcctcttcttcatttccatcagcttttgtctcaccgtcacagaaattccgattgcagcgcagtcccggattgttcactccagcccgcaaatgatcatcaccgtcagcagcagcttctcgaagaattcatgatccttttgcgatgggtccgatctccaatgatgcgtcgcataagaggttcttcagcatcgcgccaccggcggcactgatatttttcttcgtactaatattcgtcgctggtgcaattgtcacgcttgatcacaaggagaacttgttgatactgcagctgcatccaagagaagcgttggcaaccgaggagatcaggcctccagcgacgagcgcgttgcgcgctgagccaacagaagaacccaacctctgtgagaaccaatgcagaccttcaggcagcgaggccttgccgaggggcatcgtgcaggataagtccaacttccagatggagtccctgggcggcaatccagggcggaagaaggctgttaggccgtcgaaaagcctcctagcgatccccgtcggcatcaagcagaaggcggtcgtcgacaagcttgtcgccaagttcccggcttccaacttcgtcgtgatgctgttccactacgacggcgtggttgacgggtggcgagacctcaagtggtcggaccgcgccatccacgtcgccgtgcgcgaccagaccaagtgg

SEQ ID NO: 16819 - protein, 181 aa, Panicum virgatum
  misc_feature: Ceres CLONE 1790339
  misc_feature: Useful for biocontainment applications
MGPISNDASHKRFFSIAPPAALIFFFVLIFVAGAIVTLDHKENLLILQLHPREALATEEIRPPATSALRAEPTEEPNLCENQCRPSGSEALPRGIVQDKSNFQMESLGGNPGRKKAVRPSKSLLAIPVGIKQKAVVDKLVAKFPASNFVVMLFHYDGVVDGWRDLKWSDRAIHVAVRDQTK

SEQ ID NO: 16820 - DNA, 1880 bp, Panicum virgatum
  misc_feature: Ceres CLONE 1790342
  misc_feature: Encodes the peptide sequence at SEQ ID NO. 16821
agctctactccaagagcactctaccaccacactagctacaatctaaaacctcaaacggaaaggaaaaaacaaaacaaaaaggtgttgccgatcatggtggccgtgcccaaggtcgcgatggagtggctccaagaccctctgagctgggtgttgctggcgtctctggccttattcctcctgcagctgcggcggtggggcaaggcgccgctgccgccgggcccgaagccgctgccgatcatcgggaacatgacgatgatggaccagctgacccaccgcgggctggcggcgctggccgagcagtacggcgggctgctgcacctccgcctgggccagctgcacgtgttcgcggtgtcgacgcccgagttcgcgcgcgaggtgctgcaggcgcaggacgccgccttctcgaaccgccccgccaccatcgccgtctcgtacctgacctatgatcgcgccgacatggcgttcgcgcactacgggcccttctgacggcagatgcgcaagctgtgcgtgatgaagctcttcagccggcggcgcgcggagacgtgggtggcggtgcgcgacgagtccgcggcgctggtccgcgccgtggcgtccagcgccggcgaggccgtgaacctgggcgatctcatcttcaacctgaccatgaacgtcaccttccgcgccgcgttcggcacccgcgacggcgaggaccaggaggagttcatcgccatcctccaggagttctccaagctcttcggcgccttcaacgtcggcgacttcatcccctggctgagctggatggacccgcagggcatcaaccgccgcacccgcgacgcccgcgccgcgctggaccggttcatcgacaggatcatcgacgagcacatcaggcgggggaagaaccccgacgacgccgacgccgacatggtcgacgacatgctcgcctacctcgccgaggccaagcccaacaaggacggcggcaagtccgccgccggcgacgtcgacgacctgcagaacacgctccgcctcacccgggacaacatcaaggccatcatcatggacgtgatgtttggcgggacggagacggtggcgtcggcgatcgagtgggcgatggcggagatgatgcaccgccccgacgagctgcggcgcctgcagcaggagctcgccgacgtggtcgggtacgaccggaacgtgaacgagtcggacctggacaagctccccttcctccggtgcgtcgtcaaggagacgctccgcctgcacccgcccatcccggtgctcctccacgagaccgccgaggactgcgtcgtgggcggctactccgtgccccggggctcccgcgtcatggtcaacgtctgggccatcggccgcgaccgcggctcctggaaggacgccgacgcgttccggccgtcgcggttcgcgccggacggggacgccgtggggctcgacttcaagggcggctgcttcgagttcctgcccttcggctccggccgccgctcctgccccgggatggcgctgggcctctacgcgctggagctcgccgtcgcgcagctcgcgcatggcttcagctggtcgctgcccgacggcatgaagccctcggagctcgacatgggcgacatcttcgggctcaccgcgccgcgcgccacgcggctctacgccgtgcccacgccccggctcaactgccccgtgcactgacgatctatcaaggtagcagcggatggatcggacgcgcgcggcaaactgttatttctcttctatttgtgcgtgtaactgtgttttcccttggcttggtggcttaaatcatgtcgatgctatagggccgggcaataaggtaaaaattgttgctcatatatatatatatgcctagtgtaagaactcaagttgtataaaatggatgctggtcgatc

SEQ ID NO: 16821 - protein, 391 aa, Panicum virgatum
  misc_feature: Ceres CLONE 1790342
  misc_feature (1)..(381): Pfam Name: p450 Pfam Description: Cytochrome P450
  misc_feature: SWISSPROT Homolog: EC 1.14.13.21 Flavonoid 3'-monooxygenase
  misc_feature: Useful for making plants with altered lignin content
  misc_feature: Useful for making plants with altered cell wall content and/or composition
MRKLCVMKLFSRRRAETWVAVRDESAALVRAVASSAGEAVNLGDLIFNLTMNVTFRAAFGTRDGEDQEEFIAILQEFSKLFGAFNVGDFIPWLSWMDPQGINRRTRDARAALDRFIDRIIDEHIRRGKNPDDADADMVDDMLAYLAEAKPNKDGGKSAAGDVDDLQNTLRLTRDNIKAIIMDVMFGGTETVASAIEWAMAEMMHRPDELRRLQQELADVVGYDRNVNESDLDKLPFLRCVVKETLRLHPPIPVLLHETAEDCVVGGYSVPRGSRVMVNVWAIGRDRGSWKDADAFRPSRFAPDGDAVGLDFKGGCFEFLPFGSGRRSCPGMALGLYALELAVAQLAHGFSWSLPDGMKPSELDMGDIFGLTAPRATRLYAVPTPRLNCPVH

SEQ ID NO: 16822 - DNA, 1841 bp, Panicum virgatum
  misc_feature: Ceres CLONE 1790360
  misc_feature: Encodes the peptide sequence at SEQ ID NO. 16823
acttcccagcgccagcagacgcggccaaaaccccctccggcctccgcgaaatcccagctcccggattcgtatgattcgcataaattgctctgctctctgaactccctgctgtcacagagagtagttgccaccgcgaattccatcaaactccgggaaattcggctctttggtagctagattttcggctagttcaaagcagcatcagctgtagcgggggatgcgaggagtacggaggagtgctcgcggggaggcgtcgtgggaggcggaccgcgagttggactgcttcgccatggccaacgaggtgttccacctcaccagggccaggtcggagccctgccaccggactcgcggttcggcttccgcccgcgggaggaggcccttctcgactttcgggctcgtgtcggcgaggaagtctggccgcacgggcggcgccgggttctcgccggccgatcgcgcctatgttggcagcaggcacatcccgacgaaagggccgtggagcgtcgacgaagtggacagcgaggcctacgtctcgcagttctctgctgatgggtcgctgctcgtcgctgggtttcggggaagccgcatcagagtttacaatgccgatagagggtggacgattcataagaatataaactgcaaaagtctgcagtggacagtttcagatattgctctttcacctgatcaacaattccttgcctattcaagtttgtcgcctattgttcacattgtgaatgtgcagagttctggaaaggaatcgcatgctaatgttaatgaaattcatgagggattggatttcaccggcgatgaacatgacaatgaggactttggaatattttctgttaaattctcaaaagatggtaaagaagttgttattgggaacaatgaaagatcaatacatgtttatgaccttgcagcaaataaagtgtcagtccgcatccgtgctcatattgctgatgtcaatgctgttaccttcgctgatgaaagcggcaatgtgttgtactctggaagtgatgatagtctctgtaaggtgtgggacaggcgttgccttgctggggaaaaatcagcaggtgttttgacaggtcacttagatggagttacatttattgatagccgtggtgatgggaggtatttcatctccaattgcaaggatcagagaatcaaactttgggacatcaggaaaatgtcttctgtcgtgaaagttcgcccagtgataaaaatggactgggactataggtggatgccattcccatcagaagcacatcattataagcatccaaacgatcagtctttggccacatacagaggtcactcagttctgcaaacacttatccgttgctacttctcccctatgcacagcacaggccagaggtacatatacacaggatccagtgacaagtctgtacatatttatgatgtggtaagcgggaagaccgttgagaggctctcatggcatagctcagttatcagagactgcacctggcatccgtgctacccaacgctcgtgacctcctcctgggatggttatgttgctcggtgggaggcctcaggtgatgaaaaaaacccatcaatgcttgtcaccgatgagcagagggcaagcccttactttcagccatacggtgatcccttcatgatgtagagaagtttcgtgctggtgtattgtcaaaaacgaagtttggtgctggtgctgagagttgggaagcaagatgatgtcttctccaaagagcgtatactaatggcgatgaacatgtcgtttgctttgtagtttcagatcgcaactgagcaatgtgtacactgtacagtgccgtttgacgagaatagtcatgcagtaatgttagcttggt

SEQ ID NO: 16823 - protein, 472 aa, Panicum virgatum
  misc_feature: Ceres CLONE 1790360
  misc_feature (234)..(273): Pfam Name: WD40 Pfam Description: WD domain, G-beta repeat
  misc_feature (403)..(441): Pfam Name: WD40 Pfam Description: WD domain, G-beta repeat
  misc_feature (280)..(318): Pfam Name: WD40 Pfam Description: WD domain, G-beta repeat
  misc_feature: SWISSPROT Homolog: EC 2.3.1.48 Histone acetyltransferase
MRGVRRSARGEASWEADRELDCFAMANEVFHLTRARSEPCHRTRGSASARGRRPFSTFGLVSARKSGRTGGAGFSPADRAYVGSRHIPTKGPWSVDEVDSEAYVSQFSADGSLLVAGFRGSRIRVYNADRGWTIHKNINCKSLQWTVSDIALSPDQQFLAYSSLSPIVHIVNVQSSGKESHANVNEIHEGLDFTGDEHDNEDFGIFSVKFSKDGKEVVIGNNERSIHVYDLAANKVSVRIRAHIADVNAVTFADESGNVLYSGSDDSLCKVWDRRCLAGEKSAGVLTGHLDGVTFIDSRGDGRYFISNCKDQRIKLWDIRKMSSVVKVRPVIKMDWDYRWMPFPSEAHHYKHPNDQSLATYRGHSVLQTLIRCYFSPMHSTGQRYIYTGSSDKSVHIYDVVSGKTVERLSWHSSVIRDCTWHPCYPTLVTSSWDGYVARWEASGDEKNPSMLVTDEQRASPYFQPYGDPFMM

SEQ ID NO: 16824 - DNA, 1890 bp, Panicum virgatum
  misc_feature: Ceres CLONE 1790372
  misc_feature: Encodes the peptide sequence at SEQ ID NO. 16825
acaccaatcttttgacggcttccccgggctcgtgctgcttcccgatgcagacgcagttctccactcgctgcgccgccaaccaagaatgttttatgtctcaaaatcttgttgcctttgatcggctttgatttcaggagcttgtgctgctcgttgccgtctcaattttgagctctgtggtggaggcgatggtgaaggcgaggcggcaagccaccgcgagctgagccccgccgcctccttttgctccaagcgatggcctgcttccgcttccgctgcttaagcagcaaggtcaggaagggcgcgggcgggaagaggcgggagcggcccgcggcgccggcgtccccggcgcccgcctcgttcccctccaggggagcgtgctccaacctgtccttctccacggcgtcgtcggccgtcggcacgagcctgtccgaggactccggcgccgcggtgcgggccgcggcgagcaagtcgtcggcgcggagcatcccggagctgtacgaggagaggggcgccaacagcctccgcgagttcaggttccgggagctccgggccgctaccagcgatttcagccggctgctcaagctcggcgagggcggcttcgggagcgtctacaagggcgtcatccggctgccgggcgggcccgcgggcggcacgctggtcgccatcaagaagctcaatcccaaaggtcatcagggccacaagcaatggttggcagaagttcattttctgggggttgttgagcacccaaatctcgtcaagctcatcgggtactgcgccgcgcaaagtgaaagaggccctcagaggctgctggtctatgagttcatgtcgaacaagaccttgggtgatcatctgttcaataaagcataccctgtcctcccttgggacatcaggttggaaatagcactcgatgctgctgagggactgatgtacctccacgagggattggaagttcaggtcatatatcgtgacttcaaagcttccaatgtcctgcttgatgagaagtttagaggaaaactttcagattttggattggcaagggaagggccatctgctgatcatactcacgtctctacagcggttatggggacgttgggctatgcggctccagattatattgagacaggccatctcactacaaagagtgacgtttggagctttggggtagttctatatgagatcctcactggacggcgctcaatggagaggaatcgtcctaagaatgagcagaaacttcttgaatgggtgaggcagtatcctgtcgaaagtaagcaattcagcaagattatagacacaaggcttgatggccattactctaagcagggcgctagaaaagttgccacgttggccaatagttgtcttgcaaagcatcgaagggaccgtccaacaatgagagaagtggtcaagagcctgaagcaagcaatgcagcacaaggagttagatggggatgcaggggcttcaggtgagacttcaccacctgatgagatatcggggaaaccaacaacagaggatgttgccgtggcatcagcaaggcggcggatgcttcatctggctgccctaggtgagaatgcaaacagcattgcgaaggcgagattcatgctcatgaggactgccactgttccaactcctacataatcttcagttgtgatcttctcttttgactctgtactttcttatgtggttatgaagataggctcgttggtgacgttttccctttgtcagtgtacatctatagataatcaaacattattttttttccttctgatcagtactttctataagtaggatgggtgtgagactagaggttttctattgtaaagctttctttgccttaaggattctctatgtttgactgcaactttaaaccttgtaaaagctgccaaatttttcctgtcg

SEQ ID NO: 16825 - protein, 459 aa, Panicum virgatum
  misc_feature: Ceres CLONE 1790372
  misc_feature (105)..(386): Pfam Name: Pkinase Pfam Description: Protein kinase domain
  misc_feature: SWISSPROT Homolog: EC 2.7.11.1 Non-specific serine/threonine protein kinase
  misc_feature: Useful for making plants with modulated heat sensitivity
MACFRFRCLSSKVRKGAGGKRRERPAAPASPAPASFPSRGACSNLSFSTASSAVGTSLSEDSGAAVRAAASKSSARSIPELYEERGANSLREFRFRELRAATSDFSRLLKLGEGGFGSVYKGVIRLPGGPAGGTLVAIKKLNPKGHQGHKQWLAEVHFLGVVEHPNLVKLIGYCAAQSERGPQRLLVYEFMSNKTLGDHLFNKAYPVLPWDIRLEIALDAAEGLMYLHEGLEVQVIYRDFKASNVLLDEKFRGKLSDFGLAREGPSADHTHVSTAVMGTLGYAAPDYIETGHLTTKSDVWSFGVVLYEILTGRRSMERNRPKNEQKLLEWVRQYPVESKQFSKIIDTRLDGHYSKQGARKVATLANSCLAKHRRDRPTMREVVKSLKQAMQHKELDGDAGASGETSPPDEISGKPTTEDVAVASARRRMLHLAALGENANSIAKARFMLMRTATVPTPT

SEQ ID NO: 16826 - DNA, 1541 bp, Panicum virgatum
  misc_feature: Ceres CLONE 1790389
  misc_feature: Encodes the peptide sequence at SEQ ID NO. 16827
gttcccccctccccaacccacaggcgatgcccatgggctgtccatcatcgccctcgatgatccagcaatgtccatgccctataaaaatggtatgacgccgatcagcccaacgaaccgatcgacgaagaagaagaagaagaagaagagcccgccggcggcgccgacgacggaagcgccgttcgaccgcgtccggtacaaccaggtcgggagcgcgatggcgtcgaacgaggcaatgtggggctcgacgagctcgggcggcgcccccgccgcgtgcgcgttcccgacggtgccgcgggtggcgcggtcgcacgcgtgggactgggccgcgctgctcctcctggtcgccgtcgacgcgctgctcaacgtcgtcgagccgttccaccgcttcgtgggcgccggcatgatgaccgacctcagataccccatgaagaccaacaccgtccccgtctgggccgtgccggtgcggcaacgacgaacgatctctctttaataatctcctcgtaatctcgttgggatgcaggcatccttaacaacacatgacattcttggaggcgacggggccctgctgatcgcgttaattactattatttttcttttgtgctgaataaacatgcaggtcattgccgtcattgggcctgtggtcatcttcatcatcatctacgtcaggcggaggaacgtgtacgatcttcaccatgcgattctaggcatcctatttgcggtgctgataaccggggtcctgaccgacgcgatcaaggacgccgtcggccgcccgcgcccaaacttcttctggcgctgtttccccgatggaaaagcggtatacgacaacatcaccacaggagtgatttgccatggcgatccaagggagatcaaggaagggcacaaaagcttcccgagtgggcacacctcatggtcatttgccggcctggggttcctgtcgtggtacctcgccgggaagatcaccgtgttcgaccgccggggccacgtcgccaagctctgcgtcgtcctcctcccgctgctcgtcgcggcgatggttgccatctcgcgggtggacgactactggcaccactggcaagacgtctgcaccggcggcgtcctcggattggtggtcgcttcagtttgctacctccagttcttcccagctccgtcagacgagaaagggttctggccgcacgcgcacttcaggttcatcaccgagcaggaggaggagagccgagcgcagcggcctgcagagacaggagggcgcaccagccacgagctggacgcattggaagccggccggagagatcagctgttgtagcatgatcgagcaggcgccagcgcaggaccaacggtgtacagaggccccaccgtaggtagtgtgattatttgcaggacagcaggaggctgccaaggcggagaggactcccgataagcttcggtcgagagctcctccatcccatagcccaccagtctttttcttcttcttctccctcccctccgcctccgcctctgcctccatccatcctgcctctcctctgccaccgccacggatctccttctcg

SEQ ID NO: 16827 - protein, 228 aa, Panicum virgatum
  misc_feature: Ceres CLONE 1790389
  misc_feature (29)..(179): Pfam Name: PAP2 Pfam Description: PAP2 superfamily
  misc_feature: SWISSPROT Homolog: EC 3.1.3.4 Phosphatidate phosphatase
MQVIAVIGPVVIFIIIYVRRRNVYDLHHAILGILFAVLITGVLTDAIKDAVGRPRPNFFWRCFPDGKAVYDNITTGVICHGDPREIKEGHKSFPSGHTSWSFAGLGFLSWYLAGKITVFDRRGHVAKLCVVLLPLLVAAMVAISRVDDYWHHWQDVCTGGVLGLVVASVCYLQFFPAPSDEKGFWPHAHFRFITEQEEESRAQRPAETGGRTSHELDALEAGRRDQLL

SEQ ID NO: 16828 - DNA, 557 bp, Panicum virgatum
  misc_feature: Ceres CLONE 1790389-R
cattccttcccctctgctccaaccttgtccgcctccactgctcgaccccgccgtcggcctcgccgctcacaccccgcctcctccgccgggctagctctcgcccacggccttccctctaaggccaccggctatggaaaccaacctcgaacccctaaaccctaacgttaataccgccgacctccgccgccacccacggccggcggcgacctcgccgccaactgccccgcccaccttctgcccgactgtcgcgcgaataagactgttggagttacgttgtgtgatttgttactttttttctatctcaattgctactttctgttgttgcaatggctgtgctgaaggaagtaacgagaggaggggctcaggatctagcatttggattatttgcaggccgccactaacgcagattactgacatgatcccccctccacgtatatacacgcacgcatgctctgaagctcgatgtgaatagcagctgtattgaatttgtatatactatatccgattttttattatgtacagcaatcgaaatttaataaacgatgtttgtcctacag

SEQ ID NO: 16829 - DNA, 1983 bp, Panicum virgatum
  misc_feature: Ceres CLONE 1790393
  misc_feature: Encodes the peptide sequence at SEQ ID NO. 16830
tagagtacctcgccgcaggcaggcatcttgtcttgttgctctttgcttgatccgtccatggcgcttttgcagccgcagggctccccctcctctccagccatagcgttttagtgcatgaatgctccttctgcacctccctcgccatagcttgcaggagcatcaccacctagctcgcgagtattagatcaacagtgcagtgaaagtgtccagtgccagccacccccaccggcactcatcacctccatcagatctgcagctttgctcgcattaatcaaggtatgtgtacgttggccgcaatatctcatactactgatagtatatcatcatgcgtctgtgcaagttcttggtcgatttaatggcgtctgtggctagcgcacagctttcttccaacttcggtagcttcctgcgtattagatcagcagcatcttgatgtagctaataacctgcaagtgcatgcctccgatcgtttttgttgataggttttatttgcaagatggaccatagcttcagcgacatgatcttgagcgagagcgcgtggagcggcggcggcgacggaggggcggtcttgctgctgccggaggtgggcggtgttggtggcgttggcgtcgaggggggcaacatgacggtgctggagaggctggtgctcgacgaggccctggcggcggcgatcctggagctgcagggcatccaggcgcctgcctgcgccggcaaggcgccggcggccggtggtggcgtggtcggggagcccgtcgccttcccctcgatggcgacgccaacgcccgcctacgcggacgttgacgcggatgtcctccagcgacagcagcatcgccatcgccatcagggcgcgatggggatggcaccggactacgacctcacaccagcaacagccgctgtcgcggtaactactgtgccggctgccttcacaaacgccgcagcggcggttgacagtggcggccttgtcgttgatgcgccggtgttctccggcaacgagaccggcgcgccgggggccgcgacgagccagcggtgtgaagaaggaaaaggcggcggccggaggcaacgccggcccaacaggaagcggaaagccgccgagccgtcctccgtgccggcgcaggagagcaccctctgcagcctcctggcgtccaccacggcgggcgagggcggcatccagatcgccttcagcacgagcgctcaggctcccgctggcgccaagagggccaagccgtcggtgagcggcagcgggtcgtcgagcatcagcttcgacggccggaacgccggggccaacggcggggtggacgaccccatgtacgagcccgacacggaggcgctggcgcaggtgaaggagatgatctaccgcgcggcggcgatgcgccccgtctccctcggctccgacgacgccggcgagcggccgcgccggcgcaacgtgcgcatctcctcagacccgcagacggtggcggcgcggcagcggcgggagcgaatcagcgagcgcctccgcgtgctgcagaagctagtcccgggcggcgccaagatggacaccgcctccatgctggacgaggccgccaactacctccgcttcctcaagtcccaggtccgggagctgcaaaccctagaccgccggaacttcgccgcgaacaccaccaccaacgtgaacaactccatagcggcaccgcctccaccatggccgggtcactgagctacaacaatggcaacggtgttccatgccggtcggccttcgacttgcagccgaaaccctacgaggagggggaggtgttgatcgtgatcgagctagcagctgatttagtcacttagttggaagatgcatgatagatttgtaacactcatgcatgttgctggtaacactttttatttatgtctgtccaatgtgcatgtattcatcattgttagctcaaagactagggagatgatgatgctatcgatgatgggatctaccaatgcaacaaggatgcaaattggcttcattagttc

SEQ ID NO: 16830 - protein, 398 aa, Panicum virgatum
  misc_feature: Ceres CLONE 1790393
  misc_feature (315)..(362): Pfam Name: HLH Pfam Description: Helix-loop-helix DNA-binding domain
  misc_feature: The sequence is a functional homolog of SEQ ID NO 1939 in the 10/374,780 US patent application
  misc_feature: The sequence is a functional homolog of SEQ ID NO 1831 in the 11/479,226 US patent application
  misc_feature: The sequence is a functional homolog of SEQ ID NO 296 in the 10/374,780 US patent application
  misc_feature: The sequence is a functional homolog of SEQ ID NO 8 in the 10/225,066 US patent application
  misc_feature: The sequence is a functional homolog of SEQ ID NO 914 in the 10/412,699 US patent application
  misc_feature: The sequence is a functional homolog of SEQ ID NO 1938 in the 10/374,780 US patent application
MDHSFSDMILSESAWSGGGDGGAVLLLPEVGGVGGVGVEGGNMTVLERLVLDEALAAAILELQGIQAPACAGKAPAAGGGVVGEPVAFPSMATPTPAYADVDADVLQRQQHRHRHQGAMGMAPDYDLTPATAAVAVTTVPAAFTNAAAAVDSGGLVVDAPVFSGNETGAPGAATSQRCEEGKGGGRRQRRPNRKRKAAEPSSVPAQESTLCSLLASTTAGEGGIQIAFSTSAQAPAGAKRAKPSVSGSGSSSISFDGRNAGANGGVDDPMYEPDTEALAQVKEMIYRAAAMRPVSLGSDDAGERPRRRNVRISSDPQTVAARQRRERISERLRVLQKLVPGGAKMDTASMLDEAANYLRFLKSQVRELQTLDRRNFAANTTTNVNNSIAAPPPPWPGH

SEQ ID NO: 16831 - DNA, 687 bp, Panicum virgatum
  misc_feature: Ceres CLONE 1790396
  misc_feature: Encodes the peptide sequence at SEQ ID NO. 16832
aggacggatggctgtacgtgtggtgttgtggagtgagtgagcgagggagggaggaagaagaactgggagccactgagggcctttatacaagcacagccgtggtcatggcaagatcactggctgtctagcatccaggcgcacggagagatgggtctcactggcggcattgtacggagagtcttctccaagagcccgtgctcgtcggccggcagcggtggcagtcgtccccacagtgagaagggcgctggtgctcaccagagaagatggagctcgctgcggctgtacctttgcggcgaggatatgaacacggccccaaaggacgacgacaacgagacggtctccgtcaagagcttcgagacctgcgcgatgccgctgccgcaaccgcaggaggagcacgtcccggcggcggtggcgcctcaaccgagcggcggcgtgcacgacggtgacgacagcaccggggagccgcctgaagatcagagggtccccgccgggcacagccacgccatcacgccaacagagccggacgagaaggaaggagcggcggcgatgctgatccagtctgcgttcagaggattcatggcgaggagggagctgcgggagctgaggatccggagagaaacggacggcggtggcgccagcgagcccaagagccccacttcggcgtctgttgccacgtcggtggtgggc

SEQ ID NO: 16832 - protein, 179 aa, Panicum virgatum
  misc_feature: Ceres CLONE 1790396
  misc_feature (130)..(150): Pfam Name: IQ Pfam Description: IQ calmodulin-binding motif
MGLTGGIVRRVFSKSPCSSAGSGGSRPHSEKGAGAHQRRWSSLRLYLCGEDMNTAPKDDDNETVSVKSFETCAMPLPQPQEEHVPAAVAPQPSGGVHDGDDSTGEPPEDQRVPAGHSHAITPTEPDEKEGAAAMLIQSAFRGFMARRELRELRIRRETDGGGASEPKSPTSASVATSVV

SEQ ID NO: 16833 - DNA, 617 bp, Panicum virgatum
  misc_feature: Ceres CLONE 1790396-R
gcggcagggggagccggcggcagacgactgcatgagccggaacgcggacgcgggctcggccgggcggcgggtggtggtcgtccggaggcggggcaacctcgccggcgagaaggagagctgcgggtccaacgatgtgtccgtcgtcagctttgacggctccagcagcctcggcggccggagcgggctcagctgccacaagcccggcaggagccgcctcaagggcgcccggggcctgccgcgccgcaaggcggcggcgtcggaccaccgccaccaggcaagatcgcacaaggtgagcaagaaagggcaccagcggcaggagcaggcgccgacgcacaaggaccaggccgaggccaacggctacgacgcctcttgccagcctccgacggattactgagccgggcaccggagcttctgcgacgatctgctgcacatacgctatgatctggattggcagcgctgctacctcaagtacctgacgatttgtttgggatttgctagtctgaaagactgccacatgccgccagggccacatgtaaagttcatcgctaaatgttgcatcagacgtcgctgtctcttaactttgctcttctggtcctcccaaacaaaaccttctgcgc

SEQ ID NO: 16834 - DNA, 1965 bp, Panicum virgatum
  misc_feature: Ceres CLONE 1790402
  misc_feature: Encodes the peptide sequence at SEQ ID NO. 16835
atcgtcccattgctcgcccagagttgttcttgttaggcaaggcaaaagcaggagcaaaaggtgagaacaatctcaggtttcgttggtgatggcgagctcagggttctcgtggacgctgccggaccacccgaagctccccaaggggaagccggtggccgtcgtcgtgctggacggatggggcgaggccaacgccgaccagtacaattgcatccatgtcgctcagacgcccgtcatggattccctcaagaatggtgctccagagaggtggagactcgtgaaggctcatggaactgctgtgggtctcccatctgatgatgatatgggcaacagtgaagttggccacaatgctcttggagctggtcgcattttcgcccaaggcgctaagctcgtggaccaagctcttgcctccggaaaaatttatgagggtgatgggttcaactacatcaaagaatcttttgaaaatggtacacttcaccttattgggttgttgagtgatgatggcgtccactcccgtcttgaccaactgcagctacttctgaaaggtgccagtgagaggggagcaaaaagaatccgtgtacacatccttaccgatgggcgtgatgttttggatggcagcagtgttggttttgtagagacactagagaatgatctttcacagcttcgagagaagggtattgatgcacagattgcatctggtggtggaaggatgtatgttaccatggaccgttatgagaatgactgggatgtggttaaacgtgggtgggatgcccaggtgcttggagaagcaccccacaaattcaaaagtgcacttgaagcagtgaaaacactgagagcagagccgaatgctaatgatcagtatttgcctccatttgtgatagttgatgacagtggcaaagctgttggtcctgtattagatggtgatgcggttgtcactatcaacttccgggctgatcgcatggttatgcttgcaaaggcacttgagtacgcagactttgacaaatttgaccgtgtccgtgtcccaaaaatccgctatgctgggatgcttcagtatgatggcgagttgaagcttcctagccgttaccttgtttctccaccagagatagagagaacatctggtgaatacttggtgaagaatggcatctgcacctttgcttgcagtgagacggtgaagttcggtcatgtcacatttttctggaacggtaaccgttcaggatacttcgatgaaaccaaggaagagtatgtagaaattcctagtgacagtggtattacattcaatgttgcacccaagatgaaggcgcttgaaatcgcggagaaagccagggatgctctccttagtggaaagtttgaccaggtacgtgtcaacctgccaaatggtgacatggtgggtcacactggtgatattgaggccacagttgttgcttgcaaggcagctgatgaagccgttaagattattttggatgctgtggagcaagttggcggtatttacgttgtcactgctgatcatggaaatgcagaggacatggtgaaaaggaacaaagctggcaagccggcgcttgacaagagtggtggtatccaaattctcacctcacatacccttcagcctgtcccggttgcaattggaggccctggtctgcaccctggagtgaaattccggaatgacattcagacccctgggctcgccaacgttgctgccactgtgatgaacctccatggctttgaggcccctgctgactacgagacaactctcattgaagttgctgacaactaaatactggccaatcttaatgtccaattttgctgctatagttttgagaatgcatcggtggccatgtcattgaataatttctgtttgcaagcaggctgctcaaactcacagaacattgagaggaacacattttcgcctgcacttagatgctctatgtataacttgagataatgctctatgtataacttgaaattatctcc

SEQ ID NO: 16835 - protein, 559 aa, Panicum virgatum
  misc_feature: Ceres CLONE 1790402
  misc_feature (18)..(390): Pfam Name: iPGM_N Pfam Description: BPG-independent PGAM N-terminus (iPGM_N)
  misc_feature (400)..(527): Pfam Name: Metalloenzyme Pfam Description: Metalloenzyme superfamily
  misc_feature: SWISSPROT Homolog: EC 5.4.2.1 Phosphoglycerate mutase
MASSGFSWTLPDHPKLPKGKPVAVVVLDGWGEANADQYNCIHVAQTPVMDSLKNGAPERWRLVKAHGTAVGLPSDDDMGNSEVGHNALGAGRIFAQGAKLVDQALASGKIYEGDGFNYIKESFENGTLHLIGLLSDDGVHSRLDQLQLLLKGASERGAKRIRVHILTDGRDVLDGSSVGFVETLENDLSQLREKGIDAQIASGGGRMYVTMDRYENDWDVVKRGWDAQVLGEAPHKFKSALEAVKTLRAEPNANDQYLPPFVIVDDSGKAVGPVLDGDAVVTINFRADRMVMLAKALEYADFDKFDRVRVPKIRYAGMLQYDGELKLPSRYLVSPPEIERTSGEYLVKNGICTFACSETVKFGHVTFFWNGNRSGYFDETKEEYVEIPSDSGITFNVAPKMKALEIAEKARDALLSGKFDQVRVNLPNGDMVGHTGDIEATVVACKAADEAVKIILDAVEQVGGIYVVTADHGNAEDMVKRNKAGKPALDKSGGIQILTSHTLQPVPVAIGGPGLHPGVKFRNDIQTPGLANVAATVMNLHGFEAPADYETTLIEVADN

SEQ ID NO: 16836 - DNA, 1742 bp, Panicum virgatum
  misc_feature: Ceres CLONE 1790414
  misc_feature: Encodes the peptide sequence at SEQ ID NO. 16837
aactccgaaatctccccccataattctctccgcgttcccctctttcgactcacgactcacgttacgaaaattcgttgctcccaccgtgggcgatctcaccggcggcgtcgcgaacacgccgaaaccctaaccctcgcctcccccgcccgagatgtcggccgtcgccgtcgccccgacccctccggccgcggccttccaggtggcgcccccgccgtcatacccggccgccgccgccgccgccgccgagggccacgacgacgacctgtacggccgcctcaagtcgctccagcgcgccctggagttcatcgagatccaggaggactgcgtcaaggacgagctcaggaacctcaggcgcgagaagctgcacgtgaaggaggaggtcaagcggtgccgcgcgacgccgctcgagatcggccagttcatggagatggtcgacgccgaccacggcatcgtggggcccaccagcggcggcacctactacgtgcgggtcctcagcaccatcgaccgcgaggagctcaagccctcggcgtccgtcgcgctcgaccgccactcccacgcgctcgtcgacgtgctgccgcccgaggccgattccagcatttcgctgctcggctcgtcggagaagcccaacgtcacctacaatgatattggaggatgtgatatccagaagcaagagatcagggaagctgttgagctacccttgacacaccatgaattatacaaccaaattggtattgatcctccaagaggtgtgctattgtttggtcctccaggtactggcaagaccatgcttgccaaagctgtggcacatcacacaactgctgcttttatccgagtagttggttcggaatttgtacagaagtacttgggtgagggccctaggatggttcgagatgtattccgtttggctaaggagaatgcccctgctatcatattcattgatgaggttgacgcaatagccactgcacgttttgatgctcagactggtgctgatcgagaagttcagcgtattcttatggagctacttaatcagatggatggatttgatcaaacagtaaatgtgaaggttataatggcaactaaccgggcagatactctagatcctgctctgctgcgtccaggtagacttgatagaaaaattgagttccctgttcctgaccgacggcagaagaggcttgtgttccaagtctgtactgccaagatgaacttgagtgatgaggttgacttggaagattttatttccagaccggataaaatcagtgctgcagatattgctgctatatgtcaagaagctgggatgcatgctgtccgcaagaaccggtatgtcatcctccaaaaagacttcgagaagggttaccggaccaatgtgaagaagcctgagacggacttcgacttttataagtgaagaaagcatgagtgttagaatgcagtcgttgactaattgctccatacaccacttgtgtcatttgaactgaaaagctcgaacatgctgtgtcgcactcatactaggcagtagtaagcgacaattgcttgaattcaaacgggcatgatgccccgatgccttctgccgcctactggtgtgacaaatgacaaatccaccgaaccatagattacaatagatgattataggtcactcgtggattttgtactaacagcagttttctgataatcgagtctggcacttgtcctccctccctaaagttgaagtggccaccattttcttatgctagcattattattgcgtc

SEQ ID NO: 16837 - protein, 416 aa, Panicum virgatum
  misc_feature: Ceres CLONE 1790414
  misc_feature (199)..(386): Pfam Name: AAA Pfam Description: ATPase family associated with various cellular activities (AAA)
  misc_feature: SWISSPROT Homolog: EC 3.6.4.3 Microtubule-severing ATPase
MSAVAVAPTPPAAAFQVAPPPSYPAAAAAAAEGHDDDLYGRLKSLQRALEFIEIQEDCVKDELRNLRREKLHVKEEVKRCRATPLEIGQFMEMVDADHGIVGPTSGGTYYVRVLSTIDREELKPSASVALDRHSHALVDVLPPEADSSISLLGSSEKPNVTYNDIGGCDIQKQEIREAVELPLTHHELYNQIGIDPPRGVLLFGPPGTGKTMLAKAVAHHTTAAFIRVVGSEFVQKYLGEGPRMVRDVFRLAKENAPAIIFIDEVDAIATARFDAQTGADREVQRILMELLNQMDGFDQTVNVKVIMATNRADTLDPALLRPGRLDRKIEFPVPDRRQKRLVFQVCTAKMNLSDEVDLEDFISRPDKISAADIAAICQEAGMHAVRKNRYVILQKDFEKGYRTNVKKPETDFDFYK

SEQ ID NO: 16838 - DNA, 1034 bp, Panicum virgatum
  misc_feature: Ceres CLONE 1790419
  misc_feature: Encodes the peptide sequence at SEQ ID NO. 16839
actccgtctctggtctctctcctcccctgccctctctctcgtctgatctgcatctgctttttcttccccccttgtctctgtcccttctggcgtgcgcaaagatttgttttttttttctctcgaggaggcggagcggcggagcctgaggaggagtggtggtgggaggacttggggaggaaggagatcttgatctgttctgaacttctaggaaggggaagagagaggaggagggagatggcggcgcaggagcaggagcaggacaagcagcaggcgaagacgagcacgacgagctcgctcccctccagcagcgagcgctcctccagctccgcacccaacaacctcagggaaggaggggtggagagcgacgaggagatacggcgggtgccggagatgggcggcgcgtcggcgtcggcctcgtcgggcgcgggcgcggacgagcgccccaaggaggacagcaagcaggggcagctggtggcggccacgggggcgcaggggcagccgccggcggcggggaagaagcgcgggcgcaccgccggggacaaggagcagaaccggctcaagcggctgctccggaaccgcgtctcggcgcagcaggcgcgggagcggaagaaggcgtacctgacggagctcgaggcgaaggctaaggacctcgagctccgcaatgccaagctcgagcagcgggtctccacgctccagaacgagaacaacacgctccgccagattttgaagaacacgacggcgcacgcgagcaagaggagcagcggcggcggtgccggcgccggcaagggcggcgacaagaagcaccacttcaccaagagctgatggcgccggttcatgctaggagctgtgaacttttctcgcttgatctgacccccactgttacgctaggacatttgctggcttcgttctcgttcctgttgctgatgacgttttccccttctcgtcctcccttcttttttttttctactgtgccccttactctcttggtcgtctgtttcactgatgtagctgtactatttttacctgcccgtccc

SEQ ID NO: 16839 - protein, 195 aa, Panicum virgatum
  misc_feature: Ceres CLONE 1790419
  misc_feature (102)..(165): Pfam Name: bZIP_1 Pfam Description: bZIP transcription factor
  misc_feature: The sequence is a functional homolog of SEQ ID NO 206 in the 10/225,066 US patent application
  misc_feature: The sequence is a functional homolog of SEQ ID NO 2356 in the 10/374,780 US patent application
  misc_feature: The sequence is a functional homolog of SEQ ID NO 827 in the 11/479,226 US patent application
  misc_feature: Useful for making plants with modulated light quality sensitivity
  misc_feature: Useful for making plants with altered alkaloid content
  misc_feature: Useful for making plants with altered terpenoid content
MAAQEQEQDKQQAKTSTTSSLPSSSERSSSSAPNNLREGGVESDEEIRRVPEMGGASASASSGAGADERPKEDSKQGQLVAATGAQGQPPAAGKKRGRTAGDKEQNRLKRLLRNRVSAQQARERKKAYLTELEAKAKDLELRNAKLEQRVSTLQNENNTLRQILKNTTAHASKRSSGGGAGAGKGGDKKHHFTKS

SEQ ID NO: 16840 - DNA, 607 bp, Panicum virgatum
  misc_feature: Ceres CLONE 1790420-R
  misc_feature: Encodes the peptide sequence at SEQ ID NO. 16841
acagatttcacattccagtggtagagtagttgcaaattgcaatctctgaaagtagaaagcctgaactcttggatggcgccaccacaatggttgcagaccagcgccctgctgctggacggcaacaccctcagctacttcggcaacagcatccccatcaacctggtggtggccgtgatcgccgaggtggtcctcgttggcggcgccgagtactaccggatcatcaacggcctggacctggaggacaagctgcaccccggcggcccgttcgaccccttgggcctggccagcgaccccgaccaggctgccatcctcaaggtgaaggagatcaagaacggccggctggccatgttctccatgctcgccttcttcatccaggcgtacgtcaccggcgaaggccccgtcgagaacctcgccaagcacctcagcgaccccttcggcaacaacctcctcaccgtcatctccggcgccgccgagagaacgcccagcctgtgagcaacgctgctgctgctgctgcgtttgattttaccgggaaacagagtgtgcgtgagggtctgaagaatgtgccatgcgtgtaaattatcaagatggggaagaaaccatttcgttc

SEQ ID NO: 16841 - protein, 139 aa, Panicum virgatum
  misc_feature: Ceres CLONE 1790420-R
  misc_feature (2)..(103): Pfam Name: Chloroa_b-bind Pfam Description: Chlorophyll A-B binding protein
MAPPQWLQTSALLLDGNTLSYFGNSIPINLVVAVIAEVVLVGGAEYYRIINGLDLEDKLHPGGPFDPLGLASDPDQAAILKVKEIKNGRLAMFSMLAFFIQAYVTGEGPVENLAKHLSDPFGNNLLTVISGAAERTPSL

SEQ ID NO: 16842 - DNA, 702 bp, Panicum virgatum
  misc_feature: Ceres CLONE 1790420
gccatcccctcctgctgcaaatcttcctctgaattgtgggtctgcggcaatggcggcgcttgctccatccaagatcctcggcacccagctcaacttcgctggctcctcccggtacgccaccactgcaccgaccgctggggcgcagaagattgtctccctcttcagcaagaagcctgcccagaagcccaagcccgccgcggtatcatcctcgccggacatcagcgatgagctcgccaagtggtacggtcctgacaggaggatcttcctgccggatggcctcttggaccgctcagaggtgccggagtacctcaccggagaggtcccaggagagtaagtcacataataataaactctaattttgcttgccataggattcatgtttgtttctgaaaatttggatttcagttggtagttttggctgaaatcaggttaagtactacttgttggtctgaaaaataggcagtgtatcatatactgggagaaaagaataaatttgtgaaaagaagtagtttggttgtcaaattcagattgttcatgccaaggcgcaactttgctgtttgtcaaattcgttctgaaagtagaacctgtctcaaacattcagaccagcatttataattttggctaattttctcacatttttaagcaactagcagtgttcatcaactattaaggctgtctgtaattctactttttgttcaattg

SEQ ID NO: 16843 - DNA, 1326 bp, Panicum virgatum
  misc_feature: Ceres CLONE 1790425
  misc_feature: Encodes the peptide sequence at SEQ ID NO. 16844
atgaactagaccagaaccatttataccgccgctgatggtgatggctgccgcgtccttcgtcacctaccttcagaggccccgggagctgccggtgccggagttccgggcgccgccgccgtccccggtcaccggcgtcctcgcgggcagcagctcggggtcgtccgggtacggggagtgccaggatgacgacgacgtcggcaggttcctgcgctgctccgccagggtccccgtgctgcggctgccggagaggcccggcccgcgggggaacaggaagaagcaggcggcgtgggcgccgcccgtcatcgacgtgcgcgtgctggactcgccgtcgccggtggctgaaggcgcgcagcaggcggtggaggcgctgaggtcggcggccgtcgcgtttggctgcttccaggtggtcggccacggggtcgacgcgggtttggtcctgggggcgttacgtgctgcgacggcgagggaaggatcgccagcgtcgggggagggtggcggaggagatgaggatatcgaggagctgtggtggccgcccggcgaaggagacggagaaatggcgggaaatcggccgctgcgaaatggtgccaagcaaatcaggaacacagcagatgacctgttcgctcagcttgagcaagcttcaaccatgctcctgcacgccttgcagcaaggcaacaaggaagccgccgacgccgcagaagcaacattggcgaaggctgacggaaacacctcgcttctctgcatccgcaagcaccgacacgacggcagcagcgcgtccggcccggtcagccaagatgacgtcctgcggatgctggttcggagctcgcgctgctcgcgcgccctcgccctccacctctgccccggcgcgtcggggttccacgtcttctcccggcgaggctggtcgaggttccggcctctggacggcgccgtcgtggtcaccgtcggggagcaactccaggcatggagctgtgggctctacaagagcgtgtctgggaaaccagcttacagcagcgacgatcgccaaggagacggcggggacggtgccgtgtcggcagagttcttcctctcctgcgcctcggtcagcgcagcaaaggactccctgaacttgggcgccggcggcaaggtcttcccgctgaatctgcagatcatcgtagcagcttgccttgtgctggtttaccatttcttcctctcatgctcctattggtgatgttcagttcagcagctgcggggcttgtttcccctgcctgaacatgcaagtaacagcaaaaacttgtttgccactgttcgtcagctgaaatgtcaggaaaaaagtactaaccaaatttggcc

SEQ ID NO: 16844 - protein, 389 aa, Panicum virgatum
  misc_feature: Ceres CLONE 1790425
  misc_feature (88)..(141): SWISSPROT Homolog: EC 1.14.11.19 Leucocyanidin oxygenase
  misc_feature (279)..(317): SWISSPROT Homolog: EC 1.14.11.13 Gibberellin 2-beta-dioxygenase
MVMAAASFVTYLQRPRELPVPEFRAPPPSPVTGVLAGSSSGSSGYGECQDDDDVGRFLRCSARVPVLRLPERPGPRGNRKKQAAWAPPVIDVRVLDSPSPVAEGAQQAVEALRSAAVAFGCFQVVGHGVDAGLVLGALRAATAREGSPASGEGGGGDEDIEELWWPPGEGDGEMAGNRPLRNGAKQIRNTADDLFAQLEQASTMLLHALQQGNKEAADAAEATLAKADGNTSLLCIRKHRHDGSSASGPVSQDDVLRMLVRSSRCSRALALHLCPGASGFHVFSRRGWSRFRPLDGAVVVTVGEQLQAWSCGLYKSVSGKPAYSSDDRQGDGGDGAVSAEFFLSCASVSAAKDSLNLGAGGKVFPLNLQIIVAACLVLVYHFFLSCSYW

SEQ ID NO: 16845 - DNA, 1800 bp, Panicum virgatum
  misc_feature: Ceres CLONE 1790426
  misc_feature: Encodes the peptide sequence at SEQ ID NO. 16846
aagcctcaccgcgagcagcgtcctcgtctccttcgccttcgggcagcgcggcaatgcggacgttccacgccgcgtccgcctccttcctcgcgccgcccgctccccacctcctccttcccccagtcgcaccggccctaagagggggtctatcggcaaaggttcctgtccctgcggcggtcgccagccggtcgcgctcctgcttcccgccgtcgcgccgcgcgagccggcgccggcgatgctccagggctgcttcgtccggcgctgctgcgacagtcacctcggcggatgatgccaagaaggatgtgctcatagcactctcccaaatcattgatcctgatttcggcacggacatcgtctcatgtgggtttgtcaaggacttagagatcagcgatgcattggataaggtctcatttcgcctggagctgacaactcccgcatgtccaatcaaagacgagtttgaacaaaaggcaaacgaggttgttgcagcacttccatgggtcaagaaggtagaagtcacaatgtctgcgcagactgcacagccggtatatggaggtgagctcccggaaggactgcagaagatctcaaacatcatagcagtatcaagctgcaagggaggagttggaaaatcaactgttgctgtaaatctagcttatacactagctggaatgggagctagggttggaatctttgatgctgatgtcttcggtccaagcttaccaactatggtttctcctgaaaaccggttgctagtgatgaacccagaaagcagagctattcttccgactgagtatttgggcgtcaaaatggtgtcttttggatttgctggacaaggaagagcaatcatgcgaggtccaatggtttcaggagtcattaatcagttgctgaccactactgactggggcgagcttgactaccttgtcattgacatgcctcctggaacaggcgacatacacttaacactctgtcaggtagccccattgactgcagctgtgattgttaccacgcctcagaagctggctttcattgatgtcgcaaagggagtaaggatgttctccaagctgaaggttccttgtgttgcagttgttgagaacatgtgctactttgatgctgatgggaagcgttattacccattcggacaaggttctggaactcaggttgtgcagcaatttggaatacctcatctcttcgatttgccaatacggccaactctttcagcttctggagatactggaattcctgaagtagtggctgatccacaaggagatgttaccaagacatttcaaaatcttggagtttgtgttgttcaacaatgtgccaaaattaggcaacaagtttcaacagcagtgtcctatgatagatcaattagagcgatcagagtgaaagtgccagattcagatgaagagttcttgttgcatccggcaacagtcaggcggaatgatcgatctgctcaaagtgtggatgaatggacaggagagcagaaaattcagtacagcgatgtaccagacgacatcgagcctgaagagattagaccgatgggaaactacgctgtttctattacttggcctgatggattcagtcagatagcaccttatgaccaattggaaatgcttgagcggttagtggatgctccgcgtgcagcaacacctgcagtggcctcatcatgatacaggggaaaactgtgttcggttatcaagggacaagaaaacaggctttccttgcaattagataatttataggtctacaatgaattttgaatgatttctcaagttgttgaaccaacataattaaaattatttattg

SEQ ID NO: 16846 - protein, 536 aa, Panicum virgatum
  misc_feature: Ceres CLONE 1790426
  misc_feature (180)..(388): Pfam Name: CbiA Pfam Description: CobQ/CobB/MinD/ParA nucleotide binding domain
MRTFHAASASFLAPPAPHLLLPPVAPALRGGLSAKVPVPAAVASRSRSCFPPSRRASRRRRCSRAASSGAAATVTSADDAKKDVLIALSQIIDPDFGTDIVSCGFVKDLEISDALDKVSFRLELTTPACPIKDEFEQKANEVVAALPWVKKVEVTMSAQTAQPVYGGELPEGLQKISNIIAVSSCKGGVGKSTVAVNLAYTLAGMGARVGIFDADVFGPSLPTMVSPENRLLVMNPESRAILPTEYLGVKMVSFGFAGQGRAIMRGPMVSGVINQLLTTTDWGELDYLVIDMPPGTGDIHLTLCQVAPLTAAVIVTTPQKLAFIDVAKGVRMFSKLKVPCVAVVENMCYFDADGKRYYPFGQGSGTQVVQQFGIPHLFDLPIRPTLSASGDTGIPEVVADPQGDVTKTFQNLGVCVVQQCAKIRQQVSTAVSYDRSIRAIRVKVPDSDEEFLLHPATVRRNDRSAQSVDEWTGEQKIQYSDVPDDIEPEEIRPMGNYAVSITWPDGFSQIAPYDQLEMLERLVDAPRAATPAVASS

SEQ ID NO: 16847 - DNA, 1902 bp, Panicum virgatum
  misc_feature: Ceres CLONE 1790427
  misc_feature: Encodes the peptide sequence at SEQ ID NO. 16848
ttattccgtattgacatgtagatagttcacctagtcgagttcattgtgcatacatttattcatcgtcatacatcgatcctattgttcacaatgtggatacacaataatataatttttgttttgttcgtaattttattcagctggaaatgaacaattgctgctatcgggtggcaacttcgcgcacccagatttggtatcgcacgattattccacaggcagtgagaattttccaaatgctacaaaaggtacgcacttcaatatggaccaaatagcatttccggtgcagctccgatgggatgtgcctaatgtggagtcgaccaagcattggagccttcttgatcagctcatgccactgtatagttgtgcacaaaaatataccaattatgattcacctactatgggcatcatgccagagctctatgtctcactggctatcataccaaagcaagtcacgcagagccgtcggaaaagaggtgttctcatcgagctacttgaactggaggactcagatgagaaacgaccaagaaagaggaagtcgcacaccaaatatcgattgcgatttgtgaataaggtgaatgaggcctattacacaatgaacccaataaaagcagatgacgggagccatctgaaagttgctttgttcgatgagaacgacatgaagatcacatttggccccctgtcttcagcttctgttgaggtcgtcgctcttcacggtgacttcaacgtcaatggtcaggattactggacttcagaggagttcagtcattgtgtagtgtatccatggcatagaaaagaagcatcagtcctaggaggtgaccgcatcttagttcttgctgagggagaggcatgtctcggtaacgcctttttccaggtaacatcctttctagctagaactgggaagttcaagatgggcgtaatgttggccagcgtccaagaagagagaattcaagaagggatatcggaaccgttattggtgaaggattgtcagttggaaggtctgcctccagcgttccggttccacccgacggacgaggagctgatcttgcactacctgtgcaaccgcgctaccatccccgaggtggacatctacaacatggagccttgggacctgcctgccagggcaaagtttggcgactgcgagtggtacctttcctgctttccaaaaaaagagtggcacattttctgccaccgcaagtaccccatcagctctggctactggatggctaccggcaaagccagaaggctcaccctctccggtgctgccggcaagatgctcggctccaagaggaggctcgtcttccacctacccagtggcaagatgacaggatgggtaatgcacgagtatcacctccctgacaacaccaccctcaggtccatcatcagtagtaccacggcctcatcgtccacctccagtaccagggacgaatgggtgctgtgcagaatcttcaaaaagacagacctgctgcagccttcgccgttcctggacgacgatgcccctgtatcgccgctgcgagattgccgtctccaagcattcctttctgtttagaataaaaagaggagtctccggcctatgcgacttgaagcgcctcagttcccacaaagaggagatagagaagacccaagaaaatcctggacaccacctcacgatccaacctaccacacaaaactcgtttaaacccaacctattagcaagccgatgtggtagtaccttgtttcctgcaagtttaaatctccattctatgggttacaaaatgaaccaagaaatgaataggttgaaagtcatgtaataatattcttagttatatatgttaacaaaacaatatcaaatgtatatatagtacactagccctaactaatgatagagatgtcgagggtgtcctgatagttggtacacttcttccc

SEQ ID NO: 16848 - protein, 428 aa, Panicum virgatum
  misc_feature: Ceres CLONE 1790427
  misc_feature (247)..(365): Pfam Name: NAM Pfam Description: No apical meristem (NAM) protein
MDQIAFPVQLRWDVPNVESTKHWSLLDQLMPLYSCAQKYTNYDSPTMGIMPELYVSLAIIPKQVTQSRRKRGVLIELLELEDSDEKRPRKRKSHTKYRLRFVNKVNEAYYTMNPIKADDGSHLKVALFDENDMKITFGPLSSASVEVVALHGDFNVNGQDYWTSEEFSHCVVYPWHRKEASVLGGDRILVLAEGEACLGNAFFQVTSFLARTGKFKMGVMLASVQEERIQEGISEPLLVKDCQLEGLPPAFRFHPTDEELILHYLCNRATIPEVDIYNMEPWDLPARAKFGDCEWYLSCFPKKEWHIFCHRKYPISSGYWMATGKARRLTLSGAAGKMLGSKRRLVFHLPSGKMTGWVMHEYHLPDNTTLRSIISSTTASSSTSSTRDEWVLCRIFKKTDLLQPSPFLDDDAPVSPLRDCRLQAFLSV

SEQ ID NO: 16849 - DNA, 1508 bp, Panicum virgatum
  misc_feature: Ceres CLONE 1790428
  misc_feature: Encodes the peptide sequence at SEQ ID NO. 16850
agcgcagcaggcagggggcgccagcgccccccctccccgcgtagcgccgtttaaccgcattctccgacccaaccctccccgcgaagcaaaaactcatgcgatctgacaagaatctcccccaatttccagctcgattccccatcgccgcccacccctgaaccgaccgaccgtgtgcttcctctccctgcccctccccctcccaccgcgtgctcctcccccctccccctccccctcccacccaccgaggcggagggcgagggcgagatccagatccggggccccagatccaccgccgccggccgccatgaaccccacgcggcccgcgcaggcgtcgttccgcgaccgcaccaacgagttccacgccgccgtcgagagcgcgcgccgccacgccgtcccttcctcctccgcgccgagcagcagcggcgccgggcccctcgacgggtcgatcgcggccacgtcggcccgctcggagttcaacaaccgcgcgtccaagatcgggctcgggatccaccagacctcccagaagctagcccgcctcgccaaattggcaaagaggacatcagtttttgatgaccctaccgtggagattcaagagatgactgcagttatcaagaaggatatcactgctttgaatactgctgttgtagacctacaagctctctgcaattcacaaaatgagagtgggaatctatccaaggacacaacgaatcattccactacagttgtagacaacctaaaaaaccgtctgatgagtgcgacaaaagaatttaaagaagttcttaccatgcgaacagagaatttgaaggttcatgaaaatagaaggcagatgttctcctcgtcagctggaaaggatgcgtcaaatccattcattcgtcaacgtccgcttgttgctagggaccaatctgagtcctctgtgcccccagcaccatgggccagcgactctgcatctaccccattgttccagaggaagaagactaatggagatcatggagcatcatcatcatcccagcctttcatgcagcagcagcaactagcagtacagcaggacagttacatgcagagcagagctgaagctctacaaaatgtggaatcaaccatccatgagctgagcaatatatttacacagttggcaaccatggtttctcaacagggagagctagcaatcagaattgatgagaacatggatgacacgttggctaacgttgagggagcacagggccagctcctcaagtacctcaacagcatctcatcgaacaggtggctgatgatgaagatattctttgtactaatggtgttcctcatgatcttcatattcttcgtcgcttgattccttctgtaccatctctctgctcatgctatgcgtagattgctgctatgcgaagtattctttaatttttgctcatactactatatcatgtacacattttcaccccggatgataagcaaccgttcacccttctgtggtcatgtaaattgggacaagctcctgcactgatctgttgctcttg

SEQ ID NO: 16850 - protein, 340 aa, Panicum virgatum
  misc_feature: Ceres CLONE 1790428
  misc_feature (53)..(159): Pfam Name: Syntaxin Pfam Description: Syntaxin
  misc_feature (253)..(315): Pfam Name: SNARE Pfam Description: SNARE domain
MNPTRPAQASFRDRTNEFHAAVESARRHAVPSSSAPSSSGAGPLDGSIAATSARSEFNNRASKIGLGIHQTSQKLARLAKLAKRTSVFDDPTVEIQEMTAVIKKDITALNTAVVDLQALCNSQNESGNLSKDTTNHSTTVVDNLKNRLMSATKEFKEVLTMRTENLKVHENRRQMFSSSAGKDASNPFIRQRPLVARDQSESSVPPAPWASDSASTPLFQRKKTNGDHGASSSSQPFMQQQQLAVQQDSYMQSRAEALQNVESTIHELSNIFTQLATMVSQQGELAIRIDENMDDTLANVEGAQGQLLKYLNSISSNRWLMMKIFFVLMVFLMIFIFFVA

SEQ ID NO: 16851 - DNA, 722 bp, Panicum virgatum
  misc_feature: Ceres CLONE 1790432
  misc_feature: Encodes the peptide sequence at SEQ ID NO. 16852
ctcggcccccgtgtcccctttccgtcctcgttcctctcccgtcgccggtgcgcccgcgccctgtctccctcccgcggcgagcgatcgggaggggatcgggatggcctcccaccattccgagcccctcggccccgtccccgccgccgacgcccccgcagataacaacccagaattgccatctccaccctatcatattgtcaccaaacctggccaactcccagtcgagtttcttgaaccctcagctacccagaagttggtaatcggatttgactgtgaaggtgttgatctctgtcgtaatggtgctctctgtatcatgcagcttgcatttcctgatgctatttacttagttgatgctattgagggtggaaaagaactcattcaagcttgtaagcccgcacttgagtctgatcatatcaccaaagttattcatgattgtaaaagagacagtgaggctttgtattttcagtttggcatcaaattgcataatgtgatggatacacagatcgcttattctctgatagaagagcaggaaggaaataagagaacacacgatgattacatatcttttgtcagccttcttgctgattcacggtactgtggcataccatatcctgaaaaggaagaagtccgtacccttctaaggcaggaccctaacttttggacaattaggcccttgtctgatatgatggttcgagcagccacagatgatgtccgcttccttc

SEQ ID NO: 16852 - protein, 207 aa, Panicum virgatum
  misc_feature: Ceres CLONE 1790432
  misc_feature (30)..(207): Pfam Name: 3_5_exonuc Pfam Description: 3'-5' exonuclease
MASHHSEPLGPVPAADAPADNNPELPSPPYHIVTKPGQLPVEFLEPSATQKLVIGFDCEGVDLCRNGALCIMQLAFPDAIYLVDAIEGGKELIQACKPALESDHITKVIHDCKRDSEALYFQFGIKLHNVMDTQIAYSLIEEQEGNKRTHDDYISFVSLLADSRYCGIPYPEKEEVRTLLRQDPNFWTIRPLSDMMVRAATDDVRFL

SEQ ID NO: 16853 - DNA, 1875 bp, Panicum virgatum
  misc_feature: Ceres CLONE 1790440
  misc_feature: Encodes the peptide sequence at SEQ ID NO. 16854
gtttttgcccctaccgcgcagtgctaggccgccgcttttgcccacgcccactgccctcacgcgacgcgacgcgagccagctagctgctctgttcaggcgccacgccgccatggcaaccgtggggtgccgtcgcggccgcgcactgcgcgcggtcctcctgctgctcgccacgctgccggcggcgaccctcgcgccggccgtcggcggctcggcggcgttcctggaggacggcatgacgatcctcggcgcggcggggtcggcggcgaaggtgggcggcaaggcgcagggcggcgcgaacgcgagcgggacgcggccgggcgggggcggcaggtactacctggggtggaaggaggagatcgcggcgctggcggggcggcccgagctggcggcgtggctgcggcgggtgcggcgccggatccacgagcgccccgagctggcgtacgaggaggtggagaccagccgcctggtccgcgacgagctggccgccatgggcgtcggcttccgccacccgctcgcgcgcacgggcgtcgtcgccacgctcggcaccgggcgcccgcccgtcgtcgcgctccgggccgacatggacgcgctgcccatccaggaggccgtggagtgggagcacaagagcaggaaccccgggaagatgcacgcgtgcgggcacgacgcgcatgtggccatgctcctcggcgccgccaggatcctcaaggcccgcgagcaccacctcaagggcacagtgaagcttctgttccagccggccgaggagtccgggtgcggcgcgaagcggatgatccaggacggcgcgctggagggcgtggaggccatcttcgccgtgcacgtctcgcaccagcacccgacgtccgtgatcgggtcccggacgggggccctcctcgccggctgcggcttcttcaaggccgtgatccgcggcgacgatcacggccgggagcggcggcggcggcgatccgccgcggaccccgtcctggccgcgtcgtcgaccatcatcagcctgcagagcctcgtctcccgcgaggcggaccccctcgactcgcatgtggtgtcggtggccgtggtgaacgggagcgacgccggcggcggcgcggcggcggcgccgctggtgctgggcggcacgttccgcgccttctcgaacgcgagcttctaccagctgcggcggcggatcgaggaggtgatcgcggcgcagtcgcgggtgcacgggtgcgcggcggcggtggacttcttcgaggacgagagcttctacccgccgacggtgaacgacgcgcgcatgtacgggcacgtgcggcgcgtggcgtcggagctcctgggcgcgggcggctaccgcgacgtgccggcaatgatgggcgccgaggacttctccttctactcgcaggcggtgccggcggggttctactacatcagggtgcggaacgagacgctggggtccgtgcacacgggccactcgccctacttcatgatcgacgaggacgtgctccccaccggcgccgccgtgcacgccgccatcgccgagcggttcctcgccgaccacgcctccctgacgggctccccgtcccccgacgacctggtcgaccaggagctgtgaccgacccggcacggacgagagcccggctagttgatcgatcgatcgaccggcgccggcacgggcacgttggagacctggccgatcgctcgggcgtcttgggtggtggtttcctttgcggcgtggtgttggaacgcgggctcggattggtttggttttttgtggccgtcgggctcgtgatcgatcggctggtccgcggccgtgacgcgccggtgggttgggggcttttcccgtgttccgtttgcctgagccaaggagccgtgagggacgggcgctttggcgcgtgc

SEQ ID NO: 16854 - protein, 493 aa, Panicum virgatum
  misc_feature: Ceres CLONE 1790440
  misc_feature (153)..(471): Pfam Name: Peptidase_M20 Pfam Description: Peptidase family M20/M25/M40
  misc_feature: SWISSPROT Homolog: EC 3.5.1.32 Hippurate hydrolase
  misc_feature: Useful for making plants with modulated nitrogen use efficiency
MATVGCRRGRALRAVLLLLATLPAATLAPAVGGSAAFLEDGMTILGAAGSAAKVGGKAQGGANASGTRPGGGGRYYLGWKEEIAALAGRPELAAWLRRVRRRIHERPELAYEEVETSRLVRDELAAMGVGFRHPLARTGVVATLGTGRPPVVALRADMDALPIQEAVEWEHKSRNPGKMHACGHDAHVAMLLGAARILKAREHHLKGTVKLLFQPAEESGCGAKRMIQDGALEGVEAIFAVHVSHQHPTSVIGSRTGALLAGCGFFKAVIRGDDHGRERRRRRSAADPVLAASSTIISLQSLVSREADPLDSHVVSVAVVNGSDAGGGAAAAPLVLGGTFRAFSNASFYQLRRRIEEVIAAQSRVHGCAAAVDFFEDESFYPPTVNDARMYGHVRRVASELLGAGGYRDVPAMMGAEDFSFYSQAVPAGFYYIRVRNETLGSVHTGHSPYFMIDEDVLPTGAAVHAAIAERFLADHASLTGSPSPDDLVDQEL

SEQ ID NO: 16855 - DNA, 674 bp, Panicum virgatum
  misc_feature: Ceres CLONE 1790443-R
  misc_feature: Encodes the peptide sequence at SEQ ID NO. 16856
acttggtctgcttggagctggtacattttttgtcattcgtcaggttctcgttcgcagagagcttgatctttctgccaaagagctgcaagaacaagtgagaagtggtgatgcaagtgctacagagtattttgagcttggagcagttatgctacggagaaaattttatccagctgctatcaaatatctgcagcaagcaattgaaaaatgggacagagatgagcaagatcttgcgcaggtgtacaatgccctgggggtcagttacaagcgagataacaaactggacaaggcaatccagcagtttgagaaggccgtggagctccaaccaggctatgtgacggcttggaacaacctaggcgacgcatatgagcagaagaaagacctgaagtcggccctcaaggcttttgaggaggtcctcctctttgatcccaacaacaaggttgcaaggccacgcgtggacgacctccggcagcgcgccagcatgtacaagggcgtgcctgtaaagtctgaaaagcgatagctgtattcccttttgggggtaaaattgtgcattactgcatttgtcctgtccccatggcggagtagcagttgttcaatttttgaacggtagcatttgtaaacatgacgactcggctcggaatggtgcctgaagaaaggcagatgtaatatgcatgctt

SEQ ID NO: 16856 - protein, 171 aa, Panicum virgatum
  misc_feature: Ceres CLONE 1790443-R
  misc_feature (77)..(110): Pfam Name: TPR_1 Pfam Description: Tetratricopeptide repeat
  misc_feature (111)..(144): Pfam Name: TPR_1 Pfam Description: Tetratricopeptide repeat
LGLLGAGTFFVIRQVLVRRELDLSAKELQEQVRSGDASATEYFELGAVMLRRKFYPAAIKYLQQAIEKWDRDEQDLAQVYNALGVSYKRDNKLDKAIQQFEKAVELQPGYVTAWNNLGDAYEQKKDLKSALKAFEEVLLFDPNNKVARPRVDDLRQRASMYKGVPVKSEKR

SEQ ID NO: 16857 - DNA, 1562 bp, Panicum virgatum
  misc_feature: Ceres CLONE 1790443
cacaaaagatgccagaagcttgccgccatttcaaccagccagctgaaattctatgcctaacatcttcatcaatgtcgccatccttttgtagcaccgatcctaaataccgaaaagtatccttctagaccaccacttgcccatctagactaacgtctcccccctcatgcctagtcgcgctgaaatcgcacatcatgtactcggtcttggtcctactaaggctgaaatttccgaccatcgaaaatttaaataatatagctggaggctagagccttgcattagttagtgagctactatgttgcacaagctaaaatatgtataatactcactttattttttttgatagttctattttatcttggtacaataatcaaggagaagaatctagcttattatctcattaatcacgacttcttgttttcgatattattatataggtacactaatattttttcaagagaagttactaagatgtccactccaatggaatgaataattcaatttagaaatatgactattgaaagataatagagggaataaagctaaatgtccagatatgcttctctttccatttatttatcgaattaaatgcctcttttagatcaatctcagtacatagcttcattacacactatcatgaagacggtaaacttaataactgaaccggatgagtgttatgggcataaaacttctctcaccttccatgaaactctccattctctcttcttgtaatgatcctgacatattaccaaatttgctgatgtgaaataaaatttaatgcccataaattttttattgagaatagcattaatcgcgcgtcttcttacctatcatcaatactgctaccgtgaagccattctgatatggtcttcataagagttaaatatcttgggctcagatcaacatcggctcgggatcctctagctttaggtggcaggctcgctggagctcggctcattgacagccctcacgctcagggctcagccgctcaagggttcatctcctccctctgtttcccttcctccttcctccctgtgctgtcgagccgctctattcgtattcgactcgagctcggaccttggtgagcttatggctcggcgcgatctcaggctctcatcgacgtcggctcacgatgctatcgaactccagctttgaggtggcaggctcgctcgagctcggcttactgaccttcctcggttcctcctcagggctccggctcagagctcatctctttcgccctctccagttccccttgtctcgactctatcctcccttgctcttccttccctggtggcgatgactgggcgagcggcggcgccatttgtcctgtcttcgcccagccctttgctggcgacgagcgcatcctccagaattatcgggtgtacatgtgtacacccacgtcctatgctgggtccgcccctgccaaccagaggagtcattttaacttcaaaaaatgtagatgaagctttctgtcacccttcagacaaggataatagaagcaggaatttgcttctgcaattcggtgcacttccatgttgcactacaggtttggtttactactgcac

SEQ ID NO: 16858 - DNA, 1239 bp, Panicum virgatum
  misc_feature: Ceres CLONE 1790444
  misc_feature: Encodes the peptide sequence at SEQ ID NO. 16859
gacagcctatccccacaaccctaagtacgctctgctcctccaccacctccgccgccggctgcggtctgttccggcgcggcggacggctgtaggagcaagccggaggggtcggcgatgagcttcgcggatctggaggcgggggcgctcagggcgcccgtagggaggaaggcgagagggggccccaacgacgcgcgcgggctcgtcttccagatcaccaccgccgtggcctcctaccgccgcctcctcaactcgctcggcacgcccaaggacaccccgacccttcgtgatcaactgcacaagaccagtcagaacattcttcaattggcaaaggatgcgaaagataagctccaaaaggctgctgaagcagacaagagcattgatactagtgcagacaagagggtagctgatatgaagcttgctaaagattttggtgccacaatggaggagttcaggaagcttcaaaatcttgcaattcagagggagatagcatataagccagttgttccgcagaatgctcagtcaaactatacgacagatgacagaagcgctgaatctggtaatatgcctgagcagcgtgcactacttgttgaatcaaaaaggcaagaggtgttgcaattggataatgagattgttttcaatgaagctctcatcgaggaaagagaacaagccattcaagagatccaacaacagatcggtgaagtacatgaagtgttcaaggatcttgctacactcgtacatgcccaaggagttataattgaggaaatcgacatgaacattgaaaattctgccgaggcaaccaaagaggcaaagagagaagtcgcgaaagcagacaaaactcagaaatcaaattcctccctgctttgcttgcttatggtcatctttggggtcgtgctgcttgttgtgataatagttctggcatcttgagacaggcaatctttcatcttaccaagctattctgtggagttcagtattgaaggctgcatctctgaaaatgttcttgtctaaccagcatcatgttttgtgcaaaaaaatatagccagtggattttagaaatctcttttacgtttcatgttttgtgagtgcacgtttctttgtcatgcgtgagtccttttttaatggcttgccttgagtgaacagtgatgctcttttgtttcctcgggtttcggaagttcgcttgggtgtgattctgcaactctgtaagtatcggcgtcgaataaagagagatgataccgtgatact

SEQ ID NO: 16859 - protein, 269 aa, Panicum virgatum
  misc_feature: Ceres CLONE 1790444
  misc_feature (181)..(243): Pfam Name: SNARE Pfam Description: SNARE domain
MSFADLEAGALRAPVGRKARGGPNDARGLVFQITTAVASYRRLLNSLGTPKDTPTLRDQLHKTSQNILQLAKDAKDKLQKAAEADKSIDTSADKRVADMKLAKDFGATMEEFRKLQNLAIQREIAYKPVVPQNAQSNYTTDDRSAESGNMPEQRALLVESKRQEVLQLDNEIVFNEALIEEREQAIQEIQQQIGEVHEVFKDLATLVHAQGVIIEEIDMNIENSAEATKEAKREVAKADKTQKSNSSLLCLLMVIFGVVLLVVIIVLAS

SEQ ID NO: 16860 - DNA, 2714 bp, Panicum virgatum
  misc_feature: Ceres CLONE 1790449
  misc_feature: Encodes the peptide sequence at SEQ ID NO. 16861
tttcccctctcgttcgctcgcgtcgcgcccccaacccccgactcccagcggcgcacggcctgcgagctcggcgccgaaacctccacctctgcgagctcgaatcagcacgccgacgccgacgacccgcgctgcccaggatcagggcgattttggcgtgcagggtgtgtggttggcttctgagttctgagatcatgtaacctcggtggatatgaatatagattcctggaaaagtggtttgccactccttggtgctgcagagggtttctcgtgccctttgtcgttagctccacacctccattgagttagagcaatttttggttgtatttccaacttgtgcaaggatgtttgacagtgctcaaaaagctcaatacatggatgggcacagagagaggtttattaggctggaggagtcaagtcctaggtcatctgtaccttctgaagtgggaggcaggagtaccttgaggttcagcatgcctgggtttggttatggttcatttaatgcactgagatctttcttgtcaggggttcgaaagggttctggacgactgaagtcacttagacagtcacttacgtctggagctcctaaaacagctttcgcggaagatcttaaatcatataagataaatatatttgatccccaggacaaacttcttttccaaatgaactgggttttcttcgtgtcttgcctatttgctgttgcagtggatccactgttcttctttctacccatcatcaacaattcaaactgcattggcatagataaaaaattggcagtgacatcaacaataatacggatgattattgattgtgtctaccttatacgtgtgtgtcttcaattccgcactgcttatgttgccccatcttctcgtgtgtttgcaactggtgagcttgtgattgatccaatgctaattgcaaagcggtactttaaaagttactttgcaatggactttgttgcattgctaccacttccacagattgttgtttggaggtatctccacattccagatggcccagatgtacggacaacaaaaactacactggtctgggttgtcctggtgcagtacattccaaggttgcttcgaatattccctgtgatcaaagatttgaaaagaacagctggtgtttttattgaaactgcttgggctggtgctgcttattatcttctatggtttatgctggctggtcataatgtaggtactttgtggtactttttaaccatacaacgtgaagatagctgctggcataagaattgtgatcccaatggtggatgcaatagcagctacttgtattgcaataatactcgggatgataactacgataaatggcttaatagtacccaagtattcgacctgtgcaatggtaaacaacctgatcttttcaactttggcatttaccagcaagcactggtctctggaatacttggtccaggaaattttgtcaaaaaattgtgttattgcttctggtggggattgcaaaatctaagcacccttggtcaagggctttcaacaagcatataccctggagaagtgctattctcaatttttatatgtgtgctcggactaatcctcttcgctcttctcattggtaacatgcagtcttatctccaatcagttgctatacgtcttgaagaaatgagagttaagaaacgtgatgctgagcagtggatgcaccaccgttcactgccaccggaaatcagacaaagagtgaggcgttatgaacgatataggtggttggagacgagaggagtagatgaagaaagtttggttcaaacacttccgaaagatcttaggagggatatcaaacgacatctctgtttgggtctcgttaaaagggtacctttgtttgagaacatggatgaacgattgttggatgcaatatgcgagcgactaagacctgcactctacactgaaaatgaattcatcctgagagaaggtgatccggtggatgagatgcattttattctgcatggttgtttggagagcgtaaccactgatggtggacgaagtggattctttaacaaagtccagctaaaggaaggttctttctgtggtgatgagttactcacctgggcattggaccccaagtcgggtgctaatttcccagcttctagtagaactgtcaaggcactcaccgaggttgaggcatttgccttgtgcgctgaggagctgaaattcgtggccagtcagttcaggaggctgcacagcaggcaggttcagcacacgttcagattctattcccagcgatggaggacttgggctgcctgcttcattcaagcggcatggcgccgctactacaagaggaagatggcggagcagcgtcgcaaggaagaagaggcagcaagcaggccaagtagtagccaccctagccttggggcgaccatctacgcatctcgttttgcggccaacgccttgagaggggttcacagactaagaagcaaggctgtccccgcaatcgtcaggctgccaaagcccccagaaccagattttggtgtcgatgacgctgactaacgaatcaatcgcactgaactcgcttgtaattgtactctacagtgtcggtagattgtgtacaaaattcaaagacagctgcagaagatcatgtttgtaaaagcttgttgccacgcagagaccataacggaggtcatgttcttgatgtctataggaatgcaaatgtataactacagtttttgcctgattatgggtccaagtttggcagcc

SEQ ID NO: 16861 - protein, 721 aa, Panicum virgatum
  misc_feature: Ceres CLONE 1790449
  misc_feature (150)..(417): Pfam Name: Ion_trans Pfam Description: Ion transport protein
  misc_feature (518)..(618): Pfam Name: cNMP_binding Pfam Description: Cyclic nucleotide-binding domain
MFDSAQKAQYMDGHRERFIRLEESSPRSSVPSEVGGRSTLRFSMPGFGYGSFNALRSFLSGVRKGSGRLKSLRQSLTSGAPKTAFAEDLKSYKINIFDPQDKLLFQMNWVFFVSCLFAVAVDPLFFFLPIINNSNCIGIDKKLAVTSTIIRMIIDCVYLIRVCLQFRTAYVAPSSRVFATGELVIDPMLIAKRYFKSYFAMDFVALLPLPQIVVWRYLHIPDGPDVRTTKTTLVWVVLVQYIPRLLRIFPVIKDLKRTAGVFIETAWAGAAYYLLWFMLAGHNVGTLWYFLTIQREDSCWHKNCDPNGGCNSSYLYCNNTRDDNYDKWLNSTQVFDLCNGKQPDLFNFGIYQQALVSGILGPGNFVKKLCYCFWWGLQNLSTLGQGLSTSIYPGEVLFSIFICVLGLILFALLIGNMQSYLQSVAIRLEEMRVKKRDAEQWMHHRSLPPEIRQRVRRYERYRWLETRGVDEESLVQTLPKDLRRDIKRHLCLGLVKRVPLFENMDERLLDAICERLRPALYTENEFILREGDPVDEMHFILHGCLESVTTDGGRSGFFNKVQLKEGSFCGDELLTWALDPKSGANFPASSRTVKALTEVEAFALCAEELKFVASQFRRLHSRQVQHTFRFYSQRWRTWAACFIQAAWRRYYKRKMAEQRRKEEEAASRPSSSHPSLGATIYASRFAANALRGVHRLRSKAVPAIVRLPKPPEPDFGVDDAD

SEQ ID NO: 16862 - DNA, 2004 bp, Panicum virgatum
  misc_feature: Ceres CLONE 1790452
  misc_feature: Encodes the peptide sequence at SEQ ID NO. 16863
cactgttccctcccccttccgcatcccaaaccctaacccccaaatccccgccctcctcccatggccgccgccgccgccgacgccgccgaggtggagcggctctacgagctcggcgagcgcctctcctccgccaaggacaagtccgagcacgccgcggactacgaggcgatcatcgcggcggtgaaggggcagagcgtcaaggcgaagcagctcgcggcacagctcatccccaggttcttccggagcttccccgcactcgccacgcgcgccatgtcggcaatgttcgacctcgtcgagatggaggagctcgcgatcagaatacaagctattcgggggtttccacttctaggcaaagatactgaatttgtgtcaaaaattgctgatattctaggacaactccttactagtgaagaaaatgtggagcgtgatgcagttcataaagccctcatgtcccttacacgacaagatgttaaaaattccttgcaacctttatttaagcatgtggagtcgggatcagagatccgtgagaagattatttgttttctaagagacaaggtctttcctcttaaagcagagctactaaaaccccaggcagaaatggagagatttataactgatttaataaagaaaagtgtacaagatgtaactggatcagaatttgaattattcatgggtttcctgcgaagcttgagcatatttggggattctgctcctagagagtcctttcaagaactaatcgaaattattcaagcacaagctgatctcgattcacaattcaatgtttctgacattgaccacattgagaggtggatttcatgcatgtatatggctcttccaatcttcatgagaggtgcatcgagcaccaaattcctcaattacttcgttaagcaaattgttccagcttttgataagatccctgaagaaaagaaactggatttgctcaagactattgctgcaagttcaccatatactgcagcacaagattcacgtcagctgcttccatctgtcgttcaattgctcaagaagtacatgcctgggaagaaggtggaatatatcaaccacaattatgttgagtgcttgctttacacttttcaccatttggctcacaagactccaaacactacaaacagtctctgtggttacaagattgttacggggcaaccatcagataggcttggagaggatttttcagagcactacaaaaatttcacagagaggttaactggaacagaagagacagtacgagcagcctcaaagagactaactcagggaatggcagacttcaacaaggcaatatcatcagcaaaaaccgaaggggaaaaaactaaaattaaaagcgatcaacagactgcaacaaggacaatgcgctcatataacaatatattggcaatgacacagccattgcatatgaaatctccttcatttatgggcgataagaaaatcactctgtcttggatggagcagcccaagaaaccagcagctacgatagcaggagtgaagaggtcccaacctgctacaaatgggaatggcccagcaagcaagaaggggcgaggaggaatgcagaatcagcttgtgaacagagcatttgaaggattgtcttatggtggtcgaggcagtggaagagggtggggcaggggaggccgaggaagaggaagaggatggggtggctaccgctgagatcatttaggaagttattcaacctgacatagaaggatgagctttctgcttccacttgagggtaagcgcagagatcggtgtttatttgtcgtgtgcttcactggtgctggctcttctgtatgcaacgatcttctaggcatgtaactgcagaatgcgtacagaaagtgtaaaagaagatgcctgagaatgtgaacaaaatatgtgcagcgttgctgttcatttaccattcatcggtggccactgtggccgccctccctccccccctttttttggctgttttaagaactgaacaattagaaattgttgttagattatttatttaatttt

SEQ ID NO: 16863 - protein, 538 aa, Panicum virgatum
  misc_feature: Ceres CLONE 1790452
  misc_feature (10)..(538): Pfam Name: API5 Pfam Description: Apoptosis inhibitory protein 5 (API5)
MAAAAADAAEVERLYELGERLSSAKDKSEHAADYEAIIAAVKGQSVKAKQLAAQLIPRFFRSFPALATRAMSAMFDLVEMEELAIRIQAIRGFPLLGKDTEFVSKIADILGQLLTSEENVERDAVHKALMSLTRQDVKNSLQPLFKHVESGSEIREKIICFLRDKVFPLKAELLKPQAEMERFITDLIKKSVQDVTGSEFELFMGFLRSLSIFGDSAPRESFQELIEIIQAQADLDSQFNVSDIDHIERWISCMYMALPIFMRGASSTKFLNYFVKQIVPAFDKIPEEKKLDLLKTIAASSPYTAAQDSRQLLPSVVQLLKKYMPGKKVEYINHNYVECLLYTFHHLAHKTPNTTNSLCGYKIVTGQPSDRLGEDFSEHYKNFTERLTGTEETVRAASKRLTQGMADFNKAISSAKTEGEKTKIKSDQQTATRTMRSYNNILAMTQPLHMKSPSFMGDKKITLSWMEQPKKPAATIAGVKRSQPATNGNGPASKKGRGGMQNQLVNRAFEGLSYGGRGSGRGWGRGGRGRGRGWGGYR

SEQ ID NO: 16864 - DNA, 2137 bp, Panicum virgatum
  misc_feature: Ceres CLONE 1790480
  misc_feature: Encodes the peptide sequence at SEQ ID NO. 16865
aaaaagccgccgcctcgagccgagcgtctttcgaggaccacccgtttccaccgtgtagccgcttgccctgttcgccttgtccgaggagggcctcttcttcttcgatccctcctctccctcggcgtcggcgggccgccgtcccagccgcagcggcgcgctctccatggcgtcctaatcggcggcaacgccgccacgtgcctgcgcttgttcagaagcagagcgtaaggtttcatatatgataccaagcatggatgaagcccttcttggcaatggtgttcagaagaccagaggggtaggagagaacctggtgctgcctgaggtcagaaagcagctgcaccttgctgggccactcattgccgcatggatcctgcagaacatcgtccagatgatatctgtcatgtttgttggtcacctcggtgagcttgcactctccagtgcctccatcgccacctcttttgcaggtgttactggcctcagcttattgtctggcatggcaagcagcttggacacactgtgtgggcaagcctttggggcaaagcagtactatcttctcggtatctacaagcagagggccatccttgttctcactctggtgagccttgtggttgctgttatctggtcgtacactggccagatccttctagtctttggtcaggacccagagattgcagctggagcagggagctacatccggtggatgattccagcgctgtttgtatacgggccactgcagtgccatgtccggttcctacagacgcagaacatagtccttccagtgatgctgagctcaggtgttacagcgcttaaccatctgctagtgtgctggctgctggtgtacaagattggtctgggcaacaagggtgctgccttggccaatgccatttcgtacctgaccaacgtctccatcctggcaatctacgtcaggcttgcaccagtctgtaagaacacctggagagggttctcgaaggaggcttttcacaacatccccagcttcttgaggcttggtgttccatctgcactgatggtttgcttggaatggtggtcatttgagctcctggtgctgctttctggacttctcccaaacccaaagcttgagacatcggttttgtcgatttccttgaacacaggctctttagcatttatgattccttttgggcttagtgcagccatcagcactcgtgtttcaaatgagctcggtgctggacgaccccaagctgcccatctggctacccgtgtggtcatggtgctggctatcgtggttggcatattaatcggactggctatgattttggttcgcaatttatggggatacgcatacagtacggaggaggaagtggtgaaatacatctccaaaatgatgccgatcctggccgtgtcattcttgtttgattgcgtgcagtgtgttctttcaggtgttgctaggggttgtgggtggcaaaagattggtgcttgtgttaaccttggtgcgtactacctgattggaattccagcagccttctttttcgccttcgtttaccatctaggtggaatgggactttggctgggaataatctgcgcactcgtcgtccagatgctattgcttctcacaattactctgtgcagcaactgggagcaagaagctttgaaggcaaaggacagaattttcagttcatccctaccagtagacatgacgacatgacacgcacaagccacacggtttctttttgaagtaaaagccacacgattttgttggaggcaatggccaacaaactttgacaaggaactctttcaagacttgctcactcgagcagggactacttttctccacggcatcataatgacactatgttctaggaaacatcagcagaaaattgatctaagtcaaatttgctgatacggtaacgcaatatgtcaatgagggaattattttgtaatttctggattaaatgatatttaaatgttaaaaaattctggattatgacctcattagtaagcgtagtacactagtacttggtgttcggaaagtgcgtgtcacctgggagatgttggatacattgtgaatcttaatgcgaacacatgttagatcaaatgctcagttacgacttgtggtattatttggttgtattgtatgatttaaattaagaaagacttcgttctt

SEQ ID NO: 16865 - protein, 476 aa, Panicum virgatum
  misc_feature: Ceres CLONE 1790480
  misc_feature (255)..(418): Pfam Name: MatE Pfam Description: MatE
  misc_feature (34)..(194): Pfam Name: MatE Pfam Description: MatE
MDEALLGNGVQKTRGVGENLVLPEVRKQLHLAGPLIAAWILQNIVQMISVMFVGHLGELALSSASIATSFAGVTGLSLLSGMASSLDTLCGQAFGAKQYYLLGIYKQRAILVLTLVSLVVAVIWSYTGQILLVFGQDPEIAAGAGSYIRWMIPALFVYGPLQCHVRFLQTQNIVLPVMLSSGVTALNHLLVCWLLVYKIGLGNKGAALANAISYLTNVSILAIYVRLAPVCKNTWRGFSKEAFHNIPSFLRLGVPSALMVCLEWWSFELLVLLSGLLPNPKLETSVLSISLNTGSLAFMIPFGLSAAISTRVSNELGAGRPQAAHLATRVVMVLAIVVGILIGLAMILVRNLWGYAYSTEEEVVKYISKMMPILAVSFLFDCVQCVLSGVARGCGWQKIGACVNLGAYYLIGIPAAFFFAFVYHLGGMGLWLGIICALVVQMLLLLTITLCSNWEQEALKAKDRIFSSSLPVDMTT

SEQ ID NO: 16866 - DNA, 2658 bp, Panicum virgatum
  misc_feature: Ceres CLONE 1790483
  misc_feature: Encodes the peptide sequence at SEQ ID NO. 16867
acagttgtatctggtgtagctgtgcgcacgcacgtagctatagctagctagctggtgatatggagtcgataatggagaagccggtggcggtggacgccgcggccggcggcggcggaggagggggtgccggtcggaccaggtcggaccagctggcgccgtcgcagtcgctgagccggacggcgtcggcggagacggtgctgagcaacgcggacacgacgagcctgtcccgcaagtccagcttcgggcggaagcgcacggcgtcggccggcggcggcggcggcggcggcggcggcaacagacacatccgcaagtcgcggagcgcgcagctgaaggtggacgtggaggacctcgtcagcagcagcgccgcgctcagccgcgcctccagcgccagcctcggcttctccttcaccttcaccggcttcaccccgccgccgcagggcatgcactactccgccgacccgacgaccttcagcgacgacgacagccccatggacatcgaggccggcgcgcggcggcgcaagaagctgatgacggagccgaccttgccgatatacctcaagttcacggaggtgaagtacaggttgtcggcgaagaagggctcgccgcgggagatcctgggcgggatatccgggtcggtgtcccccggcgaggtgctggcgctgatgggcccgtccggcagcggcaagacgacgctgctgagcatcctgggcggcagggccggcggcggcgccgtggagggctgcgtctcctacaacgacgagccctacagcaagtccctcaagcgcaggataggatttgtgactcaagatgatgttctctttacccatcttactgtgaaagagacattgacttacgcggcactacttcgtctcccaagaacaatgactaggcaacaaaagaaagaacgggcaatggacatcatatatgagcttggccttgaaaggtgccaggacacaatgattgggggatcttttgtgcgtggggtttcagggggtgaaaggaaaagagtttgcattggaaatgagattctgatcaatccatctttattgtttcttgatgagccaacatctgggctggattcaactacagccctaaggatcgttcaacttcttcatgacatagctgaggatgggaagacggttatcaccacaattcaccaaccatctagcaggctgtttcataagtttgacaagcttatcctcctgggcaaaggaagtttgctatactttgggaaggcatctgaagccatgccctacttccagtccattggatgcaccccactcatcgcgatgaacccagcagagtttctactggatctcgccaatggcaacactaacgatgtttcagtcccttcagagttagatgataaggtgcatatggaaaatcacactttggagaataataattccaagaatgactacaggccatcagcacaagatgttcatgagtatttggtagatgcctatgagactcgagtggcttttaaggagaagaagaagcttctagctccacttccgatcagtgatgacctgaaggcaactataacatcatcgaagcgagagtggggcacaagctggtgtcagcaatattccatcctcttttgtagagggatcaaggaaagacggcatgattatttgagctggatgagaataacccaggtcatagctacatcgattatcttaggtttattatggtggcactctgatcccagtacactaaaaggtctagaagatcaggctggcttactgtttttcattgctgtgttttggggtttctttcctgtctttactgcaatcttcacattccctcaagagagggcaatgttgaacaaggaacgggcagttgacatgtacaagctcagtgcatacttcttggccagaatgacaagtgatctaccacttgaccttttcctccctgtcgtattcatggtgatcgtctacttcatggcaggcctcaaagcaactgccacacatttctttcttagcatcctgactgtcttcctcagcataattgctgctcagggactaggattggcaattggagctaccctgctggatatcaagaaggcaacaactctagcttcagttacagtcatgacgttcatgctagcaggaggcttctttgtaaagagggttcccccattcatctcctggctgcgctacctgtccttcaactaccacacgtacaggctcctgctcaaggtgcagtacgatcccgtgccggacatcctgaccaccacgaaacacattgacaacggcgccaccgaagtcgctgctctcgtcgccatgatcatcgggtaccgggtgctggcgtacctgtcgctgagaagggtgaaggtcccaagcagctagcacatcgcatcaccgcgtgtgttgactcactgaagcctgaactcctggaggccgcaaaccgcaaggggttgggtgtgtagggatgtttgttttatattgtgccgtaaaaagatagagctcttttacttttctgtctttttcaacaaagttcagagggccccgaaggccaaattcgaaattgaaccagaagaatgtgtagcgagtgttaggtcagtctcagtccacagtttcattgtatagttaccaagactgagcatttggtaattgtgccaactagatttcatagtgatcaaacttctctcgtctc

SEQ ID NO: 16867 - protein, 763 aa, Panicum virgatum
  misc_feature: Ceres CLONE 1790483
  misc_feature (508)..(717): Pfam Name: ABC2_membrane Pfam Description: ABC-2 type transporter
  misc_feature (196)..(385): Pfam Name: ABC_tran Pfam Description: ABC transporter
  misc_feature: SWISSPROT Homolog: EC 3.6.3.25 Sulfate-transporting ATPase
MESIMEKPVAVDAAAGGGGGGGAGRTRSDQLAPSQSLSRTASAETVLSNADTTSLSRKSSFGRKRTASAGGGGGGGGGNRHIRKSRSAQLKVDVEDLVSSSAALSRASSASLGFSFTFTGFTPPPQGMHYSADPTTFSDDDSPMDIEAGARRRKKLMTEPTLPIYLKFTEVKYRLSAKKGSPREILGGISGSVSPGEVLALMGPSGSGKTTLLSILGGRAGGGAVEGCVSYNDEPYSKSLKRRIGFVTQDDVLFTHLTVKETLTYAALLRLPRTMTRQQKKERAMDIIYELGLERCQDTMIGGSFVRGVSGGERKRVCIGNEILINPSLLFLDEPTSGLDSTTALRIVQLLHDIAEDGKTVITTIHQPSSRLFHKFDKLILLGKGSLLYFGKASEAMPYFQSIGCTPLIAMNPAEFLLDLANGNTNDVSVPSELDDKVHMENHTLENNNSKNDYRPSAQDVHEYLVDAYETRVAFKEKKKLLAPLPISDDLKATITSSKREWGTSWCQQYSILFCRGIKERRHDYLSWMRITQVIATSIILGLLWWHSDPSTLKGLEDQAGLLFFIAVFWGFFPVFTAIFTFPQERAMLNKERAVDMYKLSAYFLARMTSDLPLDLFLPVVFMVIVYFMAGLKATATHFFLSILTVFLSIIAAQGLGLAIGATLLDIKKATTLASVTVMTFMLAGGFFVKRVPPFISWLRYLSFNYHTYRLLLKVQYDPVPDILTTTKHIDNGATEVAALVAMIIGYRVLAYLSLRRVKVPSS

SEQ ID NO: 16868 - DNA, 2079 bp, Panicum virgatum
  misc_feature: Ceres CLONE 1790508
  misc_feature: Encodes the peptide sequence at SEQ ID NO. 16869
agccaacacctcacggaccacccgcgcactcctcctgcacgctgcacaccacctcacctcgcgccggcgaggagcgagggaggacactggacacaggacacgacgctccggcgctcgctggtacaccaataatcgagggcgcagagaggacagaggccggcacacaggacgacacgcccgataaacaactagcgccgaacagccgcagccaaactgacacaacgcctcgctcacgcctccgatagagaaccagccaccatgagcaccgacgcggccgccgccgccgccgtcccggccgccgtggcgccggcgaagcgcgcgcccatcaacaagtacgcctgcgcctgcgccctgctcgcctccatgaactccgtcctcctcggctacgacatctcggtgatgagcggcgcgcagctgttcatgaaggaggacctcaagatcacggacacgcagatcgagatcctggccggcgtcatcagcatctactcgctcttcggctcgctcgccgccggcctcaccgccgactggctcggccgccgctacaccatggtgctcgcggccgccatcttcttcacgggcgcgctcctcatgggcctcgccccggactacgcgctgctcatggtcggccgcttcgtcgccggcatcggcgtcggcttcgcgctcatgatcgcgcccgtctacaccgccgaggtcgcgcccacctcgacgcgcgggttcctcacctccttcccggaggtgttcaacaacttcggcatcctcctcggctacgtctccaacttcgccttcgcgcgcctccccgtccacctcagctggcgcgccatgttcctggtcggcgccgtgccgcccgtcttcctgggcgtcgccgtcctcgccatgccggagtcgccccggtggctcgtcatgcggggccgcatcgacgacgcgcgccgcgtcctgctgaagacctccgactcgcccgccgaggccgaggagcgcctgctcgacatcaagaaggtggtcggcatccccgagggcgtgtccgacgccgacgacgtggccgccatcgtccgcgccggcagcaagagctcccgcggcgagggggtgtggaaggagctgctcatcaacccgtcgcgccccgtgcgccgcatgctcgtggccgggctcgggctcatgttcatccagcaggccacgggcgtggactgcgtggtgatgtacagcccgcgggtgttcgcgcaggcgggcatcaagtccaagaccaactcgctgggcgcgtccatggcggtgggcgcgtgcaagaccttcttcatccccatctcgacgctgctcctcgaccgcatcgggcggcggccgctgctcctggcgagcggcggcgggatggccatcttcctgttcacgctggccacgtccctgcacatgatggaccagcgccccgagggggaggcggcggcgctgggcgcggtgagcatcgcggcgatgctggcgttcgtggcgtcgttcgcgtccgggctgggccccgtcgcctgggtgtactgctccgagatctacccgctgcggctgcgcgcgcaggccgccgccatcagcacggggctgaaccggatcatgagcggggccaccaccatgtccttcctctccctctccaacgccatcaccatcgcggggagcttctacctctacgcctgcgtcgcggcggccgggtgggtgttcatgtacttgttcctgccggagacgatgggcaagagcctggaggacaccgtgaagctcttcggcaaggacgcggacgacgaggacgccgccgccgtggccgcacgccccgagcgcaagaagtcatccaccgagttcagtgctcagtaaagcgcccctgcatgcaccacgtgcccgtacacacatgtcgtccccagtgtggccggagctttcccgtaaagcttcgatgagtactccagtatataagtactttttttttgtctttgctgtggtgaatcttttagaatccagcgcgctttgtttggataggtttttggtgatctggtcgtgccagcatgtagggtccttggcattgcacgggcagaggagaaacaaatatcacctgatatttccacgtgt

SEQ ID NO: 16869 - protein, 523 aa, Panicum virgatum
  misc_feature: Ceres CLONE 1790508
  misc_feature (30)..(495): Pfam Name: Sugar_tr Pfam Description: Sugar (and other) transporter
MSTDAAAAAAVPAAVAPAKRAPINKYACACALLASMNSVLLGYDISVMSGAQLFMKEDLKITDTQIEILAGVISIYSLFGSLAAGLTADWLGRRYTMVLAAAIFFTGALLMGLAPDYALLMVGRFVAGIGVGFALMIAPVYTAEVAPTSTRGFLTSFPEVFNNFGILLGYVSNFAFARLPVHLSWRAMFLVGAVPPVFLGVAVLAMPESPRWLVMRGRIDDARRVLLKTSDSPAEAEERLLDIKKVVGIPEGVSDADDVAAIVRAGSKSSRGEGVWKELLINPSRPVRRMLVAGLGLMFIQQATGVDCVVMYSPRVFAQAGIKSKTNSLGASMAVGACKTFFIPISTLLLDRIGRRPLLLASGGGMAIFLFTLATSLHMMDQRPEGEAAALGAVSIAAMLAFVASFASGLGPVAWVYCSEIYPLRLRAQAAAISTGLNRIMSGATTMSFLSLSNAITIAGSFYLYACVAAAGWVFMYLFLPETMGKSLEDTVKLFGKDADDEDAAAVAARPERKKSSTEFSAQ

SEQ ID NO: 16870 - DNA, 679 bp, Panicum virgatum
  misc_feature: Ceres CLONE 1790509
  misc_feature: Encodes the peptide sequence at SEQ ID NO. 16871
accgacaccttcctccacgtccatggagcccgccgcggacgaggtggccttcgagtccccggcgcacttccgcatctacaagagcggcaggatcgagcgcctcaaccggcctccggtcctccccgccggcctcgacgaggccaccggcgtcacctccaaggacgtcgtcctggacgccgggaccggcctctcagcgcgcctctacctcccgaagctccaggcggagccgtccaagaagctccctgtcctcgtctacttccacggcggcgcgttcctgatcgagtcggccgactccgccacgtaccacacctacgtcaaccccctcgcggcggcggcgggcgtcctcgcggtgtccgtgagctaccgcctggcgccggagcacccgctcccggcggcctacgaggactcctgggccgcgctccagtgggcggcgtcggcggaggacgagtggatcgccgagcacggcgacgtggcgcgcctcttcctcgcgggcgacagtgccggcgccaacatcgtgcacgacatgctgctgagggcgtccggcgccggcggcgggccgcgcatcgagggcgccgtcatgctccacccgtggaccgtggttcggcgggaacgcgcccatcgagggggagcccgagggctcttcggcggccaccgctgggctctggacgtacgcgtgccc

SEQ ID NO: 16871 - protein, 218 aa, Panicum virgatum
  misc_feature: Ceres CLONE 1790509
  misc_feature (76)..(218): Pfam Name: Abhydrolase_3 Pfam Description: alpha/beta hydrolase fold
  misc_feature: SWISSPROT Homolog: EC 3.1.1.79 Hormone-sensitive lipase
MEPAADEVAFESPAHFRIYKSGRIERLNRPPVLPAGLDEATGVTSKDVVLDAGTGLSARLYLPKLQAEPSKKLPVLVYFHGGAFLIESADSATYHTYVNPLAAAAGVLAVSVSYRLAPEHPLPAAYEDSWAALQWAASAEDEWIAEHGDVARLFLAGDSAGANIVHDMLLRASGAGGGPRIEGAVMLHPWTVVRRERAHRGGARGLFGGHRWALDVRV

SEQ ID NO: 16872 - DNA, 1388 bp, Panicum virgatum
  misc_feature: Ceres CLONE 1790513
  misc_feature: Encodes the peptide sequence at SEQ ID NO. 16873
ggcgtctccccggaggagagacagcgaggctgctgcttgctctctctggcttccttccaacccaaaccagagcccgagcccaccgcctccgcccattccgcccccgtcgcctcccccgcaaaacccaatcccgagccagccagacagcccggccaccaaaccctaatccccccgcgccacgcctcgcgcgcggcctcccatgggctgaccgcgccgctgtggggagcccccggatccggagctagggttccgccatggagtgggacagcgagtccgacggcgccggcagcgtcggcgccggcgacgaggaggaggaggtgggagccgcgggagccggtgacgcggcggcggccgccgccggcgggatgttcacgttcgcgatcgaaggcatgctgcgcgcgtccgggccgtgcgggctggtcgtcaccgacgcgctcgagcccgactgccccatcatctacgtcaaccgcggcttcgaggaggccacgggataccgcgccgaggaggtgctcggcaggaactgccggttcctgcaatgtagagggccatttgctcaaaggaggcaccccctagttgatgccgcagtggtttcaaatattcgaagatgcatagacaatggtattgagttccgtggtgatttactaaatttcaaaaaggatggatctccattaatgaacaggttgcatctgacccctatatatggagatgacgaaaccataacccactatatgggcattcagttcttcactaatgctaatgttgatttgggaccattgcctggctcaataacaaaggaacccgtgagatctacaaggtttgctccagataactcatttcgacccatatccatgggtcctggggagagcaatttctgccgggaatactctagtatcttccaattgtcggatgaagtgctttgtcaaagtatactgtcaaggttgtcaccaagagatatagcatctgtgagctctgtgtgcaggcacttgtaccacttaacaagaaatgaagatctttggagaatggtttgccagaatgcttggggcagtgagactactcaagctcttgagacagtgcctgctgcaagaagattgggctggggtcggctggcgagagaactgaccacactagaagctgttgcctggaggaaattgacagttgggggtgccgtggagccatctcgatgcaatttcagtgcctgtgctgtagggaaccgtgttgttctctttggtggggaaggtgtaaacatgcaaccaatgaatgatacatttgtattggatttaaatgctagcaatccagagtggaggcacatcaatgtaagcgcagctcctccaggtcgctggggccatactctgtcatgcttaaatggatcttggttggttgttttggtg

SEQ ID NO: 16873 - protein, 377 aa, Panicum virgatum
  misc_feature: Ceres CLONE 1790513
  misc_feature (211)..(259): Pfam Name: F-box Pfam Description: F-box domain
  misc_feature (56)..(184): SWISSPROT Homolog: EC 2.7.11.1 Non-specific serine/threonine protein kinase
  misc_feature (296)..(377): SWISSPROT Homolog: EC 3.1.3.16 Phosphoprotein phosphatase
MEWDSESDGAGSVGAGDEEEEVGAAGAGDAAAAAAGGMFTFAIEGMLRASGPCGLVVTDALEPDCPIIYVNRGFEEATGYRAEEVLGRNCRFLQCRGPFAQRRHPLVDAAVVSNIRRCIDNGIEFRGDLLNFKKDGSPLMNRLHLTPIYGDDETITHYMGIQFFTNANVDLGPLPGSITKEPVRSTRFAPDNSFRPISMGPGESNFCREYSSIFQLSDEVLCQSILSRLSPRDIASVSSVCRHLYHLTRNEDLWRMVCQNAWGSETTQALETVPAARRLGWGRLARELTTLEAVAWRKLTVGGAVEPSRCNFSACAVGNRVVLFGGEGVNMQPMNDTFVLDLNASNPEWRHINVSAAPPGRWGHTLSCLNGSWLVVL

SEQ ID NO: 16874 - DNA, 708 bp, Panicum virgatum
  misc_feature: Ceres CLONE 1790513-R
  misc_feature: Encodes the peptide sequence at SEQ ID NO. 16875
gatgatgaagaacaacaggatgcaggcggtggtggcgttggccgttgtcatggcagctgcggcgctggtggcgtcggcgtcggcggccatcacgtgcgggcaggtgggttcggcgctggcgccgtgcatcccttacgcgacggggaaggcgagcgcgctgccgtcgtcgtgctgcggcggcgtgcgcagcctgaacagcgcggcgcgcacgagcgcggaccggcaggcggcgtgccggtgcctcaagagcctggccagcaccgtcaagtcggtgaacatgggcaccgtcgccaccatccccggcaagtgcggcgtctccgtcccattccccatcagcatgtccacagactgcaacaaggtcaactaaattaatggaatatatgtacataccagctgatcgacgatgacaagcttggtgacgtcgtccttcacaagatagctgctacgaggcagctatatatttaattaggagaataaaataaagttgttatcaaggcatcagcatcatctatactattatgtatgtatgtatgtagtaattaaatgcatgttgtgctcgatctgtgtgtacgtgcgcatatatatacatgtgtacatgcctttgtacgatcgatgttatgtgcacatgtatgcttgtgtgtcctgctgtaataatcgagacagagaactgctgctacactgttagttcagtgctgcttcgactggccc

SEQ ID NO: 16875 - protein, 121 aa, Panicum virgatum
  misc_feature: Ceres CLONE 1790513-R
  misc_feature (32)..(117): Pfam Name: Tryp_alpha_amyl Pfam Description: Protease inhibitor/seed storage/LTP family
MMKNNRMQAVVALAVVMAAAALVASASAAITCGQVGSALAPCIPYATGKASALPSSCCGGVRSLNSAARTSADRQAACRCLKSLASTVKSVNMGTVATIPGKCGVSVPFPISMSTDCNKVN

SEQ ID NO: 16876 - DNA, 1911 bp, Panicum virgatum
  misc_feature: Ceres CLONE 1790526
  misc_feature: Encodes the peptide sequence at SEQ ID NO. 16877
accgcaggtaatccccaccccatccaaaccctcccacccgctgccgccgccgcaatcctcccctacccgagatggagatggacgccggcacgccatccaagaaggccaagacatcggcggctgccggcgccacgccgcagaagccgtggaaggccgaccagatcctgacgccggagaagctgacgccgaaggtcacggcggcggccgagcagatctggacgccggagaagcccgaggagaggccgacggcacgcggccgcagcgtggcgttctccgtgaaggaggtgcgccgggcggcgctcgggctgcggaggccggagaagggaacgcgggcggcggccgaggaggcggacgagctcgagtccctcgagcgggagctcggtgttggcgccggggctagccagagccccgtcaagcgcaaggctgaagtcaagctgccggaaagttatgagatgctttgtgagttcttcaactgcctggagagctccactcggctgctccgtatgaagggatccaaggcctccttccccaacatctgcgctagcatccagcatctgtctgaacggaggtttacctacagccatcttgcgcagctcaagtacataatgcccgaggcaattgtcatcaataagatccttttgcgtgatgacacaacatgctgtatgaagccagatcttcaggtgaaccttgtggttggtgctgttgagagtgtcaagaagcagaagggggaaactgcatactcagcattgagaaggatcttcaggcagaggctagtggatttcttcagggaccatcctgagggagatgacgtaccagagcatgaattgccacatccatttaaccgaacaagattgagcatgccccaggctgccccaagagttgttcctgaaccggcatccccaatcgaggcttctgatgtcaatggacaacaggctactatgatgtcacacatgtcacagtcattcaagagaaggttttcgcagaggtctccaatcagttctgcaatagctaacgcaaccagtcaattggcgaaggttgagtccactgttctatcaccattgagcaggaattccctctccagtagctatgtttctgctactaaagaagctcagccagaggaggatgacaaggttgctgtatccatgtctggagtttcagagggcacacctgctaaatatgcctctacgccagtgaggttaatggcatccacaccagaccttacgacaccaaagagaccaatctctgatgcaggttatggcacaccacctctaaaaatgtcaaagagatcagctcgtgctaagttgtttaccactccaacaaaggttgctagtatggatgaaaaggacgaaaatgctatttctgctgttgatagtgacgatgaattactcagttttcttccacaatccctccttcagtcggtaaagcagaaggaacagaggactatggaggagaaggaaactggttttgctgataaggttaaaaggcagaagttgattgcttccctgccaagtatgtttgatgttgtatttcttatctaccagtcaagacagcggtctgtaatgacaaagcaggagctgattcataagatagttgcaagcagtccaaagattgtggacagaagtgaagttgaagagcagctgacattgttgaaagagcttgttccagagtggatctctgagaggagtgcacggagtggagatgttctatgctgcgttgatgcaactttgagccaagcggatattcgcaaaagactgtatgctgctgagtaggaaggatatactaaatgccacaatcacctttttttttagactccacaatcaccttgtttgggaacatgtacatatgtcaacagtgtaaatcagaattcgctcagccatgttacctgagatgtggtgcatgtgcctttggttc

SEQ ID NO: 16877 - protein, 565 aa, Panicum virgatum
  misc_feature: Ceres CLONE 1790526
  misc_feature (122)..(254): Pfam Name: CDT1 Pfam Description: DNA replication factor CDT1 like
MEMDAGTPSKKAKTSAAAGATPQKPWKADQILTPEKLTPKVTAAAEQIWTPEKPEERPTARGRSVAFSVKEVRRAALGLRRPEKGTRAAAEEADELESLERELGVGAGASQSPVKRKAEVKLPESYEMLCEFFNCLESSTRLLRMKGSKASFPNICASIQHLSERRFTYSHLAQLKYIMPEAIVINKILLRDDTTCCMKPDLQVNLVVGAVESVKKQKGETAYSALRRIFRQRLVDFFRDHPEGDDVPEHELPHPFNRTRLSMPQAAPRVVPEPASPIEASDVNGQQATMMSHMSQSFKRRFSQRSPISSAIANATSQLAKVESTVLSPLSRNSLSSSYVSATKEAQPEEDDKVAVSMSGVSEGTPAKYASTPVRLMASTPDLTTPKRPISDAGYGTPPLKMSKRSARAKLFTTPTKVASMDEKDENAISAVDSDDELLSFLPQSLLQSVKQKEQRTMEEKETGFADKVKRQKLIASLPSMFDVVFLIYQSRQRSVMTKQELIHKIVASSPKIVDRSEVEEQLTLLKELVPEWISERSARSGDVLCCVDATLSQADIRKRLYAAE

SEQ ID NO: 16878 - DNA, 1825 bp, Panicum virgatum
  misc_feature: Ceres CLONE 1790529
  misc_feature: Encodes the peptide sequence at SEQ ID NO. 16879
aaaaactcaaatccagaagcagaagcagaagccgataagaacttcaggcgcagcaggagtagatagaagaagagaaggaatttgaaaatcagccaacgttcgtatcagctggggccggaatggcgacgcccaagctgtccccggtctcgccggcgcggcgggacgacacgccccgcgcgcagccgccggctgccctgagggtgcaggacgcgtccgcggcggaggcgtacgagcagtacctgcgcctgccggagctgtcggcgctgcgggagcccgggcgcttcccggggtgggcgggcgaggccctcctcacgccggcgctgcaggcgctcgagctcaccttccgcctcgcgtccctcgcgctgtcggacccgcgcgggtacgccagccgccgcgagctcgcgcgccggcttgagtgcctcgcggcgcgggagctcgagctggcggccgcgctctgcgagggcggcggcgaccggggcgcgccgctcgccgagctgtccgcctccgcgggcgtgctcccgcgggagcgcagcgcgtcggaggtctggcagctgcccgggagcgccaccgccgtggtgtgccggcccagcgaggccagcctgctcccgcgcctcgcggcctgggacaagtccgagacgctcgccgcccggatcacgtacgccatcgagggccagatgcaggggtgcgccttcacgctcggcctcggcgagcccaacctcgccggcaagcccgtgctcgagtacgaccgcgtcgtgcggccccacgagctgcacgcgctcaagcccaagcccgcgccggagcccgggtccggctaccgcaaccgggagaacgagacgctcttcgccatgtaccagatcctcgagtcctggctgtgcgcggcgtcccagctcctcgcccgcctcaacgagcgcatcgaagccaagagctgggcagaggcggccagcgactgctggattctggagcgcgtgtggaagctgctcgccgacgtcgaggacctccaccttctcatggaccccgacgacttcctgcggctcaagagccagctcgcgatccgggcggcgcctggctccgacgcgtccttctgcttccggtccagagcgctcctgcacatcgccaacaccaccagggacctcaagaagcgagtgccctgggtactcggcgtcgaggtggaccccaacggcggcccgcgggtgcaggaggcggccatgaggctctaccacagccggaggcgcggcgagggcgaggaggccggcaaggtggagctgctccaggccttccaggccgtggaggcggccgtgaggaggttcttcttcgcgtaccggcagctggtggcggcggtgatgggcacggcggaggcgtcgggcaaccgggcgctgttcgtgccggcggaggggatggacccgctcgcgcagatgttcctcgagccgcactactaccccagcctggacgccgccaagacgttcttggcggactactgggttcagaagatggcggggacctctgctccgtcccggcagagctgaaaccacgagatggcgctgcggctggatagcgaccggatcgaagttttgcccgacctgctttcatgcatgcttgatgcatcctaattccggtggtgatagtgtgatcaattcctatagatattttgtacttgtagcaccagattctcttattttttttgtgcactgcttctgcattgtgttgtgttctacacctacccagagagtttgattcagttagatgccatttgtaactctaggcaaagcatttcaattggaaattatgtacagaccacattttgtaaatattttatatggtttcatgt

SEQ ID NO: 16879 - protein, 467 aa, Panicum virgatum
  misc_feature: Ceres CLONE 1790529
  misc_feature (186)..(456): Pfam Name: Hs1pro-1_C Pfam Description: Hs1pro-1 protein C-terminus
  misc_feature (1)..(183): Pfam Name: Hs1pro-1_N Pfam Description: Hs1pro-1 N-terminus
MATPKLSPVSPARRDDTPRAQPPAALRVQDASAAEAYEQYLRLPELSALREPGRFPGWAGEALLTPALQALELTFRLASLALSDPRGYASRRELARRLECLAARELELAAALCEGGGDRGAPLAELSASAGVLPRERSASEVWQLPGSATAVVCRPSEASLLPRLAAWDKSETLAARITYAIEGQMQGCAFTLGLGEPNLAGKPVLEYDRVVRPHELHALKPKPAPEPGSGYRNRENETLFAMYQILESWLCAASQLLARLNERIEAKSWAEAASDCWILERVWKLLADVEDLHLLMDPDDFLRLKSQLAIRAAPGSDASFCFRSRALLHIANTTRDLKKRVPWVLGVEVDPNGGPRVQEAAMRLYHSRRRGEGEEAGKVELLQAFQAVEAAVRRFFFAYRQLVAAVMGTAEASGNRALFVPAEGMDPLAQMFLEPHYYPSLDAAKTFLADYWVQKMAGTSAPSRQS

SEQ ID NO: 16880 - DNA, 702 bp, Panicum virgatum
  misc_feature: Ceres CLONE 1790536
  misc_feature: Encodes the peptide sequence at SEQ ID NO. 16881
cggcttcactggtgctaacctcaccctcgatggtatggcctctatcacaccaaatggtctacttcaactgaccaatggcaccctccggctcaaaggccatgcgttccacccaactccattccacttccgcaagaaacccaatgggacagtgcaatcgttttctgtcacatacgtctttgccatctactgcatccaatctgccatctgtggtcatggcattgcgttcctcattgctgcaagaaaaaacttctcggatgcattgcaggcccagtacatgggtctcgccaatggatacaacaatggcaacgcaaccaacaacttctttgctgttgagctcgacaccaacaaaaatgatgagttcaatgacataaacaacaatcatgttggagtcgacatcaatgggctaaactctgtgaactccagcagcgccggctactacgacgataatagcggtaacttccacaacttgactttagcaagctacaaaatgatgcaggtgtgggtggaatatgatgggggtaccacacaggtcaatgtgaccttagcttccccgaacatggccaaaccaatcaaaccactcctctctattacttacaacatatcaagagtacttctcacagataaggtatatatcggcttctcatcgtcaacaggttcattcattgcacggcaatatgtgcttgcttggagttttggcatgaa

SEQ ID NO: 16881 - protein, 233 aa, Panicum virgatum
  misc_feature: Ceres CLONE 1790536
  misc_feature (1)..(232): Pfam Name: Lectin_legB Pfam Description: Legume lectin domain
GFTGANLTLDGMASITPNGLLQLTNGTLRLKGHAFHPTPFHFRKKPNGTVQSFSVTYVFAIYCIQSAICGHGIAFLIAARKNFSDALQAQYMGLANGYNNGNATNNFFAVELDTNKNDEFNDINNNHVGVDINGLNSVNSSSAGYYDDNSGNFHNLTLASYKMMQVWVEYDGGTTQVNVTLASPNMAKPIKPLLSITYNISRVLLTDKVYIGFSSSTGSFIARQYVLAWSFGM

SEQ ID NO: 16882 - DNA, 619 bp, Panicum virgatum
  misc_feature: Ceres CLONE 1790541
  misc_feature: Encodes the peptide sequence at SEQ ID NO. 16883
attcctgattctctccagctcatcccagtcggtactggatcgaaaggatggaggacgccaataacaatcagtcgtactcgtcttgcgcgcgcgtggagaggaaagattggattttgtgttacattttggtgaacagaaaggttgagggcggcggcgaggtgctgcggcccctgggcgcatagcgcggcggcagcagaagggatactttggcagacggagctgcggccgcatggggggggtgagttctcgatggccacgacccacgccaacctggccatgtacgaccgggcgcaggtgctggcctccccggccgactcactcgtcggcgtctacgacggacactgcggggccgacgcctcccgtttcctccgatctggactcttcctccatgtccaacgcttcgcgacggatcatgtgggcatgagcgcggaggtgatccggatgtcgttcaacgagaccgacgaggagtttcatacgggggctgtgcaggagtggagtaggcggcctcggatggccgccttgggctcgtgctgccttctcggtgctatctccggggacaccctctacctggccgaccgtggagactcgcacgccgtgatattgcgtcaagtgctggggg

SEQ ID NO: 16883 - protein, 123 aa, Panicum virgatum
  misc_feature: Ceres CLONE 1790541
  misc_feature: SWISSPROT Homolog: EC 3.1.3.16 Phosphoprotein phosphatase
MATTHANLAMYDRAQVLASPADSLVGVYDGHCGADASRFLRSGLFLHVQRFATDHVGMSAEVIRMSFNETDEEFHTGAVQEWSRRPRMAALGSCCLLGAISGDTLYLADRGDSHAVILRQVLG

SEQ ID NO: 16884 - DNA, 2333 bp, Panicum virgatum
  misc_feature: Ceres CLONE 1790546
  misc_feature: Encodes the peptide sequence at SEQ ID NO. 16885
gaatcagatcgatcaatccccttcccctcccctcgcctcgggacagtcctgctcatcctctcctccttggaatcgcaggcggagctgcaggggcaggggccgaggctggcggcgctccaccaaatcgatcgatccatcgactagattgatatatagatagatgctccgccgagatttcatggcgccgccgccgtgcccccacatcccgccgtcctgaccccaaccgcgaaaacctcagccgcaccaaccaccagagcaacaggatagccgacagcggcggtctcagcgccaacaacgccgccgccgcccacgacgacgacgacgccaacgccacacctttccccgacaccgtccaggtcggaggatcccccgagtacaaggtcgacaggaagctgggcaaaggtggctttggccatgtctttcttggccgacgcctaactgctgcacgctcctcggcttccgctgcccaagaggttgccatcaaatttgagcacactaccagcaagggctgtagctacggccctccgtatgaatggcaagtctacacagctctgggtggcacgcatggcgtgcccaaggtgcattataaaggccgccagggtgactactatgtcatgattatggatatgctggggcctagcttgtgggattcttggaattcattaggccaatcgatgtcatcggaaatggtggcttgcattgccatggagtccatttccatcctggaaagcatgcattctaaaggatatgtgcatggagacgtcaaacctgagaactttcttctgggtcagccttcaacgcctcaagaaaagaaactttatcttgtggatcttggattagcaacaaagtggagagattctgctagtggacagcatgttggttatgatcaacgtcctgatgcctttagaggaacggtaagatatgctagtgtccatgcacatttaggaagaacagctagcagaagagatgatttggaatcacttgcctatacactagtatttcttcatcggggcaggttgccatggcaaggataccagggtgataataaatcatttttggtgtgcaagagaaagatgagtacctcgcccgagagcctttgcggcatatgtcctcaacctttcaaacagtttcttgagacagttgttaacatgaagtttgatgaggagccaaactattccaagttgatttctttgtttgatagtttaattggaccaaacccttccatcagaccaatcaatactgatggagcccaaaaggtagggcagaagcgtgccaggttgcttaatgatgatgatggccatgtaaaaaagaagattcgtctgggtgctccagcaacacagtggatttcagtatataattcaaggtcacctatgaaacagaggtaccactataatgtggctgacacaaggttagcccaacatgtggacaaaggaaatgaggatggtttactgataagttcaatatcatcatgcgcaaatctttgggcaatcattatggatgcaggaactggcttcacagctcaagtgtatgagctgtctccacactttcttcataaggaatggattatggaacagtgggataaaagcttctacatcagttctgttgctggctccaacaatggaagttctcttgtagtgatgtccaaaggcacgccatatacacagcaatcgtacaaagtcagtgattccttcccatttaaatggataaacaaaaaatggaaggaaggttttcatgtgacttcaatggctacatcaggcagtcgatgggctatagtcatgtcccgcagtgctgaattttctgagcaggttgtggaattggactttctgtacccaagcgagggcatccatagacgctgggacaacggctatcgtattaccgcaatgggtgccacaatggaccagtctgcactgatcctaagcaagccaaggcggcgcccaagagacgagacacaagagactttgcggactacacagtttcctagtcaacatgtcaaggagaagtgggccaagaacctctaccttgctgggatatgctatgggcgaaccgtggcctaacatcgtcggctgctgacctagctgtttgttgatatatatttgagtttttgtcctctgttaccatatcagccccagagcaagtgccttagtccaagatgagttctgatgtatctgaaccctattgtaggtctggtctcgtaagttaatcaggaaagtcgaggggcacagacggatagaatagtgtagcttctaccatcagtaacgtgctactttggtccaataaaatgagtctcattgtgaatcaatacaaggataagggataaatatgtcccttttatt

SEQ ID NO: 16885 - protein, 479 aa, Panicum virgatum
  misc_feature: Ceres CLONE 1790546
  misc_feature (1)..(194): Pfam Name: Pkinase Pfam Description: Protein kinase domain
  misc_feature: SWISSPROT Homolog: EC 2.7.11.1 Non-specific serine/threonine protein kinase
MIMDMLGPSLWDSWNSLGQSMSSEMVACIAMESISILESMHSKGYVHGDVKPENFLLGQPSTPQEKKLYLVDLGLATKWRDSASGQHVGYDQRPDAFRGTVRYASVHAHLGRTASRRDDLESLAYTLVFLHRGRLPWQGYQGDNKSFLVCKRKMSTSPESLCGICPQPFKQFLETVVNMKFDEEPNYSKLISLFDSLIGPNPSIRPINTDGAQKVGQKRARLLNDDDGHVKKKIRLGAPATQWISVYNSRSPMKQRYHYNVADTRLAQHVDKGNEDGLLISSISSCANLWAIIMDAGTGFTAQVYELSPHFLHKEWIMEQWDKSFYISSVAGSNNGSSLVVMSKGTPYTQQSYKVSDSFPFKWINKKWKEGFHVTSMATSGSRWAIVMSRSAEFSEQVVELDFLYPSEGIHRRWDNGYRITAMGATMDQSALILSKPRRRPRDETQETLRTTQFPSQHVKEKWAKNLYLAGICYGRTVA

SEQ ID NO: 16886 - DNA, 2450 bp, Panicum virgatum
  misc_feature: Ceres CLONE 1790552
  misc_feature: Encodes the peptide sequence at SEQ ID NO. 16887
atcccctcctccgcccgcgccctctgcctccatcttcgtctcacctcgtcgccgtggaccgcgtccccttgcgcgcctccgcagcagccgagagcgcgcggtcaactctcccgccggcggagcgagagcgggtccggagccggggaggagaggcgggagggtccccggatctgagctgagccgcgctccccgtgcgcccgccgccggccaccgcccgcccgcccgcccagatctcgagcccccgcagatctgctgctgcgcctcgtgcacgtaagatctaaaccgaacaagaggggagctccagctccggttggtgggggttagtcggtgacgaggaggcggcggcggcaggggaggctgcgaggatgtcgtcgagcacgatccggaaggcgctgggggcggtcaaggaccagaccagcatcagcctcgccaaggtcaccagcaacatcgccccggagctcgacgtgctcatcgtcaaggtcaccagccacgacgacgagcccgccgaggagcgccacatccgcgagatcctccacctcacctccggatcccgcgcccacgtcgccgccgccgtggcggcctgcgcgcgcaggctcgcccgcacccgcgactacgtggtggcgctcaagtcgctcatgctcgtgcaccgcctcctggccgacggcaacccaaccttccaccgcgagctcctccacgccaccaggcgcggcacccgcctgctgaacctctccgacttccgcgacgaggcgcactctgggtcgtgggatcactctgcctttgtgcgcacctacgcgctctacctcgaccagcgccttgagttcttcctccatgagcgcaagcagggatcaaatgctggcagcagtgctaatggtccgtcgccccgtgaccgttggggttcgcctgacccctatggccgccgctcaccctcctactcatcaccccctgggtatggcggatatgatgattaccgtgagaggaatggtggcaacaatgatgacaagaggccgccgaccccggtgagggacatgaagccggagcgggtacttgcccgcatgcaccacctgcagcagctgcttgacaggttccttgcttgccgccccactggtggcgcaaagcacagcaggatggtgctggttgcattgtaccagattgtgagagagagcttccagctctatgcagatatctgtgaggtgctggcagtgctgctggacaggttctttgacatggaatatgctgagtgcgtgaaggcttttgaggcatatgctagtgctgcgaagcagattgatgagctctgtgcattctacgcatggtgcaaagatactggagttgcgaggtcatcagagtacccagaggtgcagcgtgtcactgataagctgctggagacactggaagaatttatgagggaccgggctaagcggcccaagaacccaccgcgggagcctgagcctgagcctgtaaaggaagagcctgagccggatatgaatgacatcaaggcgcttccagcacctgaggattttaaggagcctgaacctgagaaggttgaggaagaagtgaagccagagccacccccgcagccacagggtaacttggtggatctcagagaagatactgtaagtgcggatgaacaaggtaacaggcttgctctggctctcttccaggggccacctgctgctggcggaagcaatggttcatgggaggccttcccttcaaatggtggcaacgaggtgacttcagcatggcagaatcctgcagctgagcctgggaaggctgattgggaactcgcccttgtagagacagcaagcaacttgtcgaagcagaagcctgcaatgtctggtggtatggacccactgctgctgaatggtatgtatgaccagggtgctgtgcgccagcacgtcagtgcacaggtgaccaccgggagtgccagcagtgtcgccctgcctgctcctggacagaaaactcaggtcctggctctgcctgcaccggatggttcgatgcagactgttggtggtgatcccttcgcagcatccctcaccgtcccaccgccatcctatgtgcagatggcggacttagaaaagaagcagcagttcttgacacaggagcagatgatgtggcagcagtaccagagggatggcatgcaagggcaatcgagcctcaacaagctcgaccgggcatacaacaacggtttcgcccccaaccccgccatgccctacgggatgcccatgccatacaacacaaaccccatgccaacgacttataccgggaaccctgggtattactaccccacttactgaggcctattctttgttcatccttacagttgctgtgaatttttgttctgtattgtgatcttactcccagccctggggttgtgtccagcatcagctgttgttcccccgtctctggatcaaaccttttggtctcatatatgtaatgtaattttatttgtttgg

SEQ ID NO: 16887 - protein, 641 aa, Panicum virgatum
  misc_feature: Ceres CLONE 1790552
  misc_feature (29)..(348): Pfam Name: ANTH Pfam Description: ANTH domain
MSSSTIRKALGAVKDQTSISLAKVTSNIAPELDVLIVKVTSHDDEPAEERHIREILHLTSGSRAHVAAAVAACARRLARTRDYVVALKSLMLVHRLLADGNPTFHRELLHATRRGTRLLNLSDFRDEAHSGSWDHSAFVRTYALYLDQRLEFFLHERKQGSNAGSSANGPSPRDRWGSPDPYGRRSPSYSSPPGYGGYDDYRERNGGNNDDKRPPTPVRDMKPERVLARMHHLQQLLDRFLACRPTGGAKHSRMVLVALYQIVRESFQLYADICEVLAVLLDRFFDMEYAECVKAFEAYASAAKQIDELCAFYAWCKDTGVARSSEYPEVQRVTDKLLETLEEFMRDRAKRPKNPPREPEPEPVKEEPEPDMNDIKALPAPEDFKEPEPEKVEEEVKPEPPPQPQGNLVDLREDTVSADEQGNRLALALFQGPPAAGGSNGSWEAFPSNGGNEVTSAWQNPAAEPGKADWELALVETASNLSKQKPAMSGGMDPLLLNGMYDQGAVRQHVSAQVTTGSASSVALPAPGQKTQVLALPAPDGSMQTVGGDPFAASLTVPPPSYVQMADLEKKQQFLTQEQMMWQQYQRDGMQGQSSLNKLDRAYNNGFAPNPAMPYGMPMPYNTNPMPTTYTGNPGYYYPTY

SEQ ID NO: 16888 - DNA, 1813 bp, Panicum virgatum
  misc_feature: Ceres CLONE 1790556
  misc_feature: Encodes the peptide sequence at SEQ ID NO. 16889
attccacgctgcttcggcgcccggcaccaacctccccccctccccacttcgccgccggcgggtggagtcgggttggagcagccgccttttaccagatactacccaaactatccatccggcgaccatggggcacggcgtcagctgcgcccgcaccggtgacgagcacgactacttccgcgcggtgcagctcggggacctcgacgccctggccgcgctcctcgccgccgacacctccctcgctcgccgcgccaccctctacgaccgcctctccgcgctccacatcgccgccgccaatggacgtctcgaggtgctgtccatgatcttggatcacggggtgccgccggacgtggtgaatcggcacaagcagactccgctgatgctcgcggcgatgcacggcaagattgactgcgtgatcaggctcctccaggccgacgccaatatcttgatgttcgattctgtgcacgggcggagctgtctgcaccacgctgcctacttcggccatgtggactgcctgcaggccatcctctcggcggcgcagacgacgccggtggccgactcatggggtttcgcccggttcgtcaacgtcagggacgaccacggcgccacgccgttgcatctcgcggccaggcaggggcggccagggtgcgtgcagatgttgctggagaaaggcgccattgtatccgctttgacaggctcatacgggttccctggtagcacatcgttgcatctggctgctcgcagtgggaacctggattgcatccggaaactgcttgcctggggagcagatcgtctccaaagggactcggcagggagaattccctatgctgttgcactgaagcgcaactacgaagcatgtgcggctttgctaaacccttcatcagctgagcccatggtgtggccttccccacttaagttcatcagcgagctcgatccggaagcaaaggctctcctggaagcagccctgatggaagccaacagggagagggagaagaagatcttgaagggcacaaagtactctctgccatcgccttcgcattgcgacgccgatgttgtgaacgatgcatcctcagaggtgagcgacgcagagctgtgctgcatctgcttcgaccaggcatgcaccatcgaggtgcaggactgcgggcaccagatgtgcgcgccgtgcacgctggcgctgtgctgccacagcaagcccaacccgacgacccaaacgctgccgtcgccagcctgcccgttctgccgcggcagcatctcgcggctgctggtggcccggacaagcacgcccagtgaccccgagaaggcaggctactccccgcagctatcccgacggcggtctcggcggtctcacaacctcagcgacgggggcagcagcagcttcaaggggctctcgtccgccatggggtccttgtccaagatcgggcgcggctcgagccggatggtcgacagcgacagtggcagcctggacaagcccgagcacgacctgtgattgtgaagcagaccagccggcgatcatgtggtaaagcggaagcagccgtcaccgccggcggctttccgagagtctcagcaatcccaatccaagcaatgtgtcgggagaggtgatcgtgagtttatatactagataggagctaaataagtagtgtctcgctatgtctcttcgcctgccctatttttccggcgtgccaggattcacctggccgcgccatgttccattgtcaccatcagctatagattccttggcgtcccattcctatgctatgcttgcttgagccacagggcatgtaccatcgatgtaactgtcgggggagctcgcctattc

SEQ ID NO: 16889 - protein, 452 aa, Panicum virgatum
  misc_feature: Ceres CLONE 1790556
  misc_feature (158)..(190): Pfam Name: Ank Pfam Description: Ankyrin repeat
  misc_feature (46)..(78): Pfam Name: Ank Pfam Description: Ankyrin repeat
  misc_feature (195)..(227): Pfam Name: Ank Pfam Description: Ankyrin repeat
  misc_feature (79)..(111): Pfam Name: Ank Pfam Description: Ankyrin repeat
  misc_feature: SWISSPROT Homolog: EC 2.7.11.1 Non-specific serine/threonine protein kinase
MGHGVSCARTGDEHDYFRAVQLGDLDALAALLAADTSLARRATLYDRLSALHIAAANGRLEVLSMILDHGVPPDVVNRHKQTPLMLAAMHGKIDCVIRLLQADANILMFDSVHGRSCLHHAAYFGHVDCLQAILSAAQTTPVADSWGFARFVNVRDDHGATPLHLAARQGRPGCVQMLLEKGAIVSALTGSYGFPGSTSLHLAARSGNLDCIRKLLAWGADRLQRDSAGRIPYAVALKRNYEACAALLNPSSAEPMVWPSPLKFISELDPEAKALLEAALMEANREREKKILKGTKYSLPSPSHCDADVVNDASSEVSDAELCCICFDQACTIEVQDCGHQMCAPCTLALCCHSKPNPTTQTLPSPACPFCRGSISRLLVARTSTPSDPEKAGYSPQLSRRRSRRSHNLSDGGSSSFKGLSSAMGSLSKIGRGSSRMVDSDSGSLDKPEHDL

SEQ ID NO: 16890 - DNA, 2129 bp, Panicum virgatum
  misc_feature: Ceres CLONE 1790559
  misc_feature: Encodes the peptide sequence at SEQ ID NO. 16891
cacgcagcactccccttcccctccttccatcctcggccagtcatcctccccgccggccgccgctggactgccgtgggggtccgtccggctttgcgctgtttccttcttcgttccgttccgcccctccctcggttgaggactggtcttctacaagcatggtatcatggtagagaacggagtacagctgacactgacctccactttgaagagcacaggcaaggcaaaaatcaatggagaggggctgagtaatgggtcacacgaaaaagagaagcaggaacataatggcactcaacaaccatcaaaaggccagaagcagcagctgtgcacaacatgcgcagaaggccatacttgtcaatcggtcattaaccggacaagacaaatgcgagctctaatcgactcaaagaagccttaccaagcgcactctgtatttaagcacctggtagatgaggggcacaagccttcattggtcacatacacaactctactgactgccctgacaaaccagaggatgtttgagtcgattccatcactgcttgctcaagttgagctagctggattgaggccggactccatcttcttcaattccttgatcaatgcatttgtcgaggcgaagcggatgggtgaagcaataaacacgttctggaaaatgaagcattccggctgccatccaacaacaagcaccttcaatacactgataaaagggtatggcattgtaggcaaacctgaagaatcgcagcgcgtcttcgacatgatgggcgttgaagattcagtcaggccaaacctcacaacatacaacattcttgtgaaggcgtggtgtgaccagagaaatcttgaggaggcctggagaattgtgggaaatatgcgagcaggcggtgttgagcccgatatcgtcacttacaataccatagccagcgcatatgccaataatgacgagacatggagagcagaagagctcattgtggagattcagactagagtgcgcaccagcgagagaacatggggcataatcattggtggttattgccgggagggcaggttggaggaggcattcaggtgtgtccggcaaatgaaggatgcaggagtcattcctaacgttgttatcttcaacacattgctcaagggcttcctcgatgcaaatgacatggctgccgtcaataatatccttgggctgatggagcagtttggcatcaaggctgacattgtcacatacagccaccagctgaatacattcagctcagtaggccacatggccgaatgcatgaaggtgttcgacaagatgattgaggcaggaatcgagccagatcctcaggtgtacagcattcttgcaaaaggatacgtccgtgctcagcagcccgagaaagcagaagagctcctgctgcaaatgtgccagcttggtgtctgtccaaatgtcgtcaccttcacaactgtcatcagcgggtggtgcagcgtggccgacatggagagtgccatgagagtctatgagaagatgcgcgaatcaggcgtccatcctaatctcaggacatttgagactctgatatggggttacagcgaacagaagcaaccatggaaagctgaggaagtccttcagatgatgcaggagactggtgtcaagccaaagcaaagcacctacggtctcgttgctgatgcatggaaagcagttggtttgatagagaatgccaaccaggcaaacagttccttaaatggtcgccatgcgatcgacaattcagatcattcacatgacagtagtaacctgcaaatatcagaagacgataacaaactgcgaagttttgaaaaaagtaatggacatggaatgaatggtaggtcacgctccagttttcttcagatgacaagcgcacttggtagcagtggtttagtttcttccaagatactgaaggctggagaatttccatccaaaagattgaaagccgttaataaaacatccttgctacaaagttcgtacctgtttcaattgcggtattctgggttttgtagaaagcagcttcagaagaatggtggattctacagtcagagtgtcagctcattcaaaatggtgttcctctagtagaggctgaatttttttaatagatgtacacattggcctgaagctgtaagcaaatcttggtgttccg

SEQ ID NO: 16891 - protein, 632 aa, Panicum virgatum
  misc_feature: Ceres CLONE 1790559
  misc_feature (277)..(311): Pfam Name: PPR Pfam Description: PPR repeat
  misc_feature (417)..(451): Pfam Name: PPR Pfam Description: PPR repeat
  misc_feature (208)..(242): Pfam Name: PPR Pfam Description: PPR repeat
  misc_feature (137)..(171): Pfam Name: PPR Pfam Description: PPR repeat
  misc_feature (347)..(381): Pfam Name: PPR Pfam Description: PPR repeat
  misc_feature (382)..(416): Pfam Name: PPR Pfam Description: PPR repeat
  misc_feature (452)..(486): Pfam Name: PPR Pfam Description: PPR repeat
  misc_feature (172)..(206): Pfam Name: PPR Pfam Description: PPR repeat
  misc_feature (312)..(346): Pfam Name: PPR Pfam Description: PPR repeat
MVENGVQLTLTSTLKSTGKAKINGEGLSNGSHEKEKQEHNGTQQPSKGQKQQLCTTCAEGHTCQSVINRTRQMRALIDSKKPYQAHSVFKHLVDEGHKPSLVTYTTLLTALTNQRMFESIPSLLAQVELAGLRPDSIFFNSLINAFVEAKRMGEAINTFWKMKHSGCHPTTSTFNTLIKGYGIVGKPEESQRVFDMMGVEDSVRPNLTTYNILVKAWCDQRNLEEAWRIVGNMRAGGVEPDIVTYNTIASAYANNDETWRAEELIVEIQTRVRTSERTWGIIIGGYCREGRLEEAFRCVRQMKDAGVIPNVVIFNTLLKGFLDANDMAAVNNILGLMEQFGIKADIVTYSHQLNTFSSVGHMAECMKVFDKMIEAGIEPDPQVYSILAKGYVRAQQPEKAEELLLQMCQLGVCPNVVTFTTVISGWCSVADMESAMRVYEKMRESGVHPNLRTFETLIWGYSEQKQPWKAEEVLQMMQETGVKPKQSTYGLVADAWKAVGLIENANQANSSLNGRHAIDNSDHSHDSSNLQISEDDNKLRSFEKSNGHGMNGRSRSSFLQMTSALGSSGLVSSKILKAGEFPSKRLKAVNKTSLLQSSYLFQLRYSGFCRKQLQKNGGFYSQSVSSFKMVFL

SEQ ID NO: 16892 - DNA, 2597 bp, Panicum virgatum
  misc_feature: Ceres CLONE 1790561
  misc_feature: Encodes the peptide sequence at SEQ ID NO. 16893
agatcctcctcacacgacattctctctctacatcctctgcttccctctcgctcttcctcctctgccgctgcctctggccccggcggagtctgctgcttcccttgctcgcctcgcctcggcttcctcctcctcctctctttactccaactgctcccactcctcaaccaactccactccctcactctcatttccgcccttcatccccatgtgcccgtgctgagcggcagcggcggtgcccagcagcggcgcgccacccatggctccgtgaaccacttcgcgcgccgctctccaggactcttcactcgtcgtgatcaagctgggggttagcgatttggcaccactagcttagtgtcgccgcttagtcttggacatgacttggcgcggggctgcggcggcgccggtgccggtgccgagcctcctgcaggtcctcctcgccttgcactgcggggtcgtgttcctgcaatgctccgcggcctctgccatgagcggcgatgtgtcggcgctcatggcattcaaacgcgcaatcatcgaggatcctcactccgtgctatcagactggactgatgcggacggcaacgcctgtgactggcacggcgtgatctgctccgcgccgcagggctccgtcatctcgctgaagctatcaaactcatctctcaagggattcattgcacctgaacttggacggcttaatttcttgcaagagctgtatttggatcataacctgttctttggtacaattccgaaactaattggctcactgaggaacttgagggttctggatttgagtgttaatcggctcactggccctatcccatccaagttaggcgggttgagcagcgtgagcgtaataaatttccattcaaatgggttgagtgggaaaataccatcggagttgggaaaactacagaacctcgttgagttgaggttggacaggaatagattgaagggatcaattccgggaagcaaaactggcagtttttctcctacttcaagtatcggatccacagctcacaatggactatgcccttctcctcgattatatgttggggatttctcttacaactttcttgttggaaaaattccatcctgcttgaaatatctaccaaggtcaagtttccaaggaaattgcttccaggatgagtactctacccaacagcgagctttgcaaatttgtatgagtggttctactggccagcgaggtggcataaatggatccaaacatcctgtacataagcatgaaagaatgccgcaaccaacttggcttcttgttttagaaattgcaactggcgttcttctggttgtctttgtgattactggtattgttactgcttccagaagctgcaagctgaagccttctataagaatatcctcatggaatcaatcaaagagttggagcgatgagataacagtgttaattgattctgatatgctgaaaagtttaccaaaactaagtcgccaggagcttgaagtagcttgtgaggattttagcaacattattggctcgtctcctgagacagtagtctacaaaggaaccatgaaggatgggcctgaagtttctgtcatatcattatgcgcctttgaaggtcattggactagccaccatgaactcttttaccaaaataaggttattgatctgtcaagattgaatcatgagaacatagcaaagtttctaggctactgcagagagagtgatccattctcaaggatgctagtctttgagtatgcatcaaatgggaccttatttgaacatctacattatggagatggagcccagttatcttggctcaggcggatgaaaatagccattggaatcgcccagggtctaagatacttgcataccgagttgcagcccccatttgctatatctgagctgaattcgaattccgtatatgttacagaagattttacaccaaagctggttgatttcgagtgctggaaaatgatgttttcgaaacatgagaaggctccgaaccacttcaatagtaaaggttctttccctggtcatggggattctgcggaggataaacatgcagatatccaaggcaacacgtatgctttcggggtgattttactggagattatcagtggacggctcccgtactgcaaggataaaggatatttggttgactgggctaccaagttcctccagcagcctgaggagatcgggaagctagtcgaccccgagctgagcaacgtgaggacagaggacctcgcggtcctatgcagcgtggtgagtcggtgcatcgaccctgacccttccaagagaccgtcgatgcagatcatcacgggcgtgctggagaacgggatcgacctgtcggcggccgccatcctcaaggaatcgtcgctggcatgggccgagctcgccctggcgttgtgacatgccctgcctttccgtcagtcaccatgtaaatccatcgtcacgcacactaatattagccgtggttgtctgcttgacgtatagagagagtgagagagggcctttggctgcggccaacaagcaggagctagctgctcaggttggcgcacgacactgatttgtttcgactgatgtaatacgatttgatatagctgatggtgtgtcggggaggcattgcgcc

SEQ ID NO: 16893 - protein, 668 aa, Panicum virgatum
  misc_feature: Ceres CLONE 1790561
  misc_feature (38)..(79): Pfam Name: LRRNT_2 Pfam Description: Leucine rich repeat N-terminal domain
  misc_feature (371)..(642): Pfam Name: Pkinase_Tyr Pfam Description: Protein tyrosine kinase
  misc_feature (357)..(635): SWISSPROT Homolog: EC 2.7.11.1 Non-specific serine/threonine protein kinase
  misc_feature (88)..(189): SWISSPROT Homolog: EC 3.1.13.4 Poly(A)-specific ribonuclease
MTWRGAAAAPVPVPSLLQVLLALHCGVVFLQCSAASAMSGDVSALMAFKRAIIEDPHSVLSDWTDADGNACDWHGVICSAPQGSVISLKLSNSSLKGFIAPELGRLNFLQELYLDHNLFFGTIPKLIGSLRNLRVLDLSVNRLTGPIPSKLGGLSSVSVINFHSNGLSGKIPSELGKLQNLVELRLDRNRLKGSIPGSKTGSFSPTSSIGSTAHNGLCPSPRLYVGDFSYNFLVGKIPSCLKYLPRSSFQGNCFQDEYSTQQRALQICMSGSTGQRGGINGSKHPVHKHERMPQPTWLLVLEIATGVLLVVFVITGIVTASRSCKLKPSIRISSWNQSKSWSDEITVLIDSDMLKSLPKLSRQELEVACEDFSNIIGSSPETVVYKGTMKDGPEVSVISLCAFEGHWTSHHELFYQNKVIDLSRLNHENIAKFLGYCRESDPFSRMLVFEYASNGTLFEHLHYGDGAQLSWLRRMKIAIGIAQGLRYLHTELQPPFAISELNSNSVYVTEDFTPKLVDFECWKMMFSKHEKAPNHFNSKGSFPGHGDSAEDKHADIQGNTYAFGVILLEIISGRLPYCKDKGYLVDWATKFLQQPEEIGKLVDPELSNVRTEDLAVLCSVVSRCIDPDPSKRPSMQIITGVLENGIDLSAAAILKESSLAWAELALAL

SEQ ID NO: 16894 - DNA, 2071 bp, Panicum virgatum
  misc_feature: Ceres CLONE 1790563
  misc_feature: Encodes the peptide sequence at SEQ ID NO. 16895
cccttccaatctgaaattctccacccaaccctagccgcccgccgccatggccgaatccggcgactcgtccccgcactccgccgcggccacggacgacacgcaccatgacggctcggagtccgcggcggcggcggtgacggcggcggggcacgcgccgcctctgccgccggcgaaggtgcggctgatggtgagctacggggggcgtatccagccgcggccccacgacaaccagctcgcctacgtcaacggcgagaccaagatcctgtcgctcgagaggccgctccgcttcgccgacttcgccgcacgcctcgccgcgctcgccgggaacctgggggacatctgcgtcaagtaccagctgccaggggaggatctcgacgcgctcgtctccgtcactaacgacgaggatctggagcacctcgtcctcgagtacgaccgcctccacctgctccgccccgcgccgggctccggcggcggctccaaccgcggatccacgctccggctgagggtcttcctcttccccgtccagtcgcccccgccgccgccgcagccggccggcctcctcgagcccaagccggagcgccactggttcgtcgaggcgctcaacaacgtcccgcagccgaagcaggagacgtcgccttcgcccgtccccgcgcagcagtcgccgccgcagcagaagcatgagtcggtgttcgcgcagcagtcgtcgccgccgcaggcgaagcatgagatggtgttcgttcagcagcctccaccacagacgctggtgcacatgccgccgcctcctcagccgcacatggtgcttgcggcggcgagccccgactacctgttcggcctcgacaacggcttcgtgcctcccccggtggtgaaggtgaaggacccggccggcgagcctccgacgatgagggagaatgtccccgtcgagttacccgccaaaaacgacgaccgccatcccaaccccgcgggcgagcacgtcgcggtctcccctgtcgtctcccctgccgagttccagcgccagatccaggagctcgagaagctgcaggttgcggaaaacggcacccaccaaccacctccagcgccagcgcctgctccggccgccgcccccgctcctgccccggtgcccgcacccgccgcccttccgaggaacgggagcgacgactccctcacccgcgcgtaccctcccgcgaccgccaccccacccgccaacgcggagtactaccttcccaagttcccggagaagcccccagttccaccgccgtcatccgctcctcctgcgacggcgtacctgcaggtgccgggcaggtatacatccgttgcccctggctccggcgcggaccatgcccccgtgttcttcatcccggcgccccatggctacttcgccgccaccgcctccccaggtgcgacctccttcccggccgtgtacgccgtcgcgccacccaatgccaacgcccacgggaacggctccgccccttcgcccgcggtgtcgaatgcgacggcctacgccccagccccgcaggtagcgtacgacagcaacggccgcgccatctactacaccagcatgctcccccagtatccttctgctgtcaatggcatgtcggcggcgggtgccgtactcggcacagagcccgcgaagccggtggctgtgaagccgaccgtctcttgattgaacaccacagattacctcaccttacctatcaccgcccatggatcaaaggagttttccaaattttctttcatccgtcgcccgtcaatatccgttaataccgtgtcagttggattcgttattgtctctagtattcacctatattttttcctctcctttttaattgtctagagttttttggtttggcgttctgggtctatgatatgatgcaaaaacgttctttggtgtgcttagatgtacatacagagtctgtggacataatggataagtattatattagcttattattggagagttgagttccagtcgagttgttaacaatcttgaggtgtcagcttctatttgttaattctttgggggttgctgtatcgattaatgtcagaggttcaatgcgggctaattggccatgtg

SEQ ID NO: 16895 - protein, 537 aa, Panicum virgatum
  misc_feature: Ceres CLONE 1790563
  misc_feature (58)..(159): Pfam Name: PB1 Pfam Description: PB1 domain
MAESGDSSPHSAAATDDTHHDGSESAAAAVTAAGHAPPLPPAKVRLMVSYGGRIQPRPHDNQLAYVNGETKILSLERPLRFADFAARLAALAGNLGDICVKYQLPGEDLDALVSVTNDEDLEHLVLEYDRLHLLRPAPGSGGGSNRGSTLRLRVFLFPVQSPPPPPQPAGLLEPKPERHWFVEALNNVPQPKQETSPSPVPAQQSPPQQKHESVFAQQSSPPQAKHEMVFVQQPPPQTLVHMPPPPQPHMVLAAASPDYLFGLDNGFVPPPVVKVKDPAGEPPTMRENVPVELPAKNDDRHPNPAGEHVAVSPVVSPAEFQRQIQELEKLQVAENGTHQPPPAPAPAPAAAPAPAPVPAPAALPRNGSDDSLTRAYPPATATPPANAEYYLPKFPEKPPVPPPSSAPPATAYLQVPGRYTSVAPGSGADHAPVFFIPAPHGYFAATASPGATSFPAVYAVAPPNANAHGNGSAPSPAVSNATAYAPAPQVAYDSNGRAIYYTSMLPQYPSAVNGMSAAGAVLGTEPAKPVAVKPTVS

SEQ ID NO: 16896 - DNA, 1478 bp, Panicum virgatum
  misc_feature: Ceres CLONE 1790564
  misc_feature: Encodes the peptide sequence at SEQ ID NO. 16897
atctcgtcccacgccctcgcgtcggtaaacttccgtctcctcccacgcctcaatcttccattcccccgaaaccctaaccgccacttggccccttcccggagcggccgagcccctcgccatcctaggcttcgggcgggagcccgctgcgcgtgggctgcggcggagaatcggagatggcctcgtcgtcggcgtcctcgaggcaccaggtcaccatcaccctcggccgcagcggtcaggttgtcaaaaggagggctgtatctgatgttactaatggtgatgaagtgccattgtcggggaaaaaacgatctttgagggagaggttaggaagtaatgtgactgattctgatttttatgaaagctggcatggaaacaaaaggcaacagacagagagtgatagctcacatggagatgatggttcagatcgccaggttggcaaggatgatctgagactgaaacttatgaggaaaggcttgttacagaggagcaatggtggtgcagaacagaatggagtggatctcagggaaaagctttcccgaaatcagaagaatttgtcgagatacgatgcaagaggccatgcaccagaatcaagggctaggtatgatatgagagacaatcctccagagttaaggtttagatattcttcgagggaggctgtcctaggatcaaggcccccctctgctgttgtaagtcgagttccttctgcaagaagtgcggatgatttgttgaagatggagtcttcaagaaaaccttacccctcatggacagctgatggtttgaggcacagatcacctgaaaggcttacaagaattcggggtgatgcatctccaccaagagcttatgataagattatgtctatgccatcccttagatctgttggttcctcaagacctcagagttttattacaagagatgctcatgacacatcaagagctcaaccatattctggcaaatccaccatttctgtcgatgcaatacagagagctaatggaatcacttcgcctagtgcagctctgcctacagcccctgttgtgaaagaagtcccgcaaacggttactgaattgctgaattctctgggactggagaagtatcttgttctctttcaggccgaggaggtggatatggctgcattgaagcaaatgggagagagtgacctcaaggacatgggggtaccaatgggcccgaggaagaagattctccttgcactaggtcctcggtcgaagcaacggcaaagatgagcagcatgatctgtaacttggaaactgaaaacatttgtttggcaactgcaaattattggtgtaactaaagaatgccttactgcagatcttgtatatctttagtgtccgtcttagttgctgatcgattaagttcgtgcctttgttgacacgtgtaaagtcttgtctgtcagctattagagtagcagtctcgaaacaggtggataattaccagtctggaatttggtggggtatattagaacggcc

SEQ ID NO: 16897 - protein, 353 aa, Panicum virgatum
  misc_feature: Ceres CLONE 1790564
  misc_feature (288)..(347): Pfam Name: SAM_1 Pfam Description: SAM domain (Sterile alpha motif)
MASSSASSRHQVTITLGRSGQVVKRRAVSDVTNGDEVPLSGKKRSLRERLGSNVTDSDFYESWHGNKRQQTESDSSHGDDGSDRQVGKDDLRLKLMRKGLLQRSNGGAEQNGVDLREKLSRNQKNLSRYDARGHAPESRARYDMRDNPPELRFRYSSREAVLGSRPPSAVVSRVPSARSADDLLKMESSRKPYPSWTADGLRHRSPERLTRIRGDASPPRAYDKIMSMPSLRSVGSSRPQSFITRDAHDTSRAQPYSGKSTISVDAIQRANGITSPSAALPTAPVVKEVPQTVTELLNSLGLEKYLVLFQAEEVDMAALKQMGESDLKDMGVPMGPRKKILLALGPRSKQRQR

SEQ ID NO: 16898 - DNA, 1324 bp, Panicum virgatum
  misc_feature: Ceres CLONE 1790573
  misc_feature: Encodes the peptide sequence at SEQ ID NO. 16899
ttccctctactgcaccgagttctcctcttctccttcccggccgcgccacgcacggcacgccatcgccgcggcggaggcccgcgagaccggccggccagcgccggccttgtcgcggctcccaggtgactcccgcgatcggccccccgccggcgccgcggcgcacggctcgactgaagtagcggcgcccccgccccctggttgcgggtgtcgaggatgagcgggaggaagaatgccggcaggacctccccctggctgctcatcctcatctccgcagggtgcttcttcgcgacctataacttcctgacgatgcacggccggggccgggacgcgccgcgcaagcggttccacgttgcgctgacggcgacggacgcgctctacagccagtggcagtcccggatcatgcactactggtacaaggagatgagggacggccccggctccgacatgggcggcttcacacggatccttcactcggggaaacctgatgggttgatggacgagatacccaccatggtggtggacccgcttcctgaaggcacggataagggatacattgtcttaaataggccttgggcatttgtccagtggctgcagagagcaaagattgatgaagagtatatactaatggcggagccagatcatgtctttgtgaagcctttgccaaacttagctcatggtgatgaaccagcggcgtttccatttttctacatcaacccaactcagaatgagaagatattgcggaagttttttccagaagaaaaagggcctgtctcaaaaattgatcctattggcaactctccagttataataaagaaggcccaacttgagaagattgctccaacctggatgaatgtttcattaaaaatgaaagaggatcaggatacagacaaagcttttggatgggtcttggaaatgtatgcatatgctgttgctagtgcactgcatggtgtgcaccatagtctccgtaaagatttcatgattcaggtgctaagtcttgtcactagataattaatcgcatattgaagtgatggcagtttatatcattaaagatgtgcttgataataactgcagcctccttgggacctaaaaacagacaacacattcattatccattatacatatggatgtgattatacaatgaagggtcagctaacttatgggaaaattggtgaatggcgttttgacaaaagatcttatcttgaatcaccaccaccaagaaatctttcactaccccctcctggagttcctgaaagtgtggccacccttgtgaagatggtgaatgaggccactgcaaacattccagggtgggaggatgagagataat

SEQ ID NO: 16899 - protein, 264 aa, Panicum virgatum
  misc_feature: Ceres CLONE 1790573
  misc_feature: Useful for making plants with modulated drought sensitivity
MSGRKNAGRTSPWLLILISAGCFFATYNFLTMHGRGRDAPRKRFHVALTATDALYSQWQSRIMHYWYKEMRDGPGSDMGGFTRILHSGKPDGLMDEIPTMVVDPLPEGTDKGYIVLNRPWAFVQWLQRAKIDEEYILMAEPDHVFVKPLPNLAHGDEPAAFPFFYINPTQNEKILRKFFPEEKGPVSKIDPIGNSPVIIKKAQLEKIAPTWMNVSLKMKEDQDTDKAFGWVLEMYAYAVASALHGVHHSLRKDFMIQVLSLVTR

SEQ ID NO: 16900 - DNA, 614 bp, Panicum virgatum
  misc_feature: Ceres CLONE 1790573-R
tagcttattttagctcctagctggtatggtttttgttggaaaacatagaggaataccacgggtgaataaaagaagagtgttcaattcatatctgaagtctaggactgtgtccaattttccacagtttaacctaggttagtgttcgggaagaaaaagatatattcactttgatctagtgagttgcatcgtttttgtattgtaaagcagaaatataggcttctggctacttttggttcatttagttagccgtgttgtaaagcagagatgtagtttagacttcagagtcctccaaccatgagaggtttgttattagtcatcttgggaaaagttctggtggatgctgccaacatcctgctgagtgctatcactggaaaccaccaaagactttcagaaataatctagtgtacctagataaaaatatttgatgatcaggttttttgctttcgaacctatgtgtgtaatacagctgttgtctttgtagtacttactgtactactactattttcttctgcccagaatacagatgctgccgtctaatctggaaagagggcctctgcacagtcaggattgtattaccacccatgacccatcaatgtgtgccataattgtggatg

SEQ ID NO: 16901 - DNA, 1601 bp, Panicum virgatum
  misc_feature: Ceres CLONE 1790583
  misc_feature: Encodes the peptide sequence at SEQ ID NO. 16902
aaccgcgtcgcgtgtccaaaacattctgtggcctgctggagggcagcaccaggtatcatcagtctactagtgtccaccaccctacttcccgttacgagaagcactcgcgggcaccagctcagctttacctcccgcgccgcgaccggaaaccagagcagcgcccgcgccgagcataaagccggcgctcgtggcattccgatcccctgttcggttctattgttctgttctgttctcttctcttctcccgagtgaagccaattcgagccttctcgtcttcgacctcgagctcggtccgtggccgtcgccatgaggagcgccgcgcccctgtccctcgccttgctcctactcctcctcgcagtgccgtccccggctcgcggctgcgaccgctgcgtgcgccgctccaaggccacctaccaggcctcctcgctcgccctcaacgccggttcttgcgggtacggctccctggccgcgtccttgaacggcggcctcctcgccgcggcgggccccgtgctctaccggggcggcgtcggctgcggcgcctgcttccaggtgcggtgcggggacagcgagctgtgcagcgccgccggcgccaaggtggtggtgacggaccaggcgcggacctcgaaccgcaccggcctggtgctcagcggcgcggcgtacgcggccatggcccgcgccggcagggccgcgcggctcatggcgcggcgcgtcgtcgacgtcgagtacaagaggtaggtgcccgcccgcccaaccccttgtcgccgcccgcggtgccgtgcgcaagtacggcgtgtctcggcgtcggtattgtgcgtgcgtcacctcagctccgctcgcacgtgccgaggatgcagaggacagccgagttttttttttcttttggccgtaggggagaagaattagcatctgatctgagtttttcgtggggacaggatcccgtgcgagtacgcgaaccgcaacctgtcgatccgcgtggaggagaagagccggccgccgagcgagctgtccatccggttcctctaccagggcggccagaccgacatcgtcgccgtcgacgtcgccacggtaagcagcaactcccccggccgctccagacaaagattgagagctgagggcagcgaagcaacgctccgattcggcggcggttgattgacgtggttgccggtgtggttttttgttgctggcacgcaggtggggtcgtccaactggcggttcatgacgcgggagcacgggccggcgtggagcacggcgcaggcgccggcggggccgctgcagctccggctggtggtgaccggcgggtacgacggcaagtgggtgtgggcggagtcggatgcgctgcggcggcggtgggaggccggccgcgtctacgacaccggggtgcaggtcgcggacgtcgcgcaggaagggtgctacccctgcgacacgcgcgagtggcagtgacgcgagcgcgcacacagcctggactgtaaaactgtacatcccttttttttgcttttttctgtctttttctggaccgtccgtttttggacggatggacggatgaatggatgaaattacggaatgatgaatcgaatcggagagtcaaacgtgccgttgcgact

SEQ ID NO: 16902 - protein, 142 aa, Panicum virgatum
  misc_feature: Ceres CLONE 1790583
  misc_feature (62)..(140): Pfam Name: DPBB_1 Pfam Description: Rare lipoprotein A (RlpA)-like double-psi beta-barrel
  misc_feature: Useful for making plants with altered carbohydrate content
  misc_feature: Useful for making plants with altered cell wall content and/or composition
MRSAAPLSLALLLLLLAVPSPARGCDRCVRRSKATYQASSLALNAGSCGYGSLAASLNGGLLAAAGPVLYRGGVGCGACFQVRCGDSELCSAAGAKVVVTDQARTSNRTGLVLSGAAYAAMARAGRAARLMARRVVDVEYKR

SEQ ID NO: 16903 - DNA, 715 bp, Panicum virgatum
  misc_feature: Ceres CLONE 1790613
  misc_feature: Encodes the peptide sequence at SEQ ID NO. 16904
cttcgcccgccgccgcctcccccgtcctcctcgccgccgtagactaggttaggctagggtttcgacgagctcgcggacatggtggccttcaggttccatcagtaccaggtggtggggcgtgcgcttccgacgcctggcgatgagcaccccaagatctaccgcatgaagctctgggccaccaacgaggttcgggccaagagcaagttctggtacttcctgaggaagctcaagaaggttaagaagagcaacggccagatcctcgccatcaacgagatctttgagcgtaacccaactacaatcaagaactacggcatctggctccgctaccagagcagaaccggctaccacaacatgtacaaggagtaccgggacaccaccctgaacggtgcagtggagcagatgtacaatgagatggcttcgcgccaccgcgtgagggccccctgcatccagatcatcaagaccgcgacggtccacttcgagctgctcaagaaggacaacacctacgtctacatgtgcgggctcaaggggatggagaagggcatcgacgacatcatggtcgacctcgcagccaaggacgggatcgactggattgagtacaagaagcagctcaagaagggcgagcaatggaacgtcgaagtctactaaaccatcatgcatgcatattctcactagctagctagcaccatcttatatatgctgcatatatagtacgtac

SEQ ID NO: 16904 - protein, 188 aa, Panicum virgatum
  misc_feature: Ceres CLONE 1790613
  misc_feature: SWISSPROT Homolog: EC 1.18.1.2 Ferredoxin--NADP(+) reductase
MVAFRFHQYQVVGRALPTPGDEHPKIYRMKLWATNEVRAKSKFWYFLRKLKKVKKSNGQILAINEIFERNPTTIKNYGIWLRYQSRTGYHNMYKEYRDTTLNGAVEQMYNEMASRHRVRAPCIQIIKTATVHFELLKKDNTYVYMCGLKGMEKGIDDIMVDLAAKDGIDWIEYKKQLKKGEQWNVEVY

SEQ ID NO: 16905 - DNA, 678 bp, Panicum virgatum
  misc_feature: Ceres CLONE 1790613-R
  misc_feature: Encodes the peptide sequence at SEQ ID NO. 16906
tctgctccaactacctatgtgacctgaagcccggcgctgaggtgaagatcacagggccagtcggcaaggagatgctcatgcccaaagaccccaacgcaacagtcattatgctggcgacgggtaccggtatcgcccccttccgctccttcttgtggaagatgttcttcgagaagcacgacgactacaagtacaacggcctggcctggctgttcttgggagtcccgacgagcgacaccctgctgtacaaggaggagctggagaagatgaaggagatggcgccggacaacttccggctggacttcgcggtgagccgggagcagacgaacgcggcgggggagaagatgtatatccagacgcggatggccgagtacaaggaggagctgtgggagctgctcaagaaggacaacacctacgtctacatgtgcgggctcaaggggatggagaagggcatcgacgacatcatggtcgacctcgcagccaaggacgggatcgactggattgagtacaagaagcagctcaagaagggcgagcaatggaacgtcgaagtctactaaaccatcatgcatgcatattctcactagctagctagcaccatcttatatatgctgcatatatagtacgtacatacaggcgcacgtcagtacatacaccacattatatccatcattttgttgtgcc

SEQ ID NO: 16906 - protein, 183 aa, Panicum virgatum
  misc_feature: Ceres CLONE 1790613-R
  misc_feature (35)..(152): Pfam Name: NAD_binding_1 Pfam Description: Oxidoreductase NAD-binding domain
  misc_feature: SWISSPROT Homolog: EC 1.18.1.2 Ferredoxin--NADP(+) reductase
CSNYLCDLKPGAEVKITGPVGKEMLMPKDPNATVIMLATGTGIAPFRSFLWKMFFEKHDDYKYNGLAWLFLGVPTSDTLLYKEELEKMKEMAPDNFRLDFAVSREQTNAAGEKMYIQTRMAEYKEELWELLKKDNTYVYMCGLKGMEKGIDDIMVDLAAKDGIDWIEYKKQLKKGEQWNVEVY

SEQ ID NO: 16907 - DNA, 1575 bp, Panicum virgatum
  misc_feature: Ceres CLONE 1790616
  misc_feature: Encodes the peptide sequence at SEQ ID NO. 16908
gcctcggctcctcgcgtttttccgtttcgccccctccactgttccaataataataaaagaacattctcgattcagtttcctcgaatttcttccggccagcggcggcgatcggctccgattcggcgcggctcggcggggcggcggagatggttgccgtggcggcggagggcccgatccgcggcgcggatgccgtgccggcggcggagagggaggcggcggccgcggccgcggccgcggccgacgccgcggccaagggcggtgatgcggaggtggggaaggaggaggtgagggagtacgagagcgacatgaggaagctggaggagctgctctcgaagctgaacccctcggcggaggaattcgtgccgctctcgcgccgccgcggggacggggacggcggcgcccgccgcctctcggccgacgcgcccgtgttcgtgtcgccggcgatcgactactacgcgcgccaccaccagctccctccgccgccgcagcagcagccgctgcacgtgctgcagctcgtgggcgccgtcggcggcgttggtatgggcaatggcggggggagggactccagcagcgatggatccaccaacggccagccgaatcgacggagaaggaatggcttcttccaagggaggagaaggatgacgggaggccggcctcgtcgagctgatagggaggacagtgtgcggcgaacagtctatgtctctgacattgatcagcatgtaactgaacagaaactggctgaagttttttcgacctgtggacaggtggtagattgccgtatctgtggtgatcctagctcagtgctgcgttttgcattcatcgagtttgcagatgatgtcggtgcaagaacagcactaacacttggtggaaccatgcttggtttttatcctgtcaaagttttgccatcaaagacagcgattttacctgtgaaccccaaatttcttcctcgaactgaggatgagaaagaaatggtatccaggactgtatattgtactaacattgacaagaaggttggagaagatgaagtgaaacaattctttgagggaacatgtggtgaagtttctcggctgaggctacttggtgattatgtgcattccacatgcattgccttcgttgagtttgtccaagcagatagtgctattctagctctgaactgcagtggcatggttcttggcacgcttcctgtcagggtgagcccgtcaaagacaccagtccgccctcgttcgccccgtgtgacgtcgtactgaatccggctttgtgtgaagccgtcgtccaggggcagcagcaagcctatagtcgcgcagccttagagactgtcgcgtcgcggatcagcaattgtcgttgaagagagttgtcgttgattaaaacctagttgtctagttgaaagcccctcgctgatgtttctcggatcagagacccatctgtatggttgctgggagcgctattttgacctccttgttctttctttgatctttgttgattatggatggatgcaacagcagccttgaacaggcattcgaacaaataatgtctatggcttctgttattcgcgtttatctgatcaatcttattctc

SEQ ID NO: 16908 - protein, 366 aa, Panicum virgatum
  misc_feature: Ceres CLONE 1790616
  misc_feature (183)..(251): Pfam Name: RRM_1 Pfam Description: RNA recognition motif. (a.k.a. RRM, RBD, or RNP domain)
  misc_feature (280)..(349): Pfam Name: RRM_1 Pfam Description: RNA recognition motif. (a.k.a. RRM, RBD, or RNP domain)
  misc_feature: The sequence is a functional homolog of SEQ ID NO 1301 in the 10/666,642 US patent application
MVAVAAEGPIRGADAVPAAEREAAAAAAAAADAAAKGGDAEVGKEEVREYESDMRKLEELLSKLNPSAEEFVPLSRRRGDGDGGARRLSADAPVFVSPAIDYYARHHQLPPPPQQQPLHVLQLVGAVGGVGMGNGGGRDSSSDGSTNGQPNRRRRNGFFQGRRRMTGGRPRRADREDSVRRTVYVSDIDQHVTEQKLAEVFSTCGQVVDCRICGDPSSVLRFAFIEFADDVGARTALTLGGTMLGFYPVKVLPSKTAILPVNPKFLPRTEDEKEMVSRTVYCTNIDKKVGEDEVKQFFEGTCGEVSRLRLLGDYVHSTCIAFVEFVQADSAILALNCSGMVLGTLPVRVSPSKTPVRPRSPRVTSY

SEQ ID NO: 16909 - DNA, 660 bp, Panicum virgatum
  misc_feature: Ceres CLONE 1790617
  misc_feature: Encodes the peptide sequence at SEQ ID NO. 16910
tttgtgccatggatcatctggtgctttcagaaggactacgaaggggcaatgggtccatgctttctgtgctgagtggctgttggagaccacattcagaagagggcaacataatgcagttgatggaatggagaggcttcacaaggataaagatgcatgctctatatgccaccgctatgttggtgcatgcttgaagtgcagcacagcagactgtcaaattactttccatcctccatgtgctagagatgctggtttttacatgaacacaaagagaatcggtaatatgttacaacataaagcatactgcggcagacacagcatcgagcagagaaaggcttttcgtcagcaatatggacctgaggatgtcaagagcatgaaacaaatgagggttgaattggaattgttacgcttcctttgtgagaggattatgaagagagagaaagtgaagaaggatttggttgtatgcgaacatgacatactcgctgcaagaaggatgacttctgtctcgtctacgtggagttcttattatgcatctggaccgggagcaagttcagaatctgccactacatctgttaataacaaatcatatagtggaacgatgcaaagatccgatgatgtcacagtgagatcagatgatgtcacagtggacagcactgttaccag

SEQ ID NO: 16910 - protein, 219 aa, Panicum virgatum
  misc_feature: Ceres CLONE 1790617
  misc_feature: SWISSPROT Homolog: EC 2.1.1.43 Histone-lysine N-methyltransferase
LCHGSSGAFRRTTKGQWVHAFCAEWLLETTFRRGQHNAVDGMERLHKDKDACSICHRYVGACLKCSTADCQITFHPPCARDAGFYMNTKRIGNMLQHKAYCGRHSIEQRKAFRQQYGPEDVKSMKQMRVELELLRFLCERIMKREKVKKDLVVCEHDILAARRMTSVSSTWSSYYASGPGASSESATTSVNNKSYSGTMQRSDDVTVRSDDVTVDSTVT

SEQ ID NO: 16911 - DNA, 2010 bp, Panicum virgatum
  misc_feature: Ceres CLONE 1790624
  misc_feature: Encodes the peptide sequence at SEQ ID NO. 16912
gataaacgccgcacggctcctctccgtctccggtctccgcgacgcgagcgctcctctcctctcgtcgcacccgaatccggcgccgccccacctcgtcgcccagagccccagcccgcctcccgggcgggagctcctcgccggggtcgtggcctcgggcctcccctcatctccctccctcagattccgagcggtcttatcggtgcggttgtagcgaatggatcggactgctgctgggacggcgcgtcgcgcagcttgagaaaatatggatggaccagtagagaactttgtgggacatgatgttggcgggatgcctggaaatccttacgatggagaacaaccaaacccatatgaggatgtggagaagcagtacggtgaagagctgggaaacacatatgccgaacaacctggtgcccggtacaatgatgggtctgagaatctgtacaatgaagagcagggaaacttgtacagcaaggagaccgggaatcagtacaatgagaagccggcaaattcttaccaggaagagctggagaatgcatacactggggacaggagtcagcaggacaattcacagattaatgttgaggataacagatggcctggttggccaggagagagtgtttttcgtatactggttccagcccagaaggtaggggctatcattggccgcaaaggggagtttatcaaaaagatgtgtgaggagtccaaagcgcgcatcaaaatacttgatggcccacctggtgtaccagaaagagtagtaatgatttcagcaaaggatgaaccagatgcaccggtatctccagctatggatggcttacttagagttcataaaagaataactgatagttcagatggggaatctggtcagcctcaacgaagtgctggtaatatcggaccgacacgacttctagttccagcatcgcaagctggcagccttattggaaagcagggagcaactattaaatccatacaggattcttcaaagtgtgctgtacgtattgttgagaatgttcctcctgtcgcattaaatgatgacagagttgtggagatacaaggcgagtctcttggtgtccacaaagcagtggaattaatagcaagtcacttaagaaagtttcttgtcgaccgcagtgttcttccactatttgaaacacatatgaaaatgcacagtatgcagagggagcaaccaatgccacctccccagcactgggggcctcctcaaccctggggccctcctccaaacctacctccaggtggtccaggttttggtggaaattcgcaattcatgcctccaaggccgcaagacagttattatcctcctcctgatgtcccccctgtgcctgtggaaaagcagccacactatggtatttctgcatatggacgtgaggccccaccaagcggtgttcctgctgcaggaaatcaaccacgctctcatgcaggttctcaggtgacacataacatgcacattccccttgcctacgctgatgctgtgattggggcagctggtgctagtatcagctatatccgtaggcacagtggcgcaactgtaactattcaagaaagcagaggcgcacctggagagatgactgtggagataattgggactgcatcccaagttcaaaccgcccaacaactggtccagaatttcatggcagaagctgctcccccaggcccaccagcagcttctaaccctccagcaccgccagtagatccgagctacgcatcttacccagcaccatatggaggtgctccgtcctatggttcttcagctgccgccgggccgcctccgcagtacaacggagggagctatggtggcccgacctaccctcccagctatggttattagggagtagcagtaagccaagggtttgatttctctcttgtgttatggtaaggaatttgttgccgaataatgacaatgcagtgctgcatgccctcctgttaccttgtgtctgacttacattggagacacgtttatgtggtgcatgattgattagtattctggccttctggggt

SEQ ID NO: 16912 - protein, 525 aa, Panicum virgatum
  misc_feature: Ceres CLONE 1790624
  misc_feature (211)..(276): Pfam Name: KH_1 Pfam Description: KH domain
  misc_feature (119)..(184): Pfam Name: KH_1 Pfam Description: KH domain
  misc_feature (395)..(457): Pfam Name: KH_1 Pfam Description: KH domain
  misc_feature: Useful for making plants with modulated flowering time
MDGPVENFVGHDVGGMPGNPYDGEQPNPYEDVEKQYGEELGNTYAEQPGARYNDGSENLYNEEQGNLYSKETGNQYNEKPANSYQEELENAYTGDRSQQDNSQINVEDNRWPGWPGESVFRILVPAQKVGAIIGRKGEFIKKMCEESKARIKILDGPPGVPERVVMISAKDEPDAPVSPAMDGLLRVHKRITDSSDGESGQPQRSAGNIGPTRLLVPASQAGSLIGKQGATIKSIQDSSKCAVRIVENVPPVALNDDRVVEIQGESLGVHKAVELIASHLRKFLVDRSVLPLFETHMKMHSMQREQPMPPPQHWGPPQPWGPPPNLPPGGPGFGGNSQFMPPRPQDSYYPPPDVPPVPVEKQPHYGISAYGREAPPSGVPAAGNQPRSHAGSQVTHNMHIPLAYADAVIGAAGASISYIRRHSGATVTIQESRGAPGEMTVEIIGTASQVQTAQQLVQNFMAEAAPPGPPAASNPPAPPVDPSYASYPAPYGGAPSYGSSAAAGPPPQYNGGSYGGPTYPPSYGY

SEQ ID NO: 16913 - DNA, 1647 bp, Panicum virgatum
  misc_feature: Ceres CLONE 1790648
  misc_feature: Encodes the peptide sequence at SEQ ID NO. 16914
aggctgcagcaaggccatctcgtctgcatcgccctcctttacaccgggatcatctcagcttgctcattggccatcttcgtcgtccatggacaggctcctcgccggcttgcttggcttcctattgcttgcgtcagtaggaagccatgcagctcgagctccggatcagtactggaagtctgctctccccgacacgcccatgccaagctccctctcccaactcctaaacaccccagccggcggcacgaccgtgaacgtcggctggggcggtgtccatgtcgacgccgggcatggcaagcccgggggcacgaccgttgatgtaggcaagggcggcgtcggtgtcaacgtcaaccctggcagcggcaagcccggcggcaccaccgtcggtgttgggaaaggtggagtcggcgttaacgtcaagcctggttatggcaagcccggcggcaccaccgtcggcgtcggcaagagcggggtcggcgtcaacgtcaaaccagggagcggcgggaagcccggcggcaccacggtcggcgtcgggaagggaggtgttggcgtcaacgtcaatcctggcaagccgggtggcaccaccgtcggcgtcggcaaaggtggcgtcggcgtcggcgtcaatcccggatacggcaagcccggcggcaccacggtgggcgtcgggaagggtggggttggcgtcaacgtgaagccccgcgggaagcccgtccacgtcaacgtctctcctttcctatacaactacgccgcgacggagacgcagctgcacgacgaccccagcgtcgcgctcttcttccaggagaaggagctccgccccggcaagaagatgaccgtccagttcaccaacaccgtgcccggtaccaagttcctcccccggagcgaggccgatgccatcccgttctcctccgagaaggtgcccgagatcctcggccgcttctcggtgagcccggactccgtcgaggcggcggagatggcgcagacgctgcgcgactgcgaggcgcccgcggccaagggcgagaagaaggcctgcgccacgtcgctggagtccatggtcgacttcgccacggccggccttgggaccagccacgtgagggccgtctccaccgtcgtggcgaggccggactcaccgaagcaggagtacaccatcaccggcgttaagcgcgcgggcgcgggcgccgacgacggcggccggctcgtcgcctgccacgcggagccgtacgcgtacgccgtgttcgcgtgccaccagacgcggcggacgcgggcgtactcggtgtcgatgctcggcagggacggcacggccgtggacgccgtcgcggtgtgccacgccgacacgtccgggtggaaccccaagcacgtcgccttccaggtgctcaacgtgaagcccggcaccgtgccggtctgccacttcctgccgcaggaccacgtcgtctggacccgcagcggctgacccttgggtggccgccgccgttgtatgttcttgctgcgctgatggttttcatctacgttctagtagcctctaagcatgctgtcgtatggtatcatgatgcgtttgcttatgttttcagtattgtatggatggtgttgccagccagtatcgatcacctgctaggatctgttgtacatttctgaataaacggacatctctttggc

SEQ ID NO: 16914 - protein, 452 aa, Panicum virgatum
  misc_feature: Ceres CLONE 1790648
  misc_feature (233)..(451): Pfam Name: BURP Pfam Description: BURP domain
MDRLLAGLLGFLLLASVGSHAARAPDQYWKSALPDTPMPSSLSQLLNTPAGGTTVNVGWGGVHVDAGHGKPGGTTVDVGKGGVGVNVNPGSGKPGGTTVGVGKGGVGVNVKPGYGKPGGTTVGVGKSGVGVNVKPGSGGKPGGTTVGVGKGGVGVNVNPGKPGGTTVGVGKGGVGVGVNPGYGKPGGTTVGVGKGGVGVNVKPRGKPVHVNVSPFLYNYAATETQLHDDPSVALFFQEKELRPGKKMTVQFTNTVPGTKFLPRSEADAIPFSSEKVPEILGRFSVSPDSVEAAEMAQTLRDCEAPAAKGEKKACATSLESMVDFATAGLGTSHVRAVSTVVARPDSPKQEYTITGVKRAGAGADDGGRLVACHAEPYAYAVFACHQTRRTRAYSVSMLGRDGTAVDAVAVCHADTSGWNPKHVAFQVLNVKPGTVPVCHFLPQDHVVWTRSG

SEQ ID NO: 16915 - DNA, 2257 bp, Panicum virgatum
  misc_feature: Ceres CLONE 1790650
  misc_feature: Encodes the peptide sequence at SEQ ID NO. 16916
gcgaccaagaacagcctactctcctctcctgcttgtcccgatgccgcctggtgctcttcctcttctgctgctgcttccgctcgccctgctgcgcttcgcgaccgctcccgccaccgccaccgccaccgccgacgccaacggaacccgcggcaacgcaacctgcgcgccggcgacatgcgggaaactgagcatcacgtacccgttctcgctcagcggcgtgcagccgctctactgcggcttcccggtcttcgagctcacgtgcgccgacgccggccgcgcctacctcgccaggacgttccgggagcgcctgtaccgcatcctcgacatctcctacgggagcaactcgttcgtgatggccgtcgacgtcgactcgtcctacgtcggcgacgagaggtgccacatcccggacttcaacgtgtcctccgggctctccctcctgccggtcaacataagcgccgccaacgcgaacatcaccttcgtctacaactgcacgctccaccgcaacgccagcgtgctgctgtcgccgccgtgcgcgaggcccacgatcggagcgtacgtcccggacggtgagggcaacgcgccgccagacgtcccgaggaactgcagctcggtgagcgtgccggtgcggcggtcctccttccgcaacgcgtcggagccagcccgtgaatacaagagattgattgaggaagggtttctcttggagtggccgccgaccgcggcggagtgcggcgcatgcagggagcgcggcggcgagtgcagattcgttgagcttgccttccagtgcatctgcagcgacgggaggccctgccggaattctcgcgatactcgaggagtaatcagaatcgggacaggaattgcagcagctcttctgttgctaatcatactgagcgctctcttccttgtgatcgcgctacacaagcgacggaagaggaggcgatcttcgtcactggccggcctcatcgctgatggcacgccattggcatcgctgaggaaagacttcagcatgaccggctcgccgcgcacccacatcttcacctacgaggagctcgacgaggccaccgacggcttcagcgacgcccgcgagctcggcgtcggcggcttcgggacagtgtacaaagggactctgcccgacggcagcgtggtggcggtgaagcggctgtacaagaacagctacaagagcgtggagcagttccagaacgaggtggagatcctgtcgcggctgcgccaccgcaacctcgtcacgctctacggctgcacctcgccgcgtagcagccaggacctgctcctcgtctacgagttcgtccccaacggcacgctggccgaccacctccacggcgcgcgcgcgtcggggcccgccgcgccgccgctcccctggcccgtccgcctcgccatcgccgtcgagacggcgagcgcgctcgactacctccacgccgtcgagccgcgccaggtcgtgcaccgcgacgtcaagaccaacaacatcctcctcgacgaggcgttccacgtgaaggtggccgacttcgggctgtcccggctgttcccggcgcacgccacgcacgtgtccacggcgccgcagggcacgcccgggtacgtcgaccccatgtaccaccagtgctaccagctcaccgacaagagcgacgtgtacagcttcggcgtcgtgctggtggagctcatctcctccaagccggcggtggacatgaaccgcaccggcgccgacgtgaacctggccaacctggccgtgcacatgattcagcgctacgagatcgaccggctggtggacccgcggctcgggtaccgggcggacgccgagacgaagaggaccgtcgacatcgtcgccgaggtggcgttccggtgcctgcagccggagcaggacgtcaggccgcccatcagcgaggtcctggcaacgctgagagaggcgcacgagacggggcaggctggctgtgccaaggtcatggatgacgtcgcgttgctgaagaagagcagggatggctcgccggactccgtcatgcacaagtggacgagcccatccacaactgcccataacagcagttgaggcttcagaaaatgtttctgcaagtggccagtctgcaggacccgtaatgtggctgaaatgtacactgaatgaatggttcgtgtaaatgtgaagaaatatgttctttgtaaggaagagtgagggttggttcagaatttcagattcctgcaccaaacgaggcagttaggaactgacatttaaggacagatttgagaattagaaattttc

SEQ ID NO: 16916 - protein, 669 aa, Panicum virgatum
  misc_feature: Ceres CLONE 1790650
  misc_feature (343)..(622): Pfam Name: Pkinase Pfam Description: Protein kinase domain
  misc_feature: SWISSPROT Homolog: EC 2.7.11.1 Non-specific serine/threonine protein kinase
MPPGALPLLLLLPLALLRFATAPATATATADANGTRGNATCAPATCGKLSITYPFSLSGVQPLYCGFPVFELTCADAGRAYLARTFRERLYRILDISYGSNSFVMAVDVDSSYVGDERCHIPDFNVSSGLSLLPVNISAANANITFVYNCTLHRNASVLLSPPCARPTIGAYVPDGEGNAPPDVPRNCSSVSVPVRRSSFRNASEPAREYKRLIEEGFLLEWPPTAAECGACRERGGECRFVELAFQCICSDGRPCRNSRDTRGVIRIGTGIAAALLLLIILSALFLVIALHKRRKRRRSSSLAGLIADGTPLASLRKDFSMTGSPRTHIFTYEELDEATDGFSDARELGVGGFGTVYKGTLPDGSVVAVKRLYKNSYKSVEQFQNEVEILSRLRHRNLVTLYGCTSPRSSQDLLLVYEFVPNGTLADHLHGARASGPAAPPLPWPVRLAIAVETASALDYLHAVEPRQVVHRDVKTNNILLDEAFHVKVADFGLSRLFPAHATHVSTAPQGTPGYVDPMYHQCYQLTDKSDVYSFGVVLVELISSKPAVDMNRTGADVNLANLAVHMIQRYEIDRLVDPRLGYRADAETKRTVDIVAEVAFRCLQPEQDVRPPISEVLATLREAHETGQAGCAKVMDDVALLKKSRDGSPDSVMHKWTSPSTTAHNSS

SEQ ID NO: 16917 - DNA, 1654 bp, Panicum virgatum
  misc_feature: Ceres CLONE 1790655
  misc_feature: Encodes the peptide sequence at SEQ ID NO. 16918
agaaatacagcacgctcccgtcggagggtttcagcatcggacccatggctctcgttcctccgctcctcgtcgtggcggcgctgctgccgctggctctgccgctcgggggcgccgccggggacctgcacccggtcgtgctcgtgccgggctacgcctccaaccggctcgaggcgacgctgacggcggcgtacgagcccccggcgcccgcatgcgcgggccggcaggggttgtggttcccgctgtggcccaaccacacggcgacgcgcgacgccagccaggtcccctgcttcgcggaccagatgagcctcgtctacgacgccggcgccgacgactaccgcaacgccgacggcgtggtcacccgcgtcccgtccttcggctccgcgcgcgccctcatcgggggagcccctaccctaccctccaactctccagtctccagtctccacccaccgcacgcacacttgttttttttttttgagacaaccgcacgcacacttgtctcgccgtcacttccagccgtgctcgtcatcgttacctcggatttctactgttccacttgaatgcttgatgcgcatagacaaatgattgacctggactgacagtctggcacacatgcgcggtcggctggcaggtgggaccagctggtgcggcagctggagggcatgggctaccgcgacggcgagaccctcctcgccgcgccctacgacttccgctacgccgtcgcgccgcggggccacccgtcggcggtgggcggccgctacttccgcgacctcgggcgcctcatccgggcgagcggcctccgccggggccgcccggccgtcctcgtcgcgcacagcttcggctgcgcgctcacgtaccagttcctcctctcccgcccgctcccctggcgccgccgccacgtcaagcacgtcgtcttcctgggctccgcgctcggcgggttcgcgccggggatgtacgtgctcgccgccggcaccgactacggcctgccgggcgtcacgcggccgtcgatgctccggctggcgcggagccagcagagcgccctgtggcgcctgcccacgccgctggtgttcggggaccgcccgctggcggtcaccaggagcggcacctacacggcgcgcaacatgtcggcgttcctcgacgcgatcggcttccccgacggggtgcggcagtaccagacccgggcgctgccgatgtgggaggcgctgccgccgccgatggtgccggtgaccagcgtcatcggggtcgggatcaggacgccggagacgtacctgttcggggcggacggtttcgagggggaacccgaggtggtgtacggcgacggggacggggacatcaacctggtgagcctcgcggccgtcgaggactgggccggggtagaggggcaggccatggaggtcgtcaggctcccgggcgtgcaccacggtggcttcttcagcgtcgatgccgctgtcgagagggtagtcgatgagatacgcagggcagcaggaggaagcatagagctcgatcggaaattcagtatctgagcgactatactagcatactgcaatccaacttgtggcagctgaacagtggtgtcggtggtgagatcatcgtcggggttttttttcttcttttcgaacagactattcattgcaacttgtaagtccggttaccagcg

SEQ ID NO: 16918 - protein, 286 aa, Panicum virgatum
  misc_feature: Ceres CLONE 1790655
  misc_feature (1)..(269): Pfam Name: LACT Pfam Description: Lecithin:cholesterol acyltransferase
  misc_feature: SWISSPROT Homolog: EC 2.3.1.43 Phosphatidylcholine--sterol O-acyltransferase
MGYRDGETLLAAPYDFRYAVAPRGHPSAVGGRYFRDLGRLIRASGLRRGRPAVLVAHSFGCALTYQFLLSRPLPWRRRHVKHVVFLGSALGGFAPGMYVLAAGTDYGLPGVTRPSMLRLARSQQSALWRLPTPLVFGDRPLAVTRSGTYTARNMSAFLDAIGFPDGVRQYQTRALPMWEALPPPMVPVTSVIGVGIRTPETYLFGADGFEGEPEVVYGDGDGDINLVSLAAVEDWAGVEGQAMEVVRLPGVHHGGFFSVDAAVERVVDEIRRAAGGSIELDRKFSI

SEQ ID NO: 16919 - DNA, 729 bp, Panicum virgatum
  misc_feature: Ceres CLONE 1790657
  misc_feature: Encodes the peptide sequence at SEQ ID NO. 16920
gcacgcaccaccgccgcgcaacccccaacgcccccgccaccgccgccgcaccaccggcgaagagagacaggaggaggggagcagcagcctcctccaggagcctagcctccgcccccccccccctccgggcgtggccgagttgtaggcatcacggctagcgttgtagccccccggcgcggccccgcagctgcgcaggtggagcccacgggcaccatcgcctccgccgtcgccaccagccccgccccgcacggcggccgcggggcgctgccctcggccggagggagcccgtccgacctcctcttcctcgccggcggcggttgcctctgagccgctcccccacccttctctctctccatctgaccccttctcctcctcctaacaaccgtcgtctgctgaccccccgaccccgacaaacacgcacccgagagatttgagcgagccaccggccggccgccatggagatgaagctcaccatcaggagggtgcccaccgtcgtctccaactaccaggaggacgccgacaagccccgcgccggatgcgggaggaactgcctcggccactgctgcctgcctgtttccaagcttcccctctatgctttcaaggcaaatccggcaaaacctgcacaggaggatgctgcttcatctaagtcccttgtcaatatcctccttgctgagtgggargacaggatggcccgggggcttwttccgctwtgatgtcactgcctgtgag

SEQ ID NO: 16920 - protein, 85 aa, Panicum virgatum
  misc_feature: Ceres CLONE 1790657
  misc_feature: Useful for making plants with modulated nitrogen use efficiency
  misc_feature (83)..(83): Xaa is any aa, unknown, or other
MEMKLTIRRVPTVVSNYQEDADKPRAGCGRNCLGHCCLPVSKLPLYAFKANPAKPAQEDAASSKSLVNILLAEWEDRMARGLXPL

SEQ ID NO: 16921 - DNA, 658 bp, Panicum virgatum
  misc_feature: Ceres CLONE 1790657-R
  misc_feature: Encodes the peptide sequence at SEQ ID NO. 16922
aaacgtgcttatttcggactgtggcaagaggatctttctcttcccccagtgctacgctgagaagcaggctctgggcgaagtgagccaagagctgctggacacccaggtgaatccagctgtgtgggagatcagtggccacattgtgctgaagcggaggaatgactatgaggaggcatctgaaacctctgcgtggaagctccttgccgaggtctccctgtctgaagaacgcttcgaggaagtgaaagcttacatcttcactgctgctggcctggttcaggcggatgaggaggaagtctgcgagggtgaggaagcaacctacgcgcctgtccctgtcgcccctctgcctgtggcagaaggctgcctcgtcctccagtgagatggtacagctggctgttgcgctattaagcgttgtcattgttgtctatggcgcctatagctctgccataataaggtccttgtgatgaaactgctgcctggtctggtctggtctggtctgtgcgcctgagccttgtgctctgccgcaacttgctctcgtttctgtatcctctctgtggtgactgagtgattcagtgctctgcaatattaagcggaggctatgtgtattgtttgggtcgtttagaacttaaatgataaatgaaatgtgatggacattgctagt

SEQ ID NO: 16922 - protein, 124 aa, Panicum virgatum
  misc_feature: Ceres CLONE 1790657-R
  misc_feature: Useful for making plants with modulated nitrogen use efficiency
NVLISDCGKRIFLFPQCYAEKQALGEVSQELLDTQVNPAVWEISGHIVLKRRNDYEEASETSAWKLLAEVSLSEERFEEVKAYIFTAAGLVQADEEEVCEGEEATYAPVPVAPLPVAEGCLVLQ

SEQ ID NO: 16923 - DNA, 1556 bp, Panicum virgatum
  misc_feature: Ceres CLONE 1790664
  misc_feature: Encodes the peptide sequence at SEQ ID NO. 16924
atcatcgtgctcgcaccgcatcgcatcgccccccagcgtctatctctcaaccggccggtctcctcccgacctcccgccccctccttgttggctttggttcggctcgttcctccctcctcctcctccgcctcgcccagcccggccggcggccgcgctccgcatgtcaatccatgggctgatcctggaagtcagagtcaccgggtgccggaagctgcgggacacggagttcttcacccgccaggacccctacgtcgtgctcgagtacgccaccaccaagctccgcacccgcacctgcaccgatgggggaagaaacccaactttcgatgagaagttccatatacccctcattgaagggctccgcgagttgaatgttgtcgtttggaacagcaacacattaacccatgatgacttcatcggcagtggcagagtatatctgcacaaggtgcttgcaaatggatatgatgattcctcatggccacttcagacacgccacatgagatctgctggggaagtgaagctcattatgcatgttgatgtctcggcaatgaagaacaaaatgggtaaaagtatcggtgcagcaagtacacattctgttcctccaccttcagtgccagccccagccccagccgcagccgcagcaccagcactagcatcagcagttccatacactggggttccaccttcatatccacctgctcctgcatatcctgtggcatctgcataccctgcttacccaactcctagccaatcaccatataccactacagaatatccaccacctccgcagcaagcgtacccacccccttcggcaggatatcctccatcatatccaccgcagccatatgggcaatcatatccgccacaaccatatggtcaaccatacccacccccgccagaagcacagtccccatatccacctgcgccttaccctggtacctatccaccaagaccttattgatatatcagcttcagtaaccacaggcaggggcatcaaaagcagcatacaacaatggtgttacatgatctttgcctgtgtgtgggttctttgtttctagttatttggttattcttcctaactgaattctacatacgccgaactgttacagcgatctcaagtcagctaaaggtctggatggtaattgttacatgggaaatcaaaaaggaatgtcgtgaattcacttgtcagaagctgaagcttggctaagtgcaacagatggaaattgcttcctttttgtgaatcatatgaacagcccagcgaccatcactccgtcagttatatttaccttctccattatgtaccataggcagcttgtagaatgtctcgatgaaatcattcatccatcctatattgctcgctgtgtgtttgccaaaattgagatcagacccagcttgcttcggtcttggagtcatgtctgactgttctgtgtgaacaaacaattgtgcatagtagggtattgctagtaactgcagacgcgttagctgcgaagattgcagcacctcgtcggcttgacacttggaatgtatctgtaacggtcaataaaatttgcttcagtgat

SEQ ID NO: 16924 - protein, 265 aa, Panicum virgatum
  misc_feature: Ceres CLONE 1790664
  misc_feature (8)..(89): Pfam Name: C2 Pfam Description: C2 domain
  misc_feature: SWISSPROT Homolog: EC 3.1.1.4 Phospholipase A(2)
  misc_feature: Useful for making plants with altered carbohydrate content
  misc_feature: Useful for making plants with altered cell wall content and/or composition
MSIHGLILEVRVTGCRKLRDTEFFTRQDPYVVLEYATTKLRTRTCTDGGRNPTFDEKFHIPLIEGLRELNVVVWNSNTLTHDDFIGSGRVYLHKVLANGYDDSSWPLQTRHMRSAGEVKLIMHVDVSAMKNKMGKSIGAASTHSVPPPSVPAPAPAAAAAPALASAVPYTGVPPSYPPAPAYPVASAYPAYPTPSQSPYTTTEYPPPPQQAYPPPSAGYPPSYPPQPYGQSYPPQPYGQPYPPPPEAQSPYPPAPYPGTYPPRPY

SEQ ID NO: 16925 - DNA, 1860 bp, Panicum virgatum
  misc_feature: Ceres CLONE 1790671
  misc_feature: Encodes the peptide sequence at SEQ ID NO. 16926
gcttctcctgaactcttccacacttcgacaggctttcttcatcctcttcgtcttccttcccctggcctcccatccacccccacagccccaccccgcccgcaactacaagcaacccctgatccagtccgttccgcctccaggcgaatggtcgccaaccaggaggcggaggcggcatcggcggcagcgcccggggcagggacgccggtggacccgatgcgtctggcgtcgcggtggcggtccccggcggagtgggagtgtgcggcggcggagctggatgctgagccgctcccgtccgagctcaacaccgtcaacagctctggacttttcgccgtcgtctccaccgacaagttgtccgtcaaatacctcggcagccatcaccatggccacgacgtcggggtcgtgcaagccgaccgccccgcgcccacgcgccgggccgtgtactactttgagatgcgggtcaagaacgccggctacaaggggcagacctcaatcgggttcacaagcgaaagcttcaagatgcggcgacaaccgggttgggagcctaacagttgtggataccacggtgatgatggccatctttaccgaggtcaagggaaaggtgaaccattcggggccaaatttacatctggcgacacaatcggtgctggcatcaactacttgtcacaagaatttttcttgacgaaaaatggatctctggttggagcctttccaaaagaaattaaaggtccactatatcctaccgttgcagttcatagtcagggtgaagaattgactgtgaactttggtaaagaaccattctgttttgacattgagggttatatactcgaagagaaaatgaggcaacaatcgatgacgaacaaattgaagttggaagagaacatcagtcatgtgattgtccgttcatatctgctacattatggttaccaagatacattaaattcttttgatttggcaaatgcaactgatccccctggcagtcgccaaaatggacatagggaacctccagaaacgtatggacttagccacagaaaacttttgcgtcagcttatcatgagtggagatattgactctacattcaaaagactagaggaatggtatccacaagtgataaaggatgataaatcggttatttgcttcttactccattctcagagattcatagaatatatcagggctgaacaactggaggatgctgtgaaatatgctcgtgctaacctggcaagcttcttgacgcacaaagctttcgaggggttgctgaaggagagtgtggccctgcttgcgtatgagaagcctgcagaatcatgcatcggatacctgctggactccccccagcgtgaattcgtggcggatgcagtgaacgcagctgtcctgtctacgaacccagccatgaaggaccccaagagctgtctttactcgtgtcttgagaggttactaaggcagctcacagtatgtagctttgagcgacgcaccttcaacaatgaccaaggagatgcattcttacttcacaaagaagtgcgcaactgtgaaaggtcctggcgttcataggcacatctgagaattctcggatgttagactccaactgctgttgggaggaccaaggatcacctcggatggagttgttgagcatggcacgcgcaagcacagatccttccttttgaaggtctgcagcgtccatgggctttctaattccgataggtgcacttaattgcacagagctctgaaggagtttccttcctgtaatcagaaaacttgttcagaatcggccaacgtgtctgttcccatagtttgatggttggctaatagaccatttgattttgtgaatgctaaaaacgcttcaatatatgttctttacttttgtat

SEQ ID NO: 16926 - protein, 466 aa, Panicum virgatum
  misc_feature: Ceres CLONE 1790671
  misc_feature (96)..(217): Pfam Name: SPRY Pfam Description: SPRY domain
  misc_feature: SWISSPROT Homolog: EC 2.7.10.2 Non-specific protein-tyrosine kinase
MVANQEAEAASAAAPGAGTPVDPMRLASRWRSPAEWECAAAELDAEPLPSELNTVNSSGLFAVVSTDKLSVKYLGSHHHGHDVGVVQADRPAPTRRAVYYFEMRVKNAGYKGQTSIGFTSESFKMRRQPGWEPNSCGYHGDDGHLYRGQGKGEPFGAKFTSGDTIGAGINYLSQEFFLTKNGSLVGAFPKEIKGPLYPTVAVHSQGEELTVNFGKEPFCFDIEGYILEEKMRQQSMTNKLKLEENISHVIVRSYLLHYGYQDTLNSFDLANATDPPGSRQNGHREPPETYGLSHRKLLRQLIMSGDIDSTFKRLEEWYPQVIKDDKSVICFLLHSQRFIEYIRAEQLEDAVKYARANLASFLTHKAFEGLLKESVALLAYEKPAESCIGYLLDSPQREFVADAVNAAVLSTNPAMKDPKSCLYSCLERLLRQLTVCSFERRTFNNDQGDAFLLHKEVRNCERSWRS

SEQ ID NO: 16927 - DNA, 1073 bp, Panicum virgatum
  misc_feature: Ceres CLONE 1790680
  misc_feature: Encodes the peptide sequence at SEQ ID NO. 16928
cccgagcctgcaagcgcctcccccccgccgccgccgcgccgccctcctcgcgcgcagccatggccgtcgggaaaaacaagcgcatctccaaggggaggaagggcggcaagaagaagatcgtcgaccccttcgccaagaaggactggtatgacatcaaggccccgtcggtgttcagcgtgaggaacgtcggcaagactttggtgtccaggacccagggtaccaagattgcctctgaaggactgaagcacagagtgttcgaggtctccttggctgatcttcagagcgatgaggatcaggcgtacaggaagatcagacttcgtgcagaagatgtgcaaggaaggaacgtgctcacaaacttttggggcatggacttcaccactgacaagctcaggtcactggtgaagaagtggcagaccctcattgaggctcatgtagatgtcaagacaactgacaactacatgctcagacttttctgcattggcttcaccaaaagacgccccaatcaagtgaagcgcacctgctacgcccaggcgagccagatccgtcagatccggagtaagatggtggacatcatgtcgaaccaagcgtcaacatgtgacctgaaagagcttgtgtcgaagtttataccagaggtcattggcaaggagattgagaaagcaacatcaagcattttcccactccagaatgttttcatccggaaggtgaaaatcctgaaggcacccaagttcgacttgggaaagctcatggaggtccatggtgactacaaggaagatgttggcaccaagctggagaggcctgccgacacagacgaagccatggctggacaggaggttgctgctgcagagtgatgatgcttttgggttactttcagtcgtttatgtgtctaggaatctatcttaagttgatatgaacttcccagtccatgtttgatattgcaccacacttttgtcgagacctgttctgtggctgcatgatttcggatgaaaactgttgaatatttgctgggttttccgtgagtacgactgaacatatgaaaaaaaattgctgaagaagaataaatatactacttcgcg

SEQ ID NO: 16928 - protein, 262 aa, Panicum virgatum
  misc_feature: Ceres CLONE 1790680
  misc_feature (11)..(222): Pfam Name: Ribosomal_S3Ae Pfam Description: Ribosomal S3Ae family
MAVGKNKRISKGRKGGKKKIVDPFAKKDWYDIKAPSVFSVRNVGKTLVSRTQGTKIASEGLKHRVFEVSLADLQSDEDQAYRKIRLRAEDVQGRNVLTNFWGMDFTTDKLRSLVKKWQTLIEAHVDVKTTDNYMLRLFCIGFTKRRPNQVKRTCYAQASQIRQIRSKMVDIMSNQASTCDLKELVSKFIPEVIGKEIEKATSSIFPLQNVFIRKVKILKAPKFDLGKLMEVHGDYKEDVGTKLERPADTDEAMAGQEVAAAE

SEQ ID NO: 16929 - DNA, 1583 bp, Panicum virgatum
  misc_feature: Ceres CLONE 1790687
  misc_feature: Encodes the peptide sequence at SEQ ID NO. 16930
accgaacggcggcatcgcccggtcgctgatgaaatggcgccgcgtcgccctcccaagaagcgccggattcgtgatgccacggccgtgccgccgccggcggcgtccgacgccctgctctctctgcccccggaggtgctcgacgagatcctcgcccgccttgacctccgcgacgccgtccgcacctgcgcgctgtgccgcgcctggagccgccgctgggagtcgctcccctccatcgacatctacacccgcatcggccagcagtcgctctggaccgtcgactgcgtcctcccccgctgctccggccgtgttcggcgcttcgacgtctccctcgatgagctctccgcccgccgcctggacgattggctcctcgtcctctcccgccgcggcggcgtggaggatctcgaactcagccctccattcccctataagttcttcacccttcattccaccgtcttctcttggcgccgcctcgtctccatcgacctcttcgcctgcgacataccgccgctacccccggacttcgaggggtttccgaaccttaaagtgctaagccttggcaatgtgaggttacagcagaacggggagtaccaactggaggagatcattgagacatccccattgctcgagcagctgatactatgcgaagtctgcatacttggggacgacttcatagaatgggaaatccgggcaaccaatctgcagcacataacaatttgctcaaatatcgattatggctggaattttgcagagctgcgatgcctgaactctgctgtcattgatttgtgggagtatgttggtggtcgaaatttcgccaaatttcttgctgggcttgttcaagttaggaagcttaggctctgctcgttttatgcaccggtaaatgggattaagatactggagacacttccatgcacctttgacaacttgaagagcttgaaactgttcatgcacttctgtgaactgccccccattttgttagtgttttgcttcctaaggagagctccaaaccttcaaaaacttaaaatacggatttatgatggcaaagagcagaaaatagaggcaaatggggagttactaaatgcacagtggactgatggcatgtgtgccaatcttcagattctggagatgaccggtatcaattggcttccaaatgaaatgtcttttatgaagcttattctctctaaagctaagcttcttcacacattatccattagtcacgatgatgattgctcactatctcatgtggatccactgaatgagttagtaacatgcggaagagcctcagctcaagctcagattctgtttcatggtgccgcaggaagctattagatggcgagcgtcttctgagcattaatagaatgtgtgaaagtggttcacttgaatgagccggtggtccctttttttgtttgaagtggtcttttgaggccagaatgtcagatatgaaagacacagaaaattactcatacaaggagttgtcgtggttttcatcttctatttcagaaggaattgacgttctatcagtactttgctaaggattgacgctcatgttctgtatgagattgcagacaattttctgcatttgaagt

SEQ ID NO: 16930 - protein, 430 aa, Panicum virgatum
  misc_feature: Ceres CLONE 1790687
  misc_feature (25)..(72): Pfam Name: F-box Pfam Description: F-box domain
MAPRRPPKKRRIRDATAVPPPAASDALLSLPPEVLDEILARLDLRDAVRTCALCRAWSRRWESLPSIDIYTRIGQQSLWTVDCVLPRCSGRVRRFDVSLDELSARRLDDWLLVLSRRGGVEDLELSPPFPYKFFTLHSTVFSWRRLVSIDLFACDIPPLPPDFEGFPNLKVLSLGNVRLQQNGEYQLEEIIETSPLLEQLILCEVCILGDDFIEWEIRATNLQHITICSNIDYGWNFAELRCLNSAVIDLWEYVGGRNFAKFLAGLVQVRKLRLCSFYAPVNGIKILETLPCTFDNLKSLKLFMHFCELPPILLVFCFLRRAPNLQKLKIRIYDGKEQKIEANGELLNAQWTDGMCANLQILEMTGINWLPNEMSFMKLILSKAKLLHTLSISHDDDCSLSHVDPLNELVTCGRASAQAQILFHGAAGSY

SEQ ID NO: 16931 - DNA, 1787 bp, Panicum virgatum
  misc_feature: Ceres CLONE 1790690
  misc_feature: Encodes the peptide sequence at SEQ ID NO. 16932
gccgcacctccacacgtacaccacagcctagctagctagtcctctgtcctctccatggcggcgtccgaggtcagctggctatctccggcgtcccgcctcccgtccgtcgccaacgcaccacctcgctttcgcgccaggccgcctaagccagcagccgcctccctgctctctccctcatcccgcccaggcccagctgcagcggccctgcccgtgctgcaccgcaggggcagggtgaccaccgtccgccgccgtcttagcgccaccgagcagcaaggccaggttcaggagcaggaggacgaggtggtcgacggcaacgtcctcccctactgcagcatcgacaagaagcagaagaagacggtgggggagatggagcaggagttcctacaggctctccagtccttctactacgaccagaaggccatcatgtccaacgaggagttcgacaacctcaaggaggagctcatgtgggaagggagcagtgtcgtcatgctaagccctgatgagcaaaggcttttggaggcttccatggcctatgcggctggcaatcccatcatgtctgatgctgaatttgacgagttgaaactgagattgaaggttagttcgcctccagctgcttccttccattctatatatatatgtaatatgcagctgatcgagagttcaagcctactatatgtctctgctaccacaaggagacctttttttaagaaagaaaaactgaaattccttttctggctggttacgatcgtcgaccattgcattggctagaaagacgggagtgacattgtgacggaaggtcccaggtgcagtctcaggagtcgtaaggtgtacagtgacctgtctgttgactacttaaagatgttcctgctaaatgttccagccaccgtagttgctctgggactgttcttcttcattgatgagttgactggctttgagatcaacgtgttccaggtcagtatatatgatcaattcaaatacatatacacactctatttcgatgtgagcatatatccaatccctcgctaaccagctgccggccagagaccaaatatatatatatatatatatatatatatatatatatatatatatatatatatatatatatatatatatatatatatatatatatatatatatatatatatatatatatatatatatatatatatatttatgttaacttattatttgcattcgtcttggatatatatgatggtgcagctgccggagccttttggtttcattttcacatggtttgctgctttgccactaatattgttcttagcacaatcgttgactaaagccatagtccatgactttctaatcctgaaggtatgtatgtatatagttttctttaattatattagttttccttgaaaaagcagctagctagtccagggaaaactaactgatgatgaatttaattatttttctttaattatattatgtatgtaggggccatgtccaaattgtggcactgaaaatctttccttcttcgggacaatactgtcggtctctagtggcggtacaacaaacaacgtcaaatgtgcagattgcggtaccgagttggtatatgactcaaaatctcggctcatcacacctgcagaagcgtcaaaagcataagcctgccaacagtcgctagctctgtccatctctactttgtagggtcggcaataaattactcctaactagtctgtgtatgtatgtatgtatgtatgtatagatccaagagcttatgagatgtgtgtgtgtatttatatgtaatatatatgtatagtacgtac

SEQ ID NO: 16932 - protein, 237 aa, Panicum virgatum
  misc_feature: Ceres CLONE 1790690
  misc_feature: Useful for making plants with modulated nitrogen use efficiency
MAASEVSWLSPASRLPSVANAPPRFRARPPKPAAASLLSPSSRPGPAAAALPVLHRRGRVTTVRRRLSATEQQGQVQEQEDEVVDGNVLPYCSIDKKQKKTVGEMEQEFLQALQSFYYDQKAIMSNEEFDNLKEELMWEGSSVVMLSPDEQRLLEASMAYAAGNPIMSDAEFDELKLRLKVSSPPAASFHSIYICNMQLIESSSLLYVSATTRRPFFKKEKLKFLFWLVTIVDHCIG

SEQ ID NO: 16933 - DNA, 679 bp, Panicum virgatum
  misc_feature: Ceres CLONE 1790698-R
  misc_feature: Encodes the peptide sequence at SEQ ID NO. 16934
tgctggtctcactggccggaagatcatcattgatacctatggtggctggggagcccacggtggtggtgctttctctggcaaggacccgaccaaggtcgaccgcagtggagcctacattgcaaggcaggctgccaagagcattgtcgctaacggccttgctcgccgtgccatcgtccaggtctcctacgccattggtgtgcccgagccactctccgtgtttgtggacacatacggcactggcacgatccctgacaaggagatcctcaagattgtgaaggagaacttcgacttcaggcctggcatgatcatcatcaacctcgacctcaagaaaggtggcaacgggcgctatcttaagacagcggcctacggtcactttggaagggatgaccctgacttcacctgggaggtggtgaagcccctcaagtgggagaagccttctgcctaaggtgcccttttggaagaaacttttggtctgtcacgcttatcatgttttgtggctccagtgttgtgattcttgatctgccccttactgtcatttgtattgtaccgtcttaataagtggtacttgtgagggtattactgtgtcttgttatttacttagaggagggtttattgtctactgtttctggttttgctacatatgtcatggtaaaccaagaatgaatctacaggttacttg

SEQ ID NO: 16934 - protein, 147 aa, Panicum virgatum
  misc_feature: Ceres CLONE 1790698-R
  misc_feature (1)..(136): Pfam Name: S-AdoMet_synt_C Pfam Description: S-adenosylmethionine synthetase, C-terminal domain
  misc_feature: SWISSPROT Homolog: EC 2.5.1.6 Methionine adenosyltransferase
  misc_feature: Useful for making plants with modulated biomass
AGLTGRKIIIDTYGGWGAHGGGAFSGKDPTKVDRSGAYIARQAAKSIVANGLARRAIVQVSYAIGVPEPLSVFVDTYGTGTIPDKEILKIVKENFDFRPGMIIINLDLKKGGNGRYLKTAAYGHFGRDDPDFTWEVVKPLKWEKPSA

SEQ ID NO: 16935 - DNA, 189 bp, Panicum virgatum
  misc_feature: Ceres CLONE 1790698
gcaaacatccacttggtcagtcaccatatcgcgcaaactacctagctcctccgcttcccttgcagtttcaggcctccggggagcatgcagcacgctgcctgggagagctagaggaggcgcgtcagtcaacgccacgacctcgtcctcctcgctcatcacgttcggcctcgggtacgaccacaattagag

SEQ ID NO: 16936 - DNA, 651 bp, Panicum virgatum
  misc_feature: Ceres CLONE 1790703
  misc_feature: Encodes the peptide sequence at SEQ ID NO. 16937
attcctgattccaaccagctcacacgagtcggtactggatagagaggaaggaggaagccaagaacaagcagtcgtactcgtcttgcgcgcgcgtggagaggaaagattggattttgtgttacgttttggtgagcagagatgttgagggcggtggcgaggtgctgcggcccctggccgccgagcgcggcggcggcggacgggatgctgtggcagacggagctgcggccgcacgcggcgggggagttctcgatggccgcggcgcaggccaacctggcctccccgtccgacacgctcgtcggcgtctacgacggacacggcggggccgacgcctcccgtttcctccgatctcgactcttcccccatgtccaacgcttcgcgacggagcaggggggcatgagcacggaggtgatccggagggcgttcagcgagacggaggaggagttccatacgcaggtgaggcaggagtggaggaggcggccgcggatggccgccgtgggctcgtgctgccttctcggggctatctccggggacacgctctacgtggccaaccttggggactcccgcgccgtgctcgggcgtcgagtggtggggggcgggggtggccgtcgccgagcggctgtccagcgagcacaacacggcgtccgaagaggt

SEQ ID NO: 16937 - protein, 170 aa, Panicum virgatum
  misc_feature: Ceres CLONE 1790703
  misc_feature: SWISSPROT Homolog: EC 3.1.3.16 Phosphoprotein phosphatase
MLRAVARCCGPWPPSAAAADGMLWQTELRPHAAGEFSMAAAQANLASPSDTLVGVYDGHGGADASRFLRSRLFPHVQRFATEQGGMSTEVIRRAFSETEEEFHTQVRQEWRRRPRMAAVGSCCLLGAISGDTLYVANLGDSRAVLGRRVVGGGGGRRRAAVQRAQHGVRR

SEQ ID NO: 16938 - DNA, 1902 bp, Panicum virgatum
  misc_feature: Ceres CLONE 1790709
  misc_feature: Encodes the peptide sequence at SEQ ID NO. 16939
gaaaagttgggctcaccaccagtcaccacaccacggatccctccctcctccatctttactgcgctacggcgaagctgtcgccgggcagctcccaccacccacccctcatccaccgtcccacgtacacctccgcgctcccacaccgttgctcgcgacgccatagccatggcccatgcccgcagattcaaagccaggacggacggggccagccaggcctccgcctccgcctccgcctccgcctgcgtcgtcgtcgtgccctcacggacggagcatcatcaactcgcctcaggctcagcacagtggctgccacgtcgtgctgccacctgccagggacgaccccacatggcgcgcccccatccgctgcgccggcgactccctgtgccccgtccttcttgcgccgccggtttcccgtaatcccatggctggccgttgcgccacaggaatgcctcgccgcagaaaagagcgcgcgtgccggctcgccctggcatttggcgaaagcgccccggctacgtgccatcaaactgggcgcctccccggggcccggcctctttatcttggcgggcagcagtgagcagtgacgcacaccaccaccatttcttctccgcaggacacacaccacctttcggctttcgcctgcctgggtgggcgttgtctccttccttccttccaccacctgttcgtttcgccctcacctcgccgcagcctagctgcacacccgtcacattgcccccaagccgatctccctgcgaattcactccctcctgctgggcggtgctcactgctctggtcagtcaggcatgcgcgcctcccgcccctgccggctggcgctcctcctcctcgccgtggcggcggcggcgggcggccacgacttccggcgggacttcgacgtggtgtggggggagggcaatgcgcggttccgcgacggcgggcgggaggtggagctgtcgctggacgagcgcacgggcgcgcggctgcagtccaagcagcgctacctcttcggccgcttcgacctcgagatcaagctcgtcgccggcgagtccgcggggaccatcacctccttctacatctgcagcggcggcgcgcgtcacgacgaggtggacttcgagttcctgggcaacgcgagcggcgagccgtacctcctgcacaccaacatcttcaacgacggcaggggcgagcgggagcagcagttcgtgctgtggttcgaccccaccgcgggcttccacacctactccatcctctggaacccgcacaacgtcatcctctacatcgacggcgtccccatccgggtgttccgggacaacgccgcccgcggggtgctgttcccggcgcgccagccggcgcacgtcttcgccagcatctgggacgccgaggactgggccacgcagggcggccgcgtcaagacggactgggccagcgcgcccttcgtcgccgcctaccgccgctacaacgtctccgccaccgcctgcgtctgggacgaaggggaagggcgcgcgcactgcccgccggcggcgtcgtggatggcgcggaggatggactggtggagctggatgacgctcagctgggtgcgcatgaactacatggtctacgactactgcgacgaccgcaggaggttcccgcacggagccccgcccgagtgcgacatccccatcggcaggtcgtgacctgcttgctgatcgagctccaacctccaatccggcagtcgtgtcgtgtcgtgtgcagggagaatgaagaagtcttcttctgcttctgcaagctagctagagaacgttctgtctccccacgtgacggcactgtaataatcgggcttgcttttttgttgatctcttgaagaccgatgcagttgccgggttgtttagaccctccacagtggagggagcaaatgaaggagcaaatatactgttt

SEQ ID NO: 16939 - protein, 287 aa, Panicum virgatum
  misc_feature: Ceres CLONE 1790709
  misc_feature (25)..(206): Pfam Name: Glyco_hydro_16 Pfam Description: Glycosyl hydrolases family 16
  misc_feature (234)..(280): Pfam Name: XET_C Pfam Description: Xyloglucan endo-transglycosylase (XET) C-terminus
  misc_feature: SWISSPROT Homolog: EC 2.4.1.207 Xyloglucan:xyloglucosyl transferase
  misc_feature: Useful for making plants with altered carbohydrate content
  misc_feature: Useful for making plants with altered cell wall content and/or composition
MRASRPCRLALLLLAVAAAAGGHDFRRDFDVVWGEGNARFRDGGREVELSLDERTGARLQSKQRYLFGRFDLEIKLVAGESAGTITSFYICSGGARHDEVDFEFLGNASGEPYLLHTNIFNDGRGEREQQFVLWFDPTAGFHTYSILWNPHNVILYIDGVPIRVFRDNAARGVLFPARQPAHVFASIWDAEDWATQGGRVKTDWASAPFVAAYRRYNVSATACVWDEGEGRAHCPPAASWMARRMDWWSWMTLSWVRMNYMVYDYCDDRRRFPHGAPPECDIPIGRS

SEQ ID NO: 16940 - DNA, 2481 bp, Panicum virgatum
  misc_feature: Ceres CLONE 1790710
  misc_feature: Encodes the peptide sequence at SEQ ID NO. 16941
ccccactccccgcaccgtagcacgcaaagcgtccgtcccccgcgacggtccaggaggctccaaccccgccgcctccgccccgtataccccaccttgtgccataaccccgtaggacgcggctgcgtcggccgcctgaacttccggggggtggggcgcagcggcagaggcggcggcaccgagcccggctagggttcccctctctccatggacggcggcgagggtcggacgttcaaggccaacttcaccggcgagggggtgaagatgctgcaggaccgcgtcaaggagaagctcagggagctcatgggcgactactccgacgacacgctcgcggagtatgttgtagtgttgctaaggaatgggaggcgcaaggatgaggctgcaaaggagctgcaggtttttttgggcgatgacaatgatgcatttgtatcctggttatgggatcacctctcctcaaatttgcacctctatgttcaacctaaagctgccgcttctagtgatgaacctaaaagcactcgcagtgccggtagaggattgcctgctcgcagtgtgactagcagcgtacaaattaattgtgaacctgaagctgaaaaccagaagacaatgaaaactcatcagagaagagattggggaagaactgttcgagaacagtcagaagcagttcctcttcgaagtgttgtagccaatgtttctcatgcagaggaagatgagtttcatgaatcacatgcagatgaaagggattttcataaatcacatgctggaagacgaacccgctctccagacatgcataaccacagaaagaggagcagagatgcagatgcacgatctaccaagagggcatcccacccagttattggtgcaccacgccgacttctccagtttgctgttcgtgatgctgtcagaactgtgcagccagtgactcctagatcagaatcagcttccaagcgacttcgttctgtggtgtctacattggcgtcagattccacacttgatattactcatattaggttacagagaacaaattcagatgggagaataccaggtgccacagcagcactaagggctgcggctgaggcggctgaggatgctatcaagggcagcttttcggggagtgtttttaatagattggggaggatgcccacaataaatcataccgaaactagagatcaggatccagaaggtgaagaatatgagaatatagataacatacgagcagaaaatcaagttgaattttatgaaagaaatcagtatggtggcagtgatgcttacatgcatgaccaggaatcagaggaagctacaggttctgctcccaatattgatgagtatgataggtataatggattgggttctcgccgaagtacattcccttctagtggtggcaaagagtcattagtattaggctatgtaaggggagctgctgaagtaagaaacagaagattgatagctcagggcgcgcatgctggttcaggaccaagaccatctgaaaatgacttaaatatttctgctaacattagtatgcggaagcttccaactcatgaaaccagggatgctgttgtatttgaccctcaagtgccagtggagaaggttgctgatgcgaggaagtcaaatgcgaaaactgcacatgctaatgatatggtcatgactgataagtccaaagattttgtacattcgggttctatgttggaggtgcagaaggcttcatcacctgctgttgggccaaatactacaggtcaacctgaaggtggccctgattctagaactgtctttgttaacaatgtacattttggtgcatcgaaagatgctcttactcgacacttcaataagtttggggctgtcctaaagacccttatggtaactgatggcatcactggtcagccaactggctcagcatatattgagtttttgcataaagaatcggcagagcaggcattaaccctaaatggcacatcttttatgtcacgcattttgaaggttgttcggaaatcctccactgaagcaacccagtttcctggcctaccccgtgcttctcggggatcaccctttgcttcaaggctcattagaactgcgtacccaaggcctaccttccctggtgctacccgcgggcgactgccactcagaggtggtgcccgcagtttacagtggaagcgtggcgcatctgattccgtcgatgctggaaaacctagtcaaactacacctgcagctcctgggaatcagttggtcaccccaaccacacgaagcttcacctacacacgcactgagccgaaaccaaatgacggtgcgatggcgtgactggcaaggcgcagcatgccactgttcctgatgaacctcgcagaaggagctcttgattgatggctgtcgtagttcattcagccacttttggtacatatttaagtagctgcagatcttagtttgtagcaggctgtttttttttgtgcacgtcaaaactttgagccatattctatgagcggcgttccgttttttccc

SEQ ID NO: 16941 - protein, 693 aa, Panicum virgatum
  misc_feature: Ceres CLONE 1790710
  misc_feature (519)..(589): Pfam Name: RRM_1 Pfam Description: RNA recognition motif. (a.k.a. RRM, RBD, or RNP domain)
MDGGEGRTFKANFTGEGVKMLQDRVKEKLRELMGDYSDDTLAEYVVVLLRNGRRKDEAAKELQVFLGDDNDAFVSWLWDHLSSNLHLYVQPKAAASSDEPKSTRSAGRGLPARSVTSSVQINCEPEAENQKTMKTHQRRDWGRTVREQSEAVPLRSVVANVSHAEEDEFHESHADERDFHKSHAGRRTRSPDMHNHRKRSRDADARSTKRASHPVIGAPRRLLQFAVRDAVRTVQPVTPRSESASKRLRSVVSTLASDSTLDITHIRLQRTNSDGRIPGATAALRAAAEAAEDAIKGSFSGSVFNRLGRMPTINHTETRDQDPEGEEYENIDNIRAENQVEFYERNQYGGSDAYMHDQESEEATGSAPNIDEYDRYNGLGSRRSTFPSSGGKESLVLGYVRGAAEVRNRRLIAQGAHAGSGPRPSENDLNISANISMRKLPTHETRDAVVFDPQVPVEKVADARKSNAKTAHANDMVMTDKSKDFVHSGSMLEVQKASSPAVGPNTTGQPEGGPDSRTVFVNNVHFGASKDALTRHFNKFGAVLKTLMVTDGITGQPTGSAYIEFLHKESAEQALTLNGTSFMSRILKVVRKSSTEATQFPGLPRASRGSPFASRLIRTAYPRPTFPGATRGRLPLRGGARSLQWKRGASDSVDAGKPSQTTPAAPGNQLVTPTTRSFTYTRTEPKPNDGAMA

SEQ ID NO: 16942 - DNA, 580 bp, Panicum virgatum
  misc_feature: Ceres CLONE 1790713
  misc_feature: Encodes the peptide sequence at SEQ ID NO. 16943
atcaagtgggcttcgacagcaaacattcagttcttggttagcctctattgccacttgctcgctgctcgatcacaaggagagtcggatccattgccaaccctggagccactcacctactacctgctggcgctccttctccctctcctgcttctcaagctcatcgcgagagcgcgacggcaatggacatgaggctgccgccgggggcgtgggagctgccggtcatccgcagcctccaccacctggtcggcaccccgctgccgcaccgcgccatggtcctcatcgcgcgccgcctcggcgcgccgcccttcatctacctccggctcggggaggtccccgaggccgtggcgaccgccccggtcaccacccgcgaggacatgaagacccacgacgcccgcctctccacgggcccgtggacgcccacgacgagggtcctcgtgcaggccggacatcgcctggtgttcgcgcgctcacggcgcgctgtggctgcagctccgcaggatcagcgtcctggagctgctcaacgtccgccgcgtccactcgttccgcgccgtctgggaggaggaggcgcgccgactcgtgg

SEQ ID NO: 16943 - protein, 133 aa, Panicum virgatum
  misc_feature: Ceres CLONE 1790713
  misc_feature: SWISSPROT Homolog: EC 1.14.13.68 4-hydroxyphenylacetaldehyde oxime monooxygenase
MDMRLPPGAWELPVIRSLHHLVGTPLPHRAMVLIARRLGAPPFIYLRLGEVPEAVATAPVTTREDMKTHDARLSTGPWTPTTRVLVQAGHRLVFARSRRAVAAAPQDQRPGAAQRPPRPLVPRRLGGGGAPTR

SEQ ID NO: 16944 - DNA, 720 bp, Panicum virgatum
  misc_feature: Ceres CLONE 1790717
  misc_feature: Encodes the peptide sequence at SEQ ID NO. 16945
gtggctatgcctaatactaacaggcagcaatggcggctctgcaagctacgccgctcaaaaccctagccttctcccgccggcgagccggcggcgcggcgctgcgcccgcggcagatggcttccttccggtgctccgccgccgcgaggagctacaacatcacgctcctcccaggggacggcatcgggccggaggtggtcgccgtcgccaaggacgttctctccctcgccggagcactcgaaggcgtcgagctccggttccaggagaagctgatgggcggctcggcgctcgatgccaccggcgtgccgctccccgacgaaacgctcgcggcagcgagggattctgatgccgtcctcctcggagccataggggggtataagtgggataacaatgaaaagcacctcaagcctgagacaggcttgctccagctccgtgctggcctttgtgtgtttgccaatctgcgtccagctgcggtactgccgcagctagtagatgcatctactctgaagaaagaggtagctgaaggtgttgacatcatggttgtcagagagcttactggagggatatactttggcaaacctaggggttttggaacaaatgacaacggagaggaaactggcttcaacacagaagtttattcagcttctgagattgatcgcatcgcacgtgttgcgtttgaggktgctcgcaagagaagagggaaactatgctcagttgataagg

SEQ ID NO: 16945 - protein, 202 aa, Panicum virgatum
  misc_feature: Ceres CLONE 1790717
  misc_feature (14)..(202): Pfam Name: Iso_dh Pfam Description: Isocitrate/isopropylmalate dehydrogenase
  misc_feature: SWISSPROT Homolog: EC 1.1.1.85 3-isopropylmalate dehydrogenase
  misc_feature: Useful for making plants with modulated biomass
  misc_feature (189)..(189): Xaa is any aa, unknown, or other
MASFRCSAAARSYNITLLPGDGIGPEVVAVAKDVLSLAGALEGVELRFQEKLMGGSALDATGVPLPDETLAAARDSDAVLLGAIGGYKWDNNEKHLKPETGLLQLRAGLCVFANLRPAAVLPQLVDASTLKKEVAEGVDIMVVRELTGGIYFGKPRGFGTNDNGEETGFNTEVYSASEIDRIARVAFEXARKRRGKLCSVDK

SEQ ID NO: 16946 - DNA, 691 bp, Panicum virgatum
  misc_feature: Ceres CLONE 1790717-R
  misc_feature: Encodes the peptide sequence at SEQ ID NO. 16947
tctcgcacatgtatgtcgacaatgctgcaatgcagcttgttaggaatcctaagcagtttgacacaattgtcacaaacaacattttcggtgacatattatctgatgaagcatcaatgattacgggaagcatcggaatgcttccgtctgccagtgttggtgaatcgggacccggtctttttgaacctattcatggctctgctcctgatattgctgggcaggacaaggccaatccattagccacaattcttagtgcagcaatgctactgcgatatggccttggagaagaaaatgctgcaaagagaattgaagctgcagttacagaaactctgaaccagggattccgaactggtgacatatattctcctggaacgacactggttggatgcaagcggatgggggaggaagtcttgaagacagtggagtcagaaaaggcggtggctgctataaactgatgcaagttggtatagctgtatacctgtgaaatgatgttggaagtttgttagaagttgagccttctgaaagagtgcatggcatatggattgttgattttattggctgccgttgaattgattgggccgtctctttttcgctttgttgcttgttggactaccaaggtcgtccatgatgttggtgtatggtatgactgttgtccaataaatggggatagttcccattagagcatgttcaatag

SEQ ID NO: 16947 - protein, 149 aa, Panicum virgatum
  misc_feature: Ceres CLONE 1790717-R
  misc_feature (1)..(135): Pfam Name: Iso_dh Pfam Description: Isocitrate/isopropylmalate dehydrogenase
  misc_feature: SWISSPROT Homolog: EC 1.1.1.85 3-isopropylmalate dehydrogenase
  misc_feature: Useful for making plants with modulated biomass
SHMYVDNAAMQLVRNPKQFDTIVTNNIFGDILSDEASMITGSIGMLPSASVGESGPGLFEPIHGSAPDIAGQDKANPLATILSAAMLLRYGLGEENAAKRIEAAVTETLNQGFRTGDIYSPGTTLVGCKRMGEEVLKTVESEKAVAAIN

SEQ ID NO: 16948 - DNA, 1753 bp, Panicum virgatum
  misc_feature: Ceres CLONE 1790721
  misc_feature: Encodes the peptide sequence at SEQ ID NO. 16949
atcctcggagttggaggttggaacagaaccgagcggccaccgccggacggaggaggagaggagacggcggccggagcggccgaagagagccttgcaggcgtagcgtagacagccgagttcgccatgaggaggaggctgctgcagttccagtcccttgtcgcgcagcacgccctccgcggggtcccaaaacccagaccccagctccaaccccaccaccaccgcctcctcctccacttcccctcggctccgtcacccgcacccccctccccgtcggctcacctcctatggaatcgcctctccggggacaccgcttccgccctcctcccgaggagcgcggcggccgtcgcagcgtccgcgcggaccgctgcttcccggtggttggccgccgcccgcagcgccggctccctcgatctcttctcgctgcagcagcgacgggaggaccagcggtcggggcggcaattcgcgtcgaccatctttctccaaggcgcgccctgggcgtacgcgtactggacgcagtcccccgacgaggtggtgttgacactcgtcggcgtgaatgtggctgtcttcatgctctggcgtgtggctgatccggggttcatgtggaggcatttcatgatttcgctggacaatttcaaaagcggacggttgcacaccttgctcactaatgctatcagccactttgaatcggatcacctgatctccaatatgattggcctctacttctttgggacaagtattgcgaggacgtttggtccggcttttctgttgaagttgtatgtagctggagcacttactggatcggcattcttcttgctagagaaggcttttctagctccaaggaaacaggatggaagggatacttcaagagctcctgcacttggtgccagtgctgcagtcaatgcaactatcctccttcagatttttctgaatcccaacgggctggtctatctttacttcctaattcctatcccagctgcatttatgggggctgctttgattggtactgatttgtatagggtcaagaagggtaagggccgtatatcaggttcagctcatttgggtggtgcccttgttgctgctcttgtgtgggctcgaattaaaggctggatctgatcctcgggctttaatataagtggaccaaaagtgcaaaggcaaccatctgcgctcaccttgtgccccctaggttgaaatttgcatttgttgtcatctgctgactcgctgacattgagggatggctcctagaacatgcatgctacttatgcggaggatttttttttagataatgggaaaagagtacccagctttgatctcaaaagaggctacggctgcgcaggataatgtggtagcgggtattgtcaacactgactgatttttctagcggctttattctggcaatgactgcccctaaaacggaagaagaacccgaatcccagttggcacgttttaacttcgagtatatgaggctacggctggcctacggttgctgtctttctgatagaaagcggggaagagaatggcgaagaactgtatgaatggttcaagaaagcgtgttgaaagattcatgtaccagatcctacttatctatgcaaccgcagctgctactgtaggcaaaggtttccctctcttgtccatgctacttgtcataactgatgttcgaagatgctactcgtcatcagagcgttaggccacgcactgccgcaaactgtatgtgatgtggccgatgtcaaatgagttactggtttcgttcaagttc

SEQ ID NO: 16949 - protein, 181 aa, Panicum virgatum
  misc_feature: Ceres CLONE 1790721
  misc_feature (21)..(181): Pfam Name: Rhomboid Pfam Description: Rhomboid family
  misc_feature: SWISSPROT Homolog: EC 3.4.21.105 Rhomboid protease
MLWRVADPGFMWRHFMISLDNFKSGRLHTLLTNAISHFESDHLISNMIGLYFFGTSIARTFGPAFLLKLYVAGALTGSAFFLLEKAFLAPRKQDGRDTSRAPALGASAAVNATILLQIFLNPNGLVYLYFLIPIPAAFMGAALIGTDLYRVKKGKGRISGSAHLGGALVAALVWARIKGWI

SEQ ID NO: 16950 - DNA, 1568 bp, Panicum virgatum
  misc_feature: Ceres CLONE 1790724
  misc_feature: Encodes the peptide sequence at SEQ ID NO. 16951
aagggactcgccaataatggcatctctgactacctgtctcgggggccgttcctcgtggcgccggccggtactggtgcaccgcctcgtggtggtggcgatggcagcagcggcgtttcggccgcaggtagtccatggagcagcatcggctgggcaacagaaaatctcggcgatcttcatgttcggcgactccatcgtagatcccggcaacaacaacaaccggttcacggaggcaaaggctaacttcccgccatatgggcaggacttccctggcggcgttgccaccgggagattctccaatgggttggtacccggggacctcttagcttcgaagttgggtgttaagcagctattgcctcctttccttagtgatgatcttgaactaaaagacctactcactggtgtggcattcgcatgtggaggcagtggttatgatccactcacatcaaaactcgcggtgacttttttctctctttcatataaagtatttataccaatgttggagtatttattagcttttttatgatactttttagaactataaaatccagtcgaagttgatatatacatgcatgcaaattaatgtagacaaccttatccagtaaggatcaacttgacctatttcgtgactacaaggaaaaggtaagagccttggttgaagaggaggaaatgacacgtgttatttccgaggccgtctactttgtagtaatgggggcaaatgacattctaaataattatttcgctgttccgttgagacgccacgaatatgatcttccatcgtatgtggattttcttgtctcttcggcaatcagcttcaccaaggtaattattattttttaatttttcctgattactcttctttgtttattaatttctgttgtctgtttattatttaatgtttattgtccatcccctaatttctttatgtccatccccgaaccttccattctcgtttttattttctacttgcaaaggcatgaaatatttgctctctacttttgtgtagactctcaatgatatgggtgctaagaggattgggattgttggtgtcccaccactgggatgttgtccttcacaaataacacttggaggaagcccctcacgtcaatgcgaaccactaaggaatcaagcatcaagattatttaattctagaatttcacaggaaatagagatactaaatgcagagcgaagtgcttctggatcaacaattgcttattttgacatatactacaacctacttgatcttattcagaatccagctttgtatggtttcaaggacgtgagcgaaggatgctgtggtagcacagtgttaaatgctgccatattcattgcatatcatagtgcatgtccaaacgccaatgattatattttctgggacggcttccatcctaccgagaaggcatataacattgtagtggacaagcttattcagcaaaatatgaagtatctaatgtgaagaattgatgttgtacgtacaccctcaaaattttaattaatgtccattaccgtacgtccataccgaacaatctgaccatgaatgtaacttttcaatgccatttgccaagtggacc

SEQ ID NO: 16951 - protein, 168 aa, Panicum virgatum
  misc_feature: Ceres CLONE 1790724
  misc_feature: SWISSPROT Homolog: EC 3.2.1.51 Alpha-L-fucosidase
MASLTTCLGGRSSWRRPVLVHRLVVVAMAAAAFRPQVVHGAASAGQQKISAIFMFGDSIVDPGNNNNRFTEAKANFPPYGQDFPGGVATGRFSNGLVPGDLLASKLGVKQLLPPFLSDDLELKDLLTGVAFACGGSGYDPLTSKLAVTFFSLSYKVFIPMLEYLLAFL

SEQ ID NO: 16952 - DNA, 676 bp, Panicum virgatum
  misc_feature: Ceres CLONE 1790730-R
  misc_feature: Encodes the peptide sequence at SEQ ID NO. 16953
cagcttgtaagagaattgttcagggtggctgatgatctttctccttcgattgtatttattgatgagattgatgcagttgggacaaagaggtatgatgctcattcaggaggagagcgcgagattcagagaactatgttggagttgttaaatcagctggatggttttgattcaagaggagatgttaaagttattctagcaacaaatcgcatcgaaagtcttgacccagccttgcttcgaccaggtcgaattgacaggaagattgaattccctttaccagatgtaaaaaccaggaggcgcatcttccagattcacacatcaaagatgaccttggctgatgatgtaaacctagaagagtttatcatgtcaaaagatgagttttcaggcgctgatatcaaggcaatttgtactgaagctggcttgcttgctttgagagagcgtcggatgaaggtgacgcatgcagacttcaagaaagccaaagaaaaggtcatgttcaagaagaaagaaggtgttccggagggcctctacatgtgagattcatcagtaactgccactggaatgtagttgagcagtattttagtgtggagaactggtgtttgtaatctggttaaatggtctgagtgactgagtatgtttgctccctttttattggataatacaacacatataacagtaaatc

SEQ ID NO: 16953 - protein, 176 aa, Panicum virgatum
  misc_feature: Ceres CLONE 1790730-R
  misc_feature (1)..(144): Pfam Name: AAA Pfam Description: ATPase family associated with various cellular activities (AAA)
  misc_feature: SWISSPROT Homolog: EC 3.6.4.3 Microtubule-severing ATPase
QLVRELFRVADDLSPSIVFIDEIDAVGTKRYDAHSGGEREIQRTMLELLNQLDGFDSRGDVKVILATNRIESLDPALLRPGRIDRKIEFPLPDVKTRRRIFQIHTSKMTLADDVNLEEFIMSKDEFSGADIKAICTEAGLLALRERRMKVTHADFKKAKEKVMFKKKEGVPEGLYM

SEQ ID NO: 16954 - DNA, 716 bp, Panicum virgatum
  misc_feature: Ceres CLONE 1790730
aaaactggttttcctttcctcttctctcctccctccctctgcctctcaccaggtcacaccgggccaaaccctaaccggccatcggagatggggcaaggcacacccggcgggatggggaagcagggcggcctcccgggcgaccgcaagcccggcgagggcgggaagaaggagaagaagtacgagccccccgccgccccatcccgcgtcggccggaggcagaagcggcagaagggctccgaggcggcggcgcgcctccccgccgtcgcgccgctctccaagtgccgcctccgcctgctcaagctcgagcgggtcaaggactatctcctcatggaggaggagttcgtggccagccaggagcgcctgcgccccagcgaggacaagacggaggaggaccgatccaaggtcgacgacctccgagggacccccatgagcgtcggctcgctcgaggagataatcgacgagagccacgccatcgtctcctcgtccgtcgggcccgagtactacgtcggggtaatgtccttcgtcgacaaggaccagctcgagcctggatgcgccatactgatgcacaacaaggttctgtctgtggttggtattttgcaagatgaagttgatcctatggtttctgtaatgaaagtcgaaaaggcacctttggagtcctatgctgatattggtggcttagatgctcagattcaagaaatcaaagaagcagtcgaact

SEQ ID NO: 16955 - DNA, 661 bp, Panicum virgatum
  misc_feature: Ceres CLONE 1790745
  misc_feature: Encodes the peptide sequence at SEQ ID NO. 16956
ctgccaactagttacaattggctccaatttgccggcttcctcccctcctcccgctggatctcatgagattcgacgaccgccccgagccaccgcccccgccacctcagcatcatcatcttcacatcatataatatggtcggttgtgacaccttcctcttcgcctcagagtctgtgaacgatggacaccctgaccagctctgcgatcaggtctgatatgccctgctctatgcttgccttgctgacgaccctgacggcgaggttgcttgccagacctgcaccaagactaacatggtcatgggctttggtgacatccccacccaggccaatgtcgactacgagaagattgttatggagacttgccgcaacattggtttcgtgtcaccacatgtcgggcttgatgctgaccactgctgggtgctcgtgaacattgagcagcaatcccctgatattgctcatggtgtgcatggtcacttcacagagcgccctgatgagattggagctggtgaccagagacacatgtttgggtatgcgactgatgaaacccctgagctgatgcccctcagtcatgtccttgccaccaagcttggtgctcatctcactgaggtgcgcaagaacgggacctgcccctggctcaggcctgatggcaagacccaggtgactg

SEQ ID NO: 16956 - protein, 124 aa, Panicum virgatum
  misc_feature: Ceres CLONE 1790745
  misc_feature (67)..(124): Pfam Name: S-AdoMet_synt_M Pfam Description: S-adenosylmethionine synthetase, central domain
  misc_feature: SWISSPROT Homolog: EC 2.5.1.6 Methionine adenosyltransferase
MVMGFGDIPTQANVDYEKIVMETCRNIGFVSPHVGLDADHCWVLVNIEQQSPDIAHGVHGHFTERPDEIGAGDQRHMFGYATDETPELMPLSHVLATKLGAHLTEVRKNGTCPWLRPDGKTQVT

SEQ ID NO: 16957 - DNA, 708 bp, Panicum virgatum
  misc_feature: Ceres CLONE 1790747
  misc_feature: Encodes the peptide sequence at SEQ ID NO. 16958
aaaaacaagtccgcccaccgcacgcaaccacgacagagagagtccacgggtcgccatggcgagcaagcagagcctcctcgtcctcgccgccgtcgccgcctgcctcctcctcctcccggccgcctcggtcgccaccgacgtcgactactgcagtaggggcaagaagtacccggtgaaggtgagcggggtgcagatcgtacccgatccggtgcagcccggcaagccggccaccttcaagatttccgcttccactgataaaatcatccagaaggggaagctggtaattgatgttaagtatttcttcctctacgtgcactcggaaactcgcgacatctgtggagagactacctgtccagcaactggtgacttcgtgctctctcatcagcagacattaccaagcttcactccaccgggttcttacaccatcaccatgaagattgttggggacgacaatgaggaactgagctgcatctcgttcgggttcagcatcgggttcgtcgcctccagctgaacggatgcatcttctatgagcaccagaagtttgccatggatgtaattatgaaccacacactgtatcctacgactcccagtagagttgaggtccatgtacgctttgtgggtgtcgcaaacttactgttcaactaagacgttttttatcaaaagtgcgaccattcttcattctgctgcttgccacctcttcacaaagca

SEQ ID NO: 16958 - protein, 151 aa, Panicum virgatum
  misc_feature: Ceres CLONE 1790747
  misc_feature (25)..(145): Pfam Name: E1_DerP2_DerF2 Pfam Description: ML domain
MASKQSLLVLAAVAACLLLLPAASVATDVDYCSRGKKYPVKVSGVQIVPDPVQPGKPATFKISASTDKIIQKGKLVIDVKYFFLYVHSETRDICGETTCPATGDFVLSHQQTLPSFTPPGSYTITMKIVGDDNEELSCISFGFSIGFVASS

SEQ ID NO: 16959 - DNA, 649 bp, Panicum virgatum
  misc_feature: Ceres CLONE 1790753
  misc_feature: Encodes the peptide sequence at SEQ ID NO. 16960
gtgctctctcataggtgggttggcttctcctccccctcttagcaagtcgtcggctcaagggatttactgggaagggagatgggggacccggatgtggagtaccgctgcttcgtcggttgccgctgctgggccaccttgttccctcccctgcttccgggctacacctcctgcggggacgtcctcgactcataggtcctcgccaatcgtgagacagggaggtcccgttggttctgcttcgtcaccttctcctccgatccgtcgaggctagacgccatcccagccatgaacggcagggatctcaacggaccgtcacctcccgtctcatcaatctcaatcacgaggcggcggtggctgcggaggctacagctgtggttgtcggggtgagctactgtggctgtggcatttgctacagatgcgggggtgacgctggtggctacggcgatggtcaccgtgagggcggctacggcggaggccgcggcacccgtctccgcgagggcggctacggtggcggtggctaccgcggccgcggtgactccggtggtaactggaggaactgatggggttggccctctcgtgctggcagccaagttatcctatatatctattagtgttcgtgtcactgattgatccgactatcccctttcttttg

SEQ ID NO: 16960 - protein, 37 aa, Panicum virgatum
  misc_feature: Ceres CLONE 1790753
  misc_feature: Useful for making plants with altered lignin content
  misc_feature: Useful for making plants with modulated nitrogen use efficiency
  misc_feature: Useful for making plants with modulated flowering time
  misc_feature: Useful for making plants with altered alkaloid content
  misc_feature: Useful for making plants with modulated biomass
MGDPDVEYRCFVGCRCWATLFPPLLPGYTSCGDVLDS

SEQ ID NO: 16961 - DNA, 744 bp, Panicum virgatum
  misc_feature: Ceres CLONE 1790755
  misc_feature: Encodes the peptide sequence at SEQ ID NO. 16962
aggtgcatccatcgtggcctccgactccatctatctatcctcttcctctccagcgccacgccgcgctagttcacacagcacacatccctctgcagactccggccctgcggggggcggcgccatggcggctgcgaatgggagcggcggcaaggggttcgaggtgcccaaggtggaggtcaggttcaccaagctcttcatcaacggccagttcgtcgacgccgtctccggtaagacgttcgagacccgggacccgcgcaccggcgaggtcatcgccaacatcgccgagggcgacaaggccgacgtcgacctcgccgtcaaggccgcccgggaggccttcgacaatggcccctggcccaggatgtcgggctatgagcggggccggatcctgtacaagttcgcggacctgatcgaccagcacgtcgaggagctggcgatgctggacacggtggacgccggcaagctcttcctcgtcggcaaggtctgggacatcccgggcgccgcgcacctgctgcgctactacgccggcgccgccgacaagatccacggcgagacgctcaagatggcgcagcggatgcacgggtacacgctcaaggagcccgtcggcgtcgtcggccacatcgtgccctggaactactccaccaccatgttcttcttcaaggtcagcccggcgctcgccgccgggtgcaccgtcgtcgtcaagcccgccgagcagacgccgctctccgcgctcttctacgcgcacct

SEQ ID NO: 16962 - protein, 207 aa, Panicum virgatum
  misc_feature: Ceres CLONE 1790755
  misc_feature (30)..(207): Pfam Name: Aldedh Pfam Description: Aldehyde dehydrogenase family
  misc_feature: SWISSPROT Homolog: EC 1.2.1.3 Aldehyde dehydrogenase (NAD(+))
  misc_feature: Useful for making plants with altered carbohydrate content
MAAANGSGGKGFEVPKVEVRFTKLFINGQFVDAVSGKTFETRDPRTGEVIANIAEGDKADVDLAVKAAREAFDNGPWPRMSGYERGRILYKFADLIDQHVEELAMLDTVDAGKLFLVGKVWDIPGAAHLLRYYAGAADKIHGETLKMAQRMHGYTLKEPVGVVGHIVPWNYSTTMFFFKVSPALAAGCTVVVKPAEQTPLSALFYAH

SEQ ID NO: 16963 - DNA, 2163 bp, Panicum virgatum
  misc_feature: Ceres CLONE 1790756
  misc_feature: Encodes the peptide sequence at SEQ ID NO. 16964
gacattccttcggagttcggacggcagcgctccgcccggcccaccctagcgcattctcccgtgacccctcgttcgctgcctactgcctcccgtcccgtctcgatccccttccctcccccttccgcctcgtcagtttctaccctgcggcttgccccttctccggccgccctagccgccccgccgccgccgccgcagaagcccgatccgaccaccccgaggtcagaaatccttgataaacttgatggcaatgattgatgagcctctgtatccgattgaggtactgattgacgagcttaagaatgaggatatccaattgcgtctaaactccctcagaagactttccacaattgcacgggcgcttggggaagaaagaaccagaaaggaactgattccttttcttagtgaaaacaatgacgatgaagacgaggtgcttcttgcaatggctgaggaattgggtgtgttcattccttatgttgggggtgtagaacatgcacatgttttgcttcctccattggagacattgtgtacggtggaggaaacttgtgtccgtgataaggcagttgaatctctgtgccgtattggtgcgcagatgaaggaaaatgacattgtcgactggttcattccagtagtaaagaggctagcagcaggtgagtggtttgcagctcgggtatcatcatgtggtcttttccacattgcctattcaagtgccccggaccaactgaaagcagaattgaggactatctatggtcagttatgtcaggatgacatgcctatggtcagaagagcagctgcatcaaatcttggaaagtttgcggccacagttgaacaaagtcatttgaagacggaaataatgtcaatatttgatgatttaacccaagatgatcaagattcagtgcgtttgttggctgttgaaggctgtgctgctcttggtaaattgttggaaccacaagattgtgtagcacatattctcccagttattgtcaatttctcccaggataaatcttggcgtgttcgttatatggttgccaatcaattgtatgagctctgtgaggctgttggccctgagcctacaagagctgatttggcgcctgcatatgttcgtctccttcgtgacaatgaggctgaagtgcggatagccgctgctggaaaagttactaagttctgtcgcatattaagtccacagctcgcaattcaacacattcttccatgtgttaaggaattgtcatcagattcgtcccagcatgttcgttcagctttggcttcagtcattatggggatggctcctgttttgggaaaggatgctaccattgaacaacttcttcctatttttctctctttgttgaaggatgaatttcctgatgttcgactcaacataatcagcaaacttgatcaagtgaatcaggttattggaattgacttgctgtctcaatcactgcttccagccattgtagaacttgcagaggataggcactggagagtccggcttgcaataattgagtacatcccattgttagcaagtcaattaggtgttgggtttttcgataacaagttgggggtgctctgcatgcaatggttggaagataaggtcttctctatcagagatgctgctgctaacaacttgaagcgccttgcagaggagtttggtccagagtgggcaatgcagcatataattcctcaggtgctggaaaagatcaacaatccgcactacctgtaccgcatgacgattctgcaagctatctcattgttggcccctgtcataggtgcagaaatcacttgtcaaaagctgcttccagtcgtcattaattcttcaaaggacagggttcctaacatcaagttcaatgttgcaaaagtactgcagtcgcttgtaccaatccttgatcaatttgttttggataagactgtgaaaccgtgccttgttgagctcagcgaggaccctgatgtggacgtaagatactacgcaaaccaggccctgcaggcgtgcgatcaaatgatggtgtcgagctaacgagtctgatatttagagcttgatttttcttagtccaattttggagtacctgtaatttggcttttagattgaagagttccttctagcctcagtaacagatcaacttccatgctgataaatggacgtcatccaaaattaaataccttgtttgttgtgtc

SEQ ID NO: 16964 - protein, 587 aa, Panicum virgatum
  misc_feature: Ceres CLONE 1790756
  misc_feature (236)..(272): Pfam Name: HEAT Pfam Description: HEAT repeat
  misc_feature (353)..(389): Pfam Name: HEAT Pfam Description: HEAT repeat
  misc_feature (314)..(350): Pfam Name: HEAT Pfam Description: HEAT repeat
  misc_feature (392)..(428): Pfam Name: HEAT Pfam Description: HEAT repeat
  misc_feature (275)..(311): Pfam Name: HEAT Pfam Description: HEAT repeat
MAMIDEPLYPIEVLIDELKNEDIQLRLNSLRRLSTIARALGEERTRKELIPFLSENNDDEDEVLLAMAEELGVFIPYVGGVEHAHVLLPPLETLCTVEETCVRDKAVESLCRIGAQMKENDIVDWFIPVVKRLAAGEWFAARVSSCGLFHIAYSSAPDQLKAELRTIYGQLCQDDMPMVRRAAASNLGKFAATVEQSHLKTEIMSIFDDLTQDDQDSVRLLAVEGCAALGKLLEPQDCVAHILPVIVNFSQDKSWRVRYMVANQLYELCEAVGPEPTRADLAPAYVRLLRDNEAEVRIAAAGKVTKFCRILSPQLAIQHILPCVKELSSDSSQHVRSALASVIMGMAPVLGKDATIEQLLPIFLSLLKDEFPDVRLNIISKLDQVNQVIGIDLLSQSLLPAIVELAEDRHWRVRLAIIEYIPLLASQLGVGFFDNKLGVLCMQWLEDKVFSIRDAAANNLKRLAEEFGPEWAMQHIIPQVLEKINNPHYLYRMTILQAISLLAPVIGAEITCQKLLPVVINSSKDRVPNIKFNVAKVLQSLVPILDQFVLDKTVKPCLVELSEDPDVDVRYYANQALQACDQMMVSS

SEQ ID NO: 16965 - DNA, 1603 bp, Panicum virgatum
  misc_feature: Ceres CLONE 1790758
  misc_feature: Encodes the peptide sequence at SEQ ID NO. 16966
aagcagcgagggaaaccaaaaccgccgccgccgaccacccgctccgattcgccgccgctgctctccccaccgcccgccgcggaggaaatggcgtccactttctctttcccggagatgacgccggctcagctcgcggaggcgctgcgcaccttcggcatcgcgcccaccgccaacctccgcgccgaggacatcgccaccccgcagcccgacctcctccccggcgtcctctccctcttcctcgccaccgtcgtaggcgacgaccccgacgaccagctagggttcgacctgctgcagaagctcgacaacccggagcaccacatgggcgccataggccttaggagcatttacgggagggcacgggacgtccttgagtccatccacttcgggggcctcacgttccgcgacctcacccgccccgaaccgcgccgcgtcgtctacatcctcagcgccatcgtcaactacctccacttcaggcacgagaagctcgccctcctcaaccccatcgcagaagagttctccagcgttgacgagcgcctcccggagggcaaggctaggatcgccgagctccagaaggtgaaagagaatcatgcgtccaaggagcagatggacgagcctgccgtccagcagctccaggcggaggtcaacgccctcaagcagaagattcaagaatacaacacaaagcagctggcgctgcgaggcagagcaaagtccatagatgaaaagaaagaggggatccttgccaagatctcccaagctgatttcgagttgatgaaacgctcccaagaaaattcaaagctattatccaaaatcgttcagtcccctgaaaagtttcagaaaaaccttgaggagaagaaaggagtccgtgatgagttaaagaccttggagaagatggcaatgcataaagtccaggacaaaaccaatgctcttgagatgtatacaaaggtctgtgagaaactatcaaagcatctctctaaaattgatgctctacatgaaacgagcacttctgctaaagcttctgagaaggaggttaaagcactcaaagccaagattagtgatcaaagtttggagatgaagacccttcatattaaagctgatgaatggcgatcaaaagtacatgaaaccgaggaccggctcaaggcaaaggagaaagaaaaggaccaaagaatcggagagaataaacagaagatggctgcactgaaatctgaagctgaatcagaacttaagtgccttgcagatagggaaagggaaactgaggagaaagttgcaaaggctgctgatttacgctcccaagctgatgcggtagaggctgctggcagaaaaaaacgagaggaaatctttgccacgtttgggcaagtttgcgagacggctaacctgtacttggacggcatcgatcgttccgccagagaagttgacgaagcgagtatgaccattataggacagtgtgtcgcttcatgtgacgatatggcatgatggatgtatataggtcgtagtaattgagctagtgctgttccccttgtgtatattcgactggattttggattttggattttggacagcatttgcacctcgatccatgctgctctagccattccagtatgctcgc

SEQ ID NO: 16966 - protein, 460 aa, Panicum virgatum
  misc_feature: Ceres CLONE 1790758
  misc_feature (2)..(146): Pfam Name: Nuf2 Pfam Description: Nuf2 family
  misc_feature: SWISSPROT Homolog: EC 5.2.1.8 Peptidylprolyl isomerase
MASTFSFPEMTPAQLAEALRTFGIAPTANLRAEDIATPQPDLLPGVLSLFLATVVGDDPDDQLGFDLLQKLDNPEHHMGAIGLRSIYGRARDVLESIHFGGLTFRDLTRPEPRRVVYILSAIVNYLHFRHEKLALLNPIAEEFSSVDERLPEGKARIAELQKVKENHASKEQMDEPAVQQLQAEVNALKQKIQEYNTKQLALRGRAKSIDEKKEGILAKISQADFELMKRSQENSKLLSKIVQSPEKFQKNLEEKKGVRDELKTLEKMAMHKVQDKTNALEMYTKVCEKLSKHLSKIDALHETSTSAKASEKEVKALKAKISDQSLEMKTLHIKADEWRSKVHETEDRLKAKEKEKDQRIGENKQKMAALKSEAESELKCLADRERETEEKVAKAADLRSQADAVEAAGRKKREEIFATFGQVCETANLYLDGIDRSAREVDEASMTIIGQCVASCDDMA

SEQ ID NO: 16967 - DNA, 1543 bp, Panicum virgatum
  misc_feature: Ceres CLONE 1790771
  misc_feature: Encodes the peptide sequence at SEQ ID NO. 16968
aatccccgctcgctgcttccggagagctcgcgtcgcgtggcgcgtgcgtgcgtgcgctggctggcgcgcgcggcggcggagcagcacagcactggcggtgcgcgttctcgatggccgacggcgagccttccctcacgcgctggaccttcgaggatttcgaggtctactacgaggcgcgcctcggcgtccgccgcgagcccgcgggcgacggcgacgatgggcccccgccgcgcggatccggccacctggccggcagccccgccgtaccacgcgccaacggcggcgcggacctcgccgtcgtcgagcagttcgagcggatggtgctggagaggaaggtggaggcgcgcaatggggctatagaggatgggccgccgctgaaacctctacttccttcatttgaatctgcagaaatgcgtaacttagctgagacattgttgaaggatataattcgtgggagcccagatgtcaagtgggaaagcataaaaggtctggagaatgcaaagcggctcctcaaagaagcagttgtcatgcccattaaatatcccaagtacttcacaggcctattatcaccttggaaaggtatattactatttggtccacctggaacaggaaagacgatgctagcaaaagctgtggctactgaatgcaaaactacctttttcaatatttctgcctcgtcaattgtgagcaagtggcgtggtgactcggagaaactagtcaaagtgttatttgagcttgcaaggcatcatgcaccatctaccattttccttgatgagattgatgctattattagtcaacgtggtgaagctcgtagtgaacatgaagccagccggcgattgaaaactgagttattaatacaaatggatgggttgactaagacagatgagcttgtctttgttctagcggctacaaatttaccatgggagttggatgcagcaatgctgcgacggctggagaagcgtattcttgtaccattgccagagccagatgctagatatgctatgtttgaagaactcctgccatctggtcctggcagaatggagatgccctatgatgttcttgtggagaaaactgaaggatattctggctctgatattcgccttgtgtgcaaggaggcagcaatgcagcccctaagacggttaatgacagttctcgaatgcaaccaagaagaggtccctgaggatgagttgcctgaagtcagtccggtaacatcagaagatattgaacttgctttaaggaatacaaggccgtctgctcatcttcatgcacacagatatgaaaagttcaaccaagattatggtagccatgtccatggctgaaggagtctgttgtaagatatttgtactcagtatggaactcgtgcatgggctgttagatcagtgttgagtttccatcgatgagatgaaggtatccttgtaaacgcactgcttatgcttgtatcctgtacattatcattcatttgacgagtaataagctcttggcttaatttagctccacctggaatcagcagaaactagggtggtacctacatttggctcgtttt

SEQ ID NO: 16968 - protein, 402 aa, Panicum virgatum
  misc_feature: Ceres CLONE 1790771
  misc_feature (157)..(342): Pfam Name: AAA Pfam Description: ATPase family associated with various cellular activities (AAA)
  misc_feature: SWISSPROT Homolog: EC 3.6.4.3 Microtubule-severing ATPase
MADGEPSLTRWTFEDFEVYYEARLGVRREPAGDGDDGPPPRGSGHLAGSPAVPRANGGADLAVVEQFERMVLERKVEARNGAIEDGPPLKPLLPSFESAEMRNLAETLLKDIIRGSPDVKWESIKGLENAKRLLKEAVVMPIKYPKYFTGLLSPWKGILLFGPPGTGKTMLAKAVATECKTTFFNISASSIVSKWRGDSEKLVKVLFELARHHAPSTIFLDEIDAIISQRGEARSEHEASRRLKTELLIQMDGLTKTDELVFVLAATNLPWELDAAMLRRLEKRILVPLPEPDARYAMFEELLPSGPGRMEMPYDVLVEKTEGYSGSDIRLVCKEAAMQPLRRLMTVLECNQEEVPEDELPEVSPVTSEDIELALRNTRPSAHLHAHRYEKFNQDYGSHVHG

SEQ ID NO: 16969 - DNA, 2112 bp, Panicum virgatum
  misc_feature: Ceres CLONE 1790791
  misc_feature: Encodes the peptide sequence at SEQ ID NO. 16970
agagacttccgcaaacaagtcatcgctcgcagagagatccgcagaactaataaacagccgggctctctccgctcacccttcgcgcaccgcccctcctatcctctctccccgcctccctctcctcggcgccgcgtcgcctccggaccctctcgccatggcgaggccgccgcaggaggcgatcgacaccttcgtcagcatcacgggggcggacgaggccctggccgtccgcaggctcgaggaacatggtggtgacctcaatcgggccatcaactctcatttcaatgaaggagacagcgcgctgaatgcaatcaatcaaaacactgtaactgctagtcgtgatgatatgatggatgtggatggaccacttgataatacattccaaagatctttgttcccagagaatttccgtgatccttttgcactgatggatccaaattttcagcaacaatttttcgacagaattggtgccactgatagtgtcagtcttgggccgctggtttcacaccctagagaggtgagagagattcctatcgaagttaaggagggtgatcctcacacaggtccatctggtcaggcccctgttattgaggatgttactggaaatgagtcttcacttggccctgaagttcatgaaactgtcataattgatgatgaggatgacatgttgccatcggcactgtctgctccgcatgctaatatccctagcaacacatcttctgtgccaactgctcctccattggttcatgttaatgattatgatgatgacatagaagaggaaatgattagggcagcaattgaagcttcaaagaaggatgctgaaggactggaaaatatagtagagcgaggaggagatcaacatccagagggcgtgaacttgggagagcattcttctgcagacatgggaactgcagatggaacagttggaaggcaaggactagcttcaggaaaggctggaacatctaggcaacccatagatgaagagagcttgcaagaggatactgaagatgtagaagaacaaccgttggttagacgtcgttctaggcgtgttccttctgaaagcactgagttagcaccaatggtgcaaccaggtcctagccctgtcctgaacaatcgccagtctaatggagatgatttcccatctgagtggggtggcatttcttctgaggaacatgatgaagctgttatgcttgaggctgcaatgtttggtggagttcctgaaggaccaacatatcatttctccatgccttctcacagaagctcaacttattatcccccactagcgcattctccttcaccagcattaaccgaacaacggttattacgagagcagcaggatgatgaataccttgcatctctacaagctgaccaagaaaaggaattaaaggccttagaggaggctgagctccgccgcctagaagaaacggttgcgagagaagctgctcttgaaaaacagaagcaggaggagcaggaaaggcgtaaaaagcaacttgaggaagaggagctagagtccaatctcgcatccaagcaagcatcattaccgtcagaaccacctccggacatagaaggtgctgtgacagttgtggttcgcatgcctgatggtagtcgacaggggcgtcgctttctcaaaactgataagtttcagtttctatttgacttcttagacattgggaggacttttaagccagggacctacagattggtcaggacatacccgaggcgcacctttaccaccagcgagggtgacgtatcattcagtgatctcggcctcacaagcaagcaagaagccctatttctagaacagatcacagaatagtgccctgtgtcctaggcatggttagagagagatgccatctggacttgggaggttttacatttttatacttgtgccttgtatctgtaaagattcagtccgtcaaatggttcggttgaagaaaggttaaattcttttgtggcgacactttgcgccccaaatgttttactgtgttatatgtgccagctaagaaaaggttcatgtcagagtaaaccgtggagggcatatggggccaggatatgtatgcaatgtgaaaccttgtgcctgtgcattatcattcatctcaaagagcccccctctgc

SEQ ID NO: 16970 - protein, 552 aa, Panicum virgatum
  misc_feature: Ceres CLONE 1790791
  misc_feature (467)..(549): Pfam Name: UBX Pfam Description: UBX domain
MARPPQEAIDTFVSITGADEALAVRRLEEHGGDLNRAINSHFNEGDSALNAINQNTVTASRDDMMDVDGPLDNTFQRSLFPENFRDPFALMDPNFQQQFFDRIGATDSVSLGPLVSHPREVREIPIEVKEGDPHTGPSGQAPVIEDVTGNESSLGPEVHETVIIDDEDDMLPSALSAPHANIPSNTSSVPTAPPLVHVNDYDDDIEEEMIRAAIEASKKDAEGLENIVERGGDQHPEGVNLGEHSSADMGTADGTVGRQGLASGKAGTSRQPIDEESLQEDTEDVEEQPLVRRRSRRVPSESTELAPMVQPGPSPVLNNRQSNGDDFPSEWGGISSEEHDEAVMLEAAMFGGVPEGPTYHFSMPSHRSSTYYPPLAHSPSPALTEQRLLREQQDDEYLASLQADQEKELKALEEAELRRLEETVAREAALEKQKQEEQERRKKQLEEEELESNLASKQASLPSEPPPDIEGAVTVVVRMPDGSRQGRRFLKTDKFQFLFDFLDIGRTFKPGTYRLVRTYPRRTFTTSEGDVSFSDLGLTSKQEALFLEQITE

SEQ ID NO: 16971 - DNA, 3176 bp, Panicum virgatum
  misc_feature: Ceres CLONE 1790792
  misc_feature: Encodes the peptide sequence at SEQ ID NO. 16972
acagctcggcagctcacacccgagcagcccagcgcacagccgccgccgccgcatgtgagcgagccggcgccgcgaggggcacacgcattctctgccgggaacgagatccggcggggaaggaggatggaggcgagcgcggggctggtggccggctcgcacaaccggaacgagctggtggtgatccgccgcgagcccggcgggggggccggggcggcggcgcggcgggcggcggcggaggcgccgtgccagatatgcggggacgacgtcggggtgggcttcgacggggagcccttcgtggcctgcaacgagtgcgccttccccgtctgccgcgcctgctacgagtacgagcgccgggagggctcgcaggcgtgcccgcagtgccggacgcggtacaggcgcctcaagggctgcccccgcgtcaccggcgacgaggacgaggacggcgtcgacgacctcgagggcgagttcggcctgcgccacggcgggggagagggggacggcgatgacccccgggacgtcgccgcgtccatgctgcgggcgcacatgagctacggccgcggcgacgcgcaccacccggcggccggcttcggcgccgcccccggcgtcccgctcctcaccaacggccaaatggtcgacgacatcccgccggagcagcacgcgctcgtgccgtcctacatgggcggcggcggcggcgggggcaagaggatccacccgctccccttcgcagatccgagccttccagtgcaaccgagatccatggacccgtccaaggatctggccgcctacggctacggcagcgtggcctggagcgaccggatggagcgctggaagaagaaccaggagcgcctgcagcacgccaggagcgagggcggcgatgattgggacggcgacgatgcagatctgccgctaatggatgaagctcggcagccattgtccagaaaagttccgataccatcaagccgaattaacccctacaggatgattattgttatccggttggtggttttggggttcttcttccactaccgtgtgatgcatcctgtgcatgatgcatttgctttatggctcatatctgtaatctgtgaaatctggtttgccatgtcctggattcttgatcagttcccaaagtggcttccaattgagagagagacttacctggaccgtttgtcgctaagatttgacaaggaaggccaactctctcaacttgctccagttgacttctttgtcagtacggttgatccctcaaaggagcctcccttagtcacagcaaacactgtcctttccatccttgctgttgattatccagttgagaaggtctcctgctatgtttctgatgatggtgctgcgatgcttacatttgaagcactgtctgaaacttccgaatttgcaaagaaatgggttcctttctgcaaaaagtttaatattgagcctcgtgctcctgagtggtacttccaacagaagatagactacctgaaagacaaggttgccgcatcctttgttagggacaggagggcaatgaagagagaatatgaggaattcaaggtaagaatcaatgccttggttgcgaaagcccaaaaggttcccgaggaaggatggacaatgcaggatggaagcccctggcctggaaacaacgtacgcgatcatcctggaatgattcaggtattccttggccaaagcggtggtcatgatgtggaaggaaatgagctgcctcgcctcgtttatgtctcgagagaaaagaggccaggctatgatcatcataagaaggctggtgccatgaatgcactggttcgtgtctctgctgtcttatcaaatgctccatacctattgaacttggactgtgatcactacatcaacaatagcaaggccataaaagaggctatgtgtttcatgatggatcctttggtggggaagaaagtgtgctacgtgcagttccctcagaggtttgatggtattgaccggcatgatcgatacgctaacaggaacgttgtcttctttgatatcaacatgaaaggtttggatggtattcaaggacccatctatgtgggtactggatgtgtctttagacgccaggcactgtatggttatgatgctccgaaaaccaagaagccaccatcaagaacttgcaattgctggcccaagtggtgcctctcttgctgctgcagcagaaacaagaataagaatacgaaaccgaaaacagagaagaaaaagaaaatattatttttcaagaaagaagaaaatccatctcctgcatacgccctgggcgaaattgaggaaggtgctccaggtgctgacgttgagaaggctggaattgtaaatcaacagaagcttgaaaagaagttcgggcaatcttctgtatttgttgcatcaacacttcttgagaatggtgggaccttgaagagtgcaagtccagcatcgctactgaaggaagctatacatgttatcagctgcggttatgaagacaagactgactgggggaaagagattggctggatttatggatcaattacagaagatatcttgactggatttaagatgcactgccatggttggcggtctatttattgcatcccaaagaggcctgcattcaaaggttctgcacctctgaatctttctgatcgtcttcaccaggtccttcggtgggctcttggatctgttgaaattttcttcagcaagcactgcccactttggtatgggtatggtggtgggctaaaatttttggagaggttctcatatattaactctatcgtatacccctggacatccattccgttgttggcttactgtacattgcctgccatatgcttgctcacggggaaatttatcacaccagagcttaccaatgctgccagtatctggttcatggcgcttttcatgtgcatctttatcaccggcatacttgagatgagatggagcggtgtggccatcgatgactggtggagaaacgagcagttctgggtcattggaggtgtttcatcacatctctttgctgttttccaaggcctcctgaaggtccttgccggtatcgacaccagcttcaccgtgacatcgaaggctggggatgacgaggagttctcggagctgtacaccttcaaatggacgaccctgctgatccccccgacgacgctgctcctgctgaacttcatcggggtcgtggctggggtctccaacgcgatcac

SEQ ID NO: 16972 - protein, 1017 aa, Panicum virgatum
  misc_feature: Ceres CLONE 1790792
  misc_feature (269)..(1017): Pfam Name: Cellulose_synt Pfam Description: Cellulose synthase
  misc_feature: SWISSPROT Homolog: EC 2.4.1.12 Cellulose synthase (UDP-forming)
  misc_feature: The sequence is a functional homolog of SEQ ID NO 26 in US patent 7312377
  misc_feature: Useful for making plants with altered cell wall content and/or composition
  misc_feature: Useful for making plants with modulated biomass
  misc_feature: The sequence is a functional homolog of SEQ ID NO 6 in US patent 7285702
  misc_feature: Useful for making plants with altered carbohydrate content
  misc_feature: The sequence is a functional homolog of SEQ ID NO 2 in US patent 7049481
MEASAGLVAGSHNRNELVVIRREPGGGAGAAARRAAAEAPCQICGDDVGVGFDGEPFVACNECAFPVCRACYEYERREGSQACPQCRTRYRRLKGCPRVTGDEDEDGVDDLEGEFGLRHGGGEGDGDDPRDVAASMLRAHMSYGRGDAHHPAAGFGAAPGVPLLTNGQMVDDIPPEQHALVPSYMGGGGGGGKRIHPLPFADPSLPVQPRSMDPSKDLAAYGYGSVAWSDRMERWKKNQERLQHARSEGGDDWDGDDADLPLMDEARQPLSRKVPIPSSRINPYRMIIVIRLVVLGFFFHYRVMHPVHDAFALWLISVICEIWFAMSWILDQFPKWLPIERETYLDRLSLRFDKEGQLSQLAPVDFFVSTVDPSKEPPLVTANTVLSILAVDYPVEKVSCYVSDDGAAMLTFEALSETSEFAKKWVPFCKKFNIEPRAPEWYFQQKIDYLKDKVAASFVRDRRAMKREYEEFKVRINALVAKAQKVPEEGWTMQDGSPWPGNNVRDHPGMIQVFLGQSGGHDVEGNELPRLVYVSREKRPGYDHHKKAGAMNALVRVSAVLSNAPYLLNLDCDHYINNSKAIKEAMCFMMDPLVGKKVCYVQFPQRFDGIDRHDRYANRNVVFFDINMKGLDGIQGPIYVGTGCVFRRQALYGYDAPKTKKPPSRTCNCWPKWCLSCCCSRNKNKNTKPKTEKKKKILFFKKEENPSPAYALGEIEEGAPGADVEKAGIVNQQKLEKKFGQSSVFVASTLLENGGTLKSASPASLLKEAIHVISCGYEDKTDWGKEIGWIYGSITEDILTGFKMHCHGWRSIYCIPKRPAFKGSAPLNLSDRLHQVLRWALGSVEIFFSKHCPLWYGYGGGLKFLERFSYINSIVYPWTSIPLLAYCTLPAICLLTGKFITPELTNAASIWFMALFMCIFITGILEMRWSGVAIDDWWRNEQFWVIGGVSSHLFAVFQGLLKVLAGIDTSFTVTSKAGDDEEFSELYTFKWTTLLIPPTTLLLLNFIGVVAGVSNAI

SEQ ID NO: 16973 - DNA, 633 bp, Panicum virgatum
  misc_feature: Ceres CLONE 1790792-R
  misc_feature: Encodes the peptide sequence at SEQ ID NO. 16974
ggtctggtggggaggcagaaccggacgccaacgatcgtcatcgtctggtccatcctgctggcctccatcttctcgctcctgtgggtccgcatcgacccgttcctcgccaagagtgacggccccctcctggaggagtgcggcctggactgcaactgaggaagaaaaccccccctgccgcaggcgaattacgccctgattttttggaattctttcctgtagatagaaacacagatcctggcacccgtccggcgttccttctgttccatggcggcgaggccgtggcatccctgtgcagctcttcttcaacattctccatccatttctccgttctccgaggaacctgcatcggaccgatctgctggtggccaccggagcaggaggacgacggcgattgtttgttgagtaaattaaagttaagttatataccatgcacattccattcccccccacagttggcacattagcgaagaacagatgattggttaggagttgattctttgtaagacctgcccgctcgccggaaacacgcggcgcgtgggcagcgatgtgttttttttgcttccgtggaatcgtatagaaactcccccactttttggtgctgtttcttgacgttttgaaagaaggaaagattgg

SEQ ID NO: 16974 - protein, 51 aa, Panicum virgatum
  misc_feature: Ceres CLONE 1790792-R
  misc_feature: SWISSPROT Homolog: EC 2.4.1.12 Cellulose synthase (UDP-forming)
  misc_feature: The sequence is a functional homolog of SEQ ID NO 26 in US patent 7312377
  misc_feature: Useful for making plants with altered cell wall content and/or composition
  misc_feature: Useful for making plants with modulated biomass
  misc_feature: Useful for making plants with altered carbohydrate content
  misc_feature: The sequence is a functional homolog of SEQ ID NO 6 in US patent 7285702
  misc_feature: The sequence is a functional homolog of SEQ ID NO 2 in US patent 7049481
GLVGRQNRTPTIVIVWSILLASIFSLLWVRIDPFLAKSDGPLLEECGLDCN

SEQ ID NO: 16975 - DNA, 2059 bp, Panicum virgatum
  misc_feature: Ceres CLONE 1790795
  misc_feature: Encodes the peptide sequence at SEQ ID NO. 16976
tctcttctctctcgcacggtcgcttcgttcttcgcaggttccaacctccagcaggaaagtgggaggggaatacgggatcggaggcgcccggcccccggaggcggaggagcggcgcaccctcggactcctcgctgaacaaaatggacctggcatcagaaggtttgacagcacaacagcagaaggcaaatagtcgaaaaccagttggtagctcacagatttggacacgatatggtgttctgcttccaagccagcagactcgaaagctaaaggaatgggttctgactaatcagcagcaacagcttgttaatgctagtggtcttggacatcttgcacttatcactgggtttaccattgatctttctttgcttacatccttttgtgagagatggaacaatgagacaaacactgcacatttcatgggatttgaaatggcgccatcacttcgtgatgtttcatacattcttggaattccagtgactggtcatgttgtgaccgcagagccaattggtgatgaagctgtgaatcgaatgtgcttacattatctaggacagagccctggaaatggagagcaattgtgtggcttaattaggttgacttggttgtataggaacttcagtcaactgccagaaaatcctaccattaatgagatcgcatattgcaccagagcatacctcctatacctggttggttccaccttatttcctgacaccatgagaggatttgtatccccaagatatctgcccctgttggcggattttaggaagatccgtgagtatgcttggggggctgcagcccttgctcatctgtataggggattgtctgttgcagtaacacctaatgccacaacacagtttcttggcagtgcaactttgctgatggcttggatttatgagtaccttcctataactcaaccacaacagaagaatcagagcaccttgctgccccgggcttgctggtggaactttggaggagcaacacgtggacaaagaaaaaaagttatggagtggagaaaagttttcgagcaacttcagttatctgaggtcaattggaacccttacaaggacatgaatccagcaattgttccagaatattgcattgctgcagataacatctgctactcacggacttggctaatcagctttaacataaaggaggtgtatgttcctgacaggtttgctaggcagtttggaagggatcagggtcgcctccacggcgtaccaatgtgggcaagaagaacatggagtaagtggaaagactggagggttgagtatgctcgtgagattgaggagttccatcaattggttggctgccgtttcaccccttcggcagaaaccaatatcaactccctaccaccagatgagtctgtagctggacagaatgctactggatgtagtcagaatacctctcatgacatttcttcaatgattgtagatttgaagaatgatctcccagtaattgataggtatcttgagggacacttgcttcctgcagaggttgcaagcttcttagagaaagtgggtacaatgatcaagaactactctccaccacagggcaacagaaggaagcataaagcagctcagggccaaataggcccggtcaggtcgaagaacccaaggaaaagggggaaaccttcactctttcaggatccttcaaaccctcatcagtatccaggcgcgctagtcccatatcaggcaagcaagtgtgacatagtgtttgatggtacggttcctctactaaatgggggtgaggagtacaaggaacaagaggctatggagccttggcaaacctcccatttgacaatgaccccgtcatcttcgtctctaggttcaagctcaccagaatcaatgaagcgggttcggcaagatgagggcgaaactcaaattccaagggactctgatggcctccggaggagtggaaggctctgcgtgcagctgaaaatgttcaagcacagggatggagtgggtgctgaggcagctaatccaatttttctctgacggagactaccagctcttggccttcgtattgtacaaagtagtggaaaaagaaaacttattttgtc

SEQ ID NO: 16976 - protein, 617 aa, Panicum virgatum
  misc_feature: Ceres CLONE 1790795
  misc_feature: SWISSPROT Homolog: EC 3.1.3.16 Phosphoprotein phosphatase
MDLASEGLTAQQQKANSRKPVGSSQIWTRYGVLLPSQQTRKLKEWVLTNQQQQLVNASGLGHLALITGFTIDLSLLTSFCERWNNETNTAHFMGFEMAPSLRDVSYILGIPVTGHVVTAEPIGDEAVNRMCLHYLGQSPGNGEQLCGLIRLTWLYRNFSQLPENPTINEIAYCTRAYLLYLVGSTLFPDTMRGFVSPRYLPLLADFRKIREYAWGAAALAHLYRGLSVAVTPNATTQFLGSATLLMAWIYEYLPITQPQQKNQSTLLPRACWWNFGGATRGQRKKVMEWRKVFEQLQLSEVNWNPYKDMNPAIVPEYCIAADNICYSRTWLISFNIKEVYVPDRFARQFGRDQGRLHGVPMWARRTWSKWKDWRVEYAREIEEFHQLVGCRFTPSAETNINSLPPDESVAGQNATGCSQNTSHDISSMIVDLKNDLPVIDRYLEGHLLPAEVASFLEKVGTMIKNYSPPQGNRRKHKAAQGQIGPVRSKNPRKRGKPSLFQDPSNPHQYPGALVPYQASKCDIVFDGTVPLLNGGEEYKEQEAMEPWQTSHLTMTPSSSSLGSSSPESMKRVRQDEGETQIPRDSDGLRRSGRLCVQLKMFKHRDGVGAEAANPIFL

SEQ ID NO: 16977 - DNA, 1641 bp, Panicum virgatum
  misc_feature: Ceres CLONE 1790810
  misc_feature: Encodes the peptide sequence at SEQ ID NO. 16978
gcagtaaaaggatccggcaattccagttagacgactcttaagtgaagtttaaatgcgcaaatttcttaaagctccattcgtccattcgttcttgtttcgtttttttgctctgtgggtagttttcagatcgtgaagtaaatatatgtcttattgcagctcgatctggtccggtagttttgaggttccggtaggtcttggatctgaagcgcaaccaaactccgctttttatgaactcaggtgatagtcaagaggcaatgcggccgttggacaagaagtgctacagctacatcaccaatggggcggcggcgagcgggaggccgcagcgcacgaatccagagccgacccggcccaagccgacgccgtccaagtgggacgacgcgcagaagtggctcgtcggcatgtccagcggtcgcgccgacggggtccgcggtttcgccggcgcggccagggccaggaactccaacgccgacgaccgccgcctcctcagctcgtcctcgcagaacggacgggtgtcgtgcagcagcgtggacggcgcgctggggtacagcatggtggtgaccgcgcccccgacgccgccgctgcagggcgagggcgccgacgacgtgggggagaccaagaagatcgactgcatggtgcagcagcacggctcgcccgtcgcggagatccggtccgtgtgcctgcgggacatggggacggagatgacgcccatcgctagcaaagagccgtccaggacagccacgcccctgcgtgcctccacccctgtagcgcggagcccaatctcctcgaggtcgtccaccccagcgaggagacgccaggaaaggcctagggccgttaccaccgccgttgtagggacgacgaccgagccggtgccgccacgcccggtcggttgtgccggcgaggaggggcccatggacgctcatgtgcccagcagcgcgaactcgctggagtcgcgcgcggcagcctgggatgaggcggagcgggccaagtacacggcgaggtataagcgtgaagaggtgaagatacaggcctgggagaaccatgagaagagaaaagctgagatggagatgaagaaaatgcagatgaagaccgaccagatgaaagcacgggctcaagagaagctggccaaccggctggccgcgacgcggcggatagccgaggagaagcgggcaagcgcagaggcgaagctcaacgagcgtgcggcgaggacgtcagagaaggccaactacatcaggaggacagggcacctgccatcctccttcaaaatgccgtgcttgtgcggctgaagcttgagcagagctagaagaaattgactgtgacaccatgcctcgtcattttttctggcactgtttgagaccacccagccgacggccagtcgtagctccaaagtcgagttcagacaatgagcccgtgcttttctgtgctaatgcattgtcagaatcaatctggctgcctggcttcttataacaaggtaaccggctgttcgggccatgatttgaaatgggaaaaaaaaacttcatgggataatatacaccctccgaacccaaacaggtcatttaggacataagcatagttttcaaacgacagtttgacttgtaatttttagatgtttacttttttttaatagagaaagctcaatatttt

SEQ ID NO: 16978 - protein, 351 aa, Panicum virgatum
  misc_feature: Ceres CLONE 1790810
  misc_feature (234)..(345): Pfam Name: Remorin_C Pfam Description: Remorin, C-terminal region
MNSGDSQEAMRPLDKKCYSYITNGAAASGRPQRTNPEPTRPKPTPSKWDDAQKWLVGMSSGRADGVRGFAGAARARNSNADDRRLLSSSSQNGRVSCSSVDGALGYSMVVTAPPTPPLQGEGADDVGETKKIDCMVQQHGSPVAEIRSVCLRDMGTEMTPIASKEPSRTATPLRASTPVARSPISSRSSTPARRRQERPRAVTTAVVGTTTEPVPPRPVGCAGEEGPMDAHVPSSANSLESRAAAWDEAERAKYTARYKREEVKIQAWENHEKRKAEMEMKKMQMKTDQMKARAQEKLANRLAATRRIAEEKRASAEAKLNERAARTSEKANYIRRTGHLPSSFKMPCLCG

SEQ ID NO: 16979 - DNA, 1431 bp, Panicum virgatum
  misc_feature: Ceres CLONE 1790820
  misc_feature: Encodes the peptide sequence at SEQ ID NO. 16980
aaccaaagccaccgccaccccaccattggcattactgcttctccctcccggtcgccgtcgacccccacccataccggacggaaggcgcgaggcgggcggacgagatgatggaggccgacgccgcgcggcggttacccgaaatggccggcgcacgcatggcttccgcgcccgccgctggatcctccgcccggaaacgcgcccgcggttaggtgcggcgtgtgctcgccgcgtccgcgtgcgtgcgtgtgtgtatatacatacatacagcagcaggtgaccggtgtcgccgaccgttgctgcggcgaggccggcgggggcgtgtggttgcagcgcagtgaatggtcatcatggccgggatgcttcccggtgtggagtgcgcgcggcggcggcggctccgccagggcggcgcgggcgcgggcgcggaggcgggcgcgggcacgggcacgaggcggctctccttctgcctgtatgcggcagggcacggagggcccccggccgccggccatggcggcgccggcagttccggcaaggtacgagaaccgaacaacgagtgatcagggaccactcgtcttgtcagtcgacgcagtgagatggcgcgcgggcggagtgattggttcttgatggctttgtttgtttgtttgcagcagcggagcgccgagatggagatgatacacgggtggacgctgggcagcaatgcccgggaggccaaggagcggctggaccagaagctccggagcaagagggaggccgccatcaagaggcatcacagcacggggagcataaagctgagcagaccccaccacaacgtgggcggcggcgcggaggagcgcggcgagagctcggcctcggcgccggcgatggccggcgtgcagcgggaggtgtactcgaggaagggcgtgatgcggcggctgatgcggtggagccgcctgcggtgggccgcggcggagcaggcggagtgcgcggtgtgcctggacgagttccgcgcgggcgacgtgctggcgcacctcccctgcggccaccgcttccactgggcctgcgcggcgccctgggtcgagggcacctcccgctgccccttctgccgcgccgccgtcgacgcccacccacatgccggcccatagatacgcctcgccggccgggccagcgtcgacgcaggaggaagaagtacgttgccggcgagccacaccattgccgtgctgccggagattggagaccacgactgcacgagacatccgtgaatctgcggccggttttgcacgcatccgacggcgccgtgccctgccgttctccttgttcggttgttgttcccatgagcgatcgatgagcgtttttcctacggcgagtaggcactgtacagagtgtgctagcgtttcccaatgtacgagtgcacgatgatcgtgtgatccagaaaaaaaagggactgtaatttggatc

SEQ ID NO: 16980 - protein, 175 aa, Panicum virgatum
  misc_feature: Ceres CLONE 1790820
  misc_feature (123)..(163): Pfam Name: zf-C3HC4 Pfam Description: Zinc finger, C3HC4 type (RING finger)
  misc_feature: SWISSPROT Homolog: EC 6.3.2.19 Ubiquitin--protein ligase
MARGRSDWFLMALFVCLQQRSAEMEMIHGWTLGSNAREAKERLDQKLRSKREAAIKRHHSTGSIKLSRPHHNVGGGAEERGESSASAPAMAGVQREVYSRKGVMRRLMRWSRLRWAAAEQAECAVCLDEFRAGDVLAHLPCGHRFHWACAAPWVEGTSRCPFCRAAVDAHPHAGP

SEQ ID NO: 16981 - DNA, 714 bp, Panicum virgatum
  misc_feature: Ceres CLONE 1790824
  misc_feature: Encodes the peptide sequence at SEQ ID NO. 16982
acaaacacagaccgcactacgccgctcctcccttgtcccctccatctcctccgtccgtctccatggaggcgagcaccggcaccggctgcagcgcccggacgctgacggcgtgcgtcatcggcggcatcgttctgggcgcatccgtgctcgcgctccacctcgcggggcctgtgtccgttccgtccctgccgccgctcgacgcggtcaggcgccgcctccgccgccgccgccgccccgtgcgcgtctacatggacggctgcttcgacatgatgcactacggacactgcaacgcgctgcgccaggcgcgcgccctcggggacgagctcatcgtcggcgtcatcagcgacgaagagatcaaggccaacaaagggccgccagttacgccgctccacgagagaatgataatggtccgtgctgtgaaatgggtggatgatatcattccagatgcaccttatgccataaccgaagagttcatgaacaaactattcactgagtacaacatagattacattatccatggtgatgatccttgtttgctaccagatggcactgatgcatatgcccttgccaaaaaggttggccgatataagcagattaaaagaacagagggagtgtcaacaacggacattgttggacggatgcttctttgtgttagggagagatcatcttctgatgcccacaatcactcttcgctacaaaggcaattcagtagtg

SEQ ID NO: 16982 - protein, 217 aa, Panicum virgatum
  misc_feature: Ceres CLONE 1790824
  misc_feature (62)..(192): Pfam Name: CTP_transf_2 Pfam Description: Cytidylyltransferase
  misc_feature: SWISSPROT Homolog: EC 2.7.7.14 Ethanolamine-phosphate cytidylyltransferase
MEASTGTGCSARTLTACVIGGIVLGASVLALHLAGPVSVPSLPPLDAVRRRLRRRRRPVRVYMDGCFDMMHYGHCNALRQARALGDELIVGVISDEEIKANKGPPVTPLHERMIMVRAVKWVDDIIPDAPYAITEEFMNKLFTEYNIDYIIHGDDPCLLPDGTDAYALAKKVGRYKQIKRTEGVSTTDIVGRMLLCVRERSSSDAHNHSSLQRQFSS

SEQ ID NO: 16983 - DNA, 683 bp, Panicum virgatum
  misc_feature: Ceres CLONE 1790824-R
  misc_feature: Encodes the peptide sequence at SEQ ID NO. 16984
tgggacgtatcaaaagacatgattaccacattcaatatttcgttggttgttcatggaacaattgctgagaatatggactatgcaaaggatgatgcaaatccatatgctgttccaatggctatgggtatttaccataggctggagagccctttggatatcactacaagtactattataaggaggattgttgctaaccatgaagcttaccagaagcggaacgagaagaaggaagccagtgagaagaagtactacgagggtaaaagctttgtcaatggggagtaagttacaactagacatagtaaggtggatgaagattgttgactagatgagttgagattccaagcctccttcacgaaggcaacagatccagagttttacctagcatgtttgatgttttgctaacttagcttaggaagtatcatgtgcaacattgatgagggattaccagaggcgatcgattacttgggctaggctagaagcatttctatcatttcccccagtgtctccagctaaaatttttcccctgtatatgcacctttgagttgtcgtttctggctgagttgtattttagatctataggtttcagaattgtgtggagcagtatgaatgttgccctgataaacagtgtgctgctgatgctcctgtatgcggatctgaatgcagtccttttctggatgcgcatc

SEQ ID NO: 16984 - protein, 93 aa, Panicum virgatum
  misc_feature: Ceres CLONE 1790824-R
  misc_feature: SWISSPROT Homolog: EC 2.7.7.14 Ethanolamine-phosphate cytidylyltransferase
WDVSKDMITTFNISLVVHGTIAENMDYAKDDANPYAVPMAMGIYHRLESPLDITTSTIIRRIVANHEAYQKRNEKKEASEKKYYEGKSFVNGE

SEQ ID NO: 16985 - DNA, 1776 bp, Panicum virgatum
  misc_feature: Ceres CLONE 1790829
  misc_feature: Encodes the peptide sequence at SEQ ID NO. 16986
tctccatagaccataagtatgttcccaactcgccgtcgcaccaatcggcggatcagccatgccgctgtctgcggccgaagttgacccccgcagcggttactgcgccgccactaggaccttccacagcatccgcccaacgcttccgctgccgccggccgacctcccgctctcctttccggccttcatgttctccctgctacccgccgcgctcccctcccgcccggccctcgtcgacgccgcaactggcgaggccgtccccttccccgccttcctctcccgggtccgcgcgctcgccgccgcgctccgtgcccgcctgggcgtctcccgcggcgacgtcgcctttgtcctcacgccgcccggcgtccacgtccccgtgctctactacgcgctcatggccgtcggcgccgtcgtgtccccagccaatccggccctcaccgccggcgagatctccggcctcatcgcgctctccggcccctccgtcgccttcgccgtcaaggccaccgcaggcaagctccctcccgacctcaacaccgtgctcctcgactcggcaagatttctttccttcttccacgaagcccgtgacgaggacggcgcggccgccgggacagatgtggtgacccaccaatcggacccggcggcgatactgtactcgtccggcaccaccgggcgctccaaggcggtcgtgctgacgcaccgcaacctcatggcctctgatgccacacgggcggcggcgactgcagaggtgctgatgctcgccgtgcctctcttccacgtatacggtttcacgttctgcctcagggtggcgccttcggcgagtacactagtgctgcacacggcgaggagattcgacggcagggaggtgctggctgcggtagggagatttggggctacgcggctcgcgctggcgccaccggcggtgctggcgattgtgcgggccgcggaggaggacgaggctttgattgctcgcgctgccaagctgcaggcagtgaactgcggcggcgcccccctcgcgactgagctctttcggcgcttcttgcacaaatttcctggcgtgtgccttttgcaggggtatggtcttacagagactacatctggtttttgccgtgctgttggagaggcagaaagtgcacaaattgggtcagtgggtcgtctttcatggggtgctcaagcaaagattgttcatcctgaaacaggggttgccctgcctcctggtgtgccaggggagctttgggtccgaggaccttttctgatgaaaggttatgctggtgatgaggattcaacatctaagatcatggatagtgagggttggttgaggacaggagatctttgttatattgacaaatatggaatcgtttttgttgttgatcggcttaaagagttaattaagtacaaaggctaccaggttcctcccgcagaacttgaaagcttgcttcagacacacccagatattgatgaagctgcagttgtgccataccctgatgatcaggctggggagttgccggtagcattcatagttagccgctcaggaagcattttgcatgaagcacaaatcaaagaatttgttgctaaacgggttgtgcactataagcaaatacaccatatcttctttgtgaattctataccaaaaaatgcagcgggtaagattttaaggaaggacttggcaaagttaacattgcagcatattcagtcgaagttatagtagtatatgtctgtttgtgtatgacctaagtcgctggtgtttgataaatggaaagataggacgaacaattattgcag

SEQ ID NO: 16986 - protein, 546 aa, Panicum virgatum
  misc_feature: Ceres CLONE 1790829
  misc_feature (67)..(469): Pfam Name: AMP-binding Pfam Description: AMP-binding enzyme
  misc_feature: SWISSPROT Homolog: EC 6.2.1.12 4-coumarate--CoA ligase
MPLSAAEVDPRSGYCAATRTFHSIRPTLPLPPADLPLSFPAFMFSLLPAALPSRPALVDAATGEAVPFPAFLSRVRALAAALRARLGVSRGDVAFVLTPPGVHVPVLYYALMAVGAVVSPANPALTAGEISGLIALSGPSVAFAVKATAGKLPPDLNTVLLDSARFLSFFHEARDEDGAAAGTDVVTHQSDPAAILYSSGTTGRSKAVVLTHRNLMASDATRAAATAEVLMLAVPLFHVYGFTFCLRVAPSASTLVLHTARRFDGREVLAAVGRFGATRLALAPPAVLAIVRAAEEDEALIARAAKLQAVNCGGAPLATELFRRFLHKFPGVCLLQGYGLTETTSGFCRAVGEAESAQIGSVGRLSWGAQAKIVHPETGVALPPGVPGELWVRGPFLMKGYAGDEDSTSKIMDSEGWLRTGDLCYIDKYGIVFVVDRLKELIKYKGYQVPPAELESLLQTHPDIDEAAVVPYPDDQAGELPVAFIVSRSGSILHEAQIKEFVAKRVVHYKQIHHIFFVNSIPKNAAGKILRKDLAKLTLQHIQSKL

SEQ ID NO: 16987 - DNA, 2011 bp, Panicum virgatum
  misc_feature: Ceres CLONE 1790830
  misc_feature: Encodes the peptide sequence at SEQ ID NO. 16988
aggcaaggtcttcgcagctgcagatcgagatcgaggcacagagtcagaagccaagagcttgctcctgtttctcggctgtgagtaaaatcagtgagaagagagggagagagagaaagagaatggcgtctccggttggcgcgtacaccggcggcagcggcagctcccacgccaggagcggcgggaggccggcggcggcgaagcagatgctgtcgaggctgcggtccacgtggaggagaagcgcggcgcggccgaggcggcgggccgcggtgagtttcggctacgacccgcggagctactcgcagaacttcgacgacggccttggtggatcctccggccacccgctctcagtgattccatgtaactagctcgtcagttattcaattcctggggattagcttagctttagctcgctggcacctccagattctgtaaatgactctcttctcctttgtagttagctagtgtacagtggagactcatgagtcatgaatcctccatcagtcagcattcagctagcgcacttcttgtcacctgttggaacctggaacggaatggttttaaaaaagccattcggcgagcaggtggttcagttcagggaccggtagcgcgggcaacaggcgcgcaacacggttgcatcagttcgtgttgagctcagcatccctagctcgcttggagtgtactacgagtctacgactgagctgaggatggagagcagcctgctcgacaccgccgcagctgccgccagtctctgcgcggcggcgggcgggcgccgccgcgccgggagcacggcgagcttcctcagctgctcctgctccccaagagactgcagggtgagcgcgtcctactcccgctccatcagccggatgctgagcggggtgcggtcggcggcgcgcaggaagctgttcagggccgacccggccgacctgctgggcgtcgccaactggcccgaggcgggcgtcgccgggcaccaccagcagcagcacttgtgggcggcgctcgagcacaacttcgtgctggagtccaccgacgacgagtacggcggggtcgtcgtcgacgccgacaggctgccggccgacaaagccgccttcgcgcgctcgctcgccgcgtcgctctcctactggaagtccgtggggaagaaaggggtgtggttgaagttaccggtggatcgtgccgagttcgttcccttggcagtaaaggaaggtttcaagtaccaccacgctgaggaatcgtacttgatgatgacgtactggatccctgacgagccaaacatgctcccagcaaatgcttctcatcaggttggagttgggggctttgtgatcaatgatcaaatggaggtcctagttgtgcaggagaagtattgcggttcgtcgctggatggtgtgtggaaactccccacaggtttcattcttgcgtcggaggagatctatacgggggctagcagggaggtgaaggaggaaaccggggtcgacaccgagttcgttgatgtcgttgctttcaggcatgcccacaacgtcgcgtttcagaagtccgacctgttcttcatctgcatgctgaggcctgtatcgagtgagatcaagattgatgagacagagattcaggcagcaaagtggatgccgctggaggagttcgtgaagcagcccttcatccaggaagaccacatgttccagaagatcatggacatctgcatccagtgcctgcgcaagtgctactgcggcctgacgccgcaccacgtcgtctccaggttcgacgaccggacgtcgacactgtactacaacgtcgccgagccagaggacgtgaactacagcgccacctgacgaagcgatcgccgcccagcctataccttagtagtacgattgctgcaagtgtgcaaacagctgaaactgcaaggcaatagtgttgccgagcctgtaaatatatttgtaggatgacagatcggtagctgcagtttggatagtgaatatctgtattcagatcctcggcaataaagaagtccgaaactgtgcacccgatc

SEQ ID NO: 16988 - protein, 369 aa, Panicum virgatum
  misc_feature: Ceres CLONE 1790830
  misc_feature (196)..(326): Pfam Name: NUDIX Pfam Description: NUDIX domain
  misc_feature: SWISSPROT Homolog: EC 3.6.1.17 Bis(5'-nucleosyl)-tetraphosphatase (asymmetrical)
MESSLLDTAAAAASLCAAAGGRRRAGSTASFLSCSCSPRDCRVSASYSRSISRMLSGVRSAARRKLFRADPADLLGVANWPEAGVAGHHQQQHLWAALEHNFVLESTDDEYGGVVVDADRLPADKAAFARSLAASLSYWKSVGKKGVWLKLPVDRAEFVPLAVKEGFKYHHAEESYLMMTYWIPDEPNMLPANASHQVGVGGFVINDQMEVLVVQEKYCGSSLDGVWKLPTGFILASEEIYTGASREVKEETGVDTEFVDVVAFRHAHNVAFQKSDLFFICMLRPVSSEIKIDETEIQAAKWMPLEEFVKQPFIQEDHMFQKIMDICIQCLRKCYCGLTPHHVVSRFDDRTSTLYYNVAEPEDVNYSAT

SEQ ID NO: 16989 - DNA, 2342 bp, Panicum virgatum
  misc_feature: Ceres CLONE 1790845
  misc_feature: Encodes the peptide sequence at SEQ ID NO. 16990
accatctccctcctcttctcaccgaatcgcacgaagaggggctcccccttcctcaagacctcacctctctcccggtctccccccgtcccccctcacctacgagtgatagcccacgcctgctgcgcgtgccccctccctcctatagcccctcgccattactccctccctcataaaggaagagcagagcagagcagggtcgaggaagaagcagcgccggggaagggcccggccgtagcctctccgcgacgccggctcggcgcctgccaaccgcgcggcgcggccaccccgctagaccccgtcttgcaggcgaacagagcctcgccgtcgatagcacagtaaattccgccgcattccattccccttcgctttcgaaacccaccctgcatttactgcacgccactcctcgccctccggcctcccgcgatcctcaaaatcttctcactgccaaaagccagcggccggagacgggaaggccgggcgcttctggatggcgcgcgagcagctggaggaggccatcgtggccgacggcaacggcaaggaggaggaggtcggcgtcatgggcatcgccgtcgcgggcgacggcgacgagcagcacggcggcggcaagttcagcatgaagagcttcctctggcacggcggctccgtctgggacgcgtggttcagctgcgcctccaaccaggtggcgcaggtgctgctgaccctgccgtactccttctcgcagctggggatgctgtccggcgtgctgctgcagatcttctacggcttcctgagcagctggacggcctacctcatcagtgtcctctacgttgagtaccgctcccgcaaggagaaggagggcgtcagcttcaagacccacgtcatccagtggttcgaagtgctggacgggctgctgggcccgtactggaaggcggccggcctggccttcaactgcacgttcctgctcttcggctccgtcatccagctgatcgcctgcgccagcaacatctactacatcaacgaccggctggacaagcggacatggacgtacatcttcggcgcctgctgcgccaccacggtgttcatcccctccttccacaactaccggatctggtccttcctggggctcggcatgaccacctacaccgcgtggtacctcgccatcgccgcgctcatcaacggccaggtagagggcgtctcgcacaccggcccgaccaagctcgtgctctacttcaccggcgccaccaacatcctctacaccttcggcggccacgccgtcacagtcgagatcatgcacgcgatgtggaagcctgccaagttcaagtacatctacctgctggcgacgctgtatgtgttcacgctgacgctgccgtcggcgtcggccatgtactgggcgttcggcgacgagctcctgagccactcgaacgccttctcgctgctgcccaagaacgggtggcgcgacgcggcggtgatcctgatgctgatccaccagttcatcacgttcgggttcgcgtgcacgccgctctacttcgtgtgggagaagatgatcgggatgcacgacgccaagagcatcttcaagcgcgcgctggcgcggctccccatcgtggtgcccatctggttcctcgccatcatcttccccttcttcggccccatcaactccgccgtcggcgccctcctcgtcagcttcaccgtctacatcatccccgcgctcgcccacatcctcacctaccgcacggcctccgcgcgcatgaatgctgcggagaagccaccgttcttcctgccgagctgggtggggatgttcgtggtgaacgtgttcatcgtggtgtgggtgctgatggtcggcttcgggctcggcggctgggccagcatggtgaacttcatcaggcagatcgacacgttcgggctcttcgccaagtgctaccagtgccccaagccgcccgtccccgccgcgccggcaccgttgccgcaccactaggggggcgcgcgtacgatggcggcggcggcggtagccagaggcatcgcaaggaagcccccgctctcccggccggctcgttggcgtcgctttgcagcagccagtgttaattgctaggttttggtcgccttgtaatatacaagcctcctctcccctagggtgccgcttcacaccgtagcagagcccgatcggcagcagaggtttctcgcacggcggcggctcgggtcccgttcctgggcgtaacaagaagaacacaagatctcctcgccccgaggccgtgccgctgccgtgtcgctttcccctcgccccgcgcccgatcggtccgtcgccattggtgttccttgtgttttgtttggcttgccacaagtataagtgtgagtgatggtcatgggtt

SEQ ID NO: 16990 - protein, 487 aa, Panicum virgatum
  misc_feature: Ceres CLONE 1790845
  misc_feature (49)..(443): Pfam Name: Aa_trans Pfam Description: Transmembrane amino acid transporter protein
MAREQLEEAIVADGNGKEEEVGVMGIAVAGDGDEQHGGGKFSMKSFLWHGGSVWDAWFSCASNQVAQVLLTLPYSFSQLGMLSGVLLQIFYGFLSSWTAYLISVLYVEYRSRKEKEGVSFKTHVIQWFEVLDGLLGPYWKAAGLAFNCTFLLFGSVIQLIACASNIYYINDRLDKRTWTYIFGACCATTVFIPSFHNYRIWSFLGLGMTTYTAWYLAIAALINGQVEGVSHTGPTKLVLYFTGATNILYTFGGHAVTVEIMHAMWKPAKFKYIYLLATLYVFTLTLPSASAMYWAFGDELLSHSNAFSLLPKNGWRDAAVILMLIHQFITFGFACTPLYFVWEKMIGMHDAKSIFKRALARLPIVVPIWFLAIIFPFFGPINSAVGALLVSFTVYIIPALAHILTYRTASARMNAAEKPPFFLPSWVGMFVVNVFIVVWVLMVGFGLGGWASMVNFIRQIDTFGLFAKCYQCPKPPVPAAPAPLPHH

SEQ ID NO: 16991 - DNA, 1255 bp, Panicum virgatum
  misc_feature: Ceres CLONE 1790855
  misc_feature: Encodes the peptide sequence at SEQ ID NO. 16992
acaccccgggccacccgtgccatggcccggggttcggctcaaaaaattgctgaagaagctcaaaaaattgctgaagaagaataaatatactaattcgcgatgacacttattgcggcagatgattctcagcttcccgtcgagtgagcgagcactttgctgacacggcgagcagcaggctataagcaagctccaacttgtgagtgatcagcaaccgtgatggcgtcggagaagaccaagatcctggtggtcggcgccacggggtacctgggccggcacgtcgtggcggcgagcgcgcgactgggccacacgaccttcgcgctcgtcagggacgcggcgccgtccgacccggccaaggcggcgctgctcaagagcttccaggacgccggcgcgacgctcctcaagggcgacctctacgaccaggccagcctggtgagcgccgtcaaggccgccgacgtggtcatctccacggtcgggtcgttgcagatcgccgaccagaccaggctcgtcgacgccatcaaggaggccggcaacgtcaagaggttcttcccgtcggagttcgggctggacgtggaccgcacgggcatcgtggagccgggcaggacactcttgtcgggcaaggtggccgtccggcgcgccgtcgaggccgccggcatcccctatacgtacgtggtgaccggcttcttcgcgggctactcgctgcccgggatcgggcaggccctcgcccaggggccccccgccgacaaggccgtcgtcctcggcgacggcaacgccaaggccgtgtacatggaggagggcgacatcgcgacgtatacggtgctcgccgccgacgacccgcgcgccgagaacaagacgctgtacgtgcggccgcaggccaacacgctgtcgcacaacgagctgctggcgctgtgggagaagaagaccggcagggcgctcgagcgggagtacgtcccggaggaggccatcctgaagcagatccgagagtcgccggtgccggcgaacatcgtcctggcgatctggcacgcggcgcacgtgaggggggagcagaccggcttcgaggtcgacccggcgaagggggcggaggccgccgagctgtacccggacgtcaagtacaccaccgtcgacgagtacctcgacaggttcctctgaggaagacgacgcgcgtgatcatagatgtgtctccgattgatgcagtgtccaggtcgtgatgtcaatttgcacggcaataagatccgttccctttcgtggatcgtgatcc

SEQ ID NO: 16992 - protein, 309 aa, Panicum virgatum
  misc_feature: Ceres CLONE 1790855
  misc_feature (8)..(300): Pfam Name: NmrA Pfam Description: NmrA-like family
  misc_feature: SWISSPROT Homolog: EC 1.3.1.45 2'-hydroxyisoflavone reductase
MASEKTKILVVGATGYLGRHVVAASARLGHTTFALVRDAAPSDPAKAALLKSFQDAGATLLKGDLYDQASLVSAVKAADVVISTVGSLQIADQTRLVDAIKEAGNVKRFFPSEFGLDVDRTGIVEPGRTLLSGKVAVRRAVEAAGIPYTYVVTGFFAGYSLPGIGQALAQGPPADKAVVLGDGNAKAVYMEEGDIATYTVLAADDPRAENKTLYVRPQANTLSHNELLALWEKKTGRALEREYVPEEAILKQIRESPVPANIVLAIWHAAHVRGEQTGFEVDPAKGAEAAELYPDVKYTTVDEYLDRFL

SEQ ID NO: 16993 - DNA, 2232 bp, Panicum virgatum
  misc_feature: Ceres CLONE 1790857
  misc_feature: Encodes the peptide sequence at SEQ ID NO. 16994
tctctcccttatctcttcgatatctcttcagtcttctcgccccatctctccctctgccacaggccaccactcctccccggcctcatctcttccctgcagcgtcaccacctccactctcttgtcgcacggggctgcaacgcacggcagcggcgcgggtgaaaggcggcgtgccaggtctacagcgcaccgcggtggcacgaggcaggcctgggcctcggcggcgcgaggcaggccggggcagacacccactgacgccactcgtctcctacatcgcctccgccatccgcacgtgggcgcttgagcaccaccttgccacctcctttcgggacctcgacgccgagctcgccgtcgtcctcgacgttctccccgccttctcgcggggagcagcagcggccggtgcggcgcggcaacggcatggagcgcggatcgcggcacagtgggagcacggtggcggcgcgagcacggcgcgggggagcagcaatgctcagagacaaagcgcgtcgtcgcattaaaaagaaagaaatcttccctgagggatgagatcgagacaatacgttgttacctgaaggcccctgatagatctgagtatatggtaattaccttggtgaaccaattcctagaggtggtcagcgaggttgactgctgcctcatggatttgtcggccatgagggggtcactacctagtaaagccaagcagatcgaggagctcacagccaaagtggaggatatcagccaaaggattgtgccctatcgccccatcgagccagctggccattctaggatgcttggtgcagcaacactgtgcacggcggccgcccagttagactatatctcagctttgatgaaacaagttttctcccgtttaaagatggtaggcgattcagttttgaggatttggtctcaagaccatgcgtttttttgtgagaaccatgagcagaataacagtacacgtgcccaaaattctgaaggttcctactgttcagcatcccagaacaatagtaccagaggctgtagagttcaacaacatgagaaagggaggaagggaatttcagcgaagcagcgttcaaaggctggttcagtagtttggttacacttcagcaagaattcttccaatgttccaaggcatcctgagagtgttcatcagatggacctatcagctcactcagaagcggcgcagaggtcttcttgttcacaggtgctacagaccagagaaattgctgagaatgcgacgcctttgataaaaaatgagaggattgtggttgactgtgagcaaattaagctaggcaacaatgatgtcaaagctcgaataggtaaattatcaagaaagtgcaacaagtacacttcagggtctaaaccagaagtttggcttcatttcgaaaaattggtgtccgttgaagattctggcgtcaaggcaaagtgcatatactgtgacaaggtgttgaaagctgattcaaaaagaaatggtacttctcgcctgcggaggcatattatcggttgtcacaagatagagttagccggatcagtcaaaactacaggaaattgtgggaacgattcaaatgtcaaccaagaagagaccagcatcgacaaccaagccaaagatcgtgctgctgctgaatgccgaggaattgagcatgacaaagtgcctagagaggtgatcgtcctggattctcaaaactcaggttcgacgagctctgcagctggctcctcatgtcatccatcattggcactctgcttcgttcgttgtcttttgttccaggagctttctggtctactgtttagctgaatattttctttctgctctgcatcctccctgtagccagtagttgcatgttcaattcttctgtaccagcgttaatcaagagtatttctgccttaacaactcaatggacaccagtttctatttcacttatgccctcttactgtttcaggcgatgcagttgttaagatatctaaaccagaaaggcagataattaacaagattaagtcaacagaagaggaagaggttctagtgcacatcgatgatgttagtatacagaagaaggtgttggaaagcctagcagatcccatgttggaggatggtccaccaaagtacttgcaggacgatatcatagatgcatgcattcacatgttaagagacaaaaacaaaaatgacatcagggctcacggaaaggtcttcattgagactacgatgatatgccaactcctacataaagccgcttgctctttctaccc

SEQ ID NO: 16994 - protein, 397 aa, Panicum virgatum
  misc_feature: Ceres CLONE 1790857
  misc_feature (256)..(305): Pfam Name: zf-BED Pfam Description: BED zinc finger
MVITLVNQFLEVVSEVDCCLMDLSAMRGSLPSKAKQIEELTAKVEDISQRIVPYRPIEPAGHSRMLGAATLCTAAAQLDYISALMKQVFSRLKMVGDSVLRIWSQDHAFFCENHEQNNSTRAQNSEGSYCSASQNNSTRGCRVQQHEKGRKGISAKQRSKAGSVVWLHFSKNSSNVPRHPESVHQMDLSAHSEAAQRSSCSQVLQTREIAENATPLIKNERIVVDCEQIKLGNNDVKARIGKLSRKCNKYTSGSKPEVWLHFEKLVSVEDSGVKAKCIYCDKVLKADSKRNGTSRLRRHIIGCHKIELAGSVKTTGNCGNDSNVNQEETSIDNQAKDRAAAECRGIEHDKVPREVIVLDSQNSGSTSSAAGSSCHPSLALCFVRCLLFQELSGLLFS

SEQ ID NO: 16995 - DNA, 2787 bp, Panicum virgatum
  misc_feature: Ceres CLONE 1790871
  misc_feature: Encodes the peptide sequence at SEQ ID NO. 16996
gctgcttcttctactccccccatcccctcctattctattgccagccaggggcagggaggagggagcccagacgtcgattggggagcggctcttggcccccgttcgagccgcccgtcgcctctgatctggacccggagggtgcagcagctccgcccagcagttcttggttggattccgccgccgccgccttcttgagaggggggcctttgttggaggaccaagaaagatgtcgggggcagtgctcgtcgcaatcgccgcctcaatcggcaacctgctgcaggggtgggacaatgccaccattgcaggtgctgttctgtacataaagaaggaattcaaattgcaaagcgagcccactgtggaggggctaattgtgtccatgtcactcattggtgccactatcatcaccacattctctgggccagtatcagactggatcggccgccgccctatgcttatcctctcttcagttctgtacttctgcagcagcctcatcatgctatggtcccctaatgtctatgtcctgctgctggcccgtcttgtagatggatttggtattggcttggctgtcacgcttgtgcctttatacatttcagaaacagctcctccagagattagaggtttgctgaatacactgccacaattcagtggttcgggaggaatgttcttgtcatactgcatggtgtttgggatgtcactattgccatcacctgactggagaattatgcttggggtgcttgccataccttcattgttcttctttggattgacaatattctatctgcctgaatccccaagatggcttgtcagcaaagggaggatggcagaagccaagaaggttctgcaaaaattacgtgggatagacgatgtctcaggtgaaatggcccttcttgttgaagggttggcggttggaggagatacctccattgaagagtacatcatcggccctgccactgacccaactgatgatcacgttgctgatggtgataaggaacagatcactctttatggtcctgaagcagggcaatcatggattgctcgaccttccaaaggacccagcatgcttggaagtgtgctttctctcgcatctcgtcatggcagcatggtgaacccgagtgtaccccttgtggatccgatcgtcacactttttgggagtgtccatgagaacatgccccaagctggaggaagtatgaggagcacattgtttccaaactttggaagtatgttcagcgtcacagatcagcataccaaaaatgagcagtgggatgaagagaatgttcacagggatgacgaagaatatgcatcagatggtgcaggaggtgattatgaagacaatgtccacagcccattgctgtccaggcagactacaagtgcggaagggaaggacattgcacaccatggccaccgtggaagttctttgagcatgagaaggccaagccttctgggggagggcggagagggtgtgaacagcactggtattggtgggggatggcagcttgcatggaagtggtcagagcgagaaggtgaggatggtaagaaggaaggtggtttcaaaagaatctacttgcacgaaggagttcctggttcaagaaggggttcgattgtttcactccctggtggaggcgatgctcctgagggtggcgagttcatacatgctgctgctttagtaagccagccagcactttactcgaaggatcttacagaacggcacatgtctggtcctgccatgattcacccatctgaggcagctgccaaaggcccaagctggaaagatctgtttgaacctggtgtgaggcgtgccttgttagtcggtgtgggaattcagatccttcaacagtttgctggaataaacggggttctctactacactccacaaattcttgagcaagctggtgtggcagttcttctttccaatcttggtctcagctcggcatcagcatccatcttgatcagttctctcactaccttattgatgcttcctagcattggtttagccatgagacttatggatctttctggaagaaggtttttgctgctaggcacaattccaattttgattgcatctttagttgtcctggttgtatccaatgttgttgacttgggtacagtgccccatgctgcgctctccacagtcagtgtcatcatctatttctgttgcttcgtcatgggctttggtcccatccccaacattctatgtgcagagatttttccaaccagggtccgcggcctttgcattgccatctgtgccttgacattttggattggagacatcatcgtcacctacagccttcctgtgatgctgaatgctattggcctagcaggcgtctttggcatatacgcagttatctgcttgatttcctttgtattcgtcttccttaaggtccccgagacaaagggcatgccccttgaggtcatcactgagttcttttcagttggtgcaaagcaggcggctgcaaaggcctaattcctttggcagctttgcttgcaacttttgcgctgtaaattgcaaacttgaagggatctcaccaagatgcttgggagacttttatgaggaagaggcaactgctcatgctccataagcaacaccgagagttcatcaatggcacagcagctgttaagtaggcaaattccatgtcatctgccatcaatgttgtttattaataatgtattaggcatgttattcagctgtggttcttggtagagatatttagactaaagttaatgatctgattcagtggtactatatttaagctccaataaagtaaataaagttttgcatatcctcttgtc

SEQ ID NO: 16996 - protein, 744 aa, Panicum virgatum
  misc_feature: Ceres CLONE 1790871
  misc_feature (6)..(733): Pfam Name: Sugar_tr Pfam Description: Sugar (and other) transporter
MSGAVLVAIAASIGNLLQGWDNATIAGAVLYIKKEFKLQSEPTVEGLIVSMSLIGATIITTFSGPVSDWIGRRPMLILSSVLYFCSSLIMLWSPNVYVLLLARLVDGFGIGLAVTLVPLYISETAPPEIRGLLNTLPQFSGSGGMFLSYCMVFGMSLLPSPDWRIMLGVLAIPSLFFFGLTIFYLPESPRWLVSKGRMAEAKKVLQKLRGIDDVSGEMALLVEGLAVGGDTSIEEYIIGPATDPTDDHVADGDKEQITLYGPEAGQSWIARPSKGPSMLGSVLSLASRHGSMVNPSVPLVDPIVTLFGSVHENMPQAGGSMRSTLFPNFGSMFSVTDQHTKNEQWDEENVHRDDEEYASDGAGGDYEDNVHSPLLSRQTTSAEGKDIAHHGHRGSSLSMRRPSLLGEGGEGVNSTGIGGGWQLAWKWSEREGEDGKKEGGFKRIYLHEGVPGSRRGSIVSLPGGGDAPEGGEFIHAAALVSQPALYSKDLTERHMSGPAMIHPSEAAAKGPSWKDLFEPGVRRALLVGVGIQILQQFAGINGVLYYTPQILEQAGVAVLLSNLGLSSASASILISSLTTLLMLPSIGLAMRLMDLSGRRFLLLGTIPILIASLVVLVVSNVVDLGTVPHAALSTVSVIIYFCCFVMGFGPIPNILCAEIFPTRVRGLCIAICALTFWIGDIIVTYSLPVMLNAIGLAGVFGIYAVICLISFVFVFLKVPETKGMPLEVITEFFSVGAKQAAAKA

SEQ ID NO: 16997 - DNA, 1921 bp, Panicum virgatum
  misc_feature: Ceres CLONE 1790882
  misc_feature: Encodes the peptide sequence at SEQ ID NO. 16998
caacaaagctccctgaattgcatcgcatgttactctttctttctcctcgaccaaaactccaaaggccatcactctctccctctgccccctcctcaggtgcaacgatctgccttgcatatcctcctccatccgtttctagtcccatgcgtaatcatctttcgggattgaatctctcgatctcctgcctccctgagcgagtccgcttccagccagtgagagaaatgtaggcgccacggatcgccccaactctatcggaaatccaatcttttttcagcccgaatccgcctcttcctgccgtaaagtttggattttaagatctctgaaaaaaaagtttggattttaagaagcttccgacgtgcgagatttccgtcaccagtctccagaagctggttcgtcttcacagacgcttcggttcgttcgcattgcttcaaagatccatccaaactctccacgccattcgcaccccgacgaggctgcggtcgcttggggggagatgaagagcctgcagtgcttcaagcagagcagcggcggcggcggtaatggttgcgcgccggggaagcggctggagcggcggctgtcgctgggcgagtacaagaaggcggtgtcgtggtccaagtacctgatagctccgccgggcgccaggatccggggcggcggcgaggagctctggagcaccgacctgtccaagctggagatccggggcaagttcgcctcaggccgccacagccgcgtttactccggcaggtacgcaggccgcgaggtggccatcaagatggtcagccagccagaggaggacgctgcgcttgccaccgagctcgagcgccagttcgcctccgaggtcgcgctcctcctccgcctccaccaccccaacatcatctcgtttgttgcagcatgcaagaagccaccagtattctgtatcatcaccgagtacatggcagggggctcccttcgtaaatatctgcatcagcaggagcctcattcagttcccatcgaattagtgctgaacttatctttagatattgctcgggggatgagctacctccactctcagggtatacttcatagagacctgaagtcggagaatatacttctgggacaagatatgtcagtcaaagtggcagattttgggatttcatgcttggaatcacagtgtggaagtgggaaggggtttacaggaacctacaggtggatggctccagaaatgatcaaagagaagcatcatactaggaaagttgatgtgtacagctttggaatcgtcatgtgggagattttgactgctttggttccgttcaatgacatgactcctgagcaggctgctgttgctgttgcagtgaagaatgctaggccgccactgccagcttcatgcccagtggcaataagccacatgataatgcagtgctgggcgaccaaccctgacaaaagaccgcagtttgatgacattgttgcgatcctcgagagctacaaagaagcccttgacgaggacccatcgttcttcttgtcatacataccacctccaccgcaccatagccgccaccacccatcatcaccaccaccaccaccatcagagccttcttcggtgcctccctcgctccatgagacgatctgcatctctgaaagtatgaggctcgactacagcctttgttcatcgatgcaatgtacaatatgcacctcttttcgaatttctttgtttctctatatgcgcgcgttagccctctattatgcagcattagcatgctatggtttagtttcttcttcactcttgttggtaaattatttccgtcattgatgccttgagtaatgtagaggttagaggcaggcaggcagcttccggttattatctatggatgccatttgctttgagtgatggaaaacttgaaagagcctcagtaactgtaatataattcagctcttccttggactc

SEQ ID NO: 16998 - protein, 430 aa, Panicum virgatum
  misc_feature: Ceres CLONE 1790882
  misc_feature (66)..(320): Pfam Name: Pkinase_Tyr Pfam Description: Protein tyrosine kinase
  misc_feature: SWISSPROT Homolog: EC 2.7.11.1 Non-specific serine/threonine protein kinase
MKSLQCFKQSSGGGGNGCAPGKRLERRLSLGEYKKAVSWSKYLIAPPGARIRGGGEELWSTDLSKLEIRGKFASGRHSRVYSGRYAGREVAIKMVSQPEEDAALATELERQFASEVALLLRLHHPNIISFVAACKKPPVFCIITEYMAGGSLRKYLHQQEPHSVPIELVLNLSLDIARGMSYLHSQGILHRDLKSENILLGQDMSVKVADFGISCLESQCGSGKGFTGTYRWMAPEMIKEKHHTRKVDVYSFGIVMWEILTALVPFNDMTPEQAAVAVAVKNARPPLPASCPVAISHMIMQCWATNPDKRPQFDDIVAILESYKEALDEDPSFFLSYIPPPPHHSRHHPSSPPPPPSEPSSVPPSLHETICISESMRLDYSLCSSMQCTICTSFRISLFLYMRALALYYAALACYGLVSSSLLLVNYFRH

SEQ ID NO: 16999 - DNA, 2619 bp, Panicum virgatum
  misc_feature: Ceres CLONE 1790890
  misc_feature: Encodes the peptide sequence at SEQ ID NO. 17000
ggaggaaaacttcggaggcgcccggcttccaagatacccactagctccctgcctcccaccgcgttcttttcccccttgtctggtgctagaaagatgcgattttttggctctggggccacttgttcttctgattcttacgttgcgggcacccccttggcttctcgtctggtgtctgttttctcgtggatcacatgtgtggaagacgtaaatatgtgctagttctgttgatccttttctgtagtttgaggtgatatttggctcatcctttggtgcctttggagggtgggcgagaggtctcgattccaaaatctgcaagcgtcttctgtgtatgggtctggtagccgccctgtaggagacctgtatggacgaatttgggggcgatccctagtctatctgtcaagcagccaaagtgattttcgtgtgagccaaagctaggggagatgcagaaattgatgaggagacagtagaggggcttgttggactctgcaaggacttgctaagcttttgtccttcttgtgatctagaggcctgatatttttccatcagctgagccgtatttgccgaagtgcacagatagaggggtttattggagtaagcaagaacaaggcatcccaattttgggattcgtcacaatatcttcagagtgaacaaataaggaaccatttgatcctgagacatagaagcaatccagcatgcggcatggtccgctagaaaaactgaagagcttccgggggatagagaagcagagaagctttaagttcttgtccatggagaagcagcacagcttcaaaaggaacaaggacagccctgggaagcggggtgacactgcactccaccttgcggcgagggctggcagtgttgcccatgtccagaagatccttgtggagtgcgacccagaactagtggtggagttagctgcccgtcagaatcaggacggtgagactgcactgtatgtgtctgctgaaaaggggcatgttgaggttgtctgtgagattttgaaggcttgtgatgtgcagtcagcagggctcaaggccagcaacagcttcgatgcattccatattgcagcaaagcagggccatctggatgttttgaaggagctgctgcaagcctttccctcattagctatgacaacaaattctgtaaatgccactgctttggacactgctgcaactcagggccacattgatattgttaatcttttcctagaaacagatgcaagccttgctaggattgcaagaaataatggcaaaacagttttgcattcagcagcaagaataggccatgtggaggtggtcactgcactgttgaataaggatccagggattagtttcagaacagataaaaagggacagacagcgctacacatggcttcaaaaggccagaatgctgaaattctgctcgagttgttgaagcctgatgtctcagttatccatgtggaagacagcaaggggaacagaccattgcatgttgcaactcggaaggggaacaccattatggtccagaccctaatatcagttgaagggattgaaatcaatgcagttaatagagctggagagactgcttttgctattgcagagaaacaaggtaatgaagagcttattaacatccttagagaggttggtggagtaacttcaaaagagcaagtgaatcctcctaatccagcaaagcagctcaagcagactgtcagtgatatcaggcatgatgttcagtcacagatcaagcaaacacaccagaccaagatgcaattccaaaaaatcaagaagagaatccaaaagcttcacattggtgggctaaacaacgccatcaactccaatactgtagttgcagtgcttattgccactgttgcctttgcagccatattccaactccctggtaattttctggagaatatgaaagacgcaccagatccagacatgaccttggggcaagctttggtagccagcaatccagcctttataatcttcttggtctttgacgccttggctctcttcatctcccttgctgttgtcattgttcagacatctctaattgtcgtagaacagaaggcaaagaagaagatggtctttgtgataaacaagttgatgtggctcgcatgcctatgcatctcggcagccttcatagcactgacctacgttgtcgtgggccgaaatgatgagtggttggcttggtgtaccatggcgattggcactgtcatcatggtggccactctcggttccatgtgttattgcattgttgctcacaggatggaagagaagaacatgaggaaaattaggaggacctccacaagccagtcatggtccgtatcaattgactcggaaacggagcttatgaacagtgaatataagaagatgtacgccctttagggtgccatccttgcttgtcatcgagtcctgtatatatgtacccatttgccagagactactccatggcactaagtgggattgactagaactatatttaggcctagaacatggcacctgtatgtaactgcagtcagcagcctccttccatgagcagaggggtgaattccaggtgataggagtagccactttttgtaggcaaatatgactatttgccaagcaagatgtttatcttatatgcttattattactgtgatgg

SEQ ID NO: 17000 - protein, 556 aa, Panicum virgatum
  misc_feature: Ceres CLONE 1790890
  misc_feature (184)..(216): Pfam Name: Ank Pfam Description: Ankyrin repeat
  misc_feature (252)..(285): Pfam Name: Ank Pfam Description: Ankyrin repeat
  misc_feature: SWISSPROT Homolog: EC 2.7.11.1 Non-specific serine/threonine protein kinase
MRHGPLEKLKSFRGIEKQRSFKFLSMEKQHSFKRNKDSPGKRGDTALHLAARAGSVAHVQKILVECDPELVVELAARQNQDGETALYVSAEKGHVEVVCEILKACDVQSAGLKASNSFDAFHIAAKQGHLDVLKELLQAFPSLAMTTNSVNATALDTAATQGHIDIVNLFLETDASLARIARNNGKTVLHSAARIGHVEVVTALLNKDPGISFRTDKKGQTALHMASKGQNAEILLELLKPDVSVIHVEDSKGNRPLHVATRKGNTIMVQTLISVEGIEINAVNRAGETAFAIAEKQGNEELINILREVGGVTSKEQVNPPNPAKQLKQTVSDIRHDVQSQIKQTHQTKMQFQKIKKRIQKLHIGGLNNAINSNTVVAVLIATVAFAAIFQLPGNFLENMKDAPDPDMTLGQALVASNPAFIIFLVFDALALFISLAVVIVQTSLIVVEQKAKKKMVFVINKLMWLACLCISAAFIALTYVVVGRNDEWLAWCTMAIGTVIMVATLGSMCYCIVAHRMEEKNMRKIRRTSTSQSWSVSIDSETELMNSEYKKMYAL

SEQ ID NO: 17001 - DNA, 1032 bp, Panicum virgatum
  misc_feature: Ceres CLONE 1790898
  misc_feature: Encodes the peptide sequence at SEQ ID NO. 17002
aagcacgagagaggagccgagggaaagaaaaaaacgcggtgctctgctgagctgttgcgcttgtcctcggagcggagcggagagccacagccatggagggagcgggggaggtgtcggcggccgccggcaacggcaacggctccgcgcggaggccgtcgacggctccgtcggcgcgggtgtcgatcttggagtcggtgcgcgcgtgcggggtgtgggggaaggaggtggaaaaggccgagctccggaggcaggtcgtcatgccgctccacctccgccgcgcggtcgccgcggccgtcgcggccaaggacgaggccgccggcgtggcggcggcggcggcggcgaaggagcagggggaaggggagaaggaggaggggcctaccgtggcgcccgtggtcgtgttcgtcaactcgcggagcggcgggcggcacgggcccgagctcaaggtgcggctgcacgagctcatcaccgaggagcmkgtcttcgatctttctgttgtgaagccttcagattttgttcactatggcttgagttgtttggagaggttagctgatcaaggtgakractgcgcaaaagccgctcgtgaaaacatgaggattgtggttgctggaggtgatggcacagttggttggatgcttggttgcctgtcagatctttataagatgaaaagggaaccagttccacccacaggaattattccactcggtacaggaaatgatcttgctagatcatttggatggggtggctcttttccctttggttggcgctcagctgtaaagcgttatctaagcaaggcggccactggtcccgtttgccgtcttgacagttggcaaactgtaattcagatgccagaaggagaaatagaagagttgccatatgcacttaagaaagtggatcctgcagatcggctggatatcacccaggagaacggcagtgagttacctgaaaaggcttcttgctataaaggagtattctacaattaccttagcattggtattttcattcctttattatttaaaatttttcctcttgtta

SEQ ID NO: 17002 - protein, 313 aa, Panicum virgatum
  misc_feature: Ceres CLONE 1790898
  misc_feature (99)..(245): Pfam Name: DAGK_cat Pfam Description: Diacylglycerol kinase catalytic domain (presumed)
  misc_feature: SWISSPROT Homolog: EC 2.7.1.107 Diacylglycerol kinase
  misc_feature (128)..(128): Xaa is any aa, unknown, or other
  misc_feature (156)..(156): Xaa is any aa, unknown, or other
  misc_feature (157)..(157): Xaa is any aa, unknown, or other
MEGAGEVSAAAGNGNGSARRPSTAPSARVSILESVRACGVWGKEVEKAELRRQVVMPLHLRRAVAAAVAAKDEAAGVAAAAAAKEQGEGEKEEGPTVAPVVVFVNSRSGGRHGPELKVRLHELITEEXVFDLSVVKPSDFVHYGLSCLERLADQGXXCAKAARENMRIVVAGGDGTVGWMLGCLSDLYKMKREPVPPTGIIPLGTGNDLARSFGWGGSFPFGWRSAVKRYLSKAATGPVCRLDSWQTVIQMPEGEIEELPYALKKVDPADRLDITQENGSELPEKASCYKGVFYNYLSIGIFIPLLFKIFPLV

SEQ ID NO: 17003 - DNA, 695 bp, Panicum virgatum
  misc_feature: Ceres CLONE 1790898-R
aggcatccatggggtgatcttaaaccggaatatcttgaaaagaaaggttttgtagaagctcactcagatgatggcttgcttgaaatatttggactgaaagaaggttggcatgcttcatttgttatggctgagcttattaaggcaaagcacattgcccaggctgcggctataaagttcgaaatgaggggaggcgagtggaatcgagcatatgttcagatggatggggagccatggaaacaaccgcttattcaggaactgtcaacagttctggaaataaacaaagttccttatcactctctcatgatcaatggggatcaatgattttttttcttcaccaatcagggttgcgttcttagatcgttagaattgtgtacagttcaggagcagcgagtactagattcaaactaggggtcggctgcagcggggatgcttgttcgttggccttcaacatgccatggtcaaatcatgtcaagagcatgatatggcaccatgcattgttgtattgtatcatatttgttgtatccaaatttcttttgaatggaaagaaacagagcttaatttatttcgcactgaaacgttttgtgccaaaatgttgaagaataacctcatgaagaatattttgactgtaaaattggacagtttgccgtttacgcctgtcctatagcacgttcagcatgcagattaatttgctctcc

SEQ ID NO: 17004 - DNA, 1696 bp, Panicum virgatum
  misc_feature: Ceres CLONE 1790913
  misc_feature: Encodes the peptide sequence at SEQ ID NO. 17005
agcacttattagcttattggccgctctgcacctctccaccgggccggatgtctcgattcttggcttgagcatatccccgcccgggtcgtttatttctcaaattaataggggtagacgtggggcagtgagtcttggagattcatttggagcggccggcggcttggtgtgcagccaaggtacgtcacgacgctcttcgattcatggacgaccctcataggactcgcgtggccaggggcagtggcaggattgagctcaggaggggctctcctcttcctcctccttcaacctcctcttcccaaaagggctccatagtattttcaatggtaggaggggctcgagctcctccagacccaccgttgaatccgctcctggacagggatcagattcctcgacctggtttacggttacggcttgcagttaaacctcctgtttatctcttattatttggtgcggcggttatattgatatatcggatccctcacggcatccggcggacaaatccagaacatatactcttcctttatgcttgttatgttaccggtctcctcatgatttacttacccaccacccacgtaaggcgcgtgaacgcaaatgcgctcgacatgctgctccagatcagcaagcaagcagcagccaagttgctgagaaaggttaccgatcctgttagaaaaggaaaaggcctggtggtggagactctgacaagatcggtgatgaaggctaggagtattctgcatgttggcagaaatctcttccctttacgcggccgccgccggagatcgatggcctcctacgagaccaaggtgcttgattttgtggagcgtcaaacagtcgtcccctcgctgctggggatctcgggcatgcgcggcgtgggcaagaccacccttcttagatttgtgcgcgattcttacgcgcatggctcctctttctcctacgtcttcttccttggggccggccctggatgcacggtggggagcctacaccatgccatctccgtcaacatacagcagacgccagatgtccctatttccacttgcttgaaaggcaaacccttcttgttgctccttgatgatgtgcgagagaggcttgatcttgcggcagtcggtctgccgacgccacttgggcgcaggcagaaagtcatcttcacgacgaggaaccaccaaatctgcgctgacatggggtgttcaagcagcactactatccagatggagtgcttgagtgaggatgatgcgtggaaccttttcaaggataaagtcggagaacaaaacatcgatgctcatcctcacatcaagcacctcgccaaaaagatggtggcagaatgccgtggcttgcccagcgccctatgcgcccttggtcgagccatgtcaaccaagtccgacgtcaaggaatggaggtatggctacgatatgctcaagaggaagcggtcaccggtcagcgagatccaagagatcgatgatgaaggccattctgatctgtatcatttagaagaaaaattgcaggacctcttcttttagccgcctctttatggcctcaatacgggggcaaatttgtacatgccttcaaaagcaatctggatctcaaagtcatagagagtacaaaactatatcatcctgatgacacgcaccatcttgtaacggaaagatggtttccagtacttattattattattattattattattattattattattattatc

SEQ ID NO: 17005 - protein, 436 aa, Panicum virgatum
  misc_feature: Ceres CLONE 1790913
  misc_feature (186)..(435): Pfam Name: NB-ARC Pfam Description: NB-ARC domain
MDDPHRTRVARGSGRIELRRGSPLPPPSTSSSQKGSIVFSMVGGARAPPDPPLNPLLDRDQIPRPGLRLRLAVKPPVYLLLFGAAVILIYRIPHGIRRTNPEHILFLYACYVTGLLMIYLPTTHVRRVNANALDMLLQISKQAAAKLLRKVTDPVRKGKGLVVETLTRSVMKARSILHVGRNLFPLRGRRRRSMASYETKVLDFVERQTVVPSLLGISGMRGVGKTTLLRFVRDSYAHGSSFSYVFFLGAGPGCTVGSLHHAISVNIQQTPDVPISTCLKGKPFLLLLDDVRERLDLAAVGLPTPLGRRQKVIFTTRNHQICADMGCSSSTTIQMECLSEDDAWNLFKDKVGEQNIDAHPHIKHLAKKMVAECRGLPSALCALGRAMSTKSDVKEWRYGYDMLKRKRSPVSEIQEIDDEGHSDLYHLEEKLQDLFF

SEQ ID NO: 17006 - DNA, 1542 bp, Panicum virgatum
  misc_feature: Ceres CLONE 1790916
  misc_feature: Encodes the peptide sequence at SEQ ID NO. 17007
aaaagcaagcccgcgacgcgacgagcgccacctctcccctctccagtctccagcctccactcgctcgcgtccgcctcgcgagctcactcgctcgctctcgacctcccccgcccggccgcggcgccaagggatggacgcgctccgcctccggccgtccctcctctccgcgcggcccggcgccgcccgcccgcgagatcattttctaccaccattttgttcgatccaacgaaatggtgaacctcgagtttgtttttccgaccaaaggacccatggcccttccttgtatcacagtcagaaattgttcgattggaaatcctcctattctaggatatcacgtcagtcaacaagtacttctattaatgcttcgggccaaccgctgcaatctgaacctgaagcacatgattcggcaagcatctggagggcaatatcatcttcattagatgcattttacagattttcccggccacatactgtcataggaacagcattaagcatagtctcagtttcccttctatctgtccagagcttgtctgatatatctcctttgttcttcactggtttgctggaggcagtggtagcagctcttttcatgaacatctatattgttggactgaaccagttattcgacattgagatagacaaggttaacaagccaactcttccactggcgtctggggaatatacccctgcaactggggttgcaatagtattggtctttgctgctatgagctttggccttggatgggctgttggatcacaacctctgttttgggctcttttcataagcttcgttcttggaactgcatactcaatcaatttgccatacttaagatggaagagatctgctgttgttgcagcactctgcatattagcagttcgcgcagtgattgttcagctggccttttttctccacattcagacctttgttttcagaagaccagcagcttttacgaggccattgatgtttgcaactggatttatgatgttcttctcagttgtaatagcacttttcaaggatatacctgatatcgaaggggaccgcatatttgggattcgatcattcagtgttcgtttgggccaaaagaaggtcttctggatctgtgttggcctgcttgagatggcctacagcgttgcaatactgatgggagcaacttctacctctctgtggagcaaaaccgcaacaattgccgggcattccatcctcgcggcgatcctatggagccgcgcgcggtcggtcgacctgacgagcaaggccgcgataacatccttctacatgttcatctggaagctgttctacgcggagtacctgctcatccccctggtgcggtgacgcccggcgacgacgacggcggcgacggcggcggcggggcaacaactccacgggaggactttgaaatgccggagtaaacgcccgtttgaaaccggacgccacatgcgcgcgcacgagggggagaggggagaggaggaaccgaggaaggtggacccattggcatttggcaggctacggccggcgcccaataaaacggaataaaattcccgtcc

SEQ ID NO: 17007 - protein, 399 aa, Panicum virgatum
  misc_feature: Ceres CLONE 1790916
  misc_feature (120)..(398): Pfam Name: UbiA Pfam Description: UbiA prenyltransferase family
  misc_feature: SWISSPROT Homolog: EC 2.5.1.62 Chlorophyll synthase
  misc_feature: Useful for making plants with altered tocopherol content
  misc_feature: The sequence is a functional homolog of SEQ ID NO 2 in US patent 7154029
MDALRLRPSLLSARPGAARPRDHFLPPFCSIQRNGEPRVCFSDQRTHGPSLYHSQKLFDWKSSYSRISRQSTSTSINASGQPLQSEPEAHDSASIWRAISSSLDAFYRFSRPHTVIGTALSIVSVSLLSVQSLSDISPLFFTGLLEAVVAALFMNIYIVGLNQLFDIEIDKVNKPTLPLASGEYTPATGVAIVLVFAAMSFGLGWAVGSQPLFWALFISFVLGTAYSINLPYLRWKRSAVVAALCILAVRAVIVQLAFFLHIQTFVFRRPAAFTRPLMFATGFMMFFSVVIALFKDIPDIEGDRIFGIRSFSVRLGQKKVFWICVGLLEMAYSVAILMGATSTSLWSKTATIAGHSILAAILWSRARSVDLTSKAAITSFYMFIWKLFYAEYLLIPLVR

SEQ ID NO: 17008 - DNA, 1766 bp, Panicum virgatum
  misc_feature: Ceres CLONE 1790951
  misc_feature: Encodes the peptide sequence at SEQ ID NO. 17009
accatcacgcgcaccccaaggccccaactattaataaagccatcatcaccacgcgcacatgcgcagagagatagatcaatttcccttctcgcgacccagcaatttcaagtgttcttcctcctcgtttccggatctttttcaggaggtttcgatttgcgccgctgcccactggccgctggattttgcgtgtcggtgactttccccttatctggagatgtcttttcggagtatggttcgtgatttaagagaaagctttggttatatatcgaggcgtaactttgaggtgagaattcatcacagagggaagtctcttggatcttcaagtgacctgcaagacgggcctatggtaattcaacaaagcagatgagctagccttcctcctgagttactccgtgatgtgatgaaaaggttggaggaagatgagagtagctggccatcccgcaaggatgttgtttcctgtgcctctgtttgtacaacctggagggatatgtgtaaggatatagtaagaagtccagaaatttgcgcaaagctcacatttccagtatctcttaagcagcctggaccacgagatggagtgatccaatgtttcataaaaagggacaaatcaaaactgacgtaccgtctctacttgtgccttagctgtgctgtgcttgatgagaacgggaagttcctactagctgccaaaaggagccagaggacgacgcgcacggactatgccatttctatggattcaaaaagtttctcgcgatcgagtactggatacattgggaagctgaggtcaaatttccttggaaccaaattcatcatttatgacacactgcctccattcaatgctgggggactttgctcacaggaacgggcccctagccgtcggttctcttccagaaaagtctcaccaaaagttccagtgggtagctaccccattggacaggtgaactatgagctgaatgtgctcggcacccgggggccaaggcggatgcaatgcactatgcattccatcccagagtcagcagtagagcctggcggtgttgtgccagggcaaccgaaagagctccttccgaggttattcgatgagtccttcagcagcacagcaacttgcttctccaaatacaccatcgcagatagctccacggacttgagcacttgtgggtactccgagtgtggtggaggaaacccgcaaggtggcgacgacgcagacaaggagaggcccctggttctgcacaacaaggcgccaaggtggcatgagcagctgcagtgttggtgcctcaacttccgtgggcgcgtgacagtggcatcagtcaagaacttccagctggtagcctctgtgccaccgccagcttcagcaggggcttgggcgcctggtgtgcagacgcagccccaggcatcgggtccgtcttcgtcatcaagccacgacacggtgatcttgcaattcggcaaagttgcaagggatatgttcaccatggactaccggtacccgctgtcagctttccaggccttcgccatatgtttgaccagctttgacacgaagctggcctgcgaatagatgatgggtaggaagggtaggaattagagcagcaggtagcaggttgtatgtgataagcagagcattcaagtgtgcatgtacatacataacataacggctagtaggtgttgtttggtctgaaacctgaattttatgagtttgtatgttggtggtgggtcgtcgatcagatgatgttgtagtggttgcgctggaaaatctgaagataaatttggttggtgtttgg

SEQ ID NO: 17009 - protein, 380 aa, Panicum virgatum
  misc_feature: Ceres CLONE 1790951
  misc_feature (53)..(374): Pfam Name: Tub Pfam Description: Tub family
  misc_feature: The sequence is a functional homolog of SEQ ID NO 130 in the 10/225,068 US patent application
  misc_feature: The sequence is a functional homolog of SEQ ID NO 2896 in the 10/374,780 US patent application
  misc_feature: The sequence is a functional homolog of SEQ ID NO 462 in the 10/666,642 US patent application
  misc_feature: The sequence is a functional homolog of SEQ ID NO 458 in the 10/666,642 US patent application
MKRLEEDESSWPSRKDVVSCASVCTTWRDMCKDIVRSPEICAKLTFPVSLKQPGPRDGVIQCFIKRDKSKLTYRLYLCLSCAVLDENGKFLLAAKRSQRTTRTDYAISMDSKSFSRSSTGYIGKLRSNFLGTKFIIYDTLPPFNAGGLCSQERAPSRRFSSRKVSPKVPVGSYPIGQVNYELNVLGTRGPRRMQCTMHSIPESAVEPGGVVPGQPKELLPRLFDESFSSTATCFSKYTIADSSTDLSTCGYSECGGGNPQGGDDADKERPLVLHNKAPRWHEQLQCWCLNFRGRVTVASVKNFQLVASVPPPASAGAWAPGVQTQPQASGPSSSSSHDTVILQFGKVARDMFTMDYRYPLSAFQAFAICLTSFDTKLACE

SEQ ID NO: 17010 - DNA, 1652 bp, Panicum virgatum
  misc_feature: Ceres CLONE 1790963
  misc_feature: Encodes the peptide sequence at SEQ ID NO. 17011
aaccatctccctcttgattaacccagtcgcaccgcaccgcaccgccaccagccatggaggcgtactactacgtcgtcttcggcgcgctcgccgccgtcgtggcggggctcgagctcggcaagagcggcaaggaccgcgtcgccaccacctccgccttcaactccttcaagaacaactacgtcctcgtctactccctcatgatgtccggggattggctgcaggggccctacgtctactacctctacagccagtacggcttcgacaagggcgacatcggccgcctcttcatcgccggcttcggatcctccatgctcttcggcaccatcgtcggctccctcgccgacaagcagggccgcaagagggcctgcatcacctactgcatcagctacatcctcagctgcatcaccaagcactcgcccgagtacaagatcctcatgatcggccgcattctcggcggcatcgccacctccttgctcttctccgccttcgagtcctggctcgtcgccgagcacaacaagagaggctttgatccgcaatggttgtccattacattctccaaggctatcttccttgggaatggcttagttgccattgtatctggcctatttgcaaaccttcttgctgaaaacttgggtttcggtcctgttgctccttttgatgcggctgcatgcttcctggcgatcgggatggctatcataatgtcatcatggagcgaaaactatggagatccatctgaaagcaaggacctcatggcccaattcaaggttgcagcgaaggcaattgcttcagatgaaaagattgcattgctgggagccatacagtcattgtttgagggctcaatgtacacttttgtcttcctatggactccagcgttgagcccaaatgaagaagacattcctcatggttttatctttgctacattcatgctatcatccatgttgggtagctcaattgcgtcacgcctattagcccggaagcttaaggttgagggttacatgcagattgtgttttcaatatcagctgtcacccttgtgctccctgttgtcaccaactttttagtgccgccatcttctgtgaaaggaggtagcatctcatttggaggctgtcttcagcttctcggtttctgcaccttcgaggcatgtgttggcatattctggccatcaatcatgaagatgagatcacagtacattcctgaggaggcaaggagtacgatcatgaatttcttccgcattccactgaacctgtttgtttgtgtggtgctttacaatgtgaatgcattccctatcactgtcatgtttggaatgtgttctatcttcctcttcatggcagtgatcttgcagagacggctgatggttgtgtctgacctacacaaatcatcaacaaaagcacaagaaatgatcggggaagatgagccactaaatccttagatgatgtcaacagaatcatacatgacacaagtcagatatgaagacggcatccatactgcaatttatttccacctgtggaataagatgagaaccctgtggtcgagtctggttgttttcgtttgtaatttcatttctgtagtgtagatttgaccaggctgttagtctccaccaacttggatctacttgtgtcccgagggcaatatatagttcagcaagcattgagct

SEQ ID NO: 17011 - protein, 457 aa, Panicum virgatum
  misc_feature: Ceres CLONE 1790963
  misc_feature (42)..(403): Pfam Name: MFS_1 Pfam Description: Major Facilitator Superfamily
MEAYYYVVFGALAAVVAGLELGKSGKDRVATTSAFNSFKNNYVLVYSLMMSGDWLQGPYVYYLYSQYGFDKGDIGRLFIAGFGSSMLFGTIVGSLADKQGRKRACITYCISYILSCITKHSPEYKILMIGRILGGIATSLLFSAFESWLVAEHNKRGFDPQWLSITFSKAIFLGNGLVAIVSGLFANLLAENLGFGPVAPFDAAACFLAIGMAIIMSSWSENYGDPSESKDLMAQFKVAAKAIASDEKIALLGAIQSLFEGSMYTFVFLWTPALSPNEEDIPHGFIFATFMLSSMLGSSIASRLLARKLKVEGYMQIVFSISAVTLVLPVVTNFLVPPSSVKGGSISFGGCLQLLGFCTFEACVGIFWPSIMKMRSQYIPEEARSTIMNFFRIPLNLFVCVVLYNVNAFPITVMFGMCSIFLFMAVILQRRLMVVSDLHKSSTKAQEMIGEDEPLNP

SEQ ID NO: 17012 - DNA, 708 bp, Panicum virgatum
  misc_feature: Ceres CLONE 1790976
  misc_feature: Encodes the peptide sequence at SEQ ID NO. 17013
acatagctagcttggcaacacatacaggtacagctcgaaggcccgcaggcatagaagtgaacgcccgtcgtaggtagttgcgcggcttgtgctgatcgaggaggtgccgagcgagcgagcgcgtcgatggcgatccggaacatgcaggtggcgacgcgctcgctggacgcggacatgacggtggacgagttcaaggagtggctgcggcggttcgacacggaccgcgacgggcgcatcagccgcgaggagctgcggcgcgccatgcgcgccatccgcgcccggttcacggggtggcggagcaggcagggcatcagctacgccgacgccgacggcgacggctacatcgacgacagcgaggtggacggcctcatcgagttcgcgcagaagaacctcgggctcaagatcgtcgcctactgatgatcgagctggtccactcaggggcggacccgggcggcggcgagctatagctcgatccatcaccatgggctagcagcgagcacgccatctggcgcctggccccccggcccgctaaaaataagaacaactgcttgatcgaccgcttgcttgcttccttaaagctttgctttcttgtacgtactctatcaattcatggctctgtatcccctcaaaaaaaaaaaaacttcacgacacacacgcaccagaggcgaaggtccgatcgaggagagcgcaggcgcagcgacggcaatg

SEQ ID NO: 17013 - protein, 96 aa, Panicum virgatum
  misc_feature: Ceres CLONE 1790976
  misc_feature (21)..(49): Pfam Name: efhand Pfam Description: EF hand
MAIRNMQVATRSLDADMTVDEFKEWLRRFDTDRDGRISREELRRAMRAIRARFTGWRSRQGISYADADGDGYIDDSEVDGLIEFAQKNLGLKIVAY

SEQ ID NO: 17014 - DNA, 598 bp, Panicum virgatum
  misc_feature: Ceres CLONE 1790976-R
  misc_feature: Encodes the peptide sequence at SEQ ID NO. 17015
cgacgagatcgagggcccgctcgaggtcggctccgacggcgccctcaagttcgaggagaaggacggcatcgactacgccgccgtcaccgtgcagctcccgggaggcgagcgcgtgcccttcctcttcaccgtcaagcagctcgtcgccaccggcaagcccgagagcttcggcgggcccttcctcgtgccgagctaccgtggctcttccttcctcgaccccaagggccgtggtggctccaccgggtacgacaacgccgtggcgctccccgccggaggcagaggagacgaggaggagctcgtgaaggagaacatcaagaacgccgcatcgtcgacgggcaacatcacattgagcgtgaccaagagcaatccggagaccggcgaggtcatcggcgtcttcgagagcgtgcagccgtcggacaccgacctcggggccaaggcgcccaaggatgtgaagatccaggggatctggtacgcgcagctcgaatcttagacgacgcgaccgtgatccatgggcaagtgtacgatggggaacttttgagagcaaaggaggcggcattgtgtacctactaatgcaaatatatattggctgtcgattttt

SEQ ID NO: 17015 - protein, 162 aa, Panicum virgatum
  misc_feature: Ceres CLONE 1790976-R
  misc_feature (1)..(161): Pfam Name: MSP Pfam Description: Manganese-stabilising protein / photosystem II polypeptide
DEIEGPLEVGSDGALKFEEKDGIDYAAVTVQLPGGERVPFLFTVKQLVATGKPESFGGPFLVPSYRGSSFLDPKGRGGSTGYDNAVALPAGGRGDEEELVKENIKNAASSTGNITLSVTKSNPETGEVIGVFESVQPSDTDLGAKAPKDVKIQGIWYAQLES

SEQ ID NO: 17016 - DNA, 2371 bp, Panicum virgatum
  misc_feature: Ceres CLONE 1790983
  misc_feature: Encodes the peptide sequence at SEQ ID NO. 17017
gcaagctttctgtgatacatactctagatcttttctgcaagtccccatcctttctctctggacgcggcaaagggagggagaggagagttttgcagcaagcaagctgctggtggcatcctttctccctgctcgatccgctcaagatttgcatgagcttgtcatcaagaggtagagcaagctgaacctctacgcaccccattatttctgctacgcctcccaatcgctcattaaacagatcatgttgatctcttctacatcatgctgataagtggcttatcagcaatccacctgtaatcaggtcctctacgcacacaccattctattctgcacaccgttttccgttcccagatccagctcgatctgcagccatggcagaagttttagctggatttctcacttctgccgtcgtcaacattgccaaagacaagctggcctccgccatcgcggagcaggccaatctgctgtggaacttcggcgacgacctagagaacatgaactcggtgctggagtccatctctgcagcactccaggacgccgagaggcggtcggtcaaggagaagtcggtgcagctgtggctcaagcggctgaagaacgctgcctttgacatcccggacttgctcgatgactatcaagatactagcgaccgattgactgctgcaaagattccaaatgagaaaaaaatgaaattcttgcagaagacaagagtgctctcatgtcttccagttgcacgcaagaagattgctgttgctaataggatgaagaatatgagagaagagctaagaaaaatcaatgacgaatttcatagttttaatttcacattgggaggcactagcacttctgttgagcagcattatgatattcgtgaaacatcatcacttttacctgaagaaccaataaaagggagggatggagacaaacggaaaatcatgaaactgttattggcaagtaccaacaatgatgagacagtgattcttcctatatatggccttggaggtatgggcaagagtactttggcgcaactagtttacaatgatgcccaattcaagaagtatgattatcgtatatgggtttatgtgtcccgggatttcaatttaaagaaaataggaagctctataatttctcaacttccaattgaaggaggtcagcagaattgggatacattgcacgtgataaatcagtaccttgagaagaaactactctgtgacaagaaggttttgattgttttagatgacttatgggaggaaaaggacactgagttggggaaactgagaagtatgcttcacgtgggcaagaagggcagtatgatagatgtcatagtaaccacacgcaaggaagacattgctagaaaagtttccaccactgaaccatacaagctgcagcctttgaaggatgatacatgctgggaaataattaagagatatagtaagtttgaacagaaacataaccaagaaagactggagcagataggattggatattgcaaagaaatgtggaggtgtggcattagcagctcaagcacttggatacatgctacaatacaaagatatgtctgaatgggtagaaataaataacagtgatatctggaatgaatcttctgaagacaatggtggcgtgctcccgtccttgaagctaagttatgaaaggatgccactacagctcaggatatgcttttcttattgtgccatattcccaaaaggacataatattactgcagatgatttgattcaccaatggattgctctcggctttataaagccatcgatggggaaggaatacatcagacaacttttggggatgtccttccttcaggtttccaagttgcccaagacttcgggatatcatatggtgcagtacaccatgcatgacctggtgcatgacctggcaacattaatcattggtgatgagttaatggtttcttccgttgcatcgaagagaacgaatgcacataggctgaaatattgtcgctatgcactggttaccaaatatgaccaggcaacaaaattatcaagtgttttaccctcgaaggtgagggcacttcatttttcagatagcagcaagctggatctctcttgtggggcattttcatctgcaaaatgcttgcgtattttggattttagtggatgctctagtataatgttgccagtctctattgggcacgtgaagcagctgcagtatcttactgctccgcgaatgcaaaatgaagttctcccagagtatatcactgagatatcaaaacttcagtacctaaacctggatggatcttctcgcatttctgcactaccagaatcaattggcaagcttgggcgtctgaaatatctaggtctatcaggttgttctggcctctcaaaactgccagaatcatttggtgattt

SEQ ID NO: 17017 - protein, 667 aa, Panicum virgatum
  misc_feature: Ceres CLONE 1790983
  misc_feature (159)..(466): Pfam Name: NB-ARC Pfam Description: NB-ARC domain
MAEVLAGFLTSAVVNIAKDKLASAIAEQANLLWNFGDDLENMNSVLESISAALQDAERRSVKEKSVQLWLKRLKNAAFDIPDLLDDYQDTSDRLTAAKIPNEKKMKFLQKTRVLSCLPVARKKIAVANRMKNMREELRKINDEFHSFNFTLGGTSTSVEQHYDIRETSSLLPEEPIKGRDGDKRKIMKLLLASTNNDETVILPIYGLGGMGKSTLAQLVYNDAQFKKYDYRIWVYVSRDFNLKKIGSSIISQLPIEGGQQNWDTLHVINQYLEKKLLCDKKVLIVLDDLWEEKDTELGKLRSMLHVGKKGSMIDVIVTTRKEDIARKVSTTEPYKLQPLKDDTCWEIIKRYSKFEQKHNQERLEQIGLDIAKKCGGVALAAQALGYMLQYKDMSEWVEINNSDIWNESSEDNGGVLPSLKLSYERMPLQLRICFSYCAIFPKGHNITADDLIHQWIALGFIKPSMGKEYIRQLLGMSFLQVSKLPKTSGYHMVQYTMHDLVHDLATLIIGDELMVSSVASKRTNAHRLKYCRYALVTKYDQATKLSSVLPSKVRALHFSDSSKLDLSCGAFSSAKCLRILDFSGCSSIMLPVSIGHVKQLQYLTAPRMQNEVLPEYITEISKLQYLNLDGSSRISALPESIGKLGRLKYLGLSGCSGLSKLPESFGD

SEQ ID NO: 17018 - DNA, 676 bp, Panicum virgatum
  misc_feature: Ceres CLONE 1790983-R
ttgctaacaacgggaaactacggcagtggtgcgagtcagaagagaataaggcgaagctcgcacacattaacagcataatttatgagtagcttaaccaagtaccatgaaaaatgccaccggggtatgaggttcgggtcataatcagctggacttcctttgtgactgtcgcgcactcctagcctcagattcaagtgaaacatcctcaatgcttgcctaatgagttctatggacacttgaggcttctgtattttcagtacaaaacagacatggttgcttttaactacagctgtaatgtgcctgtgagacgtttcttggaaacaagctcaaatcatgttgaatcaaaggatcttcattagcagctgcattgtcagatcttagatgctcgcagagcttatacaaagttacaactgtagtgttatagtgttattgactacatttgctgcaggctctcagtgtagacaacaggggaactccatctgcttctgtcagtcatttctgactctgctgactctgtacaagtgaactctgttcgatgcttcaaattctgcaaaaagcttttgtctttagttaactaggcgtatggcccgcgcatttgcgcggctagtattgaaaatttaaaaatttgcatatcgttgtatccttactattttttaaagattatactatttgttactat

SEQ ID NO: 17019 - DNA, 2385 bp, Panicum virgatum
  misc_feature: Ceres CLONE 1790984
  misc_feature: Encodes the peptide sequence at SEQ ID NO. 17020
attactcggcctccatttcctctcttctctgtcctcctgacgccctcctgtcttgatcctccctcttgtcaccctcacttcgccggagcacagcgttcgtcgatcggcttggccggcccaaggatcgacccggcctcgtcacgccagccgcccaccaccaccagccacaccatcgctggtctgctgctcacaccagaatccaaaattttcatcacaccaaaccatccactccctcacgttccccccaagcaaatccgatctttacaaccgcccgcattgtcgccgacaacagcctccttgccttccttccgcgcccggccggttacccacccaaatccaatccgctgcgcccaaagtcgcgacctttgctactgtttcatccgcagaaccaatcttcaccgcccgattctgctcggaatccgccgtagttgcgtccatttcggtcccagaaaatccgagctcgatgctgcttgcgcagcggagcccagtcttcgcggcttaattacgctccagaacacgaggagatccggcaattcgcaggaggctgtaggtgtggggcggtggtgccctggcttctcgcgccccgccgggtcccatgtcggactcggagctatcccggagcacggtggtgttcgggctccgcatgtgggtgctcgtcggcatcggcgtcggcgccgccttcgtgctcctgctcgtcctcatctccgtcctttgcctcctcgccttccgccgccgccggcggcggcagcggccgaccaaccacgcccagcagctccccaccaccgcccctcccaagagccccgcgaatgtcaaggcgcccaaggacatccaagaagtcccctcccacgccgccgccgacgccgccgccccggcgaaggcgccgctcgcgcaggtgctccagctccccacgccacaggtctccgagcagatcgtgaccggcaaggagcaccgcatcacgaacccggagcaacggcagcagcaccccagccaaaggcgcgacgggccttcgccgcacggcagcgacgagagccgaggcgggcgaggtggcgctgcgggccacgcgccaccggcggtgccggaggtgtcccatctcgggtggggccactggtacacgctcaaggagctggagacggcgaccgggatgttcgccgacgagaacgtgatcggcgagggcgggtatgggatcgtgtaccatggcgtgctcgagaacggcacgcatgtcgccgtcaagaacttgctcaacaacaggggtcaggcagagaaggaattcaaggttgaggttgaagcgattgggcgtgtgcggcacaagaaccttgtgcgccttctaggatactgcgctgagggtaatcagaggatgcttgtttatgagtatgtcgataatgggaacttggagcagtggctgcacggagatgttggacccgtaagccctcttacatgggagaacaggatgaagatcatactgggaacagcaaaagggttaatgtatttgcatgagggacttgaaccaaaagtggttcaccgtgatgtcaagtcaagcaacatccttctggacaagcactggaatgctaagctctcagatttcggactcgcaaagcttcttggttcagaaaggagttatgttactacacgagttatgggaactttcgggtacgttgctccagagtacgcagggactggaatgttgaatgaaacgagtgatatatatagttttggaattctcattatggaaataatatcgggtagggtaccagtggattataacaggccaccaggagaggttaatttagttgattggcttaagacaatggtaagcaaccgaaattctgatggcgttgtggacccaaagataccccagaagcccagttctagggcagtgaagaaggctttgctagtggccttgcgatgtgtagatcctgatgctcggaagaggccaagaatggggcatgtcattcacatgcttgaggttgatgatttcccatacagagaagatcgccggggtagcagagcaccagggcaagcaagagcaccagagaaaacggctggtggatcaagtcgccctgagactgacagcagtgcaaatggtggcacacaagccgaaccctttagatggagaaacccagatgcttaggtgttgtcgatcactgattcagaaagtcaactcctcatgatttctgaaggagaactgtgaggactgaagccgcgtactgttcgtttcgctgccttcatcggttcgtgtggcatccatggatctcaccacatcatttgtacatgtcaatatggtttagcccttagtaaaatttcctgtttagtatttatataggtagaagaaatatgcatgtatgataaaccatgcctctatgcttttgcacaaccatacaagtttct

SEQ ID NO: 17020 - protein, 510 aa, Panicum virgatum
  misc_feature: Ceres CLONE 1790984
  misc_feature (184)..(455): Pfam Name: Pkinase Pfam Description: Protein kinase domain
  misc_feature: SWISSPROT Homolog: EC 2.7.11.1 Non-specific serine/threonine protein kinase
MSDSELSRSTVVFGLRMWVLVGIGVGAAFVLLLVLISVLCLLAFRRRRRRQRPTNHAQQLPTTAPPKSPANVKAPKDIQEVPSHAAADAAAPAKAPLAQVLQLPTPQVSEQIVTGKEHRITNPEQRQQHPSQRRDGPSPHGSDESRGGRGGAAGHAPPAVPEVSHLGWGHWYTLKELETATGMFADENVIGEGGYGIVYHGVLENGTHVAVKNLLNNRGQAEKEFKVEVEAIGRVRHKNLVRLLGYCAEGNQRMLVYEYVDNGNLEQWLHGDVGPVSPLTWENRMKIILGTAKGLMYLHEGLEPKVVHRDVKSSNILLDKHWNAKLSDFGLAKLLGSERSYVTTRVMGTFGYVAPEYAGTGMLNETSDIYSFGILIMEIISGRVPVDYNRPPGEVNLVDWLKTMVSNRNSDGVVDPKIPQKPSSRAVKKALLVALRCVDPDARKRPRMGHVIHMLEVDDFPYREDRRGSRAPGQARAPEKTAGGSSRPETDSSANGGTQAEPFRWRNPDA

SEQ ID NO: 17021 - DNA, 1144 bp, Panicum virgatum
  misc_feature: Ceres CLONE 1791001
  misc_feature: Encodes the peptide sequence at SEQ ID NO. 17022
accccaaactactccgcaattccccaaccccgaaggaagcgacgtcccctagagcacgagcacgacctggccgcaccgtgccgtctcacggagcccgcccgtctagaagcttcgtcgccgcccgcccgcccgcccgcgccgtcgcacgccgccctagggttccgccggcgcggggggttcgccagagatggactggagcgcggtgacggcggaggacctggtggacgcgctgcgggaggtggactggtccacgccgccgcggcccgtcccggagttcttctcccgcttcaccgtcccccgctcctactccaagtggaccagccgcctcaagtgcaacctctactactacaggacaaactatttcatcttgatcatgttcatccttgggatgggcttcctttggaaaccggttgcaatccttgcagcttttatgactggactcagcattgcatttctcaatgacagtttcgcggtcactttcaatgagaaagtcacaaggacagtgagacaattttcaccacatttagctgcaaagatgaggccaccaataacccctgttctccgtggtcgaccaagctcaaagagatctattcatatttgtgggcgacctcgatgggtgtttgttctattcttttcttctgttagctgtatactctggttgacctcatgcagtcttctcacagtcctctgggcacttctcattgctctatttgcaactgtgcttcatgcaagcttcagaacacctaatttgaaagcacgtctgaatacattcagagaggaattccgagctgtttggaggaattacagcgagatttaagacctcctttgtttctctcatgttcctgtggtaagaaaaggtttgtcttgctggaacatccatgctgtttgtgtgctgtgctgggagaattagatgaaggtgatacgccattgcacattactacgtggattgcttgctcttttgggaggtggatttgggtcaggttgattcagtaggcaatgctataccttagcatacgatcctcctgaacaataatttttctttcagacttctccctaactgagcatttgagaaatgacagcatgtaaaggatgtaaaaatgtaccctgatctcaatcaaatgattcaaacccgttgttgtttgtt

SEQ ID NO: 17022 - protein, 209 aa, Panicum virgatum
  misc_feature: Ceres CLONE 1791001
  misc_feature (16)..(178): Pfam Name: PRA1 Pfam Description: PRA1 family protein
MDWSAVTAEDLVDALREVDWSTPPRPVPEFFSRFTVPRSYSKWTSRLKCNLYYYRTNYFILIMFILGMGFLWKPVAILAAFMTGLSIAFLNDSFAVTFNEKVTRTVRQFSPHLAAKMRPPITPVLRGRPSSKRSIHICGRPRWVFVLFFSSVSCILWLTSCSLLTVLWALLIALFATVLHASFRTPNLKARLNTFREEFRAVWRNYSEI

SEQ ID NO: 17023 - DNA, 657 bp, Panicum virgatum
  misc_feature: Ceres CLONE 1791005-R
  misc_feature: Encodes the peptide sequence at SEQ ID NO. 17024
acatttctcagccaaagcatgcggcgtctttgtcgccttgacttgtcttacaatgagacactgagtgacaaggtgatcggtgccatgctgtcatcctgccggaatctcatcgacatcagactcagggggtgccggggcctaacaggggcctccttggtctcacttctcaggcactgtgggcagacgctggagatccttgacatctcccgctgtcctagcattgcagtaggcaatgttgaattctttgttcagcgcgccactcggttgaatcatatgatcattgaggagagtgcgatatcagaggaattaaaggcaattgctcagaagaaaggcatgaagatcggctcattattgccttatgaaggaccattctgaagtcaggtaaaacccttcagaatgcaactcatccgcacttgatttcggtgtgatgttactctaatgttggaataaggtgctgctggtttgcacttgcgtgcgcaactttataactgcagtggaatgtatataccatgtcttatttgttactacttgtagtattagttatcaccgtactcttgtcatgacaaaccttttggtgccttccatgtaaattgagggccaaaaatgtgctgttgtatatcttcaaacaattgccattgaaataataaaagaaatctc

SEQ ID NO: 17024 - protein, 124 aa, Panicum virgatum
  misc_feature: Ceres CLONE 1791005-R
  misc_feature: SWISSPROT Homolog: EC 1.14.11.27 [Histone H3]-lysine-36 demethylase
TFLSQSMRRLCRLDLSYNETLSDKVIGAMLSSCRNLIDIRLRGCRGLTGASLVSLLRHCGQTLEILDISRCPSIAVGNVEFFVQRATRLNHMIIEESAISEELKAIAQKKGMKIGSLLPYEGPF

SEQ ID NO: 17025 - DNA, 707 bp, Panicum virgatum
  misc_feature: Ceres CLONE 1791005
attccgttccccacccaatcttgcggccacaagcaaagcaaagctaccactcatcattcccctccaccctcctccagccccacccgcgcggccggcaaatccgatggcttgactggccccccagcgccccgacggcgcccacaagctcccgccacgccgccgccggcggcggcggcggctgccgtcgccttggctgctacgccggcacggacgccgcgctctgcgacgacctgctgcaggaggtgttccgcctcttgccgcccgccgccgcgccggccgtgtccctagtttcccggcgctggctctcgctcctcagggcctccacatcgtccctgacactccgcctgccggtctcctccgacgccgcggcggcggcgaccctcgccgcgctgctgtcgcactacccgttcctctccgccctgaccgtcgtctccgctgctactccggcccgggacgccgacgccgtgctgctcgctgtcgcggccgcgccggccgccgccaggttctccacgctccggctcttgcccgattcggcggtctcccccgccgcgctgctcgccgtctgccctgccctttccggcctgacgtcgctccacctcaccgccgtccgccccctgtcgttccgctggctcgagctcctgccgcgcctcaagtcgttcgccctcgtcaactccgccgccagcgttgactgcgctggctcaagctcg

SEQ ID NO: 17026 - DNA, 742 bp, Panicum virgatum
  misc_feature: Ceres CLONE 1791011
  misc_feature: Encodes the peptide sequence at SEQ ID NO. 17027
aagaagaggagagagaggcgagacgagctcgcgggcccaaaaccctaacccgcggactccttggcggcggcggcgatggcgggaggcggcggagaaggcgtttcgccgtcggcggcgctcaaggaccaggggaacgagcagttcaagtcggggaactacctcaaggccgccgcgctctacacgcaggccatcaagctcgaccccgacaacgccaccctctacagcaaccgagctgcagcctttctgcagctggttaagcttagtaaagcacttgctgatgctgagacaacagtcaagctgaagccagagtgggagaagggtcatttcaggaaaggttgtgtcttggaggccatggagcgctatgaagaggcaatatatgcttttcagacagctttgcagcacaatccacaaaatacagaagtctcgagaaaaatcaagaggctttctcagttaccaagggaaaagaagcgtgcccttgatgctgagagcatgcgttccaatgttgacattgggaagaacttagattctctgaaaacagagttggctgcaaagtatggagatgcagaaacagggcagagtatcttttcgtttgttgttaatgtgatagaattagcaataaaggattggcatgacactggaaaagttgatccaagggtcaattttcttctcgatgagcagaagactaacactaaaaaatatctcccagtggttaacattgacaaggcctttgagtcaccccaac

SEQ ID NO: 17027 - protein, 222 aa, Panicum virgatum
  misc_feature: Ceres CLONE 1791011
  misc_feature (12)..(45): Pfam Name: TPR_1 Pfam Description: Tetratricopeptide repeat
  misc_feature (80)..(113): Pfam Name: TPR_1 Pfam Description: Tetratricopeptide repeat
  misc_feature: SWISSPROT Homolog: EC 3.1.3.16 Phosphoprotein phosphatase
MAGGGGEGVSPSAALKDQGNEQFKSGNYLKAAALYTQAIKLDPDNATLYSNRAAAFLQLVKLSKALADAETTVKLKPEWEKGHFRKGCVLEAMERYEEAIYAFQTALQHNPQNTEVSRKIKRLSQLPREKKRALDAESMRSNVDIGKNLDSLKTELAAKYGDAETGQSIFSFVVNVIELAIKDWHDTGKVDPRVNFLLDEQKTNTKKYLPVVNIDKAFESPQ

SEQ ID NO: 17028 - DNA, 1522 bp, Panicum virgatum
  misc_feature: Ceres CLONE 1791013
  misc_feature: Encodes the peptide sequence at SEQ ID NO. 17029
agcaaatgctctcgagccctctctaaaatccatacccgccatcgcagattcgctgcgcagcacagcaaatcagcagaggcggcttcgccctgcccctgcccgacgccttggtgccgcgcgccatggccggcaccaagagcaggtcgaccggcaaggccggctcgcctctgctcggcaagtacgagctcggcggcctcctgggccgcggcaccttcgccaaggtctaccacgcgcgctgccttgcggggggcgaccccgtggccgtcaaggtgctcgacaagcccgggctggccgccacgggcatggcggcgcgcgtcctgcgcgaggtctccgccatgcgccgcctccgccaccccaacgtgctccgcctccacgaggtgctcgccacgcgctccaacgtgtacctcgtcatggagctcgcccccggcggggacctcctgtcccgcctcgccgccctgcccgcgcgccggctccccgagcacgccgcgcgccgcgtcttcctgcagctcgtgtccgcgctcatctacagccacgcgcgcggggtcttccaccgcgacgtcaagccgcagaacgtgctcctcgacgccgacggcaacctcaaggtctccgacttcggcctcgccgcgctcccggactcgctccgcgacgacggccgcctgcacaccgcctgcggcaccccggccttcgccgcacccgaggtgctccgtcgcagggcctacgacggcgccaaggccgatgcctggtcctgcggcgtcatcctcttcgtcctcctcgcggggcacctccccttcgacgacgccaacatcgccgacatgtgccgcaaggcgcaccgccgcgagtacgtggtcccgcggtgggtgtcgcagccggcgcgccgcctcgtgtcgcgcctgctcgacccgaacccggacacgcgcctcgccgtggccgagctcgccagccacccctggttcaagcgctcgctcagcgtcgactcgcagctcggccgcctcctgggcggccaggcggagcgcgagctcgcgttccaggccccgcccgcgctcaacgccttcgacatcatctccatgtcgccggggctcgacctgtccgggctgttcggcgagagccgccggacccgggagaagcggttcatgaccacggcgtcgccggagcagacggtggagcggctcgggcaggcgggcgcgaagctcggctacttcgtggtgggcaagaagggggccgagcgcctgccgctgggcggcttctcggggctggtggcgatgtcgatggaaatgtcggaggtgtcgccggcgctgatgctcgtggagctgaggctggagggcggcgacggcgacgaggccgaggcgttcgggtgggaggagctccgggtggagctcggcgacgtggtcacggcgtggcacgtgtgcgaggaaggttgattcgcaagctcaaacgggagctgcaggatcagaattctttcgtaggatcatcgatggaaatggaaagtgtatgtatagtaagtgttcaatgtgaaaagttgatt

SEQ ID NO: 17029 - protein, 431 aa, Panicum virgatum
  misc_feature: Ceres CLONE 1791013
  misc_feature (20)..(277): Pfam Name: Pkinase Pfam Description: Protein kinase domain
  misc_feature (303)..(363): Pfam Name: NAF Pfam Description: NAF domain
  misc_feature: SWISSPROT Homolog: EC 2.7.11.1 Non-specific serine/threonine protein kinase
MAGTKSRSTGKAGSPLLGKYELGGLLGRGTFAKVYHARCLAGGDPVAVKVLDKPGLAATGMAARVLREVSAMRRLRHPNVLRLHEVLATRSNVYLVMELAPGGDLLSRLAALPARRLPEHAARRVFLQLVSALIYSHARGVFHRDVKPQNVLLDADGNLKVSDFGLAALPDSLRDDGRLHTACGTPAFAAPEVLRRRAYDGAKADAWSCGVILFVLLAGHLPFDDANIADMCRKAHRREYVVPRWVSQPARRLVSRLLDPNPDTRLAVAELASHPWFKRSLSVDSQLGRLLGGQAERELAFQAPPALNAFDIISMSPGLDLSGLFGESRRTREKRFMTTASPEQTVERLGQAGAKLGYFVVGKKGAERLPLGGFSGLVAMSMEMSEVSPALMLVELRLEGGDGDEAEAFGWEELRVELGDVVTAWHVCEEG

SEQ ID NO: 17030 - DNA, 1221 bp, Panicum virgatum
  misc_feature: Ceres CLONE 1791036
  misc_feature: Encodes the peptide sequence at SEQ ID NO. 17031
gctcaacccactcacccccacaccagaaatcccttcatctggtgccctgccttccttgctgtcttcccccaccggcactatttaactctgattctgtcagtttagcaactataactgcctaatttgtggccgaaagaaaacgtataaatgccttattaatcgtcgtcagatatagaagcttttagtgccaataaaagggaggggaggtcacatattcagcttttcttcctggactcttctcaagtcctgcacgctctggaggttaggttagaaggttccgggcttccatctacaagaagcaatcggcgcagctctgttctgtttctcctggctcttggcatcgtctggtagctcgctcttggcatcgtctggtagctccggttcaaaggtggtcgtggataatactgtcggttggacactggaatagtaaaatgtgggacaaaagattgcacgggtgcctgcttcttctggtcttccttctcgcgaacgcgtcaggcagccatgctgaaaccgccgtcgattcagagcaaggcaagaggcgatccctggccacggggagcggcatgttctgcgtggcgatgcagggcgcggacccggcggcgctgcaggcggggctgaactgggcgtgcgggccggggcacgccgactgcacggccatccagccaggcgggccgtgctacaagcagaacaacctgcaggcgctggcgtcctacgcctacaacgactactaccagcgtagcgccaaaaccagcaccgcctgcgacttcaacggcaccgccaccaccaccaccacggatcccagttcggggcagtgcgtcttcacaggaagctccacggccggcggcactccggcggcaagcgcccccagcgggctgtccccgttcacgccgggcacgggtggcttcggcaacggatcgtccttcgggagcccctcgagcagcctggtccctttcgatggcgcggagagcctcctgtcccgcgcgcggtgggcgctctgtgccctgctgctggcgctgccgctcttcttcttcctttgaccagcagcagagcagagcagcacatgtacatgggggcagcgagggccgctgcctgctagagcgtttttacagttacatgttttgttcgtcggtagatcttgtgtgggtgtacatgtcaggatcgcgttggatgtgttgggaggttacattacataagataagatgctgcacagatggatcgtct

SEQ ID NO: 17031 - protein, 201 aa, Panicum virgatum
  misc_feature: Ceres CLONE 1791036
  misc_feature (45)..(130): Pfam Name: X8 Pfam Description: X8 domain
  misc_feature: SWISSPROT Homolog: EC 3.2.1.39 Glucan endo-1,3-beta-D-glucosidase
  misc_feature: Useful for making plants with altered carbohydrate content
MWDKRLHGCLLLLVFLLANASGSHAETAVDSEQGKRRSLATGSGMFCVAMQGADPAALQAGLNWACGPGHADCTAIQPGGPCYKQNNLQALASYAYNDYYQRSAKTSTACDFNGTATTTTTDPSSGQCVFTGSSTAGGTPAASAPSGLSPFTPGTGGFGNGSSFGSPSSSLVPFDGAESLLSRARWALCALLLALPLFFFL

SEQ ID NO: 17032 - DNA, 649 bp, Panicum virgatum
  misc_feature: Ceres CLONE 1791053-R
  misc_feature: Encodes the peptide sequence at SEQ ID NO. 17033
tctcaggcaggaaaccactttgtactggttgtccgaaagggcaggagagcctggtgatgtgggcaaattccatcatacaaggaggaaagctcgcacaacttgtagatcccaacttacctactgaaggccacaccaatgaagttgagaggatgaccctagctgcttccctctgcatcagacaagcacctcaaaaccgtcctcaaattgatgttgttgtaaagcttctcgaaggtgacagtgatatactcaagtgggcacgatcacaagtcggactgtcatacgaggttgacgccgatgaatgtgtgatgacaccaccagcacaagggagtaatgccaacatccagtcctacatcaacctcgcattcgatgtggatgatgactctgcctctgtcaccagcacggacttcatcgcagccaacacctccttggaagagtatctgaagggaagatggagccggtcctcgagcttcgactgaccgatcaatgtcagagttaccccttgttagtgtatagatctttttttttaatttaagttacatttttgctccttggatgaaagtcggcacatgcaatgccctccaccaggaatttcatttgatcatgcatggcttagtacttttgtttttatgtgagggtctttttcctctct

SEQ ID NO: 17033 - protein, 157 aa, Panicum virgatum
  misc_feature: Ceres CLONE 1791053-R
  misc_feature: SWISSPROT Homolog: EC 2.7.11.1 Non-specific serine/threonine protein kinase
SGRKPLCTGCPKGQESLVMWANSIIQGGKLAQLVDPNLPTEGHTNEVERMTLAASLCIRQAPQNRPQIDVVVKLLEGDSDILKWARSQVGLSYEVDADECVMTPPAQGSNANIQSYINLAFDVDDDSASVTSTDFIAANTSLEEYLKGRWSRSSSFD

SEQ ID NO: 17034 - DNA, 249 bp, Panicum virgatum
  misc_feature: Ceres CLONE 1791053
attttcgcacttccagccctctctctctctggcctctctctctctctctctaaagccaagaagaagcgagcggcctcgggctcggggggcgccggcggaggcacgccatgaggctgctcgtcccggacggcgcgcggcggcagcggctaatgcagtgcgaggcgcgcgggccgccgccgtccccgcccccggcgccgccggcggcggcggggggaggaggaggaggagggaggacggtggccggccggg

SEQ ID NO: 17035 - DNA, 1426 bp, Panicum virgatum
  misc_feature: Ceres CLONE 1791084
  misc_feature: Encodes the peptide sequence at SEQ ID NO. 17036
acaatcgaatcaccgggcatctacaacaatgggcgcggcgcccgttccaccgcgccagcgagaggaggagaggccgccgatgaggtccgcgaggtcgccggcgagtgtggcggcggacttcgccatgggcggcgcggccgccgtggtggccaagacgggggccgcgccggtggagcgtgtcaagctgctgctgcagaaccagggcgagatgctgcggcggggcaccctgacgcggccctacaagggcatcgccgacgccttcgcccgcgtcctccgcgaggagggcgccgccgcgctctggcgcggcaaccaggccaacgtcatccgctacttccccacccaggcttttaactttgcattcaggggctactttaaaagcttctttggctgcgacagggagaaagacggaaaatggaagtggttggctggaaatgtagcctctggcagtgctgctggagctacaacgtcattactactataccatctagattatgcacgaacaaggctagctactgatgcaattgaatcccgaggaaacaaacgccagttcaggggactgctggatgtgtacaagaggacacttacaactgatggcgtatctggactatatcgaggtttcagtgtgtctattgttggcatcaccctgtaccggggtctacattttggcatctatgacaccatgaaacctcttgttctagtgggaccattggaggggaatttctttgccagctttgccttgggctgggcagtaacaactttctcgggggcctgttcctatccatttgacacagtccgtcgtagaatgatgttaacttcaggacaaccattcaaatacaggaatggcttccatgcagtaaagcagatcgttttaactgaagggttcttcacattattcagaggagttggagcaaatattctgtcaggaatggcaggagctggagttctttctgggtatgaccagctccaaaagttcgcaagccaacatggtcagattttgagcgcaagatgggggcattgaaatgatgtgtgtatggatatgagtatattcaagtccatggtcgaaggttcgatcattcaaatgggatgcgcaaccaagatgaaagaacttcacaaaacttagacagcaaagtgaatctccttgctgctccaacacgattggctgtagattgggttatctatatctgtacaattggctgtatgctgtagccattgatgaaatgatatcttggtaatcttgcaagctccaaaatggtttagtctaaaaaaccagtcaaccctagcaaaaccagtttgtacagatagaaacaacagtaggatggccctattacattgtattatggttatttgtacaatggccattatctgactgaacagtattaggtggttttccaggaatgctggttatcaccctgattctcttggtttc

SEQ ID NO: 17036 - protein, 329 aa, Panicum virgatum
  misc_feature: Ceres CLONE 1791084
  misc_feature (26)..(123): Pfam Name: Mito_carr Pfam Description: Mitochondrial carrier protein
  misc_feature (131)..(226): Pfam Name: Mito_carr Pfam Description: Mitochondrial carrier protein
  misc_feature (230)..(320): Pfam Name: Mito_carr Pfam Description: Mitochondrial carrier protein
MGAAPVPPRQREEERPPMRSARSPASVAADFAMGGAAAVVAKTGAAPVERVKLLLQNQGEMLRRGTLTRPYKGIADAFARVLREEGAAALWRGNQANVIRYFPTQAFNFAFRGYFKSFFGCDREKDGKWKWLAGNVASGSAAGATTSLLLYHLDYARTRLATDAIESRGNKRQFRGLLDVYKRTLTTDGVSGLYRGFSVSIVGITLYRGLHFGIYDTMKPLVLVGPLEGNFFASFALGWAVTTFSGACSYPFDTVRRRMMLTSGQPFKYRNGFHAVKQIVLTEGFFTLFRGVGANILSGMAGAGVLSGYDQLQKFASQHGQILSARWGH

SEQ ID NO: 17037 - DNA, 1790 bp, Panicum virgatum
  misc_feature: Ceres CLONE 1791091
  misc_feature: Encodes the peptide sequence at SEQ ID NO. 17038
agtcctcccaaacccagagtctggtcctcgtcttcctcccgtaactacctcggccctatccgcagcaaccattcgccgcgccgcgcgagaccagctcgatccgaccgacagcggccatggctcccctgccccgcgcggcccgcctcctccgatccgccgtcgggctgctgaggtcgccccctccgccgccggcgcggctcttctccagcgccgcggggaccgggaccgggaccgggacgggggcggggaccgggcgcgaagccgcgatcgtcgccaccgccgtggcgctggccgggtccgggctcgggctgtggctgaaaccgccctcgctcgccgactccggcgaggcggtcggcggccagatctcggtcgccggcggcggcggcgccgcggaggcccgggaggagaagggtcggttcctgttcgcagactcattccgcagaagggtgttctttaactacgagaagaggatacggcttctcagccctcctgaaaagatctttgagtactttgcatctgtgaggaacccagaaggtgaagtttacatgttgccctctgacttgatgagggcattagtccctgttttccctccatctgagtcgactgcagttcgcgaagggcgattaaggggggagcggagccctggagagttgcattgtgctccatcggaattcttcatgctgttcgacacaaatagcgatggcctcatctcctttgccgagtacatcttttttgtgacattgctcagcattcccgagtcaaatttcagtgcggctttcaaaatgttcgacgttgaccatagcgggctgatcgacaaagaggagtttaagaaaataatggcactgatgcggtcttttaatagacaaggagccacccataaggatggcttacgtgttggacttaaagttggccagcctgtggaaaatggtggagtggttgagttcttctttggtaacgatggaaatgaacctctacactatgataagtttacaaaatttttgaaggacttgcatgacgagattattcgtctggagttcagtcattacgatgtcaaatcatctaaaactataccagcaaaggattttgccttgtccatggttgcttctgctgacatgaatcacatcagcatgctgcttgatagagttgatgatttggtcaataagcctgatctgaaggacatacgcatatcttttgaggagtttaaggcgtttgcttatttgcgccgaagattggagccactatcgatggccatcttcgcatatgggaaagtgaatggattgttgacaaaacaggatctaaaacgtgcggcgcagcatgtttgcggggttgacttaactgatagaatggtggacatcattttccatgtgttcgacacaaatcaggatgggaacctgagcttggaagagttcttaagagcattacaaagacgagaaactgatattcgtcaaccaacgatacctggtcctttggggttcctgtcttgctggttcggtggtaggaagtgttcttcacttcgacagatgttgttctgattggttccctctacgagcctcaatataaatgtcatgtgccttttgattgtcatgtcgtggtggagaagataaccgccaagtagtgcactgatgctgaccgttgaaacgatttagctgtaaatatcgtctgggtgggcctagtaactgtaaatagtcttgttttgtgtgtcgtctaagggtctaaggaccgagaatccgttgtgctattctcatcccatatgtaaattgaaccccatatgaccttaaggagtcattgtc

SEQ ID NO: 17038 - protein, 471 aa, Panicum virgatum
  misc_feature: Ceres CLONE 1791091
  misc_feature (216)..(244): Pfam Name: efhand Pfam Description: EF hand
  misc_feature (410)..(438): Pfam Name: efhand Pfam Description: EF hand
  misc_feature: SWISSPROT Homolog: EC 1.6.3.1 NAD(P)H oxidase
MAPLPRAARLLRSAVGLLRSPPPPPARLFSSAAGTGTGTGTGAGTGREAAIVATAVALAGSGLGLWLKPPSLADSGEAVGGQISVAGGGGAAEAREEKGRFLFADSFRRRVFFNYEKRIRLLSPPEKIFEYFASVRNPEGEVYMLPSDLMRALVPVFPPSESTAVREGRLRGERSPGELHCAPSEFFMLFDTNSDGLISFAEYIFFVTLLSIPESNFSAAFKMFDVDHSGLIDKEEFKKIMALMRSFNRQGATHKDGLRVGLKVGQPVENGGVVEFFFGNDGNEPLHYDKFTKFLKDLHDEIIRLEFSHYDVKSSKTIPAKDFALSMVASADMNHISMLLDRVDDLVNKPDLKDIRISFEEFKAFAYLRRRLEPLSMAIFAYGKVNGLLTKQDLKRAAQHVCGVDLTDRMVDIIFHVFDTNQDGNLSLEEFLRALQRRETDIRQPTIPGPLGFLSCWFGGRKCSSLRQMLF

SEQ ID NO: 17039 - DNA, 1602 bp, Panicum virgatum
  misc_feature: Ceres CLONE 1791102
  misc_feature: Encodes the peptide sequence at SEQ ID NO. 17040
gagtcgtctttatttgggggtggcgggttgcggtcaaacacaccgggcctcggctagtatatccgcccgaccgccccggcacggcggcgcaacaccgcgccaccgcctctcggagaatcgaagccgtctgggcggggcgcgatggatctgctgaagcgggagctggagaagaagcggaaggcggcgtcggccgacttcggcgggaagagcttcgtgcggcggtcggagctggagcagaagcagctccagaagcgccgcgacgagcaacgccagcagctcgccaagggcggcgcatctgcgccgttccccgattccgccgcgggcgcagcgggctccgacgccagcaaccccgatgccgcggcccaggcggcggcggggaaccctaaccctagctcctccacctccgccgcggcggcctccgtcccgcccgccctcgcgccgaagaagaccacgcaggaggaggcgctgctctccgaggagcgccgcatcgacgagctcgacctcccgcggcaggaggtggtgcggcgcctccgcgtactacgcgagcccgtcacgctcttcggggaggacgacgccgcccgcctcgcgcgcttcaagctcattctcaagtccggcgtcatagacgacatcgatgacatcgacatgacagaggggcagaccaacgatttcctccgcgacatgatcgagatgcgcaagcggcaaaagtcagggagagacacctacgccaaaggcaaggggaagcgtgtaggtggcggtgatggtggtgaaggcggagctgctggagacggtgcagatgatggggacggcaaggggagcggggatgatgcagatgcggataaggactccaagaggatgaggaccaagtttgaggagctttgcaacgaagacaagattttggtgttcttcaagaagctgcttaacgagtggaaccaagagctagatgagatgtcagagttggagaagcggactgcaaaagggaagtcaatggttgcaacatttaagcagtgtgcgcggtatctcagccccctgtttgagttctgcaggaagaaggttcttcctgatgacatccgtcaagcattgctcgttattgttgaatgctgtatgaagcgtgattatttagcagcaatggaccaatacatcaaactggccattgggaacgcaccatggcccattggagtcactatggttggtatccatgagcgttctgcccgtgaaaagatctacacaaatagtgttgcccacatcatgaacgatgagaccactcgcaagtaccttcagtcgatcaagaggctaatgaccctttgccagcggcgttatcctgcgctaccctcgaaatcagtggagttcaacagcctggcaaatgggagtgacctgcaggcgcttttatcagaggagaatggttcgggtaaagcttccgaggaaaggctccggttgatgcctgcatcgaaagactgatgctttgatatgctagcttggatcaaaaatatagttagagatctttgtgtaatatcaacctcagttttcctcctgtcttttcttttttctgtattgttccatgaagggaacagcagctgaattatggatgttaatcaaattgcttac

SEQ ID NO: 17040 - protein, 437 aa, Panicum virgatum
  misc_feature: Ceres CLONE 1791102
  misc_feature (251)..(395): Pfam Name: Prp18 Pfam Description: Prp18 domain
  misc_feature (126)..(155): Pfam Name: PRP4 Pfam Description: pre-mRNA processing factor 4 (PRP4) like
MDLLKRELEKKRKAASADFGGKSFVRRSELEQKQLQKRRDEQRQQLAKGGASAPFPDSAAGAAGSDASNPDAAAQAAAGNPNPSSSTSAAAASVPPALAPKKTTQEEALLSEERRIDELDLPRQEVVRRLRVLREPVTLFGEDDAARLARFKLILKSGVIDDIDDIDMTEGQTNDFLRDMIEMRKRQKSGRDTYAKGKGKRVGGGDGGEGGAAGDGADDGDGKGSGDDADADKDSKRMRTKFEELCNEDKILVFFKKLLNEWNQELDEMSELEKRTAKGKSMVATFKQCARYLSPLFEFCRKKVLPDDIRQALLVIVECCMKRDYLAAMDQYIKLAIGNAPWPIGVTMVGIHERSAREKIYTNSVAHIMNDETTRKYLQSIKRLMTLCQRRYPALPSKSVEFNSLANGSDLQALLSEENGSGKASEERLRLMPASKD

SEQ ID NO: 17041 - DNA, 710 bp, Panicum virgatum
  misc_feature: Ceres CLONE 1791103
  misc_feature: Encodes the peptide sequence at SEQ ID NO. 17042
attctccggccctgccctggtagcatccatatcgcagctgctaactagctatttcaaggagagatcgatcgagcatcatcatccattgcatgcgcatcttcgtcgatctcttggccctcccatctcaatctcatctagctatctgcagggcaggcaggcaggcgcacatggatcatcagcagcagacgccatgcgtgcccccagagttcaggttccatcccacggaggaggagctggtggggtactacctcgcccgcaaggtggccgcccagaagatcgacctcgacatcatccgggaggtggatctctacaggatcgagccatgggatctccaagagcggtgcagctactacggcggcgccggcggccaggaggaggagcccaccgagtactacttcttcagctacaaggaccgcaagtaccccagcggcacgcgcaccaaccgcgccaccgccgccggcttctggaaggccaccggcagggacaagcccgtgctctcctcccggtccgccgcccccctcagcgtcatcggcatgaggaagacgctcgtcttctaccgtggccgagctcccaacggcaggaagaccgactggatcatccacgagtaccgcctgcagaacaacgagcacgcgccagcgcaggaggaaggatgggtggtctgccgcgccttccagaagccgatgcccaaccagcagcagcagagacacggc

SEQ ID NO: 17042 - protein, 180 aa, Panicum virgatum
  misc_feature: Ceres CLONE 1791103
  misc_feature (10)..(150): Pfam Name: NAM Pfam Description: No apical meristem (NAM) protein
  misc_feature: Useful for making plants with altered carbohydrate content
  misc_feature: Useful for biocontainment applications
  misc_feature: Useful for making plants with altered cell wall content and/or composition
  misc_feature: Useful for making plants with altered lignin content
  misc_feature: Useful for making plants with modulated biomass
  misc_feature: The sequence is a functional homolog of SEQ ID NO 1729 in the 11/479,226 US patent application
  misc_feature: The sequence is a functional homolog of SEQ ID NO 2416 in the 10/374,780 US patent application
  misc_feature: The sequence is a functional homolog of SEQ ID NO 914 in the 10/225,066 US patent application
  misc_feature: The sequence is a functional homolog of SEQ ID NO 2590 in the 10/374,780 US patent application
  misc_feature: The sequence is a functional homolog of SEQ ID NO 286 in the 10/225,066 US patent application
  misc_feature: The sequence is a functional homolog of SEQ ID NO 1270 in the 10/374,780 US patent application
  misc_feature: The sequence is a functional homolog of SEQ ID NO 1423 in the 10/412,699 US patent application
  misc_feature: The sequence is a functional homolog of SEQ ID NO 898 in the 10/666,642 US patent application
  misc_feature: The sequence is a functional homolog of SEQ ID NO 160 in the 10/666,642 US patent application
  misc_feature: The sequence is a functional homolog of SEQ ID NO 634 in the 10/412,699 US patent application
  misc_feature: The sequence is a functional homolog of SEQ ID NO 638 in the 11/435,388 US patent application
  misc_feature: The sequence is a functional homolog of SEQ ID NO 194 in the 10/374,780 US patent application
  misc_feature: The sequence is a functional homolog of SEQ ID NO 898 in the 10/225,066 US patent application
  misc_feature: The sequence is a functional homolog of SEQ ID NO 132 in the 10/225,066 US patent application
  misc_feature: The sequence is a functional homolog of SEQ ID NO 1508 in the 10/666,642 US patent application
  misc_feature: The sequence is a functional homolog of SEQ ID NO 1924 in the 10/412,699 US patent application
  misc_feature: The sequence is a functional homolog of SEQ ID NO 2186 in the 10/374,780 US patent application
  misc_feature: The sequence is a functional homolog of SEQ ID NO 564 in the 11/435,388 US patent application
  misc_feature: The sequence is a functional homolog of SEQ ID NO 2478 in the 10/374,780 US patent application
  misc_feature: The sequence is a functional homolog of SEQ ID NO 572 in the 10/225,066 US patent application
  misc_feature: The sequence is a functional homolog of SEQ ID NO 853 in the 10/374,780 US patent application
  misc_feature: The sequence is a functional homolog of SEQ ID NO 612 in the 11/435,388 US patent application
  misc_feature: The sequence is a functional homolog of SEQ ID NO 854 in the 10/374,780 US patent application
  misc_feature: The sequence is a functional homolog of SEQ ID NO 1064 in the 10/225,066 US patent application
  misc_feature: The sequence is a functional homolog of SEQ ID NO 2838 in the 10/374,780 US patent application
  misc_feature: The sequence is a functional homolog of SEQ ID NO 682 in the 11/435,388 US patent application
  misc_feature: The sequence is a functional homolog of SEQ ID NO 2840 in the 10/374,780 US patent application
  misc_feature: The sequence is a functional homolog of SEQ ID NO 450 in the 10/225,066 US patent application
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: Useful for making plants with altered terpenoid content
  misc_feature: The sequence is a functional homolog of SEQ ID NO 326 in the 10/412,699 US patent application
  misc_feature: The sequence is a functional homolog of SEQ ID NO 760 in the 11/479,226 US patent application
  misc_feature: The sequence is a functional homolog of SEQ ID NO 320 in the 10/374,780 US patent application
  misc_feature: The sequence is a functional homolog of SEQ ID NO 850 in the 10/225,066 US patent application
MDHQQQTPCVPPEFRFHPTEEELVGYYLARKVAAQKIDLDIIREVDLYRIEPWDLQERCSYYGGAGGQEEEPTEYYFFSYKDRKYPSGTRTNRATAAGFWKATGRDKPVLSSRSAAPLSVIGMRKTLVFYRGRAPNGRKTDWIIHEYRLQNNEHAPAQEEGWVVCRAFQKPMPNQQQQRH

SEQ ID NO: 17043 - DNA, 1721 bp, Panicum virgatum
  misc_feature: Ceres CLONE 1791108
  misc_feature: Encodes the peptide sequence at SEQ ID NO. 17044
ctcaactcgaacagcccagccgcaaagccaccccgggtttccagcagctccggcacgatcgccttcgcccagtgattgagggtcagggaaaaaaaattcccccgtcgcacccgcccattacgacggcgccggccgagcagacgccgccgccacgatgtcgcccaccaccggcgccgtcgcatccgccgcgccgggagagaaatctcccgccgccacggtgctcctcggcaggtacgagctcggcgacctcctcggccgcggcgcgtccgccaaggtgtaccgcgcgcgggacctcctcaccggccactccgtcgcgatcaagtcattccccaacccccgcgccggcgccgaggaggggcgccgccccgtggccatcgagcgcgaggcggccatcctccgccgcctgcgccaccgccacgtggtgcgcctccacgaaatcctagccacgcgcaagaaggtccatttcgtcctcgacctcgccgccggcggcgagctcttctcgctcgtcgacgcctccggccgcatgacggaggacctcgccaggcactacttccggcagctcatctccgccgtgcgctactgccacgcgcgcggcgtgttccaccgcgacatcaagccggagaacctactcctggacgaggccggcgagctcaaagtcgccgactttggcctcggcgccgtggccgacgacggcaacctccgccacacgctctgcggcaccccggcgtacgtggcgccggagatcctgtcgaggagagggtacgacccagccaaggtggacatctggtcctgcggcgtggtcctgttcgtgctcgccgccgggtacctccccttcaacgacgccagcctcgtgaacatgtaccgcaagatctacgcgggcaggttccggtgcccgagctggttctcgccgtcgctgcgcgacctgctgcgccgcgtgctggacccgaacccggacgcccgcatcgacgcggacgacatcgtgggccacccgtggttctgccacggcgccggcgacaaggagctggccctcctcatgcgcggccactaggaggagccctggttcaagcccgagttcaaggaggaggacatggtgagggagatgaccgcgttcgacatcctgagcttctccgccgggtccgacctgtcggcgctcttcggcgccgggcatggcaaggagcgggtgttcgtcagcgaggccggcgcttccgtgctgagccgcgtggaggcggccgggcggaaggaagggtaccgcgtgaggagggaagggaagcggggcaccgggccggtctacctggaggaggagagcggcggtggcwtcgtggcgaaggtgagcgtcttcaagctcgccgacgcggtgtcagtggtggaggttgtgaagggcgacggcgcggaggccgcgctgttctggaccgagcggctcgagccggccgtgaagcccccggtgctgtcgtgctgagctgaccaggccgccgccgagggttcctggcttcctgctcctggccctgggaggcgcctccgccgcttgccgggaatgggatccgtttcctttggttgtgatggttcctcaaaaattcacttggttgtttggccgtgtgtgtgttgtatggtgcctgtcacgctcggcgagcatcagagcactaagcgrgcgaggtttggtgccgggtcggccaaaatcatcatcatcatgatcgtcatcatctgtataatattcctattccgac

SEQ ID NO: 17044 - protein, 297 aa, Panicum virgatum
  misc_feature: Ceres CLONE 1791108
  misc_feature (27)..(281): Pfam Name: Pkinase Pfam Description: Protein kinase domain
  misc_feature: SWISSPROT Homolog: EC 2.7.11.1 Non-specific serine/threonine protein kinase
  misc_feature: Useful for making plants with modulated biomass
  misc_feature: Useful for making plants with modulated salt sensitivity
MSPTTGAVASAAPGEKSPAATVLLGRYELGDLLGRGASAKVYRARDLLTGHSVAIKSFPNPRAGAEEGRRPVAIEREAAILRRLRHRHVVRLHEILATRKKVHFVLDLAAGGELFSLVDASGRMTEDLARHYFRQLISAVRYCHARGVFHRDIKPENLLLDEAGELKVADFGLGAVADDGNLRHTLCGTPAYVAPEILSRRGYDPAKVDIWSCGVVLFVLAAGYLPFNDASLVNMYRKIYAGRFRCPSWFSPSLRDLLRRVLDPNPDARIDADDIVGHPWFCHGAGDKELALLMRGH

SEQ ID NO: 17045 - DNA, 1559 bp, Panicum virgatum
  misc_feature: Ceres CLONE 1791110
  misc_feature: Encodes the peptide sequence at SEQ ID NO. 17046
atctaggcgagtcaccctccagttccaatctcgctatcaccgttgcttctccgctccgcccaccatgctctccgccatggccgcgcgccccgtgaccgcgagcagctcacgccgccctcctctcccagctcagcctgcagctgctgctggtccttcctcttcccctgcggctcgtggagtcagatcgggggcgggagcaaagcgctctttccttcggccgtgcccgatgccgctgacgtccgtggcagtggggagtttggttgccgctggggccgctaatgctgccgagctattggatcctctgcacggatcatcagaacttcttttggccgatcttggcattggagattggtttgggggtttgctgttttctgctggacagcaggctaatgaggctgttcaggatcagctatctgctcttagtttctctagcttggtagtcatttttggtgctggacttgtaactagtttgtctccatgtacactcagcgttctgccattgaccctaggatatataggtgcatttggctctggaaaaagccgaaccgaggttatcggaaattcaatagcattttcattaggactggcaacaaccttagctattcttggtgttgctgcttcgtttgctggaaaggcttacggtcaggttggacaaggactcccagtggctgcttctggattggccattatcatgggactgaaccttctggaggtagtcgagctgcaacttccctcatttttcagcgattttgaccctcgagctgctgctgctaacctcccttcaagtgtacaagcatatcttgctggtcttacatttgcattagcagcatcaccttgcagcacacctgttcttgctacccttctgggatatgttgccacttcaagagaccccattattggaggaagcttgttgttgacatacacaacgggctatgttgcgcctcttcttattgcagcttcttttgctggagcgttgcagagtttgctgtcattcagaagatattcagcatggataaacccaatcagtggtgcatttctacttggtggaggtgtctacacccttctggacaggatgtttcctgcaacgtcaatggcaatgtaggacattgttggagactgcaagacaacagtccattggacatgtgatagcaatgtcttcagatgtacaataggtaatgatcaaacactaacagagtgttgttggttctctctacaatgtataggcgtgtaaatgattcaagacagccaaggcatctttacctcataagtctgtacgggcctcaataattggaggtgtaccctggagactggaaggattgatataatacatggaaatccatatatgcgtatgtacctaaggatcgggttttgaaccaatgaccaaaattggttatcagggcatgtggcgggcccaaattcagtggtcaattcctttgcaattctttttcgtcagtgtattttctgtagggtacaatattgcagaatacttctgttaattgtaacaatttgacatgatatggtaatcagacagttaatatacaatcagctttatgggcgtc

SEQ ID NO: 17046 - protein, 341 aa, Panicum virgatum
  misc_feature: Ceres CLONE 1791110
  misc_feature (123)..(330): Pfam Name: DsbD Pfam Description: Cytochrome C biogenesis protein transmembrane region
  misc_feature: SWISSPROT Homolog: EC 1.8.1.8 Protein-disulfide reductase
MAARPVTASSSRRPPLPAQPAAAAGPSSSPAARGVRSGAGAKRSFLRPCPMPLTSVAVGSLVAAGAANAAELLDPLHGSSELLLADLGIGDWFGGLLFSAGQQANEAVQDQLSALSFSSLVVIFGAGLVTSLSPCTLSVLPLTLGYIGAFGSGKSRTEVIGNSIAFSLGLATTLAILGVAASFAGKAYGQVGQGLPVAASGLAIIMGLNLLEVVELQLPSFFSDFDPRAAAANLPSSVQAYLAGLTFALAASPCSTPVLATLLGYVATSRDPIIGGSLLLTYTTGYVAPLLIAASFAGALQSLLSFRRYSAWINPISGAFLLGGGVYTLLDRMFPATSMAM

SEQ ID NO: 17047 - DNA, 1456 bp, Panicum virgatum
  misc_feature: Ceres CLONE 1791123
  misc_feature: Encodes the peptide sequence at SEQ ID NO. 17048
acagtgtctgtcagtaggagagcgagggccaggggaaggcagcggcggccggcggatccagctcccttgcagtgatacaagccagtagaggtggccgaagccccccccagccccccagccagtaggggagaggaggaggagtgggggatggggaagggagggcgagggagcgacgccacggcggcggctggcgaggtggaggagaacatggcggcgtggctcgtcgccaagaacaccctcaagatcatgcccttcaagcttccgccccttggcccgcatgatgtccgggtgcggatgaaggccgtggggatctgcggcagcgacgtgcactacctcagggagatgcgcatcgcgcacttcgtggtgaaggagccgatggtgatcggccacgagtgcgcgggcgtgatcgaggaggttggctccggcgtgacgcacctcgccgccggcgaccgcgtggcgctggagcccggcatcagctgctggcgctgccgccactgcaagggcgggcgctacaacctctgcgacgacatgaagttcttcgccaccccgcccgtgcacggctcgctggccaaccagatcgtgcaccccgcggacctgtgcttcaagctccccgacggcgtcagcctggaggagggcgccatgtgcgagcccctcagcgtgggcgtccacgcgtgccgccgcgccggggtcgggcccgagacggcggtcctcatcatgggcgccggccccatcggcctcgtctcgctgctcgccgcgcgtgccttcggcgcgccgcgcgtggcgatcgtcgacgtggacgagcaccgcctcgccgtggccaagtccctgggcgcggacgcggcggtgcgggtgtcggcgaggcccgaggacaccgccgaggaggtggcgcggatccaggcggcgctgggcggcgcggagatcgacgtgagcctggactgcgccgggttcagcaagacgctggcgacggcgctggaggcgacgcggcccggggggcgggtgtgcctggtggggatggggcacaacgagatgacggtgccgctgacgtcggcggcgatccgggaggtggacgtggtgggcatcttccggtacaaggacacgtggccgctgtgcatcgagttcctgcgctccggcaaggtggacgtgaagccgctcatcacccaccgcttcggcttctcgcagcgggaggtggaggaggccttcgaggtcagcgcgcgcggccgcgacgccatcaaggtcatgttcaacctctaggccggacgactgggtgggtaggcggccgccggtcgcgctccggggatcgatcgatgaataaaataaggtagtggaagtggccggcgccgtccgtcggtcggcgatcctccggcgaagggcgcagaaaaccttgatcggcggcgagatgccatggcgttgttttggattggaataaccgtggctttaatttgttgcttctttcgcc

SEQ ID NO: 17048 - protein, 367 aa, Panicum virgatum
  misc_feature: Ceres CLONE 1791123
  misc_feature (43)..(154): Pfam Name: ADH_N Pfam Description: Alcohol dehydrogenase GroES-like domain
  misc_feature (183)..(327): Pfam Name: ADH_zinc_N Pfam Description: Zinc-binding dehydrogenase
  misc_feature: SWISSPROT Homolog: EC 1.1.1.14 L-iditol 2-dehydrogenase
MGKGGRGSDATAAAGEVEENMAAWLVAKNTLKIMPFKLPPLGPHDVRVRMKAVGICGSDVHYLREMRIAHFVVKEPMVIGHECAGVIEEVGSGVTHLAAGDRVALEPGISCWRCRHCKGGRYNLCDDMKFFATPPVHGSLANQIVHPADLCFKLPDGVSLEEGAMCEPLSVGVHACRRAGVGPETAVLIMGAGPIGLVSLLAARAFGAPRVAIVDVDEHRLAVAKSLGADAAVRVSARPEDTAEEVARIQAALGGAEIDVSLDCAGFSKTLATALEATRPGGRVCLVGMGHNEMTVPLTSAAIREVDVVGIFRYKDTWPLCIEFLRSGKVDVKPLITHRFGFSQREVEEAFEVSARGRDAIKVMFNL

SEQ ID NO: 17049 - DNA, 1856 bp, Panicum virgatum
  misc_feature: Ceres CLONE 1791125
  misc_feature: Encodes the peptide sequence at SEQ ID NO. 17050
aaccaaacgccaaatggggccaagcatgacgcccactgccacggtgcccctctcgcctctcctcctccgcctctccgccgcggccgcagaagctccacgcctcaagaacccggcggcgacagcagcagcagccgcaggagcagtcgtgcggtggccggggggcgcggccaggagcaggaggaggaggtgccgggcggcggtggtggaggaggccggcgcgcgagaggacggggtgctgctgcccaaggagggggacgaggccgcggccgcggcggcggggcggtacgactggaaggaggagtggtaccccctgtacctggccaaggaggtgcccgacgacgcggcgctcccgctcaccgtgttcgaccgccagctcgtgctctggcgcgacggcgacggcgtgctccgctgccaccaggaccggtgcccgcacaggctagcgaagctgtcggaaggccagatcgtcgacggcaggctggagtgcctctaccatggctggcagttcgatggcgagggcaagtgcgtcaagataccacagctgccggagggcggcaagatcccccggagcgcgtgcgcgcgcaagtacgaggtgcgcgactcgcagggcgtggtgtgggtgtggatgtcggacgcgaacccgcccgacgagcggaagctcccctggttcgagccgtacgcgcgggcggggttcacggacctgtcgacggtgcacgagctcccctacgaccactccatcctgctggagaacctcatggacccggcgcacgtgcccatctcccacgaccgcaccgactggacggccaagcgcgaggacgcgcagccgctcttcttcgacgtcaccgagcgcaccgcgcgcggcttcgccggctactggggccgcacgcgcacgccgcacctccgcaacctgctccgcttccaggcgccctgcgtgctcaccaacacgctccagtacacggacaaggacggcaaggaccagtgcttctccgcccagttcctctgccgccccgccggccagggcaagtccatgctcatcgtccgcttcggctccaccgtcaggtcgcccatcgccaaggtgctcccggcctggtacctgcaccagaacgcgtgcaaggtgttcgagcaggacatggggttcctgtcgtcgcagaacgaggtgctgctccgggagcaggtgcccaccagggagctctacctcaacctccgctcttccgacacctgggtcgccgagtacaggaagtggatggacagggcgggccacggcatgccctactacttcggccacagcagcctcgcgccgccgcccgtgccggccgtcgtcgagcaggcgccggcgggggccgtcgcggggatctcggcctccttcccggccaagggcggcgtcggcacggtgcacgcgcccaaccccaccaacaggtacttccgccacgtcgtgcactgcaaggggtgcagggcctccgtcaacaagtacacctcgttgaagaacgccttcgccgtcctcgcggcggcggccgtggccgcctccatcctggcggcgaccaggcaatggaaggctgtcttgctcgcggcgtcggccgtgctggccgcggcgtcgtacgcgtgcgacgcggtgctttctttgatcacaaccaacttcattaggacacataggcgactgtaggcttctagcaggtactgtgctgtatttaggtagaagggaggcttctgccctttgcatatttgtacctatctataaatgaggcgatgctttggcattctaagttgcatgtcagcagcagatgatatggggattaaatcttcaatcttctgtgaaattgtggatagtaatgcaggatccaggacgttgagtttgtgatttg

SEQ ID NO: 17050 - protein, 547 aa, Panicum virgatum
  misc_feature: Ceres CLONE 1791125
  misc_feature (301)..(391): Pfam Name: PaO Pfam Description: Pheophorbide a oxygenase
  misc_feature (96)..(198): Pfam Name: Rieske Pfam Description: Rieske [2Fe-2S] domain
  misc_feature: SWISSPROT Homolog: EC 1.13.12.14 Chlorophyllide-a oxygenase
MGPSMTPTATVPLSPLLLRLSAAAAEAPRLKNPAATAAAAAGAVVRWPGGAARSRRRRCRAAVVEEAGAREDGVLLPKEGDEAAAAAAGRYDWKEEWYPLYLAKEVPDDAALPLTVFDRQLVLWRDGDGVLRCHQDRCPHRLAKLSEGQIVDGRLECLYHGWQFDGEGKCVKIPQLPEGGKIPRSACARKYEVRDSQGVVWVWMSDANPPDERKLPWFEPYARAGFTDLSTVHELPYDHSILLENLMDPAHVPISHDRTDWTAKREDAQPLFFDVTERTARGFAGYWGRTRTPHLRNLLRFQAPCVLTNTLQYTDKDGKDQCFSAQFLCRPAGQGKSMLIVRFGSTVRSPIAKVLPAWYLHQNACKVFEQDMGFLSSQNEVLLREQVPTRELYLNLRSSDTWVAEYRKWMDRAGHGMPYYFGHSSLAPPPVPAVVEQAPAGAVAGISASFPAKGGVGTVHAPNPTNRYFRHVVHCKGCRASVNKYTSLKNAFAVLAAAAVAASILAATRQWKAVLLAASAVLAAASYACDAVLSLITTNFIRTHRRL

SEQ ID NO: 17051 - DNA, 660 bp, Panicum virgatum
  misc_feature: Ceres CLONE 1791129
  misc_feature: Encodes the peptide sequence at SEQ ID NO. 17052
atttcttttctttgctcgttcttgttcacctctatccctcacaccgcagcaagatggtgtactcgctcctgctggtcagccttggccaccgtcgacgacccaccggtgctcccccactacctcccgctgatcctcggctgcctccccaagggcagattagactggccccacgtcggcgaaaccatccgcttcctccaccgcacccgatccaacaccgccggcggcttcctcaaggagcacgtcgccaggtacgggacggtgttcaagtcgcacctcttcggctcgccggcggtggtctcctgcgacgaggagctcaaccacttcgtgctgcacaacgaggagcgcctgttcaagtgcaactaccccggcgccatccgcaccatcctcggcgagtcctccgcgctggtggtcaccggcgagcgccaccgccagatccggagcatgttcctcgccctcgtcgcctccacggggctcaaggcctcctacgtcgccagcgtcgacgagtccgcgcgctccctcatcgcgtcctggcgcggccgcgagaccatcagcttctgcgaggaggcgaggaagttcccctacaaggtgatcatggagcaggttctgggcctgccgccggacggcccggtggccctccggatcctggaagagtaccagatc

SEQ ID NO: 17052 - protein, 219 aa, Panicum virgatum
  misc_feature: Ceres CLONE 1791129
  misc_feature: SWISSPROT Homolog: EC 1.14.13.77 Taxane 13-alpha-hydroxylase
  misc_feature: Useful for making plants with modulated oxidative stress sensitivity
ISFLCSFLFTSIPHTAARWCTRSCWSALATVDDPPVLPHYLPLILGCLPKGRLDWPHVGETIRFLHRTRSNTAGGFLKEHVARYGTVFKSHLFGSPAVVSCDEELNHFVLHNEERLFKCNYPGAIRTILGESSALVVTGERHRQIRSMFLALVASTGLKASYVASVDESARSLIASWRGRETISFCEEARKFPYKVIMEQVLGLPPDGPVALRILEEYQ

SEQ ID NO: 17053 - DNA, 1887 bp, Panicum virgatum
  misc_feature: Ceres CLONE 1791131
  misc_feature: Encodes the peptide sequence at SEQ ID NO. 17054
aacgaaaatctcgccgctctcgcggaggaggaggagcacaccaccgcgcttgcttgcttgcttcgcttgctcccccagtccccatctagggtcgcctcgcggatcacgggatcagcgaccacgaccagggcgaccaccgccgcgcgcgcgagccgggcgccgggggcggcagccatggacgcggcagcggggaagcggacgctggcgctggtgaacctggcggccatcatggagcgcgccgacgaggcgctgctgcccgcggtgtaccaggaggtcggggccgctctgcacgtcacgcccatggggctcggcgcgctcacgctctaccgctccgccgtgcagggcgcctgctacccgctcgccgcctacgccgccaagcggtacaaccgcacccacgtcgtcgccgtgggggccgtcctctgggccgccgccaccttcctcgtcggcgtctccgataccttcgcccaggtagcagtagctagaggtttgaatggtattggccttgcgcttgtcacccctgcaatccagtctctagtggcagatagctctgatgacaatacccgtggcgccgcgtttggatggcttcaactcacaggcaacatgggttcaattattggcggtatgttttccctgatgttagcatcaaccacagtcatgggtattgcgggttggcgcgttgcatttcacattgttggcctcatcagtgtggtagtcggtgcactggtaggcctatttgcagtggacccccattacgtccatgttggaaatggcaagcaactcttgcgcaagtctacttgggaagagatgaaggatttagtgagagaagccaaaactgtagtccgaatctcgtcatttcagatcattgtggcccagggcatcgcaggttcgtttccatggtctgccatatcctttgccccaatgtggttggagctgatgggctttacacacagcaaaactggacttctcatgctaacattagtattggcaagctcacttgggggggtattgggtggaaagatgggggaccaccttgccgtccgcttcccggattctggccgaattgtcctagcacagataagctcagcgtctgctattccactggcttcactattgatgttagggctacctgatgacacttctggtttcttgcatggacttgtcatgtttattatgggcctgagcatctcctggaatggtcctgctacaaacaaccccatattcgcagagatcgttcctgagaggtcaaggactagtatctatgcgttggaccgttcttttgagtcagtgttatcctcatttgctccacctattgttggtttcttagccgagtatgtctatggctacatccccatctcctatggagctggggctggcagtgttgccagggacaagtcaaacgccggtgcccttgccaaagctctctggacagcaatcgccatccctatgatcctctgctgcttgatctattccctgctgtaccggacatacccacgcgacagggagagggcaagaatggatagtcttcttgcatcagagctgcagcagattgagctggaaagatgccatggagtgggagattacgctggaagcaaggatggcaccactgtgattgatatggagtacagcgaggaagattttgatgcagatgacgatgaaaaagcattgatggatcggaaggctcagcagagtggcagtgccaagtaacccaggaatcacatggcaaagaaagctccacggagttcaaacagatgtctgcgtagctctgacctctggattgcacaggaaacaccgcggatatgcggtctgctcacatagagtttcaatcggttggtgcgttttttgtggtacgtttcaatcggttgtgtttatttagtgaatttttttttc

SEQ ID NO: 17054 - protein, 509 aa, Panicum virgatum
  misc_feature: Ceres CLONE 1791131
  misc_feature (13)..(377): Pfam Name: MFS_1 Pfam Description: Major Facilitator Superfamily
MDAAAGKRTLALVNLAAIMERADEALLPAVYQEVGAALHVTPMGLGALTLYRSAVQGACYPLAAYAAKRYNRTHVVAVGAVLWAAATFLVGVSDTFAQVAVARGLNGIGLALVTPAIQSLVADSSDDNTRGAAFGWLQLTGNMGSIIGGMFSLMLASTTVMGIAGWRVAFHIVGLISVVVGALVGLFAVDPHYVHVGNGKQLLRKSTWEEMKDLVREAKTVVRISSFQIIVAQGIAGSFPWSAISFAPMWLELMGFTHSKTGLLMLTLVLASSLGGVLGGKMGDHLAVRFPDSGRIVLAQISSASAIPLASLLMLGLPDDTSGFLHGLVMFIMGLSISWNGPATNNPIFAEIVPERSRTSIYALDRSFESVLSSFAPPIVGFLAEYVYGYIPISYGAGAGSVARDKSNAGALAKALWTAIAIPMILCCLIYSLLYRTYPRDRERARMDSLLASELQQIELERCHGVGDYAGSKDGTTVIDMEYSEEDFDADDDEKALMDRKAQQSGSAK

SEQ ID NO: 17055 - DNA, 1801 bp, Panicum virgatum
  misc_feature: Ceres CLONE 1791132
  misc_feature: Encodes the peptide sequence at SEQ ID NO. 17056
actccaccttcactcgtctcacctcagccgctcagcgcctcctccgccgcatcagcatcagcatgcgcgcggcggcttgttgttggcgtttgtagatgggctcctcctcgctgctcctcttcccctcgtcctcctccgcctccgctccctcctcaacgccgaccccgccccgccgccgctcccgcatcctcctgctctcctgcacagcaccccgcccgccgccgccccagcagtgcccgctctccctccccctcatccgcttccagacaagcgccgccacgacccgcagcagcaggaggagcccaacccggcgccgcagtcgcccaagcccccgaccgcggaggagaccgcggcggcagccgcggccgccgccgccgcggctgccgcggccgccaaggagcgcaaggaagagcagcggcggaagcagcgcgacgaggagggcctccacctgctgacgctgctgctgcagtgcgccgagtcggtgaacgccgacaacctcgacgacgcgcaccagacgctgctggagatcgccgagctcgccacgcccttcggcacctccacccagcgcgtcgccgcctacttcgccgaggccatgtccgcgcgcctcgtcagctcctgcctcggcctgtacgcgccgctgccgccggcgtcccccgcggcggcgcggctgcacgggcgcgtcgccgccgcgttccaggtgttcaacggcatcagcccgctcgtcaagttctcgcacttcacggcgaaccaggccatccaggaggcgttcgagcgggaggagcgcgtccacatcatcgacctcgacatcatgcaggggctgcagtggccgggcctcttccacatcctcgcctcccgccccggcggcccgcccagggtcaggctcaccggcctcggcgcctccatggacgcgctccaggccaccggcaagcgcctctccgacttcgccgacacgcttggcctgccattcgagttctgcgccgtcgcggagaaggccggcaatgtcgacccggacaagctgctcggcggcgtcgcgcggcgcgaggccgtcgccgtccactggctccaccactcgctctacgacgtcaccggcaacgactccaacacgctctggctcatccaaaggctggcccccaaggtggtgacaatggtggagcaggacctcagccactcgggctccttcctggcgcgcttcgtggaggccatccactactactcggcgctcttcgactcgctggacgcgagctacggcgaggacagcccggagcggcacgtcgtggagcagcagctcctgtcccgggagatccgcaacgtgctcgccgtcggcggcccggcgcgcaccggcgacgtcaagttcgggagctggcgcgagaagctcgcacagtcggggttccgctcggcctcgcttgccggcagcgcggcggcgcaggcgtcgctgctgctcggcatgttcccctccgacgggtacacgctcgtcgaggagaatggtgctctcaagctcgggtggaaggatctttgcctgctcactgcatctgcctggcgcccaattcagaccccatgccgttaaattttagagcaaatttacagagctaaagcattactattactgctagatcttacttggcgttattgcccagatcttttgcctgtttagctagctgctgctcaatttaatcagttccgagattaggaaaatgataacatttctgatcactaattgctagatctcttcacagtgatagttactgatgtaagcttagttttatggtagattttgttcagctgtcgatcggttatcttcacc

SEQ ID NO: 17056 - protein, 520 aa, Panicum virgatum
  misc_feature: Ceres CLONE 1791132
  misc_feature (124)..(423): Pfam Name: GRAS Pfam Description: GRAS family transcription factor
  misc_feature: The sequence is a functional homolog of SEQ ID NO 431 in the 11/479,226 US patent application
  misc_feature: The sequence is a functional homolog of SEQ ID NO 438 in the 11/435,388 US patent application
LHLHSSHLSRSAPPPPHQHQHARGGLLLAFVDGLLLAAPLPLVLLRLRSLLNADPAPPPLPHPPALLHSTPPAAAPAVPALPPPHPLPDKRRHDPQQQEEPNPAPQSPKPPTAEETAAAAAAAAAAAAAAAKERKEEQRRKQRDEEGLHLLTLLLQCAESVNADNLDDAHQTLLEIAELATPFGTSTQRVAAYFAEAMSARLVSSCLGLYAPLPPASPAAARLHGRVAAAFQVFNGISPLVKFSHFTANQAIQEAFEREERVHIIDLDIMQGLQWPGLFHILASRPGGPPRVRLTGLGASMDALQATGKRLSDFADTLGLPFEFCAVAEKAGNVDPDKLLGGVARREAVAVHWLHHSLYDVTGNDSNTLWLIQRLAPKVVTMVEQDLSHSGSFLARFVEAIHYYSALFDSLDASYGEDSPERHVVEQQLLSREIRNVLAVGGPARTGDVKFGSWREKLAQSGFRSASLAGSAAAQASLLLGMFPSDGYTLVEENGALKLGWKDLCLLTASAWRPIQTPCR

SEQ ID NO: 17057 - DNA, 1593 bp, Panicum virgatum
  misc_feature: Ceres CLONE 1791143
  misc_feature: Encodes the peptide sequence at SEQ ID NO. 17058
atgttaaaagggctgctaaacaccaaccaaccatttgcacccatgagatgtcatatgcatactgctcgcttgatagttataacacaaattgcatcagctagcatttaacttctgtgttcgtgtgcatagccagcagctatagtagtgttaagctagatattagctataagtagtgaattttcaagtttgtgttgtgtgcatggggcatcattcctgctgcaaccagcagaaggtgaagagggggctctggtctcctgaggaggatgagaagctcatcagatacatcaccacccatggctatgggtgctggagcgaggtcccggagaaagccggtctgcagcggtgcgggaagagctgtcggttgcgatggatcaactacctcagaccggacatcaggcgggggcggttcacggcggaggaggagaagctgatcatcagcctccacgccattgttggcaacaggtgggctcacattgccagccacttgcctggccggacggacaacgagatcaagaactactggaactcgtggatcaagaagaagatccgcaagccggcagtgagcacgacgagctcgtcggtgacgacgacgtcgagccctccacgcagcacggcggcgtcggatgcggcggcggcgcttagccacctgcagacaccgttcagcagcgcggcggagcaccagctcgacgccatcatcagccagagcctagcgctgtcgccgaagctgctgggcgccggcggccaagcagactccccgccggcggcgctgctgcctccgccgcactgccccttcttcatgttcgacacaagcgtaagcccgccgtcgtcgctgacgtcgccggccgtggcccagctgcagcacccgttcctcaccttcacggcggcggcgatggacgcgccgagcttccagctgcctcccctggtcgacggcatcggcatgggcatggcaaccatggactgcggattaggtgaggaaacaggccatgatgatcacgagggaggcaacaatggccaagccgccggcatggcgaacggcggcggcggctgctgctacgggcagcatcagcagaagcagcaggaggaggagcagctagggtgggacgacgagtcggcgcagcacctgctgatgtgggacgatgaccaagaactaacaccgtccaacctggaagccatggaaagcggtgctcactccctactttttatgggaccaaatgaccatgcatgatattaagctggtgtgtgtgcacatgcatctctctccttgatatctttcttgatctgatctctatctgtgatcctttctagctatcatctcacctgatctgatctgtctatacatgaaataatgaggatttccaaggcgcataatttattttgttggattttttctttcacattttgatttaacatgttttttttggtttggagtgaatactaaagagagagagtgtgtcaattggttttttttgtaaagagaaattgcatggatgcatgcatgcatatgttcctgcatggcattgcgcttggagtgtaatttgattgatgtatctaaatgaatttaaaataataagcaagatgacacaaaagagaagc

SEQ ID NO: 17058 - protein, 341 aa, Panicum virgatum
  misc_feature: Ceres CLONE 1791143
  misc_feature (67)..(112): Pfam Name: Myb_DNA-binding Pfam Description: Myb-like DNA-binding domain
  misc_feature (14)..(61): Pfam Name: Myb_DNA-binding Pfam Description: Myb-like DNA-binding domain
  misc_feature: Useful for making plants with modulated biomass
  misc_feature: Useful for making plants with altered lignin content
  misc_feature: The sequence is a functional homolog of SEQ ID NO 2574 in the 10/374,780 US patent application
  misc_feature: The sequence is a functional homolog of SEQ ID NO 278 in the 10/225,066 US patent application
  misc_feature: The sequence is a functional homolog of SEQ ID NO 296 in the 11/479,226 US patent application
  misc_feature: The sequence is a functional homolog of SEQ ID NO 1072 in the 10/374,780 US patent application
  misc_feature: The sequence is a functional homolog of SEQ ID NO 996 in the 11/435,388 US patent application
  misc_feature: The sequence is a functional homolog of SEQ ID NO 1002 in the 11/435,388 US patent application
  misc_feature: The sequence is a functional homolog of SEQ ID NO 1004 in the 11/435,388 US patent application
  misc_feature: The sequence is a functional homolog of SEQ ID NO 108 in the 10/412,699 US patent application
  misc_feature: The sequence is a functional homolog of SEQ ID NO 1740 in the 10/412,699 US patent application
  misc_feature: The sequence is a functional homolog of SEQ ID NO 1964 in the 10/374,780 US patent application
  misc_feature: The sequence is a functional homolog of SEQ ID NO 255 in the 11/479,226 US patent application
  misc_feature: The sequence is a functional homolog of SEQ ID NO 908 in the 11/435,388 US patent application
  misc_feature: Useful for making plants with altered alkaloid content
  misc_feature: Useful for making plants with modulated nitrogen use efficiency
  misc_feature: The sequence is a functional homolog of SEQ ID NO 1068 in the 10/374,780 US patent application
  misc_feature: The sequence is a functional homolog of SEQ ID NO 984 in the 11/435,388 US patent application
  misc_feature: The sequence is a functional homolog of SEQ ID NO 2221 in the 10/666,642 US patent application
  misc_feature: The sequence is a functional homolog of SEQ ID NO 998 in the 11/435,388 US patent application
  misc_feature: The sequence is a functional homolog of SEQ ID NO 1681 in the 10/374,780 US patent application
  misc_feature: The sequence is a functional homolog of SEQ ID NO 1094 in the 10/225,066 US patent application
  misc_feature: The sequence is a functional homolog of SEQ ID NO 386 in the 10/374,780 US patent application
  misc_feature: Useful for making plants with altered carbohydrate content
  misc_feature: The sequence is a functional homolog of SEQ ID NO 2394 in the 10/374,780 US patent application
  misc_feature: The sequence is a functional homolog of SEQ ID NO 544 in the 10/225,066 US patent application
  misc_feature: The sequence is a functional homolog of SEQ ID NO 999 in the 11/479,226 US patent application
  misc_feature: The sequence is a functional homolog of SEQ ID NO 116 in the 10/412,699 US patent application
  misc_feature: The sequence is a functional homolog of SEQ ID NO 280 in the 11/479,226 US patent application
  misc_feature: The sequence is a functional homolog of SEQ ID NO 160 in the 10/412,699 US patent application
  misc_feature: The sequence is a functional homolog of SEQ ID NO 214 in the 10/225,068 US patent application
  misc_feature: The sequence is a functional homolog of SEQ ID NO 2270 in the 10/374,780 US patent application
  misc_feature: The sequence is a functional homolog of SEQ ID NO 361 in the 11/479,226 US patent application
  misc_feature: The sequence is a functional homolog of SEQ ID NO 462 in the 10/225,066 US patent application
  misc_feature: The sequence is a functional homolog of SEQ ID NO 482 in the 11/435,388 US patent application
  misc_feature: The sequence is a functional homolog of SEQ ID NO 1746 in the 10/412,699 US patent application
  misc_feature: The sequence is a functional homolog of SEQ ID NO 1970 in the 10/374,780 US patent application
  misc_feature: The sequence is a functional homolog of SEQ ID NO 452 in the 10/225,066 US patent application
  misc_feature: The sequence is a functional homolog of SEQ ID NO 584 in the 11/435,388 US patent application
  misc_feature: The sequence is a functional homolog of SEQ ID NO 36 in US patent 7193132
  misc_feature: The sequence is a functional homolog of SEQ ID NO 266 in the 10/374,780 US patent application
  misc_feature: The sequence is a functional homolog of SEQ ID NO 536 in the 11/435,388 US patent application
  misc_feature: The sequence is a functional homolog of SEQ ID NO 640 in the 10/225,066 US patent application
  misc_feature: The sequence is a functional homolog of SEQ ID NO 856 in the 10/412,699 US patent application
  misc_feature: The sequence is a functional homolog of SEQ ID NO 126 in the 10/412,699 US patent application
  misc_feature: The sequence is a functional homolog of SEQ ID NO 1625 in the 10/412,699 US patent application
  misc_feature: The sequence is a functional homolog of SEQ ID NO 978 in the 10/666,642 US patent application
  misc_feature: Useful for making plants with altered cell wall content and/or composition
  misc_feature: The sequence is a functional homolog of SEQ ID NO 1088 in the 10/374,780 US patent application
  misc_feature: The sequence is a functional homolog of SEQ ID NO 2167 in the 10/666,642 US patent application
  misc_feature: The sequence is a functional homolog of SEQ ID NO 380 in the 11/435,388 US patent application
  misc_feature: The sequence is a functional homolog of SEQ ID NO 382 in the 10/714,887 US patent application
  misc_feature: The sequence is a functional homolog of SEQ ID NO 1087 in the 10/374,780 US patent application
  misc_feature: The sequence is a functional homolog of SEQ ID NO 2165 in the 10/666,642 US patent application
  misc_feature: The sequence is a functional homolog of SEQ ID NO 378 in the 11/435,388 US patent application
  misc_feature: The sequence is a functional homolog of SEQ ID NO 380 in the 10/714,887 US patent application
MGHHSCCNQQKVKRGLWSPEEDEKLIRYITTHGYGCWSEVPEKAGLQRCGKSCRLRWINYLRPDIRRGRFTAEEEKLIISLHAIVGNRWAHIASHLPGRTDNEIKNYWNSWIKKKIRKPAVSTTSSSVTTTSSPPRSTAASDAAAALSHLQTPFSSAAEHQLDAIISQSLALSPKLLGAGGQADSPPAALLPPPHCPFFMFDTSVSPPSSLTSPAVAQLQHPFLTFTAAAMDAPSFQLPPLVDGIGMGMATMDCGLGEETGHDDHEGGNNGQAAGMANGGGGCCYGQHQQKQQEEEQLGWDDESAQHLLMWDDDQELTPSNLEAMESGAHSLLFMGPNDHA

SEQ ID NO: 17059 - DNA, 714 bp, Panicum virgatum
  misc_feature: Ceres CLONE 1791146
  misc_feature: Encodes the peptide sequence at SEQ ID NO. 17060
ctcgccggcccggcgcgccgccgaacatggacccggacgcggtgcggcgcagcctcgagcccaccgcctccgcggaggaactcacgggatccaccccggcccgcctccacttctacgaccccttcgtcctccacggcgtcagcatcgagtccgccgagcacggccgcctcctctgctccttcgtcgtcgccccgcgccacgccagccccgcggggtacctccgcagcggcgtcacggcgacgctcgccgaccagctggggtccgccgtcttcttctgcagcgggctccgcatgagcggggtctccctggagatcagcgtctcctttgtcgacgcggctactgtcggggaagaaatagaggttgagggaaagttgttgcgtgctggaaaatctattggtgtcgtttctgtcgatttcaggaagaaaaagacaggaaagttgatggcgcaggcccgtcataccaagtatcttgctgtgtcaagcaaattgtgaggctcccattctgctaacaagataataagatatcaacccaattgcggccaaactctccaatctccatcactgtgccattattactcgtcaacaatcatacaatgcttgtggtctatcctttttagaaagaaaaaatagaatgctgtatctattaggaattcgtgtatgaagggtggtctgtcatagattatatatttcgatgaggcttgtggggctgtaactt

SEQ ID NO: 17060 - protein, 154 aa, Panicum virgatum
  misc_feature: Ceres CLONE 1791146
  misc_feature (62)..(139): Pfam Name: 4HBT Pfam Description: Thioesterase superfamily
MDPDAVRRSLEPTASAEELTGSTPARLHFYDPFVLHGVSIESAEHGRLLCSFVVAPRHASPAGYLRSGVTATLADQLGSAVFFCSGLRMSGVSLEISVSFVDAATVGEEIEVEGKLLRAGKSIGVVSVDFRKKKTGKLMAQARHTKYLAVSSKL

SEQ ID NO: 17061 - DNA, 1844 bp, Panicum virgatum
  misc_feature: Ceres CLONE 1791149
  misc_feature: Encodes the peptide sequence at SEQ ID NO. 17062
gctgctgcagtgagcaacgaaacttcacccgtttctctttggcatactgcttaattttcctccccttttcggccccaagaaaacgaagaaaagtgtgttgccggggttcctccaactactactgctgccaccaaacaactccgagacccgttctcgtcgcgatcctcttcacaccgttctgatttttttgtcagggccgtcgcgactcgcgagcagggctatgctatccgatctgatcgtcatctgaagtaacctccgggcgcgcagccgacgatgggtgcgccgagttctttcgtgctcgccgtgttgaccctcctccactctgtttctgccatggccggctgctccgccgcggatctgccggcggcgcagcctagccaccggaggctgctccaggacaccaatctcgctgcgcgtccggaggcaaatattcctgagccggctgctgctcgcgttccttctcaggggagcggctcgtttcgggcaccgaaaaaggtagcgccgccggctgctgctgctgggagttctccgcatcgcccggccccgtccaagtcccattatttgttgacatccatgaggtggctctacttgattgttcttccggcggctggcctgctgttgcttgctggaatagcttgttggcttttgccatgccgcaagagtgcggttgcaccataggcccttggaggacgggactcagtggccagctgcagaaggcattcgtcacaggagtaccgaaattgcagagatcggagctggaacgtgcctgtgaggacttcagcaacattataacatgttatccacactacactgtctacaagggaacactgtcatctggtgttgagattgctgtggtatccactatgattacatcaagcaaggagtggtcagagcattcagagagctgtttcaggaaaaagatagacacgctgtcgcgaataaaccataaaaacttcatcaacctgcttggcttttgtgaggaggaggaacctttcaccaggatgatggtgcttgaatatgcagcgaatgggacactttatgagagtcttcatgctgaggactttgagcacatcggttggcgaggtaggatgcggattatcatggggctagcatactgcatccaacacatgcatgagctcaatcctccagtggcacaccctgacctgcagtccagttccatactgctctctgaagatggtgctgcaaagattgttgacatgagcgtttggcatgaactgatttccaaagggaaagcgccgacagacggtgagcttggccctcaccatgaacaagtgtctgctgccctggctgggaatgtatatagctttggcgttctacttcttgaaatcatctcggggaagcttcctgaccctgcacacgaccgatccctcgtcagcttggctctggagtgcattaacaacggtgaccggagtttagtctctctgcttgatcctacactaaatgatcacaaggaagatgagctagcgatcatcggcaaggtgatccacgcttgcatccagagcgatccgagaaacaggccgagcatgagggagatcactgacaggctgagggatgccataggcatctcgccggtcgctgcgacgccgaggctgtctccgctctggtgggcagagctggaggtcctttcgaccgcggaagcaggctaataattggcaagagccaagaagggacgataaccatcgtctgatcagatgtgttctgaagaaagaaaaccactctgcaggctgcgcatgtctcactgctgtaaatgtaaaagagcaaattgtaggaatagtaatcctcatggatgcttggtagtatgtagtagtacctttccctgcatc

SEQ ID NO: 17062 - protein, 338 aa, Panicum virgatum
  misc_feature: Ceres CLONE 1791149
  misc_feature (54)..(306): Pfam Name: Pkinase_Tyr Pfam Description: Protein tyrosine kinase
  misc_feature: SWISSPROT Homolog: EC 2.7.11.1 Non-specific serine/threonine protein kinase
MPQECGCTIGPWRTGLSGQLQKAFVTGVPKLQRSELERACEDFSNIITCYPHYTVYKGTLSSGVEIAVVSTMITSSKEWSEHSESCFRKKIDTLSRINHKNFINLLGFCEEEEPFTRMMVLEYAANGTLYESLHAEDFEHIGWRGRMRIIMGLAYCIQHMHELNPPVAHPDLQSSSILLSEDGAAKIVDMSVWHELISKGKAPTDGELGPHHEQVSAALAGNVYSFGVLLLEIISGKLPDPAHDRSLVSLALECINNGDRSLVSLLDPTLNDHKEDELAIIGKVIHACIQSDPRNRPSMREITDRLRDAIGISPVAATPRLSPLWWAELEVLSTAEAG

SEQ ID NO: 17063 - DNA, 2026 bp, Panicum virgatum
  misc_feature: Ceres CLONE 1791152
  misc_feature: Encodes the peptide sequence at SEQ ID NO. 17064
acactcatcacagaccgctgcaaaatgtcatccccgaacagtgaacagattgctctcactcccagccacccacttctcgccggcatcggaaaaaatatccccagcgagcgagagcacgggcgtgagcacctcgtcaccgccgccggccatggaggactggctcttctacaccctcatcgcgctcctctgcctgctcagctcgctcctgctgcgcgcccgcgcccgcagctcggccggggaaaagggccatgccgccgccggcgacgagctcccgcctctcccgccggggccaacgccgctgccggtggtgggcccgttgctcttcctggcgcgccgcgacttcgacttcgagcccgtgcttcgccgcatcgcgcgggagcacggcccggtcttcacctacgcgccgctgggcagggcgctgccctccgtcttcgtggcctcccgcggcgcggcgcaccgcgcgctcgtgcagcgcggcgcggcgttcgcgtcccgcccgccggtgacggcctcgagcgccgtggtcaccagtggcggccgcaacatcagctccgctccctacggcgccacgtggcgcgcgctgcggcggaacctggcggccggcgtgctcaatccggcgcggctccgggcgttctcgccagcgaggcggtgggtgctcggcgtcctcgcctcccgcgtccgcgacgccgccggcgccggcggggagcgcgccgtcgccgtgatggagccgttccagtacgccatgttctgcctgctcgtgtacatgtgcttcggggaccgcgtcgaggacgcgcgcgtgcgggacattgaggccacgcagcgggagctcctcggcagcttccttagcttccaggtcttctctttcctcccggcgctcaccaaggtcgtgttccggcggcggtgggagaagcttctctcgctgcggcggcggcaggaggagctcttcctcccgctggttcaggcgaggagggacgccggggccgacggggactgctacgtggactccatgctgaagctgaccatccccgaggacggcggtagggttctcaccgacggcgagatcgtcagcctgtgctccgagttcctcggcgccggcactgacaccacggccaccgcgctgcagtggatcctggcgaacctggtcaagtacccaacgatgcaggacaggctgcgggacgaggtggccggcgtcgttggcgctgccgacggcgaggtgcgggaggaggacctgcaggcgatgccgtacctgaaggtcgtggtgctggaggggctccggcgccacccgccgggccactacctgctcccgcacgccgtgcacgaggacacgatgctggacgggtaccgcgtgcccgccggcgcgccgatcaacttcgcggtgggcgacatgggtcttgacgaggtgtgggacgcgccctcggagttccggccggagcggttccttcccggcggtgaaggggaggacgtggacctcacggggagcaaggagatcaagatgatgccgttcggcgccgggcggagggtctgccccggcatggcgctggcgctgctgcacctcgagtacttcgtggccaacctcgtgagggagttcgagtggcgcgaggccgacggcgaggaggtggacctcaccgagaagcttgagttcaccgtcgtcatgaagcggccgctcaaggccagagccgtgccgctgcggtcgccgccacccgccgtcgccgctgcttgatcgattgttcacttcaattctctctagctagcatggcaatggattggcaatgaattggcaacagatggagtctgcttctggttgctgattgctctagctatgcatgccatggaattatatggtacaaccaaagacaattaggttcataaatttctcatgttcttttgggaacataggtacaagcagtaaggtaatgctgcactagtagtgtgcgtgtatttgtatgtacaataaggctccagttagtaaatatttgcttcactgaatgtctgaattccaaatgaaaagtttctagtgttgtccacg

SEQ ID NO: 17064 - protein, 523 aa, Panicum virgatum
  misc_feature: Ceres CLONE 1791152
  misc_feature (45)..(512): Pfam Name: p450 Pfam Description: Cytochrome P450
  misc_feature: SWISSPROT Homolog: EC 1.14.13.21 Flavonoid 3'-monooxygenase
MEDWLFYTLIALLCLLSSLLLRARARSSAGEKGHAAAGDELPPLPPGPTPLPVVGPLLFLARRDFDFEPVLRRIAREHGPVFTYAPLGRALPSVFVASRGAAHRALVQRGAAFASRPPVTASSAVVTSGGRNISSAPYGATWRALRRNLAAGVLNPARLRAFSPARRWVLGVLASRVRDAAGAGGERAVAVMEPFQYAMFCLLVYMCFGDRVEDARVRDIEATQRELLGSFLSFQVFSFLPALTKVVFRRRWEKLLSLRRRQEELFLPLVQARRDAGADGDCYVDSMLKLTIPEDGGRVLTDGEIVSLCSEFLGAGTDTTATALQWILANLVKYPTMQDRLRDEVAGVVGAADGEVREEDLQAMPYLKVVVLEGLRRHPPGHYLLPHAVHEDTMLDGYRVPAGAPINFAVGDMGLDEVWDAPSEFRPERFLPGGEGEDVDLTGSKEIKMMPFGAGRRVCPGMALALLHLEYFVANLVREFEWREADGEEVDLTEKLEFTVVMKRPLKARAVPLRSPPPAVAAA

SEQ ID NO: 17065 - DNA, 1727 bp, Panicum virgatum
  misc_feature: Ceres CLONE 1791159
  misc_feature: Encodes the peptide sequence at SEQ ID NO. 17066
agctgccagcggaggggcagatagcaagctgttcggcgaaatgccgccatggccgccgtgtctccagcccaccctcgccaccgctcgccgcgccaccgccttctccaggagcaggagccacctctcctcctcctcctcctcccccgccttcgtctgcgcaaccccgggcgaccacgcccacgagcagcagggagacaacgaggagcagtcgttggtcgtggtgggcggcggcgcggcgggggtttacgcctccataagggccaagaccctggcgccccgcctcaacgtcgtcgtcatcgagaaagggaggttcttgtccaaggtcaaggtttccggcggtggccgctgcaacgtgaccaatggccatcatcttgagcccgtgggactggccagaaattatcctagggggaacaaggagctcagaggatcgttctttgccgctcatggcccgcaggataccatgcgttggttcacagaccatggtgtggagcttaagacggaagatgatggaagagtctttcctgtcactgacaattcagcttcagtagtagactgcctgctaaacgaagctaggagacttggagtttctctgcaggctggcaaagctgtgtccagtgcatctgtgactcagcatggaaagtttgtcctcaaggttgagaagcgtactgctgatcttgttgattacatcactgctaactatgtcttggttgctacaggtagcagccagcagggctattcaatagctgcacaactcggccattccattatttcaccagtgcccagcttattcacatttaaggttgcagacaagagattggctgatcttgctggggttacatttccagtagtcaaagcaaaattgaagctagatggcgtgcaaaaaaatgttccggaattaactcagattgggcctatgttagttacgcactgggggctcagtggtccagttgttctgcgtttgtctgcatggggagcacgtgaactacatcagtgcaactaccaaggaaaggttatggttgacttcatacctaacatccatattgaggacgtgaaaggcatcctgttccgctacaaagatcagcatgcgagtttaaatggtgatatgcactgggcctcgatgtcaaataatcatctaagtgcaatagctgttcggttaaaacaatggatgtttgaggttgttgggaagggacaatttaaagatgaatttgtgactgccagaggtgttccaatttcagagatatcacttggcacaatggaaagcaagaaacaaccaaatctgttctttgctggagaggtacttaatgtcgacggggtcactggcggtttcaattttcagaatgcatggactggtgggtacatagctggcacaagcatagccacattggcattgacaagcaatctacaagaaccagtccttccaactagaaagatcatagaaggaaatgtggattgagcgatgaaagaatcttcttagatcatctggggactgcaagctgcgtgatgattcagggatattactaattttgaagatatccaagataaccaagattagttagcttttgttttttgaaagacaccaggaaggtaacattagcctaacatggggtcaatgtagagtcaatctaggcatacaacgtgcagtctggaaagatggtagttacaatctagttgaacaagctgtgaattgtacttgactgatcagaatgcacatcgagcaattttcttcc

SEQ ID NO: 17066 - protein, 470 aa, Panicum virgatum
  misc_feature: Ceres CLONE 1791159
  misc_feature (56)..(444): Pfam Name: HI0933_like Pfam Description: HI0933-like protein
MPPWPPCLQPTLATARRATAFSRSRSHLSSSSSSPAFVCATPGDHAHEQQGDNEEQSLVVVGGGAAGVYASIRAKTLAPRLNVVVIEKGRFLSKVKVSGGGRCNVTNGHHLEPVGLARNYPRGNKELRGSFFAAHGPQDTMRWFTDHGVELKTEDDGRVFPVTDNSASVVDCLLNEARRLGVSLQAGKAVSSASVTQHGKFVLKVEKRTADLVDYITANYVLVATGSSQQGYSIAAQLGHSIISPVPSLFTFKVADKRLADLAGVTFPVVKAKLKLDGVQKNVPELTQIGPMLVTHWGLSGPVVLRLSAWGARELHQCNYQGKVMVDFIPNIHIEDVKGILFRYKDQHASLNGDMHWASMSNNHLSAIAVRLKQWMFEVVGKGQFKDEFVTARGVPISEISLGTMESKKQPNLFFAGEVLNVDGVTGGFNFQNAWTGGYIAGTSIATLALTSNLQEPVLPTRKIIEGNVD

SEQ ID NO: 17067 - DNA, 639 bp, Panicum virgatum
  misc_feature: Ceres CLONE 1791171
  misc_feature: Encodes the peptide sequence at SEQ ID NO. 17068
ggaagagcaagcggcaatctaaacagcagcaatggcggcctcgatgatctcgtcctcggctctggtggagccagccaaggcccaggacctgccgtccctcggccgccgcgcctcctccttcgccgtacgccgaggaaccaaggaaaaaatcaagaccgacaaccccttcgggattggcggcggcctcaccgtcaacgtcgatgcctccgggaggaaggtcaagggcaagggcgtgtaccacttcgtcgacaagtacggcgccgacgtccacggatacagcccaatctacaaagaggaggactggtctcccaccggtgacgtctacgtcggtggaaccactggacttctgatctgggccgtcaccctcgccgggctccttggaggcggtgccctccttgtttacaacaccaacgctctcgccagctaagaacactattcatgcacagtccatgcaagcacttgcggttcatgtaagatcagcttgggggtgtctgtctgtaatctagcctgcagctttgatgtccaatataatgcttggttcatgtaacaatgctactacagctctccatacttttgggacagttattatattaattacttgatgctacatatttagattaatatataactgataacttt

SEQ ID NO: 17068 - protein, 131 aa, Panicum virgatum
  misc_feature: Ceres CLONE 1791171
  misc_feature (34)..(131): Pfam Name: PsbR Pfam Description: Photosystem II 10 kDa polypeptide PsbR
MAASMISSSALVEPAKAQDLPSLGRRASSFAVRRGTKEKIKTDNPFGIGGGLTVNVDASGRKVKGKGVYHFVDKYGADVHGYSPIYKEEDWSPTGDVYVGGTTGLLIWAVTLAGLLGGGALLVYNTNALAS

SEQ ID NO: 17069 - DNA, 2015 bp, Panicum virgatum
  misc_feature: Ceres CLONE 1791184
  misc_feature: Encodes the peptide sequence at SEQ ID NO. 17070
aaatggcgccgccgcctcgccacctcccgctcctcctcggccgcctcctcatcgccggcgagatccgccggagcccggatcacctccgccgcatcatatcccaccttccctcgcacccccacctcgccgccgccctctccagcctctacttcccgctcttcccctcctccgccactttcctcctcaacctgctcatccgcgcctcctccacgtcgccctccccgcgcctgtccttcgccgcgttctcctccctcctccggtgcgacttcctccccgatcacttcaccttccctccgctggtcaaatccgcctccaggctcccctccttcccgcgcacgggcgcgcaggcccacgcccaggctgcccggcgcgggttcttgaccgacatcttcgtccttaactcgctcctcgcgatgtacgccgcgttctgcgatacggcgtcgatgtggggcgtgtttgactcgtccgcgaaggtcgccgacgtggtctcttggaacacggttattggtggctacgtgaagtgcggggatattgagaacgccagacgggtgttcgacgaaatgccacataggaatggggtgtcctggagcgcgatggtgggagcgtatgcgggtgttggggagctggatgttgccagggagatgtttgatcggatgcctgccatcggcaggaatgttgtcacacggaattcaatggtgacagggtttgcaaagcatggtctgctgccattggcgaggaagatgtttgatgagatgccgttcaggaatctggtctcatggaatgcaatgatccggggatacgtggtgaatggcgagatggatggcgcaagggagcttccaagggagctgtttgatgtgatgccggagaaggatgtggtttcttggacatgcatgatttccgggtacgcacaggctggacgctatgcagaaacccttgagctattcaggtcgatgcagagcaggagcagtacccgacctaatgaggtgaccatggtgagtgtgcttttggcatgcgcacatttagcagctctagaggaagggaggtgggctcacaccttcatcgacaagcacaagatggttctggacaatgagtacaatctaggtgctgctctcatagacatgtatgtcaagtgtgggagaacagttttccactccctggatcagaaggatgtctctgcctggaatgcacttatcacggggctggcagtaaatggtgatgctctgcaatgcattgatgtgtttgagcagatgaagggttcaggagaaaacccaaacgacataacatttgtcagtctgctgacagcttgtgcccatgctgggctggtcaacgagggtcggcagtgcttccagagcatggtatctgcttttggattgcagccggagctcaaacactatggctgcatggttgacttgttgggccgtgcagggcttcttgatgaggcagaggagctgatccggagcatgccaatggcaccggatgtcaaggttttgggtgcgctactaggtgcaagtcgaatgtataagagatttgatgtggctgaaagagtacagagttggatcatcagtctcaatacaaagcagcctggtttccatgttctgatatctgacatttatgctgctgctggcaaatggactgattctctagaggcaaggggttttctgcagaggcataatattaggaagttgtccgcatcatccagctcaaggcaataggttcttagatagatagattggattacattctttaccagcaaatgtaaggcgcacaagtataaccccaataatccatttttgtggacataaacttagtgaaaggcagaaatagaattatagaactaacttttagttgtcctcgacgatgtatgtatgcttcactttagtctaaggtcactactgcatgtgaatcgagatatctcaaaagcccaggttgttatgcttgatggaatatgacggactttaatcaccagcacacaggtgatcttctccaagtgatctctcaagatatgcattacagtt

SEQ ID NO: 17070 - protein, 432 aa, Panicum virgatum
  misc_feature: Ceres CLONE 1791184
  misc_feature (155)..(189): Pfam Name: PPR Pfam Description: PPR repeat
  misc_feature (254)..(288): Pfam Name: PPR Pfam Description: PPR repeat
  misc_feature (25)..(59): Pfam Name: PPR Pfam Description: PPR repeat
  misc_feature (89)..(123): Pfam Name: PPR Pfam Description: PPR repeat
MYAAFCDTASMWGVFDSSAKVADVVSWNTVIGGYVKCGDIENARRVFDEMPHRNGVSWSAMVGAYAGVGELDVAREMFDRMPAIGRNVVTRNSMVTGFAKHGLLPLARKMFDEMPFRNLVSWNAMIRGYVVNGEMDGARELPRELFDVMPEKDVVSWTCMISGYAQAGRYAETLELFRSMQSRSSTRPNEVTMVSVLLACAHLAALEEGRWAHTFIDKHKMVLDNEYNLGAALIDMYVKCGRTVFHSLDQKDVSAWNALITGLAVNGDALQCIDVFEQMKGSGENPNDITFVSLLTACAHAGLVNEGRQCFQSMVSAFGLQPELKHYGCMVDLLGRAGLLDEAEELIRSMPMAPDVKVLGALLGASRMYKRFDVAERVQSWIISLNTKQPGFHVLISDIYAAAGKWTDSLEARGFLQRHNIRKLSASSSSRQ

SEQ ID NO: 17071 - DNA, 1781 bp, Panicum virgatum
  misc_feature: Ceres CLONE 1791190
  misc_feature: Encodes the peptide sequence at SEQ ID NO. 17072
ttctctcgcttgctccttgctcgctcgctcgctcgctatggcggctgcgacggcggcaggagcggccgccgcggccgccgccgtctccctgataacctgctatctcctcttccacaatagtatcctcaagttcccgtgggctcgaacagctaggccctcttgcgcgagcggccggcggacgcgacggaggggtctcgtggaggccatcggcaacacgcccctcgtccgcatcaacagcctctctgatgccacagggtgcgagattttggggaaggccgagttcctgaacccgggaggcagcgtgaaggaccgcgttgcggttaagatcatcgaggaggctttagaatctggagatctcatctgtggtggtactgtaacagaggggagtgctggaagcacagctattagcttggctactgttgctcctgcttatggctgtaggtgtcatgttgttattcctgatgatgctgccattgagaagtctcaaataattgaggcgcttggagctacagttgaacgagtgcgccctgtttcaatcactcacagagaccattttgtcaatattgccagaagaagggcattagaagcaaacaaattagcagcaaagcagagagaatcaaatgagacacaaactaatggtttagatcatataaattctaagatgatggatgacaagttggcaactatgcagagtgagtcgaaaaagacacaaaataatgatcaaacacatgtcagtacgaaaatgccacacaacagtaaatgtgatccaagttctgattcaaaaggatgtgatccgagttctgattcgaaaggaggtttctttgccgaccagtttgagaatatggcaaattaccgagcacattatgaatggactggtcctgagatatgggaacaaactaaaggatccctgcatgccttcgttgccgcagctggtactggtggtacaattgctggagtctcacgatatcttaagaacaggagcatcaaatgttttttgatggacccacctggatctggtctgttcaataaggttactagaggggtaatgtacacaaaagaggaggctgaggggaaaaggctgaagaacccctttgatactattactgaaggaataggaatcaacagggttactagaaatttcatgatggcggaactggatggagcttatcgaggaacagatagggaagctgtcgagatgtcaaggttcttgctgagaaatgatgggctatttcttgggagttcttcagccatgaattgtgttggagctgtaagagttgctcgagatttgggtccagggcatacaattgtgacaattctctgtgacagtgggatgaggcatctaagcaagttcttcaatgaccagtatttggctgatcatggattgacaccaacagctactggtctggaatttctcgataaatgagcaaatttcacaggaattctcaaattgagcaatgttggcatgctccctgcgactgaaatgatgcagtgaacactgaatagctcacagcatgagaatatgcctacatataatttctcgataaaccctaatggacgaaagactgatgtatgttagtactaataatagtataactaggcattgatatttgataggcttcggatagccagttttttttaattattattgtttcaatataattgttgaggctgtgttcagtaaagaatgctgcattgagcatctttactgcaaacaactgttatatatacatttttcattttgaaatggtttcaaggagctattttgttttacgctttgcatg

SEQ ID NO: 17072 - protein, 461 aa, Panicum virgatum
  misc_feature: Ceres CLONE 1791190
  misc_feature (53)..(429): Pfam Name: PALP Pfam Description: Pyridoxal-phosphate dependent enzyme
  misc_feature (252)..(460): SWISSPROT Homolog: EC 2.5.1.47 Cysteine synthase
  misc_feature (53)..(161): SWISSPROT Homolog: EC 4.2.1.22 Cystathionine beta-synthase
MAAATAAGAAAAAAAVSLITCYLLFHNSILKFPWARTARPSCASGRRTRRRGLVEAIGNTPLVRINSLSDATGCEILGKAEFLNPGGSVKDRVAVKIIEEALESGDLICGGTVTEGSAGSTAISLATVAPAYGCRCHVVIPDDAAIEKSQIIEALGATVERVRPVSITHRDHFVNIARRRALEANKLAAKQRESNETQTNGLDHINSKMMDDKLATMQSESKKTQNNDQTHVSTKMPHNSKCDPSSDSKGCDPSSDSKGGFFADQFENMANYRAHYEWTGPEIWEQTKGSLHAFVAAAGTGGTIAGVSRYLKNRSIKCFLMDPPGSGLFNKVTRGVMYTKEEAEGKRLKNPFDTITEGIGINRVTRNFMMAELDGAYRGTDREAVEMSRFLLRNDGLFLGSSSAMNCVGAVRVARDLGPGHTIVTILCDSGMRHLSKFFNDQYLADHGLTPTATGLEFLDK

SEQ ID NO: 17073 - DNA, 703 bp, Panicum virgatum
  misc_feature: Ceres CLONE 1791193
  misc_feature: Encodes the peptide sequence at SEQ ID NO. 17074
ctcctcatcgacagacctctcgccattatttgcttctcctcttcctcctcgctgtccatccgtccgtccatcagtcgccttcctcctccgattctcccctccgatccccaagcccttcatattcgctgcctcaggagctagctctggtgcgtgcttccttcgcgccccggtcaaaggcgcccccaacccccgagctttagagctagcagcttcgaaagggagcaggaggagggggacaggaaggatgctgggagcgacccccaaggcgaggaaaggcgcgccggcgaagctggggtcggtgaaggaggcgccgccggcggtggcgccggcggggaacaaggtgccggcggaggaggtgtgggaggtgcggcccggcgggatgctggtgcagaagcgcggcggcgggctgccggacgacgagccgtcgcccaacgtcaagccggtgcccaccatccgcgtcaaggtcaagcacgccggcgtcacgcacgagatctacatcagctccgaggcgtccttcggggagctgaagaagctggtggcggccaagacggggctgcacccggacgaccagaaggtgctctacaaggacaaggagcgcgactccaaggcgttcctggacatggccggcgtcaaggaccggtcaaagctcgtcgtcgtcgaggaccccggaggccaaggcgcgccgcctcatcgaggagcgccg

SEQ ID NO: 17074 - protein, 152 aa, Panicum virgatum
  misc_feature: Ceres CLONE 1791193
  misc_feature (73)..(142): Pfam Name: ubiquitin Pfam Description: Ubiquitin family
MLGATPKARKGAPAKLGSVKEAPPAVAPAGNKVPAEEVWEVRPGGMLVQKRGGGLPDDEPSPNVKPVPTIRVKVKHAGVTHEIYISSEASFGELKKLVAAKTGLHPDDQKVLYKDKERDSKAFLDMAGVKDRSKLVVVEDPGGQGAPPHRGA

SEQ ID NO: 17075 - DNA, 685 bp, Panicum virgatum
  misc_feature: Ceres CLONE 1791193-R
agcagcagcagcagcagcacccaaggcggcagcagccgccgccgcctcagcctcagtacaatcaccaccagcagccggcggcggcggggcagacgcggtgggagatgttcgacctgctgtcgtcgctgccgtccacgtcgtcggcgtcgtccacgaccaccgtgagctcgacggcgtcctccggcgcgccgccgacgaaccggctggactggatgctcttctgacgggggagggcaagcacaccacaccccgacgagcgatcgatcaccggcgcaaaaggcgaggggaatcgtggaaagcgaaaggggaatgcagatgcgatgcttgtgtgccaaggattgcacccgtgctccgatccgatccttgatgagacgatgattgggcgagtgatcgagcgagctaccttgcttgctttgcttgaccacgcatcgcatggtatggtacgggtggtggtagttcagcatgtgaggatgcatcgtgcatgtgagagttcatttttcttcttcttttttttcagttcttcttcttgttggtcaccataatgtttttgagattcttttgtgtgcatattattcagagagagagagagagaagagagagagaaagagggttggttaggtcaagtggaagtgtattcaaacagattgggaataagtcgagtcaaaagggttggttgtccgtctcc

SEQ ID NO: 17076 - DNA, 3335 bp, Panicum virgatum
  misc_feature: Ceres CLONE 1791202
  misc_feature: Encodes the peptide sequence at SEQ ID NO. 17077
gcccgaattgcctgatctttttttttttctccctcaagaagaagaagaagcagcagcaaagcatagatcgggtgctactatagtgacccccatttttgaccaatctcgctccaaatccaggtcaaacccaggcgattagtttctaatcccattccaagctctccgtcgtcgtccccttccgccccacaagccgcttcgcgctgcagggcaactccgcaccggccggtacgagccccccgtcgagtcgctgcgcatcgactggccaccacggcgcgcgccgcgggccgcggggcggcggcggcggcggcggcggccaccatgggattcgacttcgagtacaagagggatgcatatggattcgcggtgcggccgcagcatgtccagcgattccgcgagtacgccaagatttacatggaagaggaggaggagagggcgcacagatggagagacttcttcgacaggttggctgattatgtgaatgtgcccgccacacccggcgtttcgccatatgctgctgccagagatggtgatgcaggagcagggaaagtggaagagaacaaaagtgccggaatgcattgtgataaaaaagaagatgaggaaatggagaatgcagaagataacaataaattggaagaccccaatgaaactgatgccaggaatgaattgcaagaaggaaatggcgtgtcagaagatcagaaagatgtaactgacaacttggacaaagtggaagaggagactagtagtaggcctgaagaggcgaccaaagcctcagaggacttgaaggaagtgaatggggacacggaagaattaagagattcaaatggaggctccgaagaaatggaagatgggaatagtggtaacttggaaaagctggtagaactctttttggacaagggattgttggatcaactgaagcccataaaagttgagtcccagaggcgtgtacgggcagcacttagcatcattgagaaaatgatgagctctcgggtggtgaagagagatgattgtgcaaatgatattcatggaaaggttgcaacacagcttgcttctattgaagaggaagaaagaactgcagaagtgagtcatgaaggggatccagcagaggctgtgcctcatgttgcagataatgtggagcttgggcaggagacacctgatgcttctacaggtactgctctggagggaggcaagcatgggtcttattttccttggaaggaggagcttgagagcttggttcgtgggggcgtgccaatggctcttagaggagagatatggcaagcttttgtgggtgttggtgctcggaaaattactgggtactacaacaaattgcttgaaggtgccacaaaatcagatgaaaaggaccttgttgacccaatgctcaatgaacagacaagtgcaccaagaaaaatcacacaacctgagaagtggaaaggacagatagagaaggacttgccacgaacatttccgggacaccctgcattagatgaggatggaaggaatgctttgaggcggttattaactgcatatgcaaggcataatccatcagttgggtactgtcaggccatgaacttttttgctgggttgtttttgttgttcatgcctgaagaaaatgcattttaggctctagtaggggttattgatgattactttgatggttactacactgaagaaatgattgaatctcaggttgaccagctcgtccttgaggaggttgtacgagaaaggttccctaaattggctaaacatatggatttcctgggagttcaagtgggatgggtgactggaccatggtttctttcaattttcatcaatatgcttccatgggaaagtgtacttcgcgtttgggatgttatcctttttgaaggaaatcgtacaatgttgttcaggactactcttgctttgctggatttatatgggcctgcactggtgaccacaaaagatgccggagatgcaattacactacttcaatctcttgctggatctacttttgacagcagccaattagtgttgacagcctgcatgggctttcagtcagtcagagaaatgggattgcaagagttaaggaaaaagcacaggcctgaaattttaactgcgatggaggaaagatcaaaagaccgtaattcctggaaagataagaaggggctagcgaccaaactatatagctttaaacatgatccttcatttgtgtgctcaccagttaagtccaaggaaggggaggatggtttgaaattgaatggagacacaggatcaacaaatcttgagacctaccttagtactagttctatactagagaatgatttggatcagggtgttgatcttcaagatcaggtgtcatggctaaaggtagaactgtgcaagctgcttgaggagaaaagatcagctgatctcagaagtgargagttggaaactgctttaatggagatggtcgagcttgacaacagaagaacattgagtgccaaggttgagaaattggaggcagaggtatctgaaatgcgaaaagcttttgcggacaagcaagagcaagagcaagcgatgcttcagatcttgctaagaatggagcaagaacagaaagtgacagaagatgcacgcatagctgctgagcgagatgctgctgaaagaaaacacgctgctcatttgctccaggagaagtatgaagcagcaatggcagcactttcgcaaatggagaagagagctgtaatggcagaaacaatgctggaggctacaaagcagtaccaggccgggcagattaaagccaatcagtctttcacttcaagttcgccccgtgcagaccatgctcctgggaaggcaaatcaagagccaaatcaagatgcacctaacaggagaatgggcctgctttctagaggacttggatggcttgacaagagcaaggcaaggcagaattccactgaaacagctggaagctaaactcagtcttgaaggaagtcgtagctcccaacaggatctggactgttaattcatggatggattgcctgattgccataacgatgtgttaaaaaatagtagtgatattttccccatgggaaaattcagctgctattttccaagttttgcaggaagtgtaccttgtatcatattgagttcagttgtcagataaaagttttgttggtaggtttggaaaactgttgtaagtcattggtgtaaattttcttgtattagtttaattaatattgccaatagttagtgatccatgtaggagaaaaaaaaagaatggccctccaaaatacacatggaaaagagagatgaaaatttgtgttatattagtttacgacagtgttgtaacagcccaaatttcaaatataaataaaattaaaacaaat

SEQ ID NO: 17077 - protein, 432 aa, Panicum virgatum
  misc_feature: Ceres CLONE 1791202
  misc_feature: SWISSPROT Homolog: EC 3.1.2.15 Ubiquitin thiolesterase
MGFDFEYKRDAYGFAVRPQHVQRFREYAKIYMEEEEERAHRWRDFFDRLADYVNVPATPGVSPYAAARDGDAGAGKVEENKSAGMHCDKKEDEEMENAEDNNKLEDPNETDARNELQEGNGVSEDQKDVTDNLDKVEEETSSRPEEATKASEDLKEVNGDTEELRDSNGGSEEMEDGNSGNLEKLVELFLDKGLLDQLKPIKVESQRRVRAALSIIEKMMSSRVVKRDDCANDIHGKVATQLASIEEEERTAEVSHEGDPAEAVPHVADNVELGQETPDASTGTALEGGKHGSYFPWKEELESLVRGGVPMALRGEIWQAFVGVGARKITGYYNKLLEGATKSDEKDLVDPMLNEQTSAPRKITQPEKWKGQIEKDLPRTFPGHPALDEDGRNALRRLLTAYARHNPSVGYCQAMNFFAGLFLLFMPEENAF

SEQ ID NO: 17078 - DNA, 1696 bp, Panicum virgatum
  misc_feature: Ceres CLONE 1791219
  misc_feature: Encodes the peptide sequence at SEQ ID NO. 17079
ctcctcggcgtcttcccttcttctccatctgcttccactccccatcgtctagggttttgctccaaaccctagctgccgccgatcccctcccgcttcatggaagtcgagggcgaggtccccgccacggcggcggcggcgatcgcaaacggcctgtggggcggggaggaggcctccccggcgcccttctccgcggagcagctggacgtggaggcctacgccgcgcagtactcggggcggacccgcctcgcgcgcctcatcttcgtcgcggaccggtgcggggtggagacgatgaagcttgaggcgctgcggatggcgtacgacgagatcaagaggggagaagacgtgcagctccaccgcgacgtcgccctcaaaatcaacgtccgcctcggcccccggtacgggctcgaccaggcctgggtcgataccgtcagccgccgtgccgagcagcgcaaggagaagctcgagaacgagctcaacggctacagatctaacctgatcaaagagagcatcagaatgggttataatgacattggtgatttcttctatgctcatggccaactttcagatgccttcaaaagctacatcaggacacgagactactgtaccacttccaagcatatagttcagatgtgcatgaatgtgattctggttagcattgagctggggcagtttgcacatgtttcaaactatgtcagtaaagcagagcaaaccccagactctttggatcctatcattgttgcaaagctgcgtgcagctgcaggattagccaatttggaaacaaagaaatacaagcttgctgctcgtaagtttgttgagacaggaattgaactaggaaacaactactctgaagtcattgctccgcaagatgtggctgtctatggtgccctttgtgcacttgcttcttttgatcgttctgacctgaaggtccaccttatctgcactacttaatttctggtggatcgttctacttatactgttctcaagatgtgattccttgcgtattttttatagagcaaagtcattgacaatattaacttccgtaactttctggagctggtgcctgaagtaagggagctggttaatgatttttatgcaagtcgctatggatcgtgcttggggcatcttgagaagcttaagccgaacctgctactggatattcatctgcatgggcatgtagagactctgtacacagatattcgccacaaagcaatcatacagtacacactcccatttatatctgttgatctcaacacaatggcaactgccttcaagacttctgtgtccatgttggagaaggagctggctgctctgatcaccgagaacaaaatacaggcccggatagactcccacaacaagattctttacgcaaggcatgctgaccagagaaacacaactttccaacgtgttctccagactggcaacgagttcgagagagatgtcaagtctatgcttctgcgagccaacctcctcaagcatgagtacaaccagaggaccggatcaaggaagatgtgaagttgtgagcatcgccgctagacattgctatctgcctctccttttggaaatatttgttttgctgaaatgtcttgttgaggttatggatggttgagcatcaggagatgtgatgatctgtcatgctcattttgtgggcaagaattacattgaactcttaatgctttggaggtggtacatatgagtc

SEQ ID NO: 17079 - protein, 283 aa, Panicum virgatum
  misc_feature: Ceres CLONE 1791219
  misc_feature: Useful for making plants with modulated light quality sensitivity
  misc_feature: Useful for making plants with modulated low light sensitivity
MEVEGEVPATAAAAIANGLWGGEEASPAPFSAEQLDVEAYAAQYSGRTRLARLIFVADRCGVETMKLEALRMAYDEIKRGEDVQLHRDVALKINVRLGPRYGLDQAWVDTVSRRAEQRKEKLENELNGYRSNLIKESIRMGYNDIGDFFYAHGQLSDAFKSYIRTRDYCTTSKHIVQMCMNVILVSIELGQFAHVSNYVSKAEQTPDSLDPIIVAKLRAAAGLANLETKKYKLAARKFVETGIELGNNYSEVIAPQDVAVYGALCALASFDRSDLKVHLICTT

SEQ ID NO: 17080 - DNA, 1971 bp, Panicum virgatum
  misc_feature: Ceres CLONE 1791221
  misc_feature: Encodes the peptide sequence at SEQ ID NO. 17081
atcccaaaaggacaaagaaaagaaacacaccgccctcctccctcctctactcacactcccccaccttctactaccacacccccaccggaaaacccaaaccaggcggagggagcggagccctcgccgccgccgccgccggatctacggcgctggggcacgggggtccccggatcgacgcctccgccgcgccgcacgcgagcggttcggatggctgcacagaaggagaactctgtgcctattgcttgtcaagcacccaatggacgaatcacgcgagctcaagctgctgctaatcgtagaagctttccatcttttccttccattccacttcatgcgaaagctgaacagaaacgagctgcacaagggaagacaaaaagggggtgttcatatgagaccactagttcaagtgcggcaatttcagccccccagcctaaaaggcgcacagtactcagggatgtaaccaatgtgagccgtgctaactccaacaaaaacactgctgcaactaagcttcagacaaggccctcccaaagggttggaagaacgacgagcaaaaacaagcagtgtgcaaaaaaggttcctaagatacccccaccagctgttaatagaagttcagttgctaatgattcaaaaattgctgaagaaacacaagagggcacatttttgccgcagagagaggagcccgctcttttacttgagaacatggggccactatcattacagaatgttgaaagaaacagggacagtgcttgtcatgaggcattctttgaggaaagaaatgccagggataggcctgaagcttcggtgtcaaaaactggggactctcctgccttagacattgtagacattgacaaagacaatggcaatcctcagatgtgtgcttcctatgttgtagagatatactcaaacctaatggcttcagagcttatgagaagacccagtccaaattacctggagggtttgcaacgggacatcacaaagggcatgaggggaatactcattgattggcttgtggaggtttctgaagaatacaagcttgtgccggacacgctgtacctcactgtatatctcattgaccgcttcctttctcggaactacattgaaagacagagattacaacttctgggaataacaagcatgcttgttgcctcgaaatatgaagagatatgtgcaccgcgggttgaagagttctgtttcataaccgacaatacatatacaaaggcagaggtattaaaaatggagggccaagtggtgaatgacctgggatttcatctttctgttccaacaacaaaaacatttctcaggagattccttagagcggcacaagcatctcgtaaaactccttctatcagtttgggatttctggccaattatcttgcggagttgactttggttgattatggattcttgaaatttcttccttcagttgtagcagcatcggctgttttccttgctagatggacgcttgaccaatctgaccttccatggaatcgaactcttgagcactacacctcttacaaaagctctgatattcaattatgtgtctctgctctatgggaactgcagcataacaccagtaactgccctcttaatgccgtccgtgaaaagtatagacatcaaaagtttgagtgcgtagcaaacctgacttcaccggagcttcaccagtcgctcttcagctgacacgccaatgacatcaattacctgttgatcagcgacgttagcagcagtcgtagctgagactgcgttaacattatgtagcattccttccccttgtctaatttggttctgttgtctcgagctgttgttgtttcccgacctttttcgagtcagtgttgtaaaagacagatggctcgttgcttttgcttgacatgaggtttacccgattgtaaacaccctgtgtgtaggcttggcttgagttgataaccataagctgtccagcttgtataacaaacaacagaatgctgtttgttgtgacat

SEQ ID NO: 17081 - protein, 488 aa, Panicum virgatum
  misc_feature: Ceres CLONE 1791221
  misc_feature (228)..(355): Pfam Name: Cyclin_N Pfam Description: Cyclin, N-terminal domain
  misc_feature (357)..(484): Pfam Name: Cyclin_C Pfam Description: Cyclin, C-terminal domain
  misc_feature: Useful for making plants with modulated oxidative stress sensitivity
  misc_feature: Useful for making plants with modulated nitrogen use efficiency
MAAQKENSVPIACQAPNGRITRAQAAANRRSFPSFPSIPLHAKAEQKRAAQGKTKRGCSYETTSSSAAISAPQPKRRTVLRDVTNVSRANSNKNTAATKLQTRPSQRVGRTTSKNKQCAKKVPKIPPPAVNRSSVANDSKIAEETQEGTFLPQREEPALLLENMGPLSLQNVERNRDSACHEAFFEERNARDRPEASVSKTGDSPALDIVDIDKDNGNPQMCASYVVEIYSNLMASELMRRPSPNYLEGLQRDITKGMRGILIDWLVEVSEEYKLVPDTLYLTVYLIDRFLSRNYIERQRLQLLGITSMLVASKYEEICAPRVEEFCFITDNTYTKAEVLKMEGQVVNDLGFHLSVPTTKTFLRRFLRAAQASRKTPSISLGFLANYLAELTLVDYGFLKFLPSVVAASAVFLARWTLDQSDLPWNRTLEHYTSYKSSDIQLCVSALWELQHNTSNCPLNAVREKYRHQKFECVANLTSPELHQSLFS

SEQ ID NO: 17082 - DNA, 1962 bp, Panicum virgatum
  misc_feature: Ceres CLONE 1791222
  misc_feature: Encodes the peptide sequence at SEQ ID NO. 17083
actgctaaccaaacacaaggaattgaaggagtccactgatgatgctcacatcatttctttgatacagcgttcaaaaccagttaatgtagaaggacgagacctgtccaactctcccttattttattcccacatcactagcttgcttatgcttcttgcccgtccctctaccttcttcatatcattgttgcctttctccctacatcttcgccgccccccacccccccttcctgctcctaccttcacatactattccgacgacgatcggatccaaccatggcgggatagagagagacccatcgtagaacagtacaagatggtagctagagaggagcaagtgatgagagagctcaaggataagggggtactagtcgagatccttgacggcgatgaggagagatcgaccgataacaagctgctagacctcaacgagggtttcgatgatgcggagagcgaggaaggggaggctggtgatgatgaggaagatgaaggtgaagaaggcgatgatggcggtagcaccactgatgttggtgggagtgggagctcaagcaacaatagcagcaccaacaacaactcggagagcaagaagggagacaacaagggaggcagcaagtcggaggggagcggcgagcagagggttccaacggtgcggcagtacagccggtcgaagctgcctcgactccggtggacgcctgaccttcacatggccttcgtccatgccgtcgagaggcttggtgggcaagagagagcaacccctaagctggtgcttcagatgatgaatgttagggggctcagcattgctcatgtaaaaagccacctgcagatgtacagaagcaagaagctcgatcaagatggtcgcccgagaggagctatttcctcagtgtattccccgatggatttccatttcatgagaggcgatcggcgcttccacgaaatgtcattcttccaaagagcggccgcgctctcctcctccaagcccgagcacggcagtttcttcgcgtcgtcgaggaactgcagcgctccggagctcagccggctctatggacttctccagcatctgccggctccgcaaactttcgacttcagaaactccaggaatcatgaatgggcgtcgagccagagagaggcgcccatagtactctccaggaaggacgtcacgccgccgtcgactgcaccgcatcagacgcacccgcttgccacagcttccgcggcggcggctctgaggagcgagaggcggtggtggcctttcactgacgcgggcgccgctgccgccaccggcgagcggagggtggagacaggacgggaggtagacttcgccaattccctcgggagcagctctcggcggcctcacctatggggcgcgtccgtgtccggcgatccccgtcttccgttcagatggcgacccgtgggtggtagcagcggcagagacgccgccgtcggctaccccagcaacagcgccaagatcacaacgacaagatcgtcggatcctgtcgtgatcgacgaagccctagatgcccagcagctcgagaggcagaagcgcgtagagccaacaagggattctgccatgccggcctacgcggcgtgccgcaatcggtcgccgcaggtggaggcccaagacgacggggctgcggaccttcagctcagcctgtcccccaccacggtgacggatgccaagaagaggaagaccaccgcaccaagcgagcaggagataatggacgccagcgagctctccatctcactgtcactgtccccgcccgccgcagcttccatgcagaagcagcagcaacaaaagacaaggggaagcaacgacagcaccggcagcggggaagccgttcttgggcagagtactttggatctgaccatgtcgatcagggcactggagtgagatctttcaagtactttgtcccaaggccttccaaaagttgcacactgaaccatgcaataaaacatcgttaatttaacctc

SEQ ID NO: 17083 - protein, 522 aa, Panicum virgatum
  misc_feature: Ceres CLONE 1791222
  misc_feature (121)..(172): Pfam Name: Myb_DNA-binding Pfam Description: Myb-like DNA-binding domain
  misc_feature: The sequence is a functional homolog of SEQ ID NO 2000 in the 11/479,226 US patent application
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
MVAREEQVMRELKDKGVLVEILDGDEERSTDNKLLDLNEGFDDAESEEGEAGDDEEDEGEEGDDGGSTTDVGGSGSSSNNSSTNNNSESKKGDNKGGSKSEGSGEQRVPTVRQYSRSKLPRLRWTPDLHMAFVHAVERLGGQERATPKLVLQMMNVRGLSIAHVKSHLQMYRSKKLDQDGRPRGAISSVYSPMDFHFMRGDRRFHEMSFFQRAAALSSSKPEHGSFFASSRNCSAPELSRLYGLLQHLPAPQTFDFRNSRNHEWASSQREAPIVLSRKDVTPPSTAPHQTHPLATASAAAALRSERRWWPFTDAGAAAATGERRVETGREVDFANSLGSSSRRPHLWGASVSGDPRLPFRWRPVGGSSGRDAAVGYPSNSAKITTTRSSDPVVIDEALDAQQLERQKRVEPTRDSAMPAYAACRNRSPQVEAQDDGAADLQLSLSPTTVTDAKKRKTTAPSEQEIMDASELSISLSLSPPAAASMQKQQQQKTRGSNDSTGSGEAVLGQSTLDLTMSIRALE

SEQ ID NO: 17084 - DNA, 1652 bp, Panicum virgatum
  misc_feature: Ceres CLONE 1791234
  misc_feature: Encodes the peptide sequence at SEQ ID NO. 17085
ccaatgttttcgcctctacaccgagccaccgcttcgcacaaaccgcacctagagctaggttttagccgccgcctcccccttctcgcttcggcggccgcacgcgccgacctcctcccggaagaagcccccagcgcccgccgcttccactccgtgccagatcgttgtttatgagctcgaaggagaaacccacccttggagggacgcggatcaagacccgcaagaggaatatcgcagctccattggacactgcatcattctctgatgcaattgtccagatttatattgacaatggtggagatctggaacttgttgccaaaagtatcgagtcctctgatctcaacttctctcgttatggtgacaccttttttgaggttgttttcgttggaggacgaactcagcctggcacaataaaacctgaagaagaaggagaccgccatccttattcggtgctagattgtgcagcacagcgtgaagcaattttaccttctgtactctatattcagaaaacattacgcaggaggcctttcttaattaagaatcttgaaaatgtcatgcgcaaattcctccaatcgctggagttttttgaggaaaatgagaggaagaaacttgccatattcacagcccttgcattttctcagaagctatcagggcttcctcctgagacagtattccagcctctgctcaaggataatcttgttgccaaagggatagtgctttcgttcatcaccgagtttttcaaggagtacctgaaggaaaacagtttggatgatctaattggacttttgaagaaaggcaaaatggaggacaatctgctggacttcttcccatcagccaagaggtcttctgaggctttatccgagcatttcaccaaagaaggtttgactagccttgttgagtataatgataagaaaatgtttgaagttaagcttaaggagataaagtcaacactgactaccatgatcaatgatgaggctgaaatatctgaagtcattgagactgtcaagcaacaagttaaagatgctaaatttcctgatatagaggttatccgcatgctgtgggacgtgcttatggaggctgttcagtggtctggaaagaaccagcagcagaattctaattcagcacttcggcaggtgaaagcttgggctgagcttttgaatgccttttgcacgagtggcagactagaactggaactcatatataaagttcagacacaatgttatgtggacgctaaactgatgaagctgtttcctgagatcataaggacattatatgaccaagatgtcctagctgaagatactatccttctttggttccgtaaaggttcaaacccgaagggcaggcaatctttcgttaaagctctggagccatttgtcaaatggctagaggaggcagaggaagaagaataagtgttttgctactggaggctggccaggtctgcctgaagtatttcccaatatttctatggtttgaagtttgtggaggaagttgtgtatctcctgcttgttacaaggtggataattttattttctcatgttgtgccgccaggctcttttctgctggatgctataatatgatgcaaatacagttgctgttgacttgcgaggattttgtggaacggttgctatcaattactaaactgaatctttttaacg

SEQ ID NO: 17085 - protein, 412 aa, Panicum virgatum
  misc_feature: Ceres CLONE 1791234
  misc_feature (336)..(412): Pfam Name: W2 Pfam Description: eIF4-gamma/eIF5/eIF2-epsilon
MSSKEKPTLGGTRIKTRKRNIAAPLDTASFSDAIVQIYIDNGGDLELVAKSIESSDLNFSRYGDTFFEVVFVGGRTQPGTIKPEEEGDRHPYSVLDCAAQREAILPSVLYIQKTLRRRPFLIKNLENVMRKFLQSLEFFEENERKKLAIFTALAFSQKLSGLPPETVFQPLLKDNLVAKGIVLSFITEFFKEYLKENSLDDLIGLLKKGKMEDNLLDFFPSAKRSSEALSEHFTKEGLTSLVEYNDKKMFEVKLKEIKSTLTTMINDEAEISEVIETVKQQVKDAKFPDIEVIRMLWDVLMEAVQWSGKNQQQNSNSALRQVKAWAELLNAFCTSGRLELELIYKVQTQCYVDAKLMKLFPEIIRTLYDQDVLAEDTILLWFRKGSNPKGRQSFVKALEPFVKWLEEAEEEE

SEQ ID NO: 17086 - DNA, 1573 bp, Panicum virgatum
  misc_feature: Ceres CLONE 1791238
  misc_feature: Encodes the peptide sequence at SEQ ID NO. 17087
acacgaaggtctcgcacactcagaaagactggatagtgagacacctcgagaggagatggcgagcgtggaagccaagggggagacggtgatggtcaccggcgccagcggtttcatcggctcgacgctcgtccgctgcctcctcgaccgcggctacaacgtccacgccggcgtcctcaaccccgatgacaaggcggagacggaccacctcctcgcgctcgccgccggcgccggcgagggtcgcctcagcgtcttccgctgcgacctcctcgacggcgcggtgctcctcgacgccgcgcggggctgctcgggcgtcttccacctcgcctccccctgcaccatcgatcccgtcagcgatccccagaagcaactgatcgtgccggcggtggaagggacgctgaacgtgctgcgcgccgccaaggaggccgggggcgtgcggcgggtggtggtgacctcgtccaacgcggccatcgtgcccagcccggggtggccagccggcgaggtccgcgacgagcgctgctggactgacatcgactactgcgagaagaacggggtgagcctacctatcgcagcatgtatgaaagcttggaaaactcagtggatgccgacgaagaagaaggctgcaagatttgaaggatgcaaaagcttcgacttcgtcactcgtcagtaatttctctctcagctcacatcacatttgctctgcgtgtagctctggtactctgtttcgaagacactggcagagaaggcggcgtggaagtttgcagaggagaacggcctggatgtggccgtggttaaccccggcgctgttatgggcccgataattccaccgaacataaattccagcatgtccatccttctacgcctcctccaaggttgcacagaggactacagggatgtctttatgggggcagtccacgtggaagacgtcgccatggctcatatcctggtgttcgagaacccatcggcgtccgggaggcacctctgcatcgattccatctctcactggagcgacttcgccgccaaagtcgccgagctctatcccagctacaaagtgcccaagttccccaaggatacccagcctgggctggtgagaacggaggtggggtcgaagaagctcatcgcgctggggctgcagatcagccctctggagaagatcgtcagggacgctgtggagagcctcaagagcagagggtacatctcgtgatcgtggggtactgtaatttcttcgtgaacctttatgctactgtggtttgcaactaggaaggatgacacagtgtgaaagaaagatccaatcaagttcataatcagggggattctcgaaggtcacatcgaattgcagttctaaataatgaagtttgaagttgcatatcgaagagtaaaaaaaaatacaaggagctgcaaatatgaaacttgatgatttagataagtttattaagtaggctttcgtcaagtgcaaagtataaatctggcacatcaaccacaaaattaaacctgaacctgaatctgaatgtaaagttcttcctccttgacattggaacctgaacctgaatcggaatctgaatggtgaagttcatcc

SEQ ID NO: 17087 - protein, 203 aa, Panicum virgatum
  misc_feature: Ceres CLONE 1791238
  misc_feature (12)..(203): Pfam Name: 3Beta_HSD Pfam Description: 3-beta hydroxysteroid dehydrogenase/isomerase family
  misc_feature: SWISSPROT Homolog: EC 1.1.1.219 Dihydrokaempferol 4-reductase
  misc_feature: Useful for making plants with altered cell wall content and/or composition
  misc_feature: Useful for making plants with altered carbohydrate content
MASVEAKGETVMVTGASGFIGSTLVRCLLDRGYNVHAGVLNPDDKAETDHLLALAAGAGEGRLSVFRCDLLDGAVLLDAARGCSGVFHLASPCTIDPVSDPQKQLIVPAVEGTLNVLRAAKEAGGVRRVVVTSSNAAIVPSPGWPAGEVRDERCWTDIDYCEKNGVSLPIAACMKAWKTQWMPTKKKAARFEGCKSFDFVTRQ

SEQ ID NO: 17088 - DNA, 1649 bp, Panicum virgatum
  misc_feature: Ceres CLONE 1791239
  misc_feature: Encodes the peptide sequence at SEQ ID NO. 17089
tttcgaggtcggttttcggtcccgtccaaccgccgcgaaccgcgcatgtgaactgtgccccccggcgaggcgcgcaggtgcggtgcggtgcgccgaggcgaggcgcgagcagcgcgccggattcggggtcggggctagggttttcgccggcccgccgcgagatggacggccgggaccagcaccagagccagcagcagcaggcgcaggcggcggcgcgggtggggtccccgccgcagcctggccccggcggcgccgtcatgatgcagcacgccgcggcgttcggcgccgcggccccgcccgggatgcagccgggccccgggaacgttatgcacgggatgccgctcgccttcaacaccatggcgtcgccgggcgcctcgtcgcccatgaagcccgcggacgtgccgccgggggccatgtaccgccccgactccggcgcgccgggcatgcagcagcagccgcagccgcatccgggcgccggcggcggcggcggggagctcgtgaagaagaagagggggaggccgaggaagtacggcccggacgggaccatcggcctggggcagaagcccgccgccgcgacgggcgctgaggcgggtgggcactccggcggcggcggctccaactccaacaccgacggcaagcgcagagggcgcccccctggatccggcaaaaagaaacagctcgatgctttgggatcgtcagggacttcatttactccccacataataactgtgaagcctaatgaggatgttgcgtcaaaaataatggccttctcacaacaaggtccacgcactacatgtataatttcagcaaatggtgctctgtgcacagcaacactccgtcaaccagcaacctctggtggcatagtgacatatgaaggccacttcgatatactctctctgtcgggctcattcctgcttgcagaggatggggacactcgcagcagaacaggtggtttgagtgtggcacttgctggaagcgatggacgcatagttggaggctgcattgcaggaatgctgatggctgcaacacccgtacaggttgtagttggcagtttcatcgctgaaggtaaaaagccaaaggaagagccgcaaccaaaacgcgagccggcttctgttccactgcacgcgcccggttttggggcagcctcgactgccagccccccgtccgacggaacatcaagcgagcactctgatgatccaggaagccccatgggacctaacggcagcacattcgccaacacggggcaccccatgcattccacattcgctccggttggctggtcgctgtctgggaaccaaggccgctacgatcctgacctgaagatgatgaccgactgatgactgccggttcacgccttgttagcagttgacgtactagttgagtagggctcaggccttcctgcaccggttccaccaccagcagcagcgtcggacaataaattcagattgctaggaggaatgaatagatcacgaatagtaataagtagcaccagtgcatgcctttgcctagttatgcagtagctagtagttgtttgtatccgtatcgtttcattgtctgccttccttacggttaagcagcctgccttccggcttctctctgtatcagtgtagtgctacgtttctcttaatcagggattggtatttctcctt

SEQ ID NO: 17089 - protein, 391 aa, Panicum virgatum
  misc_feature: Ceres CLONE 1791239
  misc_feature: The sequence is a functional homolog of SEQ ID NO 1503 in the 11/479,226 US patent application
  misc_feature: The sequence is a functional homolog of SEQ ID NO 646 in the 11/435,388 US patent application
MDGRDQHQSQQQQAQAAARVGSPPQPGPGGAVMMQHAAAFGAAAPPGMQPGPGNVMHGMPLAFNTMASPGASSPMKPADVPPGAMYRPDSGAPGMQQQPQPHPGAGGGGGELVKKKRGRPRKYGPDGTIGLGQKPAAATGAEAGGHSGGGGSNSNTDGKRRGRPPGSGKKKQLDALGSSGTSFTPHIITVKPNEDVASKIMAFSQQGPRTTCIISANGALCTATLRQPATSGGIVTYEGHFDILSLSGSFLLAEDGDTRSRTGGLSVALAGSDGRIVGGCIAGMLMAATPVQVVVGSFIAEGKKPKEEPQPKREPASVPLHAPGFGAASTASPPSDGTSSEHSDDPGSPMGPNGSTFANTGHPMHSTFAPVGWSLSGNQGRYDPDLKMMTD

SEQ ID NO: 17090 - DNA, 537 bp, Panicum virgatum
  misc_feature: Ceres CLONE 1791242
  misc_feature: Encodes the peptide sequence at SEQ ID NO. 17091
actgggagcgccggagagcgaggcgaggtatatgctgtggtgctggaccctcttctcctattgcctcttagtcggccggccggtggtgctggggactaatgcgacacttggtgggacacatgcagggggaagtcctcgacggcctcgactgcctggatgggcgcctggggaggtggcgacggcgccggggcccgggggcagggggggcttccggcgctagacctggcgctcgcgtgccctcgggccgcggcggcgtcgctcttcccgcccgccgtgtcggactactatcagcttgatgattcgctgaatgatgaagagaaggcactcaggaagaacgtccgaggcattatggaaaaggaaattgcacgcattatgactgaatactgggagaaggcaaaattcccatttcatgcggttcgcaaccttgcaactgttggtttatctggtggtacaacagaggggtatggctgcccacgactgtctcttacagctagtgctgtttgcatatgacaagttgcacgagacgatgccagctgc

SEQ ID NO: 17091 - protein, 117 aa, Panicum virgatum
  misc_feature: Ceres CLONE 1791242
  misc_feature: SWISSPROT Homolog: EC 1.3.3.6 Acyl-CoA oxidase
MGAWGGGDGAGARGQGGLPALDLALACPRAAAASLFPPAVSDYYQLDDSLNDEEKALRKNVRGIMEKEIARIMTEYWEKAKFPFHAVRNLATVGLSGGTTEGYGCPRLSLTASAVCI

SEQ ID NO: 17092 - DNA, 1487 bp, Panicum virgatum
  misc_feature: Ceres CLONE 1791252
  misc_feature: Encodes the peptide sequence at SEQ ID NO. 17093
gaggacccacatggacatggctatggctgcgcgcttggtccccctcgtcctcccgcacgcggcgctcctcggctcctccgccgctgcctccacccgagctctgcctctcaccccgtcccgcgctcctcgcctcccttatcctcttcctcatttccccacctgccgccgcccctcctcctcctccgccgccgccgcctacgcggcgcgccccctcccccgccgcgggtcgccgcgtctcctggctgttcgcgccatggcgtccgggaacccctacgccgccgagctcgccgcggccaagaaggccgtcaccctcgccgcccgcctctgccaggcagtgcaacaggacattgtgcattcaggcattcagtctaaggcggacaaaagccctgtcacagtggccgattatggatctcaaatattggtcagccttgtcttgaagatggaagtatcatctggcccgttttcattggtggctgaggaggactcggaagaattgagaaaagatggcgctgaagaaattttggaagaaattactgatcttgtcaatgaaaccatctctgattctggttcatataacatttcatttacgaaggaaggtatcctctcagcgattgatgatggaaagtccaagggaggcccaactgggagacattgggtcctagatccaatcgatggtactaaaggtttcgtaaggggtgaccaatatgcaatcgcactggccctgcttgatgaaggtaaagttgttctgggtgtattggcttgtccaaatcttcctttgtcatcaataagcaatccgaatggtagctcttcgggcggtcaagttggtgcccttttttctgctacaattggttgtggggctgaagtagagtctctagatggttctccgccacagaagattagtgtttgttccattgacaatccagtcaacgcctcattctttgaatcctatgaaagtgcacactccatgcatgatctgactggctctattgcagagaaacttggtgtcctagctcctccagttagaattgacagccaagcaaaatatggtgctatggcccgaggcgatggtgccatttacttgcgttttccacacaaaggttacaaagagaagatatgggaccatgcggctggctcaattgtcgtgactgaagctggaggtatagtaacagatgctgctgggaatgacttggatttctccaaagggagatttcttgatctcgacacaggcatcatcgcaacgaacaagcagttgatgccgtcactcctgaaggccgtccaagatgctattaaggagaagaaccaggccgcctccctcttgtaggctgtagcagtcagtgatcaacaaaaaatgttagttgcaataatgtttcatattcataccgtgtcttacatgtgcctggccttttgttgtgacattacaatttcatgttgtaccacttgtgatgaggctctttcctcttggcaatcagataatcgttctttttctt

SEQ ID NO: 17093 - protein, 355 aa, Panicum virgatum
  misc_feature: Ceres CLONE 1791252
  misc_feature (42)..(346): Pfam Name: Inositol_P Pfam Description: Inositol monophosphatase family
  misc_feature: SWISSPROT Homolog: EC 3.1.3.7 3'(2'),5'-bisphosphate nucleotidase
  misc_feature: Useful for making plants with modulated drought sensitivity
MASGNPYAAELAAAKKAVTLAARLCQAVQQDIVHSGIQSKADKSPVTVADYGSQILVSLVLKMEVSSGPFSLVAEEDSEELRKDGAEEILEEITDLVNETISDSGSYNISFTKEGILSAIDDGKSKGGPTGRHWVLDPIDGTKGFVRGDQYAIALALLDEGKVVLGVLACPNLPLSSISNPNGSSSGGQVGALFSATIGCGAEVESLDGSPPQKISVCSIDNPVNASFFESYESAHSMHDLTGSIAEKLGVLAPPVRIDSQAKYGAMARGDGAIYLRFPHKGYKEKIWDHAAGSIVVTEAGGIVTDAAGNDLDFSKGRFLDLDTGIIATNKQLMPSLLKAVQDAIKEKNQAASLL

SEQ ID NO: 17094 - DNA, 736 bp, Panicum virgatum
  misc_feature: Ceres CLONE 1791262
  misc_feature: Encodes the peptide sequence at SEQ ID NO. 17095
acgcacccaacggcctccagcagcctcctcagctccttgtgccgccgccgccttctcccccctcgccggccgccgcatccctcaccggaccgccgcatatttctgtcctcctgaaccgccatcgcgaacccgcgcgggagagcaggcggctccaaggaagatggggtggaaggctgcagagaagctcatcaggcactggaaggtcctccgcggtgacaacgttatgatcatcagaggcaaggacaagggggagaccgggctcatcaagcgggtcattcggtcgcagaatcgcgtcatcgtcgagggcaagaacttggtaatttgttgttgtatgttttcccaggttatttagcccgagtgtggaattgatgtggcagataataatttgtggttatattatataggactgctaccagttgcataattggcagtttatttcgttgcacattggctgcattggttcaattgaacctacccatcaacggcatcgctctctaggtgtttgttgaaattcccggactggcggacagtcataaaatggtctgaatttttcggagttcagagtactgttgcctctgagactgcgctcgtggttgtaatcttgtgttgtgagtgattagaatagtgcctggctttcatccccgttgtgctgctttgatgcagatcacatgagtttgacttgaatgctgaatgataggtatagtccctcccccttaccacatgtccatcatgacac

SEQ ID NO: 17095 - protein, 63 aa, Panicum virgatum
  misc_feature: Ceres CLONE 1791262
  misc_feature (17)..(48): Pfam Name: KOW Pfam Description: KOW motif
MGWKAAEKLIRHWKVLRGDNVMIIRGKDKGETGLIKRVIRSQNRVIVEGKNLVICCCMFSQVI

SEQ ID NO: 17096 - DNA, 695 bp, Panicum virgatum
  misc_feature: Ceres CLONE 1791262-R
attttaattgtcttgtgccttgtcatgccttcttgcacacaggaattccgtatgtaattgggctatcattcatttcaggttaagaaacacattaagcaaggggaagggcacacaggtggtattttctccattgaagctccacttcatgtttcaaatgtccaagtagttgatcctgtcactgggaaaccatgtaaggttggatacaagtatttggaagatgggaccaaagtcaggtttgctagagggatgaatgcatctggtgctgtgatcccccggccagaaattctgaaggagagaagaaaaccaagacctacatcacctggcccaaaggatacaccaattgagcttgtgctggagaagacctacgatgaaaaagctggaattggaatgcccgatctatagctgccgtgttgtttcatttttgtgctgagagttcagtatatgtgactaagtcggcaagtcctagttaaggtattagggtgtcatggtgtcaatggtcgttgggcagttgtactgtgcttccctcataataatcatgtactaaaggtcgaaagagacattgctagcatgcatgctttccttatttgttttcttggtgtttggttctgcagaaacgcattcttggatgagatatggccaagatttctttttgctataagtcactgctattggaactgtgattctgaattttcatg

SEQ ID NO: 17097 - DNA, 420 bp, Panicum virgatum
  misc_feature: Ceres CLONE 1791267-R
  misc_feature: Encodes the peptide sequence at SEQ ID NO. 17098
gaagtcaggtcctctaccgttgcatctatttggggtgctgtcagaaagcttaaagcaagaccactatgttagcgatacgggagacgtagtctactaccaaattgacaagatgatgaacacctctgcacaaaattcagattgacataaaccatagctagtagcctattcttcatttttctcaggggactgtgcctgaagacgcgtccagcctcctgggacctctgattggtgtgcgagtccattgatatttcgattcaagaatgtaagttggcgaaacattaatcatgcagaaaagagggtaaatgtaattctttccaatgatggaagacggaggctgctgcctcctatgtaacaaaacaaacatgtgattctttggacaagaggtatattacagtaaagagcggaaaaagagctttagct

SEQ ID NO: 17098 - protein, 46 aa, Panicum virgatum
  misc_feature: Ceres CLONE 1791267-R
  misc_feature: Useful for making plants with modulated heat sensitivity
KSGPLPLHLFGVLSESLKQDHYVSDTGDVVYYQIDKMMNTSAQNSD

SEQ ID NO: 17099 - DNA, 662 bp, Panicum virgatum
  misc_feature: Ceres CLONE 1791267
cagcccagctcccgctgcccagccctgccaagccaagcccgtcggccaccgcacatcccggggaacccaatcccatcgcgaacgcagaagatcccgtgccagcgggctgcggcggcggcggcggcgacggtggtggactggacggactactagtagccataacccgtagccaatagcccgtccattccatccagccagagccagacctcccacccgcatcctcctccccgccgccggcaatggcccggctcgtgctctccgagtgctgcggcctcgcgccgctgcgcctgcgcgccggccggggcgccattgcggcgccggcgccccccgccgcgctctccgccgcggcgctgccgcgcgggcccgcggccgcggccatccaccgcgactgggcgctccgcgtctccgcgcccacgcgcctcgcgtcggccgtcgacgaggggggcaggaggagcgccccgctcggggaggaggagaaggccgccgcgggcggggacttcgaccccggggcgccgccgccgttcgggctggcggagatccgcgccgccatccccaagcactgctgggtcaaggacccctggcgctccatgagctacgtcctccgcgacgtcgtcgtcgtcctggggcccgccgccgccgccgcgcgcctcgacagctggctc

SEQ ID NO: 17100 - DNA, 2085 bp, Panicum virgatum
  misc_feature: Ceres CLONE 1791268
  misc_feature: Encodes the peptide sequence at SEQ ID NO. 17101
agctgctccgctctcctcgccagtctccctcccggcgtgtggtggccatagcttcgctgcttccactacttgtcctcttgtttcctcaacacccgaggaggctcgctcgctcgctcggttcttgtccccgccgccgccgccgcggcctgctgctgctgctggctcggtgttgttcgtgccgtcggcttccagctcccgccgctgccgcgctgcctcggcgtttgcgaaggcggcaccatgacggcgacgccggcggtgatcgggctgagcgccgggaaccgcctcctcgccgcctccttcggcgccgccgacctcgcgcccgcggacgcgcacccgtcgctgcagttcgcgcccaaactcgccgtcgtcgcgcactcccgcgcctccgccgcctcctcccccgccgcccgcgcgcgcgcgcacgccgtccgcgcgctcaggaaccactccgcgcccgcgctcgccccgcctccgccggcggcggacccggccgcgccgaccccggagctcgacgcggacgccgagttcgagtcctcgctcgaggccatcgtgctgctgcagcgctccatgctcgagaagcagtgggagctgcccttcgaggacgacgtctccgctgccgaggacgaggaggacgagcagcacgagcacgagaagagccttggtagggccgccgcggtggtggtcgcgcggtccggcatgtcggcgcggcagcggcggatgagcggccggcggcggggcgccgcggggcggaagagcgtggccatcagcccggagctgatgcagagccggaaccgcatctacctccggggtaccgtcagcaaggagctcctcacgcacaagcaggtcgtccacctctccaagaagatcaaggacggcatttggctccagcaccaaagatcaaagctgaaggagaaactggggaatgagccgtcatacaagcagttggcgcaatcactacggatatcagcccctgagctgcgcgcaaggatgcgtgagtcgtttcttgcaagggagatgttgacaatgagcaacatccgtttggtgatatccattgcccagaaatatgataacctcggtgtcgagttggcagaccttattcagggtggtctgattgggctactccgtgggatcgaaaagtttgatgcatcaaggggatttaggatttccacttatgtatactggtggattcgtcagggtgtttcaagagcattggctgagaattcaaaaacattcaggcttcctacttatttgcatgagaggcttatcgcaattcgtggtgcaaagtatgcattggaagaccaaggaattgctccaacaatcgaaaacatcgccgagtcactcaatatatcggtaaagaaagtacacaatgctacagaggctgtgaacaaggttgtttcactggatcaactggcatttccctccttaaacggcctacctggcgaaacactccatagttatatagaggatgaaaacgttgcaaacgatccgtggcatgggtttgaggaggggtatctcaaggaggaagtcactaatcttatcaattcaactctcaacgagcgagagagggatattattcggttatatcacggcatagggaaacagtgccatacatgggaggatattagcagacagtttgggttgtcgagagagcgtgtgaggcaagtaggactcatcgccatggagaagctgaagcatgctgcaaggaggaaacatttggatgcattgcttgaggattattgagttgagatgctttacatttgagtcgattcccacactcagtggttgtatatacttggaaacatagggtacatcatccttgaaaggctttactgccactcagtctgcagataattatacatgtacatctgtgacaattaataggcatatgcgatcaagaaatctatacctgcacaatgatcaaggcaatccaacaagaagagaggcggcttttttcttggaagcttcacaaaatttctgtaatatatgtatatgtaatgtataatttagcgccttaatcagtagagcaacaacatttatgtcctggatctgtattcttctccagttacataaaaagaaaatgcttac

SEQ ID NO: 17101 - protein, 500 aa, Panicum virgatum
  misc_feature: Ceres CLONE 1791268
  misc_feature (261)..(331): Pfam Name: Sigma70_r2 Pfam Description: Sigma-70 region 2
  misc_feature (335)..(415): Pfam Name: Sigma70_r3 Pfam Description: Sigma-70 region 3
  misc_feature (434)..(486): Pfam Name: Sigma70_r4 Pfam Description: Sigma-70, region 4
MTATPAVIGLSAGNRLLAASFGAADLAPADAHPSLQFAPKLAVVAHSRASAASSPAARARAHAVRALRNHSAPALAPPPPAADPAAPTPELDADAEFESSLEAIVLLQRSMLEKQWELPFEDDVSAAEDEEDEQHEHEKSLGRAAAVVVARSGMSARQRRMSGRRRGAAGRKSVAISPELMQSRNRIYLRGTVSKELLTHKQVVHLSKKIKDGIWLQHQRSKLKEKLGNEPSYKQLAQSLRISAPELRARMRESFLAREMLTMSNIRLVISIAQKYDNLGVELADLIQGGLIGLLRGIEKFDASRGFRISTYVYWWIRQGVSRALAENSKTFRLPTYLHERLIAIRGAKYALEDQGIAPTIENIAESLNISVKKVHNATEAVNKVVSLDQLAFPSLNGLPGETLHSYIEDENVANDPWHGFEEGYLKEEVTNLINSTLNERERDIIRLYHGIGKQCHTWEDISRQFGLSRERVRQVGLIAMEKLKHAARRKHLDALLEDY

SEQ ID NO: 17102 - DNA, 473 bp, Panicum virgatum
  misc_feature: Ceres CLONE 1791269
  misc_feature: Encodes the peptide sequence at SEQ ID NO. 17103
cttcctcgccggcgcagcgtgtgcgagggatgaacattgtcggcaacttcatcaagttcacggtcatcggcgtgtacctggacgacggctccgccgtgtcagcgctggctaataattgcgcacggaactcctcctacgagctcgccgccgacatcaccttcttccacgacctcctctctggccacttccataacttcacgcgtgtgatgatgatcctgccgctcactcccgatcattactcgaacaacctgacggacaactgcatggagtactggaaggacgtctgcgcctacacggacgccgaaggcgcagctgtatacaagttcaaggagaccttctagcccgagactctcctccccggcgtgtccatcctcttcacgcactctcccgccggagtcctcaccgtcccgttctcattggactcgacggtgcctgactccgccggcatgccgatctacaacatgacccgctgc

SEQ ID NO: 17103 - protein, 112 aa, Panicum virgatum
  misc_feature: Ceres CLONE 1791269
  misc_feature (1)..(112): Pfam Name: Chalcone Pfam Description: Chalcone-flavanone isomerase
  misc_feature: SWISSPROT Homolog: EC 5.5.1.6 Chalcone isomerase
SSPAQRVRGMNIVGNFIKFTVIGVYLDDGSAVSALANNCARNSSYELAADITFFHDLLSGHFHNFTRVMMILPLTPDHYSNNLTDNCMEYWKDVCAYTDAEGAAVYKFKETF

SEQ ID NO: 17104 - DNA, 2654 bp, Panicum virgatum
  misc_feature: Ceres CLONE 1791275
  misc_feature: Encodes the peptide sequence at SEQ ID NO. 17105
aaccaccacttcgcacttgttcgctcggtacagttaccttcttccccgccttaatttccctctgcacgcgtcctacgccggctgcccggcttcgcttcacaacccaccagagacgcggcggcgggttccagctgcggccaagccctcggggcccttcattagcgcagctgagcatggaggccgcggcggcggcgccgcatctcctgcactgcggcggcttcggccgcgtcgcgcacctcccggcgctccccggtcgccgccgccgccgaggacagcagctcccccgcgtccgcgccgtcgccacagagccgaagccgtccacctcctcctcctctcgccccaggcccaggagccgtaatgatctctccaacaccaggttcggaggagtgtccaaggagatccagcgcgtgcgcaagcagatggagcaggacgagcagctcgccacgctcatgcgtggcctccgcggccagaacctccgcgacgagcagttcgctgatgacaatgtccgccttcgcctcgtcgaggtagaatctgcggataacaatgaggggctgcctcttgtttatagtcctgaaatcatatcagcatactggggaaagcgtccaagggctgtcgccactcgtgtggtgcaattactgtctgttgctggtggtttcatctcttctctcatatccgatcttattaacaagaaactcaaggagaatgaagtagctcgcgctatcgaactgagggaaattgtaacatctctgggtcctgcttacatcaagcttgggcaagcgctaagtatacggccggatattctgtcccctgcagcaatgactgagttgcaaaaattatgtgataaggttccttcattcccagatgatatagcaatggctcttctggaagaagagcttggtcagccttggcaagcaatctactctgagttatccccctccccaattgctgcagcatctttgggacaggtatataaaggccgcttgaaagaaactggagaactggtagctgtcaaagtgcagagaccatttgtacttgagactgtcaccatcgatttattcatcattagaaacttgggtttggtactcaggagatttccacaggtctccattgatgttgttggcctggtagatgagtgggctgctcgattttttgaagaacttgattatgtaaatgaaggggaaaatggcacctactttgctgaaatgatgaaagaagatctgccacaggttgttgtaccaaagacataccataaatacacatctagaaaagttcttaccacacaatggatagagggagagaagctgtcacaaagtacagaggatgatgttggatcattggtcagtgttggtgtcatatgctatctgaaacagttgcttgataccggattcttccacgctgatccacatccaggcaatatgattagaacacctgatggaaagctggccattcttgattttgggcttgtaacaaaactgacagatgatcagaagtatggaatgatcgaagcaattgctcaccttattcatcgtgattatgatgcaattgtgaaggactttgtgaagcttggtttcatccctgagggagttaacttggatccaatcttgcctgtactggccaaggtttttgatcaggcacttgaaggaggcggtgctaagaatattaactttcaagaattggcagcggatcttgcacagataacttttgattatccattcaggatacctccgtactttgctttgattattagagcaattggggtacttgaaggtatagctttggtgggagatcctgaatttgccattgtggatgaagcatacccatatattgcacagaggctactaacagatgaatcacctcggctaaggagtgccttgcgttacacaatatatggcaaaactggtgttttcgatgcagaaaggttcattgatgttatgcaagccttcgagaattttattcgtgcagcaaagagcggtggtggggagaacttgaagggaaacatggccgagctggctgatataggagctcaacctagcaccagtttggttcctgtatttccaatggccatagcccagcctgagcagccagttaaagcccgtgcagctcttgcttttctactctctgagagggggaacttctttcgggagttcattcttgatgagattgtcaaagccattgatgcagtttcaagggagcaattaatacagattgctgcatctttcggggtagggaatgcaacccctgtttttagcatggttcccgttagggccagagcattgcttccaacaatcacagaggaagacagagtcatcttgaacaatgtcgagaaggttgtgaaattcctaacatctgggactgcaactacaaccatgaacggggatgtaaacatggtgtctgtagtccaagaacttcttcctgtgttgccgggcatctcatcgaagatcctaccggatgtcttgagccggttgtcatcaagagtatttgcacggttgatcagagatgcatttttgtgaagttttggttatttttctttctaacagcaaagtacaattagttatacctacctacccaaacaacacacacataatgatagaaaattgtacagcagtacgatgtatataatttatatctatgcaaattaaccaaagtttagccgg

SEQ ID NO: 17105 - protein, 778 aa, Panicum virgatum
  misc_feature: Ceres CLONE 1791275
  misc_feature (239)..(358): Pfam Name: ABC1 Pfam Description: ABC1 family
MEAAAAAPHLLHCGGFGRVAHLPALPGRRRRRGQQLPRVRAVATEPKPSTSSSSRPRPRSRNDLSNTRFGGVSKEIQRVRKQMEQDEQLATLMRGLRGQNLRDEQFADDNVRLRLVEVESADNNEGLPLVYSPEIISAYWGKRPRAVATRVVQLLSVAGGFISSLISDLINKKLKENEVARAIELREIVTSLGPAYIKLGQALSIRPDILSPAAMTELQKLCDKVPSFPDDIAMALLEEELGQPWQAIYSELSPSPIAAASLGQVYKGRLKETGELVAVKVQRPFVLETVTIDLFIIRNLGLVLRRFPQVSIDVVGLVDEWAARFFEELDYVNEGENGTYFAEMMKEDLPQVVVPKTYHKYTSRKVLTTQWIEGEKLSQSTEDDVGSLVSVGVICYLKQLLDTGFFHADPHPGNMIRTPDGKLAILDFGLVTKLTDDQKYGMIEAIAHLIHRDYDAIVKDFVKLGFIPEGVNLDPILPVLAKVFDQALEGGGAKNINFQELAADLAQITFDYPFRIPPYFALIIRAIGVLEGIALVGDPEFAIVDEAYPYIAQRLLTDESPRLRSALRYTIYGKTGVFDAERFIDVMQAFENFIRAAKSGGGENLKGNMAELADIGAQPSTSLVPVFPMAIAQPEQPVKARAALAFLLSERGNFFREFILDEIVKAIDAVSREQLIQIAASFGVGNATPVFSMVPVRARALLPTITEEDRVILNNVEKVVKFLTSGTATTTMNGDVNMVSVVQELLPVLPGISSKILPDVLSRLSSRVFARLIRDAFL

SEQ ID NO: 17106 - DNA, 653 bp, Panicum virgatum
  misc_feature: Ceres CLONE 1791282
  misc_feature: Encodes the peptide sequence at SEQ ID NO. 17107
gaccaaatcctaaacgcccgccgcaaaggcgacgaccaaatcctaaacgcccgccgcaaagccaaagcgacgccgccggtgcccctctccgcggctcctccgctcgctgctcctcgctccactgccgcggcttctcgtcctcatcgggacgtcaattggtctcctattgctaacaggaaagattgagaatacttgttcctaaccggggcgcgagtgcaatcatttgtgtgttcctccaactgagcggtcatgcgccacccaaggtccgggccggggaagaagcggggccgcgggccgcggatccccgcaacgacgtttaggaagcagctggcggcgttggcgaacgtcgaccagatcactggcgccaagatccccaagagtttcgtcttctcccggggcaagctcccatccacgctccgacacctccagcaggacctccgcaaggtcatgctcccctacactgctctcaatctaaaggagaagaagcggaataacctcaaggacttcgtcaatgttgccggtccgttgggtgtgacacatttcttgatcctctcgaaccctaagagcctgccgcacctgcgctttgccaaatcgccacagggcccaaccttcacttttcagatagaggagtatgcgctagcggcagacattgc

SEQ ID NO: 17107 - protein, 134 aa, Panicum virgatum
  misc_feature: Ceres CLONE 1791282
  misc_feature: Useful for making plants with modulated biomass
MRHPRSGPGKKRGRGPRIPATTFRKQLAALANVDQITGAKIPKSFVFSRGKLPSTLRHLQQDLRKVMLPYTALNLKEKKRNNLKDFVNVAGPLGVTHFLILSNPKSLPHLRFAKSPQGPTFTFQIEEYALAADI

SEQ ID NO: 17108 - DNA, 1114 bp, Panicum virgatum
  misc_feature: Ceres CLONE 1791292
  misc_feature: Encodes the peptide sequence at SEQ ID NO. 17109
cgggatcccggcggaagatggccgcctcctgctccttccgctccgtcgtccgggcgcctccgctctcccggagcctcgccaggagcgcggtgcgctgccgccgcgccgccacgccgggggccggtggtgccgcctccacctccaagcttgtcgtggaggtgaaagaacggctggcgagggagcacccgggcctccccacgggcaggaacgggagggacgatgacgacatgatcctctggttcttgaaggaccgcaagttctccgtcgacgaagctgtctccaagctcaccaaggccattaaatggcgtcaggactttggtgtatcagaattatctgaagaatcagtgaaaggcttgtaccaaactggcaaggcatatgtacatgattctttggacattgatggcagacctgtgctagttgtaatagcagccaaacattttccttcgacacaagatccagttgaaaatgagaagctatgtgcctatttggtcgagaaagcaataaacagacttccctcaggggaagagaatatacttggaatctttgatctgcgaggcttccgtgttgaaaatggtgatctccagttcttaaagtttttgcagcttggccaagttctttttgtagatgctccatttgtttttcaaccaatgtggcaggttgttaaacctcttttgagatcatatgcctccctggtgagattttgcgattctgagactgtgaggaaagaatacttcacagaagaaaccgtgcctcctgatttccactgttaaatgtcttgatttcttcagtagcagatcattatccagaaacggctctggcaggttttggttgcaggaaatagaagacgcgactgaagatttgtgaatacagtgccgcatctggtgacacgagagaatgtcttggacgacgggcgaagaaagttttgccagcagttcaagagggctctagagtagaggtcatgatgagaactgagagtgctgtattggtgtttgtctgcagttgtccttctatgacatgtcatatgtataagtatatatgaacacactgtctggggtaccgctttggtaacaaatcttaaattaagcatgagcatgaacaaatcttaacaattctg

SEQ ID NO: 17109 - protein, 250 aa, Panicum virgatum
  misc_feature: Ceres CLONE 1791292
  misc_feature (47)..(105): Pfam Name: CRAL_TRIO_N Pfam Description: CRAL/TRIO, N-terminus
MAASCSFRSVVRAPPLSRSLARSAVRCRRAATPGAGGAASTSKLVVEVKERLAREHPGLPTGRNGRDDDDMILWFLKDRKFSVDEAVSKLTKAIKWRQDFGVSELSEESVKGLYQTGKAYVHDSLDIDGRPVLVVIAAKHFPSTQDPVENEKLCAYLVEKAINRLPSGEENILGIFDLRGFRVENGDLQFLKFLQLGQVLFVDAPFVFQPMWQVVKPLLRSYASLVRFCDSETVRKEYFTEETVPPDFHC

SEQ ID NO: 17110 - DNA, 2237 bp, Panicum virgatum
  misc_feature: Ceres CLONE 1791296
  misc_feature: Encodes the peptide sequence at SEQ ID NO. 17111
acgcatttccgccgccgctcagagctcgcccaccggaccgcgcgaaacctaccttccttccgggagacgagtccgcagacaagaggaggcatggacgccgccacgtccgtcacgccgggcgccgtgtcccacatccttgcgaacccgtcaccgggcgacgccgccgagatcccggagctcgtcgtccaggtcgtcgacctcaagtccatcggcacgggcagccggttcagtttcatggcgagcgacgggaaggacaagatcagggcgatgctccccacccaattagcgccggaggttcactccggcaacctgcagaacctcggcctaatccgcatcctcgactacacctgcaacgccctccctcccaaaaacgacaaggccttgattatcagcaaatgcgaggttgcgtcccaagcgctcgacgccgagatcattagcgaagacaagaaacaagaggggcctgcgattgtcctcaagcccaaggacgaaggcgtggttctgtccaagcccgcaaatgctcccctggttgtgttgaagccgaagcaggaggtgaaatccgcgtcccagatcgtgaacgagcagcgtggcaatgcgtgcagtgctgctccagcagcgcgcttggccatgacaaggagggtccatcctttgatctccctgaacccttaccagggtaactgggtcatcaaggtgcgggttacgaacaagggcaacctcagaacttacaagaatgcccgtggagaaggctgtgtcttcaatgtagagctcactgatgaggatggcacccagatccaggccaccatgttcaatgaggctgcaaagaagttttatccaatgtttgagctggggaaggtctacttcgtctccaagggatcacttaggattgccaacaagcagttcaagacggtccagaatgactatgagatgacactgaatgagaatgctgttgttgaggaagcagagggggaaactatcattccacaggtgcaattcaattttgtcaagattgatcagctaggatcatatgtcaatggcagggaacttatagatattgttggtgttgttcagagtgtgtcacccacactgagtgttaggagaaagagagacgatgagacaataccaaagcgtgacattgttgttgcagatgactcgggcaaaactgtgagtgtttcactctggaatgatcttgctactaccactggccaagagctcatggacatggttgacagttcgcccatcgttgcgataaagagcctaagagtatctgacttccaaggtgtttctctttcaactgtaggcaaaagtactcttctggttaatccagaccttcctgaggcacagaaccttaaatcatggtatgactctgaaggcaagggcacttcaatggcaccgattggtgcagacatgggtgtagcacgggctggtggcttgagatccatgtattccgatagagtttttctgtctcacatcaccagtgatcctaatatgggccaggaaaagcctgttttcttcagtttgaatgccatcataagtcacattaagccagatcagaacatgtggtaccgagcttgcaagacctgcaacaagaaggtgactgaagctgttgaaggtgggtactggtgtgaaggatgcaacaagaatgatgctgagtgctcactgagatacatcatggtcatcaaggtctctgatcccactggcgaggcatgggtttctgtcttcaacgagcatgcagagaggatcattggctgcagcgctgatgagcttgatcggatcagaagagaggagggtgacgacagctacattctcaaactcaaggaagccacctgggttccccatctgttccgtgtcagcgtcgcgcagcatgagtacatgaacgagaggaggcagaggaccaccgtgaggactgaggcgccggtcgactacgccgctgaatccaaatacctgctcgaggagatcgccaagcttactgcttgctagaaggctgtttctctccctgatgttttcctatggcagaggcttttgagacgttaattgtgttaagtaggtattcagtgggtttagcacttctgtaagatatgtaggtgtttgtttagcttgatttcaagcagcaggatgctaagacagttcagtacgaagcctttgtagaactgcagttccagttccatcttatttgcaatgcaattgaacaaatagccaatattatcttactactatttgctaatattggctactgttttctt

SEQ ID NO: 17111 - protein, 627 aa, Panicum virgatum
  misc_feature: Ceres CLONE 1791296
  misc_feature (472)..(617): Pfam Name: Rep_fac-A_C Pfam Description: Replication factor-A C terminal domain
  misc_feature (6)..(108): Pfam Name: Rep-A_N Pfam Description: Replication factor-A protein 1, N-terminal domain
  misc_feature (196)..(286): Pfam Name: tRNA_anti Pfam Description: OB-fold nucleic acid binding domain
MDAATSVTPGAVSHILANPSPGDAAEIPELVVQVVDLKSIGTGSRFSFMASDGKDKIRAMLPTQLAPEVHSGNLQNLGLIRILDYTCNALPPKNDKALIISKCEVASQALDAEIISEDKKQEGPAIVLKPKDEGVVLSKPANAPLVVLKPKQEVKSASQIVNEQRGNACSAAPAARLAMTRRVHPLISLNPYQGNWVIKVRVTNKGNLRTYKNARGEGCVFNVELTDEDGTQIQATMFNEAAKKFYPMFELGKVYFVSKGSLRIANKQFKTVQNDYEMTLNENAVVEEAEGETIIPQVQFNFVKIDQLGSYVNGRELIDIVGVVQSVSPTLSVRRKRDDETIPKRDIVVADDSGKTVSVSLWNDLATTTGQELMDMVDSSPIVAIKSLRVSDFQGVSLSTVGKSTLLVNPDLPEAQNLKSWYDSEGKGTSMAPIGADMGVARAGGLRSMYSDRVFLSHITSDPNMGQEKPVFFSLNAIISHIKPDQNMWYRACKTCNKKVTEAVEGGYWCEGCNKNDAECSLRYIMVIKVSDPTGEAWVSVFNEHAERIIGCSADELDRIRREEGDDSYILKLKEATWVPHLFRVSVAQHEYMNERRQRTTVRTEAPVDYAAESKYLLEEIAKLTAC

SEQ ID NO: 17112 - DNA, 2380 bp, Panicum virgatum
  misc_feature: Ceres CLONE 1791297
  misc_feature: Encodes the peptide sequence at SEQ ID NO. 17113
gtcgccgccgccgtcgtctccctctcgccggtcctccacgtcgagagatccgctcccgcaggccgcacggccgcgctccacgtcgattggataaacaatataatgccatttggtggataatatttgaggtgctccaggcttgttcatttttgggaatcatcaaaatgtcaggaccactgaattcaaacattagtggggctgcctcaaaccttcgtgattcaacaggaaggtcatttgcatcatcattttccggacaatctggatcacttccaggttttcatcactcaggctcacacaacattcatggaaatctcaatctcacaaatatctctggatcattagcaccaagaaataattcaatgtcaggtatcccgtcaccaggggttcaacagcctggtggtagtatttccagtggccgtttcccctcaaataatcttcaagcttccatgtctcagattccccatggtcattctggcatcagcaacagaggaggtatgaatgttgggggaaatcctggatttagtagtagcatgaatgctattagtggttcaatacaaggtttatcctcaaacttggctaatgtgggtagccgaaattctgctcctgggttggtagcttctccagttttggggaatttaggcccacgaataacaaattcggggaatattgtgggtgggggcaatattgggataagtataagctctgcagggctgtctatgcctggtatagcgtctcgcatgaatttaagtggcaactctggaagtggggctatcaatattcaaggatccaaccggatgagtagtatgcttcaacaagcatctcctcaattcatgaacttgcttggaagttcttacccgacacctggagcgtcattgtctcagaatcaagtacaggcaggaaacagttctttaggatcttctggaatgctacatgatggaagctcgggtgacaatgccccatttgatataaatgacttccctcagctaactggacggcctaattctgctggaggtggtcaaggccaatatgggtcactgcgaaagcatggagtaagtgtcaacaccatcgtgcaacaaaatcaagaattcagcattcagaatgaagattttccagctttaccaggatataaaggtagttcctcagattatgctatggatatgcatcacaaggaccaccttcataagaatgtaaatattatgcaagcacaacattatcctatagctagatcatctggttttaacttgggaagcagctatccgccccgccaacatcagcagagtgctagttcagttcaaaatgctgggctggaaaatattggattaaggcctgcaaattctccaagtccgtcaccaaattcgagagtttatgaacaatttatgcagcagtaccatcaaccgcagactcaaaattcacttaggttgcaggcaacttcaggcccacaaccattcaaggatcagagccaaaaatctgttcagggaacacaaaccacaccagatccatatagtttacttggattgttgagtttaataagattgaaagagcctggaccaacagcccttgctttaggaattgatttgacatcattagggttgaatttgaactcccaggataatctttataagacatttggctctccatggtcaaatgagccagctaaaggagaacccgattatcagatcccggcttgtttctctgctgagccaccaccaccgctacaaccattacattttcagaagtttcaccccttgacattgttctacatcttctacagcatgcctaaggatgtggctcagttgtatgctgctaatgaactatacaataaagggtggttttaccacaaagactaccgtgtctggctcacaagagctcctaatgccgcgcctctggtgaaaactccacttcatgaacgaaggtcctacatttgttttgatccaaacatctgggatactgtccataaggacaacttcgttctccattatgaggcagtggagaagagacctgtccttccttccgccgcccaaaatcttagacgggaactataagtttccctaggttctcctgaacttgaagttagtttgttttggttagtcttcagtagctgttgtcatagatcggatgagttcatagaaattcattctgacatgcatgctgttctggaaaatggagctccttcgttagccgacaagccctgccgccaggtggcagcagtagacatgtagctgagatctagtatgcttcataattcattggctttaatcagtagggctatattgtaactatgttttgagtttccctgcttttttggtgatgcagtctccatgacgactgtaaatgttttggtcatttgagttgcataaaagaaaattcggactttggattc

SEQ ID NO: 17113 - protein, 625 aa, Panicum virgatum
  misc_feature: Ceres CLONE 1791297
  misc_feature (470)..(609): Pfam Name: NOT2_3_5 Pfam Description: NOT2 / NOT3 / NOT5 family
MSGPLNSNISGAASNLRDSTGRSFASSFSGQSGSLPGFHHSGSHNIHGNLNLTNISGSLAPRNNSMSGIPSPGVQQPGGSISSGRFPSNNLQASMSQIPHGHSGISNRGGMNVGGNPGFSSSMNAISGSIQGLSSNLANVGSRNSAPGLVASPVLGNLGPRITNSGNIVGGGNIGISISSAGLSMPGIASRMNLSGNSGSGAINIQGSNRMSSMLQQASPQFMNLLGSSYPTPGASLSQNQVQAGNSSLGSSGMLHDGSSGDNAPFDINDFPQLTGRPNSAGGGQGQYGSLRKHGVSVNTIVQQNQEFSIQNEDFPALPGYKGSSSDYAMDMHHKDHLHKNVNIMQAQHYPIARSSGFNLGSSYPPRQHQQSASSVQNAGLENIGLRPANSPSPSPNSRVYEQFMQQYHQPQTQNSLRLQATSGPQPFKDQSQKSVQGTQTTPDPYSLLGLLSLIRLKEPGPTALALGIDLTSLGLNLNSQDNLYKTFGSPWSNEPAKGEPDYQIPACFSAEPPPPLQPLHFQKFHPLTLFYIFYSMPKDVAQLYAANELYNKGWFYHKDYRVWLTRAPNAAPLVKTPLHERRSYICFDPNIWDTVHKDNFVLHYEAVEKRPVLPSAAQNLRREL

SEQ ID NO: 17114 - DNA, 746 bp, Panicum virgatum
  misc_feature: Ceres CLONE 1791321
  misc_feature: Encodes the peptide sequence at SEQ ID NO. 17115
atcgacactctccctaccaccaccgccgccgctgcggctcacggctacgcagcccgctctcccctccgtctggccgtcccctcccccccccctctctccggttgcttcgagggtttgccccgaatcgatcgcccgactgaccccgctagggttcggcccgatcgcccgccgcttcgtcctccccgcgggggtttccccgacgcgatgtccgaccggagctcaccggccgcgccgacgttcttccccttcggcccgcaggccgaggcgtgggacgtcacgttcaaggtcaaatatggggacacacttaagaggttttatggttgtgtcaatggagctcattttgacatgaatttatctgctctacgggcaaagatagccactgcctttaagtttggtcctgatgccaacttcattctgacttacatcgatgaggatggtgatgctgtaatgctagacgatgatgatgacctgcgcgatgcagctctgcgtcagaaattaaaccctctgaggattactgttcaactaaagaaaagtcaaccaactgaacaaaaggagaaaaattctacacctgtgaagcccactcctcaggatccactgtcccagattatgtcagctattgaaggtttgaagcctgctcaggaagaaaacctggcacatataaaatcagctattggtgaagctttcaagtctatcccagagcctattcctgatgcccttgcaaaactctctcatgaagtacttgatgc

SEQ ID NO: 17115 - protein, 180 aa, Panicum virgatum
  misc_feature: Ceres CLONE 1791321
  misc_feature (23)..(108): Pfam Name: PB1 Pfam Description: PB1 domain
MSDRSSPAAPTFFPFGPQAEAWDVTFKVKYGDTLKRFYGCVNGAHFDMNLSALRAKIATAFKFGPDANFILTYIDEDGDAVMLDDDDDLRDAALRQKLNPLRITVQLKKSQPTEQKEKNSTPVKPTPQDPLSQIMSAIEGLKPAQEENLAHIKSAIGEAFKSIPEPIPDALAKLSHEVLD

SEQ ID NO: 17116 - DNA, 656 bp, Panicum virgatum
  misc_feature: Ceres CLONE 1791321-R
  misc_feature: Encodes the peptide sequence at SEQ ID NO. 17117
gcatctgtatctgtccctgcttctatgcctgtgcctccacctgttagtactgctgcagcacctgagccttttgacacagatgatcataatgaagagaagctattgagggagctggaggaaatgggctttaggcagattgatctgaacaaggaaatccttaggcagaacaattacaacctggagcagtccgttgatgatctgtgtggtgtcaacgaatgggatccactccttgcagagctggaggagatgggttttgatgataccgagatgaacaaggagctgcttgcgaagaatgggggaagcatcaagcgagctgtgatggacctcatcgccagggagaagaaggacaagtgaagatcgtgtgcctgtgcacatagttatctatgatctacgtgtaaataatgaggctgctgtaccactccggtgcagcactatcacgtctcagagcttgcttaccttataactgttgattttatgcgacttctttatattggtcgtgcgtcgtgtagtgtctggtggtgtcgatgacttgccctaagcgcctcaggaaagcagttaccctgccaggtgaattgcttgtaaggattggctgtgatgccttctaagtatctgttaccgagacatgcaaacttataatatgatgcctatgtggatgc

SEQ ID NO: 17117 - protein, 117 aa, Panicum virgatum
  misc_feature: Ceres CLONE 1791321-R
  misc_feature (30)..(67): Pfam Name: UBA Pfam Description: UBA/TS-N domain
  misc_feature (72)..(109): Pfam Name: UBA Pfam Description: UBA/TS-N domain
ASVSVPASMPVPPPVSTAAAPEPFDTDDHNEEKLLRELEEMGFRQIDLNKEILRQNNYNLEQSVDDLCGVNEWDPLLAELEEMGFDDTEMNKELLAKNGGSIKRAVMDLIAREKKDK

SEQ ID NO: 17118 - DNA, 750 bp, Panicum virgatum
  misc_feature: Ceres CLONE 1791327
  misc_feature: Encodes the peptide sequence at SEQ ID NO. 17119
tctccgttgtcgcgactcgcatcgagattcgggcggcctccgctcgctcgtcggcacgccggcctcctccgcgctccactccttcgagccgcaccccatcgtcggcgacgcctgggaggcgctccgccgctccctcgtcttcttccgaggccagcccctcggcaccgtcgccgccgtcgaccacacgtccgaggaggtccttaactacgaccaggtgtttgtgagggatttcgtgccgagcgcactggcgttcctaatgaacggcgagccggatatcgtcaggaacttccttctcaagaccctgctgctgcagggctgggagaagaaagtcgaccggttcaagcttggggaaggagccatgccggcgagcttcaaggtgatgcatgacgcgaagaagggtgttgaaaccctacacgccgattttggggagagcgcgattgggagggttgcgccggtggattccgggttctggtggatcattctcctgcgggcctacacaaagtccaccggggacttgacgctagcagagacacctgagtgccagaaagggatgaggctcatactgagcctgtgtctgtccgaggggtttgataccttcccgacattgttatgtgccgatggttgctgcatgatagatcgcagaatgggtgtatatggctaccccatagaaattctagcacttttcttcatggcacttaggtgtgctcttccaatgcttaagcatgataatgaagggggaggagtttgtag

SEQ ID NO: 17119 - protein, 249 aa, Panicum virgatum
  misc_feature: Ceres CLONE 1791327
  misc_feature (25)..(249): Pfam Name: Invertase_neut Pfam Description: Plant neutral invertase
  misc_feature: Useful for making plants with altered carbohydrate content
LRCRDSHRDSGGLRSLVGTPASSALHSFEPHPIVGDAWEALRRSLVFFRGQPLGTVAAVDHTSEEVLNYDQVFVRDFVPSALAFLMNGEPDIVRNFLLKTLLLQGWEKKVDRFKLGEGAMPASFKVMHDAKKGVETLHADFGESAIGRVAPVDSGFWWIILLRAYTKSTGDLTLAETPECQKGMRLILSLCLSEGFDTFPTLLCADGCCMIDRRMGVYGYPIEILALFFMALRCALPMLKHDNEGGGVC

SEQ ID NO: 17120 - DNA, 710 bp, Panicum virgatum
  misc_feature: Ceres CLONE 1791330
  misc_feature: Encodes the peptide sequence at SEQ ID NO. 17121
actcctctgctcctcgcgccgccgccgccgccgccgcgatggcttccgccgcggtgctccggaacgccggctcccgccgtctcttctcctacccgatcctccgcgccgccacgatctcggcgcccgccgctctccccgatgcgcccgccgcggcggcggcgccgacccagccgcaaccgatggccgggaccctctgggcgaggtccatggccaccttcacgcggacgaagccccatgtaaacgtcggtaccattgggcacgtcgatcacggcaaaaccactctcactgctgccattaccaaggttctagccgaggcggggaaagccaaagccatcgcttttgacgagatcgacaaggctccggaggagaaagcgagaggaatcaccatatctacggctcatgtggagtatgagacggctaaaaggcattatgctcatgtggattgcccaggacacgctgattatgtcaagaacatgatcactggagctgctcaaatggatggcggtattcttgtcgtgtcagcacctgatggcccgatgccacaaacaaaggagcatattcttcttgctagacaggttggtgtaccttcacttgtgtgcttcttaaacaaagttgatgctgtcgatgatccagagttgctcgaacttgtagagatggagcttcgtggtgatgagattccgatcatccgtggatctgccttgtcagcattg

SEQ ID NO: 17121 - protein, 223 aa, Panicum virgatum
  misc_feature: Ceres CLONE 1791330
  misc_feature (64)..(223): Pfam Name: GTP_EFTU Pfam Description: Elongation factor Tu GTP binding domain
  misc_feature: SWISSPROT Homolog: EC 2.7.7.4 Sulfate adenylyltransferase
  misc_feature: Useful for making plants with modulated oxidative stress sensitivity
MASAAVLRNAGSRRLFSYPILRAATISAPAALPDAPAAAAAPTQPQPMAGTLWARSMATFTRTKPHVNVGTIGHVDHGKTTLTAAITKVLAEAGKAKAIAFDEIDKAPEEKARGITISTAHVEYETAKRHYAHVDCPGHADYVKNMITGAAQMDGGILVVSAPDGPMPQTKEHILLARQVGVPSLVCFLNKVDAVDDPELLELVEMELRGDEIPIIRGSALSA

SEQ ID NO: 17122 - DNA, 587 bp, Panicum virgatum
  misc_feature: Ceres CLONE 1791330-R
  misc_feature: Encodes the peptide sequence at SEQ ID NO. 17123
gtactcttaagacatacacaaagtttgaggcagaaatatacgtcctgacaaaggatgaaggtggtcggcacacagctttcatgtcgaattacagtccacagttctacttcaggactgctgatgtcactggaaaaatcgagttgcttggtgacatgaagatggttttgcctggtgacaatgtgactgcaaattttgagttgatatcgcctgttccccttgaacaagggcaaagatttgcgctgagggaaggagggagaactgttggtgctggagttgtctccaaagttattagctaatcagtttccactttgtttccagtagcaatttagcgaaaacaaatgttgatacatgtcggaccgggttagaaacgagagcaaaggaaccggtttgcatttttcttggaatgcatgagcaaaggcaaggctggctggcctggccaccattctggactgtctcttttgtttccttgttgaggtggtgctgttaacaccgcagttagtttggttaacacgcttgttgggcataactcagtgattgaataagacaagtctcgtcataagcaaatttaccggccattttgtttgccg

SEQ ID NO: 17123 - protein, 97 aa, Panicum virgatum
  misc_feature: Ceres CLONE 1791330-R
  misc_feature (2)..(96): Pfam Name: GTP_EFTU_D3 Pfam Description: Elongation factor Tu C-terminal domain
  misc_feature: Useful for making plants with modulated oxidative stress sensitivity
TLKTYTKFEAEIYVLTKDEGGRHTAFMSNYSPQFYFRTADVTGKIELLGDMKMVLPGDNVTANFELISPVPLEQGQRFALREGGRTVGAGVVSKVIS

SEQ ID NO: 17124 - DNA, 740 bp, Panicum virgatum
  misc_feature: Ceres CLONE 1791333
  misc_feature: Encodes the peptide sequence at SEQ ID NO. 17125
aggcagcactaaccagtgtaagcctactaagccaccatgtattaaggctgctcttcccagctccttcctgaggttgagtgggagagggagaaacacacacacacacaagggagagagagagagagagagagagagagagagagagagagagagagagagagagagagagagagagagagagagcttcattattactcttcagcctagcccaaacttcggattatcagatatgatgaatcagatgaagcataggtccttcttgtgctccatcatctcccttatcttaaccttttcatattttgcagctagtgatgaccagtttgtctaccatggctttgccggagttaacctcaccttagatggcaacgccttggtcacaccagacggcctccttgagctcaccaatgacgcagtcaatctaggccatgcattttaccctactccattaaacttccaccaacagctcaacggtactgtgcaatctttctccatctcctttgtgtttgcaatcctctctgtccatgatgacattagtgccgatggcatggccttttttgttgccccaactaagaacctctcaaacacatgggcacagtacataggcctcctcaacagtgggaatgacggcaactcgaccaaccacatgtttgctgtcgagcttgatacaatccaaaacaatgagtttaaggacatcgacaataaccatgtgggcatcaccatcaatagtctcacctctttgc

SEQ ID NO: 17125 - protein, 169 aa, Panicum virgatum
  misc_feature: Ceres CLONE 1791333
  misc_feature (26)..(169): Pfam Name: Lectin_legB Pfam Description: Legume lectin domain
MNQMKHRSFLCSIISLILTFSYFAASDDQFVYHGFAGVNLTLDGNALVTPDGLLELTNDAVNLGHAFYPTPLNFHQQLNGTVQSFSISFVFAILSVHDDISADGMAFFVAPTKNLSNTWAQYIGLLNSGNDGNSTNHMFAVELDTIQNNEFKDIDNNHVGITINSLTSL

SEQ ID NO: 17126 - DNA, 641 bp, Panicum virgatum
  misc_feature: Ceres CLONE 1791333-R
  misc_feature: Encodes the peptide sequence at SEQ ID NO. 17127
atgaatagactagccccagcaattgatatatccaagctaccaaagctaccaagagttggcccaaaatcccgttccaaggtcctagagatcaccctgcctatagccactgcaacatttgttcttactgttggccttgtcattgtcctacttgtttatagaagattaaggtacaaggaggtaaaggaagattgggaggttgatttcggtccacatcggttctcgttcaaggacttattccttgccacaagaggtttcaggaaaaagaacctgcttggtgtgggtgggtttggaaaggtctacaaaggggttcttccaaagtccaaagttgaggtagctgtaaagagggtatcccacgagtcaaggcaaggcatgaaggagtttattgctgaggttgttagcattggccgacttcgacaccgcagcattgtaccgctacttggatattgtcggcgacaaggtgaacttcttttggtgtatggctatatgtcaaatggcagcctcaataagtatctgtactgtgaagatgctcatccatcattgagttgggccaataggttccacatcatcaagggtgttgcatctgggttgttctacctccatgagaagtgggaaaaagttgtcatccaccgagacattaagcc

SEQ ID NO: 17127 - protein, 213 aa, Panicum virgatum
  misc_feature: Ceres CLONE 1791333-R
  misc_feature (85)..(212): Pfam Name: Pkinase_Tyr Pfam Description: Protein tyrosine kinase
  misc_feature: SWISSPROT Homolog: EC 2.7.11.1 Non-specific serine/threonine protein kinase
MNRLAPAIDISKLPKLPRVGPKSRSKVLEITLPIATATFVLTVGLVIVLLVYRRLRYKEVKEDWEVDFGPHRFSFKDLFLATRGFRKKNLLGVGGFGKVYKGVLPKSKVEVAVKRVSHESRQGMKEFIAEVVSIGRLRHRSIVPLLGYCRRQGELLLVYGYMSNGSLNKYLYCEDAHPSLSWANRFHIIKGVASGLFYLHEKWEKVVIHRDIK

SEQ ID NO: 17128 - DNA, 1655 bp, Panicum virgatum
  misc_feature: Ceres CLONE 1791335
  misc_feature: Encodes the peptide sequence at SEQ ID NO. 17129
gtcgtccggcctcaggctaatcacggtcgtccgctcgcgccgcgcaggatcccgcccgcccgacgcccgataatcaggtgacgcatcgcgctaccctcgcccgccccccgcccgccgcgccatcgcaccgccgccgctgtctctagcttccggccactccgcgccaccgcgtcgccgccgctctgtccagtcttccggccacgccggcccctccgcgccatcacgccgccaccgctccgtccccggcttccgggcactccgcgccatcgcgccgccgccgctccgtcccaggcttccggctacgccacgccggcgtgcagttcccgaggcccgtcacccagtcggcggtcgctcatgtccgtcgtccccggcctcacatcgtcaccggcctctcgtcgctgcgccgccaccgcggactccctggcctcacgtcgtacataagggcccgctcgcttgcaggtgccagaagcagttcgcgcagtacaccagccctccgacgcaactcccggtactgctcgctcccgtgctacaagatatgagctagctggatcaagataagaataaataaataaatttcccaccctccggagagaaccactttgtttctgcagaaggaccagaagaaaacacaatcagcgaggaccacaagggggagtaggaggttgcatcaatcagcgagcttaataggttctcgataactgtagcgtttgcaaggtggtggtatccggccacccggatttcaagcccggcgatcttctgtggggtgttaccgggtgggaagagtacagcctgatccccaatccaatgttctgccacaggatcaatcaccacgaatttccactgtcctattacaccggcgttcttggtgtgccgggcctcactacatatgctggactttttgaagtggccaaggccaagaaaggtgagcatgtcttcgtctcagcggcagcagaggccgtcggtcagatcgttgggcagcttgctaagctcacgggctgctacgttgtcggcagcgccggctctgatcagaaggtcaatctgttgaaaacaaagtttggcttcgacgacgctttcaattacaagaaggagctggacctcaacgctgccttgaagaggtgcttccctgatggcatcgacgtctacttcgagaacgtgggcggcgcgatgctggacgccgtcctgcgcaacatgcgccaccgcggccgggtcgccgtgtgcgggcaggtgtcgcagtacaacctggagcggccggacggcgtcgacctcttccagctcgtcggcaagcacatccgcatggagggcttcctggtgtccgagtactccggcgactactaccgccggttcgaggaggagatggcgcgctacctcgaggaaggcaaggtcgtctgcgtggaggacgtcgccgaggggatcgaggcggcgccggcagcactcgtggggctcttcgccggccacaacgtcggcaagcaggtggtcgccgtcgcaagggagtaattgagacgttgggtgccgtaccatgccagccatgggcatggacagatcgatggtttcccattttaccaaacattattataaattttatactaaaaaacgttacatggaatgtttggacacatacattaagtattaaataaaatctatctacaaattttttt

SEQ ID NO: 17129 - protein, 229 aa, Panicum virgatum
  misc_feature: Ceres CLONE 1791335
  misc_feature (39)..(186): Pfam Name: ADH_zinc_N Pfam Description: Zinc-binding dehydrogenase
  misc_feature: SWISSPROT Homolog: EC 1.6.5.5 NADPH:quinone reductase
  misc_feature: Useful for biocontainment applications
  misc_feature: Useful for making plants with modulated nitrogen use efficiency
MFCHRINHHEFPLSYYTGVLGVPGLTTYAGLFEVAKAKKGEHVFVSAAAEAVGQIVGQLAKLTGCYVVGSAGSDQKVNLLKTKFGFDDAFNYKKELDLNAALKRCFPDGIDVYFENVGGAMLDAVLRNMRHRGRVAVCGQVSQYNLERPDGVDLFQLVGKHIRMEGFLVSEYSGDYYRRFEEEMARYLEEGKVVCVEDVAEGIEAAPAALVGLFAGHNVGKQVVAVARE

SEQ ID NO: 17130 - DNA, 1772 bp, Panicum virgatum
  misc_feature: Ceres CLONE 1791336
  misc_feature: Encodes the peptide sequence at SEQ ID NO. 17131
acacaccccctccctcctcgccatcctcccacctccgctctcccagtctccggccgcgttccagcaccagcgctgaagccgctagctagccgttgctcggctcccccgacaccaccaaggctttcccttcgatcgatcgaccagcaactagccggatgacgaagcagggcgtggtggtgccggcgcccgcggaggcggccgtcgcggtgccgcccagctcggcgccgctcctcccgtacccgccgccgcgggccgccatgcgcaagaagtgcctgcagatgggacctggcgtcggcggctgggtcgagtccatgcgcgcctcctcgcccacgcacgccagggccgccgccgcgctcgccgccggcgccgacgaggaccgccgcgccgcctggatggtggagcacccgtcggcgctgagcaagttcgaccaggtggtggcggcgtccaagggcaagcagatcgtcgtcttcctcgactacgacggcacgctctcgcccatcgtcgacgaccccgacgccgcctacatgtccgacacgatgcggcgggcggtgcgcagcgtcgccaagcacttccccacggcgatcgtcagcggccggtgccgcgacaaggtgttcgagttcgtgaagctggcggagctctactacgccggcagccacggcatggacatcaagggccccgccaaaggttcccggcacaccagggccgccaagggcgtcctcttccagccggccagccagttcctgcccatgatcgagcaggtgcacgagtctctggtggagaagaccaggagcatccctggagccaaggtggagaacaacaagttctgcgtctctgtccacttcagatgcgtcgatgagaagagctggagcgcgttggcggagacggtgaagtcggtgctcaaggagtacccgaagctgaagctgacgcaggggcggatggtgttcgaggtgcggcccatcatcaagtgggacaagggcaaggccctcgagttcctgctcgagtcgctgggcttcgccgactgcgccgacgtgctccccgtctacatcggcgacgaccgcaccgacgaggacgccttcaaggtgctccgccgccgcggccagagcgtcggcatcctcgtctccaagcaccccaaggacacctccgcgtcctactcgctgcaggagcccgccgaggtgatggagttcctgctgcggctcgtcgagtgggagcgcctctccaaggcccgccccaagtggtgaccggccggccgccgccgccgctgccgccggtcgcgaggagatcgattaccagacggattagcagtatatatattatatgtatcatatatattatctttacatcttcgatcatcagggggggttaaattagaagggagcgcgtatcctggcgtgtcagcggcgcgccgctcagctccccgcgtgtggtgtcgtacgttaaccctgccgagctcaccgcgccatgtgcgtccgcgacggggggccctcccccttctttttacgggggagggcgcgccctggggttgccggggggtagaagaaggcctcggaagcttgagctttccggagccccctggcttgctagagacgatgccatctggctgctgcgcagcaaggcaaaaaaaaaaagaacaaaaaaaaacaagaagaagaagaacgtgttgctgctttagtttgtgtaattagtgctgctattattactgtggccgcctgaattctgattgtgtaaaagatgtatgaaatggagatccagctacgggaatatatatatactag

SEQ ID NO: 17131 - protein, 360 aa, Panicum virgatum
  misc_feature: Ceres CLONE 1791336
  misc_feature (105)..(338): Pfam Name: Trehalose_PPase Pfam Description: Trehalose-phosphatase
  misc_feature: SWISSPROT Homolog: EC 3.1.3.12 Trehalose-phosphatase
  misc_feature: Useful for making plants with modulated flowering time
  misc_feature: Useful for making plants with modulated low light sensitivity
  misc_feature: Useful for making plants with modulated drought sensitivity
  misc_feature: The sequence is a functional homolog of SEQ ID NO 16 in US patent 7214858
  misc_feature: Useful for making plants with modulated water use efficiency
MTKQGVVVPAPAEAAVAVPPSSAPLLPYPPPRAAMRKKCLQMGPGVGGWVESMRASSPTHARAAAALAAGADEDRRAAWMVEHPSALSKFDQVVAASKGKQIVVFLDYDGTLSPIVDDPDAAYMSDTMRRAVRSVAKHFPTAIVSGRCRDKVFEFVKLAELYYAGSHGMDIKGPAKGSRHTRAAKGVLFQPASQFLPMIEQVHESLVEKTRSIPGAKVENNKFCVSVHFRCVDEKSWSALAETVKSVLKEYPKLKLTQGRMVFEVRPIIKWDKGKALEFLLESLGFADCADVLPVYIGDDRTDEDAFKVLRRRGQSVGILVSKHPKDTSASYSLQEPAEVMEFLLRLVEWERLSKARPKW

SEQ ID NO: 17132 - DNA, 1327 bp, Panicum virgatum
  misc_feature: Ceres CLONE 1791343
  misc_feature: Encodes the peptide sequence at SEQ ID NO. 17133
agagagagagagggatcattgaaagctgcagccatcatcgatccgccccggcccgtttgttcgccaccatttctcctcccccttggaccccctcctcctcccttccgctcgctttccccctcgtcgaagcagaaatttttatgcgcgctttgggaaagcgcgagttagttttgctctgaagcagcctgctttttatccatccggagccgcgggcgttggggcgaggcggggctccgtgcgctgctccggccgggcgggcgtgggcaccgaggacgaggagtaggaggcggcggcgagcgagccagggatctacccatgtcgtcggcggaggacgggtactgcagctcagattcgccgcgggcggagtcccccgaggagtcgcaggcggcggcgggggcggcggacgcggagtcgcctcgctccgggcccaagcgcgagcgcgacctctgcgacatccccgcctcgccgtcgtcgccgctgccggcacctaagcgcagccggagatcggtggagaagcgggtcgtgtcggtgccgctcgccgagtgcggggaccggcccaggggcgccagcggggaggggccgccgccgtcggactcgtggacgtggcgcaagtacgggcagaagcccatcaagggctccccctaccctcgggggtactaccgctgcagcagctccaaggggtgcccggcgaggaagcaggtggagcgcagccgcgcggaccccaccgtgctgctcgtcacctacaccttcgagcacaaccacccgtcgccgcagcccaagggccacagctgccaccagcagggcaaggcgtccccgcggccggcggcgccgaagcccgagctggcggtcgagcaggccgagctcggtccggagcttgagctgaagacggagccagaggcgccggagaaggagctggaaccggagcaagaacaggaccaggagcagaaggctctcgcgagtctgcccgagccggaaacggcagcagccgcaacggtggcgccggtggccgaggaggacgagagcttcgacttcgggtggttcgaccagtacccgacgtggcaccggtcggcgccgtacgcgtcgctgccgccgccggaggagtgggagcgggagctgcagggcgaagacgccctgttcgcggggctcggggagctgcccgagtgcgccgtcgtgttcggccgccggcgcgagctcagcctcgcggccaccgcgccgtgctcctgatggcagctttttctcttttttttccctttcagctatcatctatctaatcaaattttttgtctcatgtatggagcattaaatgtatggagcattaaatgtaggt

SEQ ID NO: 17133 - protein, 302 aa, Panicum virgatum
  misc_feature: Ceres CLONE 1791343
  misc_feature (91)..(151): Pfam Name: WRKY Pfam Description: WRKY DNA -binding domain
  misc_feature: Useful for making plants with modulated biomass
MSSAEDGYCSSDSPRAESPEESQAAAGAADAESPRSGPKRERDLCDIPASPSSPLPAPKRSRRSVEKRVVSVPLAECGDRPRGASGEGPPPSDSWTWRKYGQKPIKGSPYPRGYYRCSSSKGCPARKQVERSRADPTVLLVTYTFEHNHPSPQPKGHSCHQQGKASPRPAAPKPELAVEQAELGPELELKTEPEAPEKELEPEQEQDQEQKALASLPEPETAAAATVAPVAEEDESFDFGWFDQYPTWHRSAPYASLPPPEEWERELQGEDALFAGLGELPECAVVFGRRRELSLAATAPCS

SEQ ID NO: 17134 - DNA, 1858 bp, Panicum virgatum
  misc_feature: Ceres CLONE 1791351
  misc_feature: Encodes the peptide sequence at SEQ ID NO. 17135
acactgctcccaccaaagcaccaccaccaaggcccaggcagctgctcattagtaagctagaggcctgagcgagcgagagacgatagaagtagctaggtagaaagaacaatggctgcgggaggaggtggcggcggcatcgccgacgggaaggcacccgaggcattcgggctgagccggcacgtggcggaggcggagatggaggaggagcacggcggtgctggtggcggcgagtcgagcgtcaagtcgaagctgtccgggctgctgtggcacggcgggtcggcgtacgacgcctggttcagctgcgcctccaaccaggtcgctcaggtgctcctgacgctcccctactcgttcgcccagctgggcatgctgagcggcatcctgttccagctcttctacggcctgatgggcagctggacggcgtacctgatcagcatcctgtacctggagtaccgcacccagaaggagcgcgacaaggtggacttccggaaccacgtgatccagtggttcgaggtgctggacgggctgctgggccggcactggcgcaacgccggcctcgccttcaactgcaccttcctcctgttcggctccgtcatccagctcatcggctgcgccagcaacatctactacgtgaacgaccggctggacaagcggacgtggacctacatcttcggcgcctactgcgccaccaccgtcttcatcccctccttccacaactaccgggtctggtccttcctggggctcgtcatgaccacctacaccgcctggtacatcgccgtcgcctcgctcgcccacggccaggtcgagggggtggcgcactcggggcccaccaggatcgtcctctacttcaccggcgccaccaacatcctctacaccttcggcgggcacgcagtcacagtggagatcatgcacgcgatgtggcgcccgcagaagttcaagtccatctacctgctggccacggtgtacgtgctgacgctgaccctgccgtccgccgccgccgcgtactgggcgttcggcgacgcgctgctcacccactccaacgcgctggcgctgctgccacgcacgcccttccgcgacgccgccgtggtgctcatgctcatccaccagttcatcaccttcgggttcgcgtgcaccccgctctacttcgtctgggagaagctcatcggcctccacgactgccgcagcctctgcaagcgcgccgccgccaggctccccgtcgtcgtgcccatctggttcctcgccatcatcttccccttcttcgggcccatcaactccgccgtcggctcgctcctcgtcagcttcaccgtctacatcatcccggcgctggcgcatatggtcaccttcaggtccccgcagtccagggagaacgcggtggagcggccaccgaggttcgccggagggtggaccggcgcgtacgtgatcaactccttcgtggtggcgtgggtgctggtggtcggcttcggcttcggtggctgggccagcattaccaacttcgtgcagcaggtcaacaccttcggcctcttcgccaagtgctaccagtgcctgccgcacctcgctggcccgccgccggctccattcgcgccgccgcccatggccccggcccccgccataccaccggcgacggtcttcaatgccaccaggttcttccctccggtcccagccccagctccggcgccgtcgccgatgatgaacttcttcctccgccatcaccaccacaggcaccacggccgccacggcctgtgatcgacatggccgcctcgatcaagttaatccggcagattagtatgtactccgttcaagtttgttgtagttgtagtgctagttgttgatgagcagcaaggttgtccaagatagccctagt

SEQ ID NO: 17135 - protein, 543 aa, Panicum virgatum
  misc_feature: Ceres CLONE 1791351
  misc_feature (54)..(448): Pfam Name: Aa_trans Pfam Description: Transmembrane amino acid transporter protein
MAAGGGGGGIADGKAPEAFGLSRHVAEAEMEEEHGGAGGGESSVKSKLSGLLWHGGSAYDAWFSCASNQVAQVLLTLPYSFAQLGMLSGILFQLFYGLMGSWTAYLISILYLEYRTQKERDKVDFRNHVIQWFEVLDGLLGRHWRNAGLAFNCTFLLFGSVIQLIGCASNIYYVNDRLDKRTWTYIFGAYCATTVFIPSFHNYRVWSFLGLVMTTYTAWYIAVASLAHGQVEGVAHSGPTRIVLYFTGATNILYTFGGHAVTVEIMHAMWRPQKFKSIYLLATVYVLTLTLPSAAAAYWAFGDALLTHSNALALLPRTPFRDAAVVLMLIHQFITFGFACTPLYFVWEKLIGLHDCRSLCKRAAARLPVVVPIWFLAIIFPFFGPINSAVGSLLVSFTVYIIPALAHMVTFRSPQSRENAVERPPRFAGGWTGAYVINSFVVAWVLVVGFGFGGWASITNFVQQVNTFGLFAKCYQCLPHLAGPPPAPFAPPPMAPAPAIPPATVFNATRFFPPVPAPAPAPSPMMNFFLRHHHHRHHGRHGL

SEQ ID NO: 17136 - DNA, 1709 bp, Panicum virgatum
  misc_feature: Ceres CLONE 1791352
  misc_feature: Encodes the peptide sequence at SEQ ID NO. 17137
gcgaagggagcggggggagtggagtatgccggcggcgatggcggcggatggattgccggtcgagccgcagtcgctgaagaagctgagcctgaagtcgctgaagcgctcgctggacctcttcgcccccgcccaatccctcctcttcgcgcccgacgccgagagcaagaggattcgcaccgggtgcaaggtgagggccgagtacggggcggtgaaggatccgcctgctgagcaggggcgcgggcagggcaaagggacttcggcgccgtctacatcgcttgcgttgccaggcacacaagatacaaaagatgctcacagagaaggcactagtaatgccattgtccctgcacctcttatgctaccaaaagcacctgaatctacaattcctggcaaaaatacaactttgtcaattcctggatcatctgacagattttctacatcggcactgatggaaaggataccaagtagatggccacggcctgtgtggcatgctccttggaagaactatcgggtcatcagtggtcacttgggttgggtgcgttctatagcgtttgatccgggcaatgagtggttctgtacaggttcagctgataggacaataaagatatgggatcttgcatcaggaacactgaagcttactctgactggtcatattgaacaagttcgtggacttgctgtcagccaacggcatacttatttattttctgctggtgatgacaaacaagtaaaatgttgggaccttgaacaaaacaaggttattaggtcttaccatgggcatctgagcggtgtttactgcctcgctctccatccaactattgatatattactgactggcggtcgagattcagtttgcagggtgtgggacatccggacgaaagcgcatgtttctgctttgacaggtcacgataacactgtctgttcagtgtttgcacgcccaacggatcctcaagttgtaactggctcacatgatacaactatcaaactctgggatcttgttgctgggaggactatgtgtactcttacacaccataagaagtctgttcgggctatggcattgcatccaaaggagaaatcatttgcatcagcatcagcggacaacgtaaagaagtttagccttcccaaaggagaattcctccacaacatgctgtctcagcagaaaactatcataaattctatggctgtaaatgaggatggtgtcatggcaactggagggaacaatggaagcctgtggttttgggactggaagagtggccataactttcaacaagagcagactatagttcaaccgggatcattggagagtgaggcatgcatatacgccctttcttacgatgtcagtggatctaggcttgtgacttgtgaggcagataaaactataaaaatgtggaaagaggatctaaccgcaacaccagaaacccatcccatcaacttcaaaccaccaaaggacatccggcgatattgattttcccaggctgcaagttacaggattgttgtagatgccctgattctgcccaaccgattagtttgctggacccagttcaaatttgggcgcactttcccctatccacgttgctggggatttatggatgatgaaccaaacatttccgtaactgtacaagtagatatgctgcagctgtagttatgctgaatttgtatcacttgacatgcctacttcaaatttgtggattaaacctaattttcttcggggagtt

SEQ ID NO: 17137 - protein, 477 aa, Panicum virgatum
  misc_feature: Ceres CLONE 1791352
  misc_feature (157)..(195): Pfam Name: WD40 Pfam Description: WD domain, G-beta repeat
  misc_feature (241)..(279): Pfam Name: WD40 Pfam Description: WD domain, G-beta repeat
  misc_feature (199)..(237): Pfam Name: WD40 Pfam Description: WD domain, G-beta repeat
  misc_feature (283)..(321): Pfam Name: WD40 Pfam Description: WD domain, G-beta repeat
  misc_feature: SWISSPROT Homolog: EC 2.7.11.7 [Myosin heavy-chain] kinase
MPAAMAADGLPVEPQSLKKLSLKSLKRSLDLFAPAQSLLFAPDAESKRIRTGCKVRAEYGAVKDPPAEQGRGQGKGTSAPSTSLALPGTQDTKDAHREGTSNAIVPAPLMLPKAPESTIPGKNTTLSIPGSSDRFSTSALMERIPSRWPRPVWHAPWKNYRVISGHLGWVRSIAFDPGNEWFCTGSADRTIKIWDLASGTLKLTLTGHIEQVRGLAVSQRHTYLFSAGDDKQVKCWDLEQNKVIRSYHGHLSGVYCLALHPTIDILLTGGRDSVCRVWDIRTKAHVSALTGHDNTVCSVFARPTDPQVVTGSHDTTIKLWDLVAGRTMCTLTHHKKSVRAMALHPKEKSFASASADNVKKFSLPKGEFLHNMLSQQKTIINSMAVNEDGVMATGGNNGSLWFWDWKSGHNFQQEQTIVQPGSLESEACIYALSYDVSGSRLVTCEADKTIKMWKEDLTATPETHPINFKPPKDIRRY

SEQ ID NO: 17138 - DNA, 1797 bp, Panicum virgatum
  misc_feature: Ceres CLONE 1791356
  misc_feature: Encodes the peptide sequence at SEQ ID NO. 17139
atataagagacacctctgctagggtagactcgcactacatagacacacagagagaggaaggacagccaaagaagacactcacaaatcacaatcgcaaggaacgaggaagcttgctcgcaaggcaccagggaggaagaagacaaccacgcactattattactatttctactgcttgtgctttcccagtgtgtccgcgcggagagaagcagacaagccagctgcggtagcaaaacggggcatggcttctcacggtagcttctactttgttcccttgctcctcctgctgatactcttgctcgcgtctcctcttcctactgctgcattgtactcatccaagcctgggagtggcgatgctggcaatgccactgctgctgctgctgctgctgctgcaaggctgaggccggggaaggagctgctcaagtacagcaggatcagggctctgctcaggaagctcaacaagccgtctctcaagaccatcaagagcccggatggtgacatcatagactgtgtaccctctcacctccagcctgcatttgaccacccaaagctcaagggacaaaagattctggatccaccggagaggccaaagaactgctacttcaccattagcggcagcggcagcggcagaggcaacgatgtggtggtgcaggcatggcatgctaccggcgaggcgtgcccggaaggcactgtgccgattcggcgaacgatggagaaggatctgctcagggcaagctccctaaggagatacggcaggaagaagccagtgcgccggggtgttcgccgtgattccacaagcagtagccatgagcatgcagttgggtatgtgaactctgagcagtactatggggccaaggccagtgttaatgtgtggtcaccaaggataggtgacccatctgagttcagcctgtcacaaatctgggtcatatctggctcttttggcaatgatctcaacaccattgaagctggatggcaggtaagccctgagctctatggggacagtaacccaagattcttcacctactggacaactgatgcgtatcaagaaaccgggtgctacaaccacaactgccgtggattcgtgcagacgacgaacaagattgcaattggggcggctattaccccgaaatcggtgtacaacggcagacagtttgacattactctgatgctatggaaggatccgaagcacgggcactggtggctacagctgggctcgggcctggtcgtcgggtactggccgtcctacctcttcacccacctggcgcggcacgccaacatggtgcagttcggcggcgaggtcgtcaacacccgaccgtcggggtcgcacacggcgacgcagatgggtagcggccacttcccaagcgagggcttcgaccgcgccgcctacttccggaacctccaggtggtggactgggacaacaaactcatcccggcggccagcctgaagctcctcgccgaccaccctggctgctacgacatccagggagggtccaacagctactgggggagctacttctactacggaggcccagggaggaacgtgaaatgcccctgagataaaaatcaggatcttgttttcgtttcgctgttttttgctctcttgtttgttttgtttgtttaatgttttttttctgttgggtccttttctgataggaagtatttgtttagcctttctaggatactttaggtcttagatctatcttttaactcaagagtgcatcaaaacattaagactcgagagagggacttgtaaatttaagagcacctgcccatatatgcatacttcgttcgttggtattc

SEQ ID NO: 17139 - protein, 437 aa, Panicum virgatum
  misc_feature: Ceres CLONE 1791356
  misc_feature: Useful for biocontainment applications
MASHGSFYFVPLLLLLILLLASPLPTAALYSSKPGSGDAGNATAAAAAAAARLRPGKELLKYSRIRALLRKLNKPSLKTIKSPDGDIIDCVPSHLQPAFDHPKLKGQKILDPPERPKNCYFTISGSGSGRGNDVVVQAWHATGEACPEGTVPIRRTMEKDLLRASSLRRYGRKKPVRRGVRRDSTSSSHEHAVGYVNSEQYYGAKASVNVWSPRIGDPSEFSLSQIWVISGSFGNDLNTIEAGWQVSPELYGDSNPRFFTYWTTDAYQETGCYNHNCRGFVQTTNKIAIGAAITPKSVYNGRQFDITLMLWKDPKHGHWWLQLGSGLVVGYWPSYLFTHLARHANMVQFGGEVVNTRPSGSHTATQMGSGHFPSEGFDRAAYFRNLQVVDWDNKLIPAASLKLLADHPGCYDIQGGSNSYWGSYFYYGGPGRNVKCP

SEQ ID NO: 17140 - DNA, 750 bp, Panicum virgatum
  misc_feature: Ceres CLONE 1791359
  misc_feature: Encodes the peptide sequence at SEQ ID NO. 17141
accagcaattgcatcgcgcacatctcgatcgaggcacgtaactaaccctgtgcatgcatgattgcaggctccatgtcttcggcgccggtgccgggcgccaccggcctcagcgagccgctgctcggcgacggcggcggcgacggcggagcgctgaccaaagtggtcgtggctactgcgctcgacggcaaagccaaagcgaacaagggttccgaggcgaaggacgggtactgggtggaggtgccccgacagctggacgcggcggcagcaacggcggcggacctggagagcggcagtggtgacggtggccggccgcgcgcgctgatgttccaggaaaagaaggtcaaggcatcacttctctacccgtacagggcattgattctgatacgcatcatcgcaatcatcttattcatcggatggcgcatcaagcacaacaactccgacgtcatgtggttctgggtaacctccgtcgtcgccgacgtctggtttaccttctcgtggctgctctaccagctccccaagctcaaccccatcaagagagtccctgacctcgccgtgctgcagcagcactacgacctccctgatggcagctccatcctcccaggcatcgacgtcttcgtcaccactgctgacccagtcgacgagccggtgttgtacaccatgaactgcgtcctctccatcctcgccgtcgactactccattgacaggtacgcgtgctacctgtccgatgacagtggcacgctgatcgagtac

SEQ ID NO: 17141 - protein, 225 aa, Panicum virgatum
  misc_feature: Ceres CLONE 1791359
  misc_feature: SWISSPROT Homolog: EC 2.4.1.12 Cellulose synthase (UDP-forming)
MSSAPVPGATGLSEPLLGDGGGDGGALTKVVVATALDGKAKANKGSEAKDGYWVEVPRQLDAAAATAADLESGSGDGGRPRALMFQEKKVKASLLYPYRALILIRIIAIILFIGWRIKHNNSDVMWFWVTSVVADVWFTFSWLLYQLPKLNPIKRVPDLAVLQQHYDLPDGSSILPGIDVFVTTADPVDEPVLYTMNCVLSILAVDYSIDRYACYLSDDSGTLIE

SEQ ID NO: 17142 - DNA, 642 bp, Panicum virgatum
  misc_feature: Ceres CLONE 1791359-R
  misc_feature: Encodes the peptide sequence at SEQ ID NO. 17143
agagtggccagggacatgggttgagccagcagagaaccatatgaaagggcatcatgcaggagttgttcaggttgtgctagagcatcctagtggtagtaagtcgcaacctgagctacaagtgagcagtgtgagcctactcaactttgacggcattgatgtacgcctcccaatgctcgtttacatggctcgtgcgaagagcccaaactacgaccacaacaagaaggcgggtaacttgaacgcaccgctgcgtgtatccgccctgctctcgaacgcgcccttcgtcatcaacttcgactgcgaccactacatcaacgactccaaatccctgcgagcagctatgtgcttcatgctggatgcaagggatggagacaacacggccttcgtccagttcccccagcgctttgagaacgtcgaccccacggaccggtacgacaatcacaacagggttttctttgatggcgccatgtacgccctcaatggcttccaggggccttcttatcttggcaccggctgcatgttccgccgcctcgccctctatggcatcgacccgccgagatggagatctgatgatattcaggtcgacactgtcatgttcggtaactctgttcccctcttgaaatcagtattagcagccttaaaccg

SEQ ID NO: 17143 - protein, 213 aa, Panicum virgatum
  misc_feature: Ceres CLONE 1791359-R
  misc_feature: SWISSPROT Homolog: EC 2.4.1.12 Cellulose synthase (UDP-forming)
  misc_feature: Useful for making plants with altered cell wall content and/or composition
  misc_feature: Useful for making plants with modulated biomass
EWPGTWVEPAENHMKGHHAGVVQVVLEHPSGSKSQPELQVSSVSLLNFDGIDVRLPMLVYMARAKSPNYDHNKKAGNLNAPLRVSALLSNAPFVINFDCDHYINDSKSLRAAMCFMLDARDGDNTAFVQFPQRFENVDPTDRYDNHNRVFFDGAMYALNGFQGPSYLGTGCMFRRLALYGIDPPRWRSDDIQVDTVMFGNSVPLLKSVLAALN

SEQ ID NO: 17144 - DNA, 1578 bp, Panicum virgatum
  misc_feature: Ceres CLONE 1791361
  misc_feature: Encodes the peptide sequence at SEQ ID NO. 17145
aacccaatttccatttgccctcaaaggcaggcaccaggcatccaccggtggcggccaaccaaccacccacccatccagtttcgatctattagttcctgctttgatctattagttcgtgctttctttacttggatctgttgattcccacgacccgtcagggttcggggatcccacggggccttggcgcccatcgtcgaagagccgcacttgtgtcgactcgctggcactaatgctgccgtctgatagttactcgtgagggaaactgttcgcgatgtggcattcttacataatgagcagatgtatgcagtagctcaaaaaaagtacccttacatatataatcgagatggtgtggaaattcattgtctgaaggaacatggcaaagcattgaaactccagtttctgcctaaacacttcctcttggcttcaataaacagctttgggcagctccactaccaagatgtgagcactggtgagatgattgcaaattacaggacaggtctggggcgaactgatgttatgcgggtcaatccctataatgctgtcataggcctcggacatgctggtggcaaagttaccatgtggaagccaacaagtgtgaaaccccaggtcaccatgctgtgccatcatggccctgtgactgctgttgcattcgacaggggtggccatcttatggcaacagcaggtgttgacaggaagataaaaatctgggacctgagaaagtatgaggttataaagtcgtatggagcgcgtgctcaatccttggatttcagccagaaggggctattggcctgcagcaacggatctcaagtagagatctacagggatttcggtgggcatgattataggctttacatgaagcacagaatgatgaagggctatcaggttgggaaagttttgttccggccctacgaagatattctggggattgagcactcgatgggcctttcgtccatccttgttccaggatccggtgaaccgaacttcgatacctttattgacaatcccatggagactaccaagcagaagcgggagaaggaaattcatgctctcctcgacaagctcccgccggacactatcatgcttaatccaaattcgatagccactgtcagagctccgaagaagaaagagaagaagaccaaggagattgaggaagagatggaagaggctattgaggccgcgaagaacactgagcacaagaagaagaccaagggcaggagcaagcccagcaagcgggccaagaagaaagaggaggatgttttcagagccaagaggcccttcttggagcaatcaaaggaggtcgacggacgagctgacaagaagcagcggataggcgaagccgtggaactcccaaaagccttgctgcggttttccaagaagccacaatcatgatcatggtatcacaaagagctggggtttcactgtggtttgtggtttgtaatgcatcattagtgaatctttatcaattagctggccaatatgtaaaatttctgcgtgaggaattggtgcacaagattgcgccaaaattttgttctaaaccgtgggcattccagtgagcatgaaccatagccctgtgtgccg

SEQ ID NO: 17145 - protein, 363 aa, Panicum virgatum
  misc_feature: Ceres CLONE 1791361
  misc_feature (184)..(264): Pfam Name: BING4CT Pfam Description: BING4CT (NUC141) domain
  misc_feature (100)..(138): Pfam Name: WD40 Pfam Description: WD domain, G-beta repeat
MYAVAQKKYPYIYNRDGVEIHCLKEHGKALKLQFLPKHFLLASINSFGQLHYQDVSTGEMIANYRTGLGRTDVMRVNPYNAVIGLGHAGGKVTMWKPTSVKPQVTMLCHHGPVTAVAFDRGGHLMATAGVDRKIKIWDLRKYEVIKSYGARAQSLDFSQKGLLACSNGSQVEIYRDFGGHDYRLYMKHRMMKGYQVGKVLFRPYEDILGIEHSMGLSSILVPGSGEPNFDTFIDNPMETTKQKREKEIHALLDKLPPDTIMLNPNSIATVRAPKKKEKKTKEIEEEMEEAIEAAKNTEHKKKTKGRSKPSKRAKKKEEDVFRAKRPFLEQSKEVDGRADKKQRIGEAVELPKALLRFSKKPQS

SEQ ID NO: 17146 - DNA, 627 bp, Panicum virgatum
  misc_feature: Ceres CLONE 1791365
  misc_feature: Encodes the peptide sequence at SEQ ID NO. 17147
atcaatccgttccctagtatagtacgaggtgtataattttttaagagatccttaatctcacagtaatccctccttccgggcaaaacctaaagtaggagcaccaaaatattcgccgcggcggcatagttgtggttgtttaggaggagaagacgaggttaaggggagatgagcgcgccggcaccggaggcggaggaggagaaggccgtccccaacgctgctggggcggggaaggggaaggaggtggcgccggtggccgcggcagcggcagcggaggccgggagggggcggttcgtgccacacccggcgccggtggctgaagatgcggacgtggtggcagacgccctgcgcttaacggcggcgctcgagagggtgcaggcagacatgggcaccagggtcaaggtgccaattatcgcagggaaagatttggatcttcatcagctatataaggaggttacatcaccgggtggtattgataacgtgaacggagagaatagatggagggaagtgactgcatcatttattttccctgccactgcgacgaatgcttcttttatgatgaagaaatactatatgtcaatattatattattatgagccggtctatttctttagagtgcagggctggtat

SEQ ID NO: 17147 - protein, 153 aa, Panicum virgatum
  misc_feature: Ceres CLONE 1791365
  misc_feature (52)..(149): Pfam Name: ARID Pfam Description: ARID/BRIGHT DNA binding domain
MSAPAPEAEEEKAVPNAAGAGKGKEVAPVAAAAAAEAGRGRFVPHPAPVAEDADVVADALRLTAALERVQADMGTRVKVPIIAGKDLDLHQLYKEVTSPGGIDNVNGENRWREVTASFIFPATATNASFMMKKYYMSILYYYEPVYFFRVQGW

SEQ ID NO: 17148 - DNA, 1837 bp, Panicum virgatum
  misc_feature: Ceres CLONE 1791370
  misc_feature: Encodes the peptide sequence at SEQ ID NO. 17149
cttccgtcttccctctcatattcaaaactcggctcctcctctaacagccgtcacctcgcctcactcgtgtgccttctcactctaccagcgtccgcccgccacccaggtccggcgatgggcaaggcggcgcggtggttccgcagcttcctgggcaagaaggagcaggccaaagaccagcagaggcgccagcgggaggaccaccagtcgctgcccccgccagccagcgccaagcgctggagcttcggcaagtcctcccgggacacggcggaggccgccgccgcccaggccgcgcccgtctcggccggcaacgcggcgatcgcgcgcgcggccgaggccgcgtggctccggtccgcggcctacgccgagacggaccgggagcgggagcagagcaagcacgccatcgccgtagccgcggccaccgcggcggcggcggacgcggccgtagcggcggcccaggcggccgtcgccgttgtacggctcaccagcaagggacgcgccgcggccgcgcccgtcctcgccaccgccggcgggcgcgccgccgccgccgtcaggatccagacggcgttccggggattcctggcgaagaaggcgttgcgcgcgctcaaggcgctggtgaagctgcaggcgctggtgcgcggctacctcgtgcgccggcaggcggccgccacgctccagagcatgcaggccctcgtccgcgcgcaggccgccgtgcgcgcgcgccgcgccggcgtccccgtcctcccgcagctccaccacccgcccgtccggccgcgctactcgctgcaagagcggtacgcggacgacacgcggagcgagcacggcgcggcggcgtacggcagccggcggctgtcggcgagcatcgagtcctcgtcgtacgggtacgacaggagccccaagatcgtggaggtggacccgggccggcccaagtcgcggtcgtcctcgcgccgggcgagctccccgctgctcgacgccggcagcagcggcggcgaggagtggtgcgccaactccgcgtgctcgccgctgccgtgctacctgtccgccgggccgccgcgcatcgccgtgccgacgtcgcgccagttcccggaccacgagtggtgcgcgctggagaaggcccggccggcgacggcgcagagcacgccgcggtacctgcacgtgcacgcgcacgcgccggcgaccccgaccaagtccgtggccggttactccccgtcgctccacggctgcccgaactacatgtcgagcacgcaggcatcggaggccaaggtgcggtcgcagagcgcgccgaagcagcggccggagctcgcctccgcctgcggcggcggcaatggcggcggcgcgcggaagcgggtgccgctgagcgatgtggtggtggtcgagtcgtcccgcgcgagcctgagcggcgtcgtgggaatgcagcgcgggtgcggcgccagggcgcagagggcgttcagcttcaagacggccgtcgtcggccgcatcgaccgcacgctggaggtggccggcgtcgagaacgacaggctggcgttcctgcagaggaggtggtgatgaggccagcagagcaggctcggtgcattggggtgccagcgagacgacgagagctttggggggagtaattagcaataagaatgcgttttcgtgtgttcttgcgagctctcgtccttttcgttcttcttgttcttgtgtgtttgcaatgtgatcaatcatgcaacttttgtgtttcttctctctgttttttttatgtttatttctggtaaacaagtgtatgaggaaaatttgattcatactgcacttgggatgtaaattcttgctcctatcatcaatgctcttcttcgatggtgtc

SEQ ID NO: 17149 - protein, 475 aa, Panicum virgatum
  misc_feature: Ceres CLONE 1791370
  misc_feature (141)..(161): Pfam Name: IQ Pfam Description: IQ calmodulin-binding motif
MGKAARWFRSFLGKKEQAKDQQRRQREDHQSLPPPASAKRWSFGKSSRDTAEAAAAQAAPVSAGNAAIARAAEAAWLRSAAYAETDREREQSKHAIAVAAATAAAADAAVAAAQAAVAVVRLTSKGRAAAAPVLATAGGRAAAAVRIQTAFRGFLAKKALRALKALVKLQALVRGYLVRRQAAATLQSMQALVRAQAAVRARRAGVPVLPQLHHPPVRPRYSLQERYADDTRSEHGAAAYGSRRLSASIESSSYGYDRSPKIVEVDPGRPKSRSSSRRASSPLLDAGSSGGEEWCANSACSPLPCYLSAGPPRIAVPTSRQFPDHEWCALEKARPATAQSTPRYLHVHAHAPATPTKSVAGYSPSLHGCPNYMSSTQASEAKVRSQSAPKQRPELASACGGGNGGGARKRVPLSDVVVVESSRASLSGVVGMQRGCGARAQRAFSFKTAVVGRIDRTLEVAGVENDRLAFLQRRW

SEQ ID NO: 17150 - DNA, 2744 bp, Panicum virgatum
  misc_feature: Ceres CLONE 1791387
  misc_feature: Encodes the peptide sequence at SEQ ID NO. 17151
gaactccgcgcgggcggctgttagtcccagcgtccgagcgagcaccccctgcgaaggaccggtctcctctcccggcgaaggaccggcgtccggctgctccggcaccggatgagcgaggaaggcggtttcttgggcgagctgcgggtcagtgtagcggcggagtagcggcctgactccatgatgttcggttcgaggaaggtggaggatgagatggcgctcacgaggcagaggaccgtcaggttccgtgatgagagggcaaaaccaactatacccatccaccagaagcagcaaggcctagctgctagcaggctaggcttgggaagttcaggggaaaacaagatttttgtttcaggagatgacttatggtacaacaaaattattgatccgtcaagtgatttcatcctgacatggacctatgttttccgtgtatcatgcttcattgctctattcatggaccctctgtatttctatgtgcccaaaatcttttatgccccaaccacttgtgctgggaaggatagacgcctgaccgtcatcgttactgtctttcgatcaattgccgacctcttttatgtcctacagatgataataaagttcagaacagcctatgttaatccgagctcaaaattaggggtttttggtcgaggagatcttgtcacagatccgaaggaaatcgcaaagcagtacctgagatctgactttatagttgatttagtggcttcattgccttttccacagatcatcatttcgtctgtgataccagctctcaaatattctttgtctgagcatagcaacgacatactgcttctggttgctcttgttcagtatattataagattatacctcatggtttccttgaataataaaatagtcaaaactactggagttttcgcaaagactgcttggcaaggagctgcctacaatcttctgttgtatatgattgctagccatgttgtaggagcactatggtacctgctagcctttgatcgccagatcacatgttggaaaaagtattgcaataatgagactgattgcgagactaggtatatggactgtggcgtacaacaagatctgaattggaatggaacctcagtcttttctatctgtgatgctaataatactgacaatcccaattatgactatggtatgttcgagtcattgttatacaacagaactcctaatcagagcttcctgaagaagtatttctattgcctttggtggggcttacagaatctaagttgttatggccagtcattgttggtgagtacctatcttggtgagacgctgtatgctatagtcgtggcggtggttggtcttgtcttgtttgcacatttgattggaaatgtccagacctacctgcaatcaatcactgcaagggttgaggagtggagattaaagcagagagatactgaagagtggatgagacatcgacaactgccccacgaattacgggagagggtgagaagatttattcattacaaatggcttgcaactcgaggtgtggatgaaaaatctatattgaaggctctgcctgcagatctttaccgtgacatcaagcgccacctttgcttgtatcttgttcgtcgagtcccacttttttcccagatggacgatcagcttctagacgccatatgtgagcgtcttgtatcctccttgagcacagagggaacatatattgtccgtgaaggagacctagtgactgagatgctatttatcattcgtggtaagctggaaagctccaccacagatggtggcaggacgggtttcttcaattcaatcactctcaaacctggtgatttctgcggcgaagagctccttggatgggctctcgtccccaagcctactgtcaacctgccatcatccactcgaacagttaaggcgattcttgaagtggaagcgtttgctcttcgagcagaggacctcaggtttgtcgccagccaattcaggcgcctccacagcaggaagctgcagcacacattcaggtactactctcaccactggaggacctgggctgcgtgctttatccagcatgcttggcgccgccacaagaggcggaagatggccaaggacctgaggatgagggagtcgttctcctccatgacatttaatgaagacgatgcctcccaggaacagaatctcaaactcatgagaggagtcagcatcatcaaggaactccctaagttcaggaagccttctgagccggacttctcagcagagcatgacgagtgagggatagctgcgtagctgatacacatacattatttggtaagggcaagatggctgtttctgctgtgaacagatcctacctcgttggtcttcctgcaaacacgcactggtttcaggctgacaagttactattgtggataaaactttctaacatctgggcaccaactaatataggcgaaacagctaagaagctgggtagtcagggtttcggtgtttgaaagaaatgagaagaaaagactgttatgttgtgaagtaacttatccgtagcgcattttcattggatatgcattcaaccgattgttcatactgtacgtacagatatagttgtgcttgtgcaatagggacctcaccttcgagtggaagattgctgtgttggctggccgagcaggatttgcgtcccttggccagggcttcaactattctttttttttaagtgtgtaaattgcagcgttaattgtttgttttagacctgtaacaccatacccggcttggttattcgttgtaaaatttgtggtcagatt

SEQ ID NO: 17151 - protein, 682 aa, Panicum virgatum
  misc_feature: Ceres CLONE 1791387
  misc_feature (123)..(389): Pfam Name: Ion_trans Pfam Description: Ion transport protein
  misc_feature (490)..(590): Pfam Name: cNMP_binding Pfam Description: Cyclic nucleotide-binding domain
MMFGSRKVEDEMALTRQRTVRFRDERAKPTIPIHQKQQGLAASRLGLGSSGENKIFVSGDDLWYNKIIDPSSDFILTWTYVFRVSCFIALFMDPLYFYVPKIFYAPTTCAGKDRRLTVIVTVFRSIADLFYVLQMIIKFRTAYVNPSSKLGVFGRGDLVTDPKEIAKQYLRSDFIVDLVASLPFPQIIISSVIPALKYSLSEHSNDILLLVALVQYIIRLYLMVSLNNKIVKTTGVFAKTAWQGAAYNLLLYMIASHVVGALWYLLAFDRQITCWKKYCNNETDCETRYMDCGVQQDLNWNGTSVFSICDANNTDNPNYDYGMFESLLYNRTPNQSFLKKYFYCLWWGLQNLSCYGQSLLVSTYLGETLYAIVVAVVGLVLFAHLIGNVQTYLQSITARVEEWRLKQRDTEEWMRHRQLPHELRERVRRFIHYKWLATRGVDEKSILKALPADLYRDIKRHLCLYLVRRVPLFSQMDDQLLDAICERLVSSLSTEGTYIVREGDLVTEMLFIIRGKLESSTTDGGRTGFFNSITLKPGDFCGEELLGWALVPKPTVNLPSSTRTVKAILEVEAFALRAEDLRFVASQFRRLHSRKLQHTFRYYSHHWRTWAACFIQHAWRRHKRRKMAKDLRMRESFSSMTFNEDDASQEQNLKLMRGVSIIKELPKFRKPSEPDFSAEHDE

SEQ ID NO: 17152 - DNA, 1680 bp, Panicum virgatum
  misc_feature: Ceres CLONE 1791396
  misc_feature: Encodes the peptide sequence at SEQ ID NO. 17153
gatgatttctaagacagctccaagcaactgcatataggcgagcgagcttacaaatacaacgccgcccatccccccaatgcccgccccgcccgccatagatcccaaaccctaaccctaggcggccgtccaggggcccttaaccgccggaagccggtggccggcgggcgacgcgatcgggcgccgacggccgaccgacgcgggagcagcgccgaggcgccgtcaggaagaagagaaaaaggcggggagcccgaaccccctacccgtgcggccgaggcgcggatcggggaagggagtggaggggtaaggaaggttgaggtgagcgaagcgagatgccgggcgacgctgcgacctcaccggcgccgccgccttcgtcagcgtcctcgtcctcgcactcgcagcaccaccaccatcacggccccgcatccgcccgcgggctcctgtgtcacgccgtcgccggcgcctccgctggtgtggtggcggcgacgttcgtgtgcccgctcgatgtcatcaagacgaggttccaggtgcacggctgtcccaagctagccacaggcacaattggaggtagtgtaattattgggaccttacaacagattgctcaacgggaaggttttcggggaatgtatcgtggcctctccccgactattctggcgctattgccaaactgggcggtctattttactgtatatgagcaactcaaaagcctactttcttccaatgatggaagtcaccaactctctttaggggcgaatgttgttgctgcatcatgtgcaggagctgcaacaagtattgcaacaaatccactttgggttgtgaagacaagatttcagacccaaggaataagagccgggccaatcctgtataaaggtactcttgctgccttgagaagaatagcacatgaggagggcatacgtggactatacagtggtctggtccctgccttggttggtgtcagtcatgttgctattcagttcccggcatatgagaagattaaagcttatctggcggagcgagataatacaactgttgaagcattgagttttggtgatgttgctgttgcttcatctctggctaaagtagctgcatcaactatgacatatcctcacgaggttgttcgttcaaggctgcaagaccagggagcacactcggatgctagatacaaaggtgtaatagactgcatcagaaaggtttattacaaagagggtgtggctggcttctaccgtggatgtgccacaaatctgttccggacaacccctgctgcagtgataactttcaccagctttgagatgatccacaggttcctccttgatctactccctcctgcacctggaccgcacatccagccactgaagcattgaccatacaataactgtaccctgtccatgctgccaatggaaattaggaagccagcccagtaagtaaccatccagcaatgctgttcaccaagccctcttgctcgtgtaaaagagagaattctttttcccggatatgcaataggtagctgccattcaaaagttgaaacttatagtgtaggcggggattagcatctttgtatgtaatagattcgttagcatgcatttgggaggtatatgtggtgatatgggtatgttgtcttgatgatgatgaaaaagaaaagaatttttccttctgatcaatgaataattacttattctctttcag

SEQ ID NO: 17153 - protein, 342 aa, Panicum virgatum
  misc_feature: Ceres CLONE 1791396
  misc_feature (237)..(329): Pfam Name: Mito_carr Pfam Description: Mitochondrial carrier protein
  misc_feature (137)..(229): Pfam Name: Mito_carr Pfam Description: Mitochondrial carrier protein
  misc_feature (35)..(131): Pfam Name: Mito_carr Pfam Description: Mitochondrial carrier protein
MPGDAATSPAPPPSSASSSSHSQHHHHHGPASARGLLCHAVAGASAGVVAATFVCPLDVIKTRFQVHGCPKLATGTIGGSVIIGTLQQIAQREGFRGMYRGLSPTILALLPNWAVYFTVYEQLKSLLSSNDGSHQLSLGANVVAASCAGAATSIATNPLWVVKTRFQTQGIRAGPILYKGTLAALRRIAHEEGIRGLYSGLVPALVGVSHVAIQFPAYEKIKAYLAERDNTTVEALSFGDVAVASSLAKVAASTMTYPHEVVRSRLQDQGAHSDARYKGVIDCIRKVYYKEGVAGFYRGCATNLFRTTPAAVITFTSFEMIHRFLLDLLPPAPGPHIQPLKH

SEQ ID NO: 17154 - DNA, 2546 bp, Panicum virgatum
  misc_feature: Ceres CLONE 1791402
  misc_feature: Encodes the peptide sequence at SEQ ID NO. 17155
ttcccttttctcgtcgaccctgctgcgctgcccccatctcctttcctctcgtctccgtctccgtctccgtctccatctcctcctccgccttccccacgccacgccgcattcgcatctccggatccccgccgccgccctccctcaccctcactctgcgtccctcgccattccggccaccaacctcgatcccgccccgattgcccgcgccccgattcgtctcagtctcgcgtgggtaggatatggcttggagcgggggctgctcgccccggcgcgggtgatctctcctcgcgcggggagccctctcgcgcaccacgcggagaatcccgtcgcggctggtgcgcccttctccctcctcctctgcgcgcgcgcccgcgcgcggctctagggtttgctctccttcctcgctagcggattcgatctccttccctcccctcccgctgctctgccatcatgttctcgcacggcgctgattccgcccacgactccggaggcgtcggcgtcagcaccgccggagccaccgtcccggcccgctttgtttggccctatggtggcaagagggtcttcgtatcaggctccttcaccaggtggtcagagcatttgcaaatgtctcctgttgaaggctgcccgaccgtatttcaggctatttgcagcctgtctccaggaatgcaccagtacaagttctttgtggacggggagtggcggcacgatgagcgccaacctactatatcaggagagtatggcatagttaacactgtatacttgacaagggaaataaactcagtattgagtccaagcacacccggaaccaggatggatgtggataatgaaaattttcaacgtatggttacgttgacagatggtaatattcaggacggtacacctagagtttcagaggctgctatacaaatctctaggtgccgtgtttctgagtatctgagtttgcatactggctatgatttgcttccagattcgggcaaggttattgctctggacattaatttacctgtgaagcaatctttccatattctgcatgaacagggaattcctgtagctcctctgtgggactcgttcagaggtcagtttgttggccttctgagcccattggatttcatactcatattgaaagagctagaaactcatggctcgaacttgacagaggagcagcttgaaacacacaccatatctgcatggaaagaggctaagcggcaaacttatggaagacatgatggtcagtggcgagcacatcaggctctagtgcatgccaccccttatgagtccttgagggacattgctctaaagatactgcaaaatggcatttctacagtgccagttatttattcatcatcgtcagatggatcattcccgcagctgttgcatctcgcatccctttctggaattttgaaatgtatttgtagatatttcaagaactcaactggtaatttgcctattctaaaccaaccagtatgcacaattcctctgggttcctgggttccaaaaattggtgatccaaacagtcgtccattggctatgttgcggcctcatgcatcacttagctctgcccttaacatgctggttcaagctggtgtcagctcaataccaattgtggatgaaaatgattcgctgcttgacacttactcgagaagtgacatcacagctctagcaaaagacaaggtctacacacatgttcgcttggaggagatgaccattcatcaggctttgcaacttggacaagatgccaatacaccatttggttttttcaacgggcagaggtgccagatgtgcctccggtctgatcctttgctgaaagtgatggagcgactgtctaatcctggggtgcggcgagtgttcattgtggaagctggcagcaaacgtgtggaaggcataatatcactgagtgatattttcaagttcttgctaagcttgtgagaagagcatggatgttttgttgtgacaagtgctggagttttaacagtagcaaacagcaggtgcggagcaagccgccatgcccatgccaaggacgaatggatctctctctctcactatctcaggctgcctctagcctgtggataagtatggcgggatttaaggtggcggcttgtctttgcagataatggccattcagttcagggtctgtaaagttccttgtttctctttttttttttgtgccccttgttacacaaaatatctggtgatttttatttattggattgttttctgtattgttgggtcgctgggagaccatggcgtccccagccgccagccagaccccaaggaggtagctcttcaactcccaaaaacactaggttgtagcgtcgtgttattgttccattccaatagtcgtgtgctgtgctgctggggactaggtgtggtggcatcaaacacaagagtgaattttacggggatcctggggactgggaaattgattttggagcgtgtgttggtttttggtggacaatcgttatatccgggcagcctggcagcaatgcaatgcaggcgactccctttgtttgatgaatcaacccaaccctgttgggattccttttgtc

SEQ ID NO: 17155 - protein, 491 aa, Panicum virgatum
  misc_feature: Ceres CLONE 1791402
  misc_feature (352)..(489): Pfam Name: CBS Pfam Description: CBS domain pair
MFSHGADSAHDSGGVGVSTAGATVPARFVWPYGGKRVFVSGSFTRWSEHLQMSPVEGCPTVFQAICSLSPGMHQYKFFVDGEWRHDERQPTISGEYGIVNTVYLTREINSVLSPSTPGTRMDVDNENFQRMVTLTDGNIQDGTPRVSEAAIQISRCRVSEYLSLHTGYDLLPDSGKVIALDINLPVKQSFHILHEQGIPVAPLWDSFRGQFVGLLSPLDFILILKELETHGSNLTEEQLETHTISAWKEAKRQTYGRHDGQWRAHQALVHATPYESLRDIALKILQNGISTVPVIYSSSSDGSFPQLLHLASLSGILKCICRYFKNSTGNLPILNQPVCTIPLGSWVPKIGDPNSRPLAMLRPHASLSSALNMLVQAGVSSIPIVDENDSLLDTYSRSDITALAKDKVYTHVRLEEMTIHQALQLGQDANTPFGFFNGQRCQMCLRSDPLLKVMERLSNPGVRRVFIVEAGSKRVEGIISLSDIFKFLLSL

SEQ ID NO: 17156 - DNA, 750 bp, Panicum virgatum
  misc_feature: Ceres CLONE 1791408
  misc_feature: Encodes the peptide sequence at SEQ ID NO. 17157
ggtcgctccccctcccaactcgacgcgcctctgaaagatcggagccgccgcccggtcctgcctccctctctcccccgcctccggcgcccaagggtaatagttttgaggtggtgatggcggaccaggtcaatcaaccaactgtccttcacaagctcggtggccagttccacctgagctccagcttctctgaaggtgtacgggcccgtaacatctgcccttctgtctcatcctatgaaaggagttttgccacaaggaattacatgacccagactctttggggcccttcaatgtccgtcagtggtggcatcaatgtcccggtggtttcatcctccccactttttgctaatgctccagctgagaaaggaggcaagaacttcatggttgatttcctcatgggtggtgtttcagctgctgtctcaaagactgctgctgctcccattgagcgtgtgaagctgcttattcagaaccaggatgagatgattaaggctggtaggctttctgagccatacaagggtattggtgactgcttcaagcgcaccatcaaggatgagggtttctcctccctgtggaggggtaacacagctaatgttattcgctacttccctactcaggctttgaactttgcgttcaaggactacttcaagaggctcttcaacttcaagaaggacagggatggttactggaagtggttcgctggcaaccttgcctctggtggtgctgctggtgcttcttccctgttttttgtttact

SEQ ID NO: 17157 - protein, 212 aa, Panicum virgatum
  misc_feature: Ceres CLONE 1791408
  misc_feature (87)..(184): Pfam Name: Mito_carr Pfam Description: Mitochondrial carrier protein
MADQVNQPTVLHKLGGQFHLSSSFSEGVRARNICPSVSSYERSFATRNYMTQTLWGPSMSVSGGINVPVVSSSPLFANAPAEKGGKNFMVDFLMGGVSAAVSKTAAAPIERVKLLIQNQDEMIKAGRLSEPYKGIGDCFKRTIKDEGFSSLWRGNTANVIRYFPTQALNFAFKDYFKRLFNFKKDRDGYWKWFAGNLASGGAAGASSLFFVY

SEQ ID NO: 17158 - DNA, 605 bp, Panicum virgatum
  misc_feature: Ceres CLONE 1791408-R
  misc_feature: Encodes the peptide sequence at SEQ ID NO. 17159
tgaggctgtgaagtacaagagctccttggatgcgttccagcagatcctgaagaaggaaggccccaagtcactgttcaagggtgctggtgccaacatcctccgtgccattgctggtgctggtgtgctctctggttatgaccagctccagatcctcttcttcgggaagaagtacggctccggcggtgcttaaatgaagaaaaaatgatgacgaacaagagcagtttgttgccggtcctgcccaatcaggatttggtgaagtttttgcctttcatataaaaaaaaaaataataattcatgaagagggaggattcttccaacattcgttttcggtggaggcttcgatctccaaacacaatcgtaactatcctagatatggtggcatcagtccccaaaaacatttgtcgtcataggttcagttgagtctgcccaactttatcagtcgggcaattttccttccatacattgccttcgatttaagtatcggatgagagtcaagttgatgcggttaaattttcttgttgcaatgcttaatgatgtcagtgattttgttcgtgatatcatttgcctttttttcgattacatacgaatgctgcatttctcttccc

SEQ ID NO: 17159 - protein, 62 aa, Panicum virgatum
  misc_feature: Ceres CLONE 1791408-R
  misc_feature (1)..(56): Pfam Name: Mito_carr Pfam Description: Mitochondrial carrier protein
EAVKYKSSLDAFQQILKKEGPKSLFKGAGANILRAIAGAGVLSGYDQLQILFFGKKYGSGGA

SEQ ID NO: 17160 - DNA, 1025 bp, Panicum virgatum
  misc_feature: Ceres CLONE 1791415
  misc_feature: Encodes the peptide sequence at SEQ ID NO. 17161
accagcttagctcgtcgtcactctcctcctcagtcctcaccacccacctaccactcccctcactgctaatagatagctcatctcagctcgtctttccttgctccagccagctccatccacccaactaaccatggagatgcgggtggcgctggccctgctcgtggtcgccgtggcggcgtcgcagctgccgtcggcggcggaggcggccaactacacggtgggcgacgacaagggctggaaccccgacgtggactacacggcctgggtcaagaagcacaagccattctacaagggggactggcttatcttcgagtaccagacggggcgtgcggacgtggtgcaggtgggcgaggtggggtacgacaagtgcgacaaggccggcgccctcagcagctacagcaagggcacctcctacgccttccagctcaaggaggccaaggactactacttcatctgcagctacggctactgctacaacggcatgaagctccacctcaccgccaagtcctcctccgccggcacctcctccggcaagcagtccggcagcggctcctccgatgattcctcctcttccgacgactcctccgacacgccctcgccatcctccaagaaggccaagcccaagtcgtcgtccagcgccgcgccgccgtccatcctcgccgccaccccctacgccgccattgctgccacaggcgccgccctgctccatctccacatgattgttctgtgactactctgatccattcagagatcaggcagaggtcgattattcagtcagatatatcttcagtggtgttcagttatgctctagtaccattcttccttttgctttctctcttcttcccctttaatacagatctcctctagctgctgctgctccttgattgcgtgattattgtttggttcttgcttccattttcctctcttttttctctacctctctctcaacttctagttttcttttcaagtggagtttggtaatgctgctactgtagtagtaatcgagttgttaagatgcgattttc

SEQ ID NO: 17161 - protein, 199 aa, Panicum virgatum
  misc_feature: Ceres CLONE 1791415
  misc_feature (36)..(118): Pfam Name: Cu_bind_like Pfam Description: Plastocyanin-like domain
MEMRVALALLVVAVAASQLPSAAEAANYTVGDDKGWNPDVDYTAWVKKHKPFYKGDWLIFEYQTGRADVVQVGEVGYDKCDKAGALSSYSKGTSYAFQLKEAKDYYFICSYGYCYNGMKLHLTAKSSSAGTSSGKQSGSGSSDDSSSSDDSSDTPSPSSKKAKPKSSSSAAPPSILAATPYAAIAATGAALLHLHMIVL

SEQ ID NO: 17162 - DNA, 1361 bp, Panicum virgatum
  misc_feature: Ceres CLONE 1791416
  misc_feature: Encodes the peptide sequence at SEQ ID NO. 17163
gtcgtccgctgcggctggggttggttgccgtggagcggcgggggttccatctctgcgccgcagcctgctccccgcccgccgcgccggttccgtctcctcccggtctcaagatgatcggttccctcgttaccggagctctaacccttgttcttggatatgcataccctgcctatgactgctacaagacagtggagctaaacaggcccgagatcgagcagttgcggttctggtgtcagtactggattttacttgcagttctcactgtactggagagagtcggggaaaatttcgtgtcatggttaccaatgtatagtgaagcaaagctggcatttatcgtgtacttgtggtatccaaagacacgtgggactgcctatgtgtacgagactttcttcaaaccatacatcgcaaaacatgaaactgagattgatcgaaatctgcttgagtttaggacaagagccggtgacatggcagttgtttacttccagagggttgcaaactatgtccagacaaggtcctatgaaatcttgcagtatattgcctcacagtcaccatctcaaagacctcgccctcagggacagcagcagcagcagcgcccacctccaccacggactcggcaggtgaaccctggacctccacctgttcccgcgccatcggctcctccgttgccaccacagcctgcccaagcccaagttcctccggcaccaccaaggcccccagttccagttgcccctcctggtgcagtgcctcccatccagccacaggcaccacctgctcctggagctgctgccaccaatggtcctcagaacaccgaagccatgcaagtcaacccaccccgtgtgtccacgagcagcgcaccgccaccactaccatctgaggagacgctcatcgaggaggcgatccggctgactcggggccggctcaggaggcgcatagctggaggatctggaccaccgccaaattagcatcgaccaaggtttcatctcgtgcaggtcactctacaccgggcttgttctattgctcaactgaaaagagatgggggaatgctgagttggttaaacagatttcggttccaagcattcgttcctatggcacaaactggaaccggtttggtgttgtttcacgacccaaatgtgaatagattcccaggagcagaagtggatttcgtgatgctcgtagatcagttcacaggatataactaggaactacgactgggcatcatatgttgcaaacatgtctgaagtgggcgggtgcggcatgtctgaacacctccggactgatctggtccttgaaccacaaaaaaatgtgcctgtactctatgcattagcaacggtgatagcactgaatacagtagtttggaatcc

SEQ ID NO: 17163 - protein, 283 aa, Panicum virgatum
  misc_feature: Ceres CLONE 1791416
  misc_feature (3)..(98): Pfam Name: TB2_DP1_HVA22 Pfam Description: TB2/DP1, HVA22 family
MIGSLVTGALTLVLGYAYPAYDCYKTVELNRPEIEQLRFWCQYWILLAVLTVLERVGENFVSWLPMYSEAKLAFIVYLWYPKTRGTAYVYETFFKPYIAKHETEIDRNLLEFRTRAGDMAVVYFQRVANYVQTRSYEILQYIASQSPSQRPRPQGQQQQQRPPPPRTRQVNPGPPPVPAPSAPPLPPQPAQAQVPPAPPRPPVPVAPPGAVPPIQPQAPPAPGAAATNGPQNTEAMQVNPPRVSTSSAPPPLPSEETLIEEAIRLTRGRLRRRIAGGSGPPPN

SEQ ID NO: 17164 - DNA, 1514 bp, Panicum virgatum
  misc_feature: Ceres CLONE 1791420
  misc_feature: Encodes the peptide sequence at SEQ ID NO. 17165
gagaatgtgaggccacacaaggggaggcttgggaaggagacacaggtgctgccaaggggcttgtggcgagcatgaacatgaggcaggtcttcgccatcgccattcttgccgccaccgctgcagcagtgctcttccttgggtctgagcctctgaggcgcaggaagtgaagcaggaccaccatacagagaggatctcaggcagcgccggtgatgttctggaagacgaccctgtcggccggctcaaggtctacgtctacgacctcccggcccgatacaacacggcgctgctggagaaggacccgaggtgcctgacacacatgttcgccgcggaggtgttcgtgcaccggtccctcctctccagcgccgtccgcaccctggaccccgaggaagccgactggttcttcgtgcccgtgtacaccacctgcgacctcacgtcctcgggccacccgatgcccttcgactcgccgcggatgatgcacggcgcgatccgcctcgtcgccgagcggtggccgcactggaaccgctccgagggcgccgaccacttcttcgtcacgccgcacgacttcggggcctgcttccacttcaaggaggagaaggcggtggcgcgcgggatcctgccgctgctccggcgcgccacgctggtgcagacgttcgggcagcggcggcacgcgtgcctcaagggcggctccatcaccgtcccgctgtacgcgccgccggcgcggatgaaggcgcggcgcctgccccccgggacgccgcgctccgttttcgcctacttccgggggctcttctacgacgccggcaacgaccccgagggcgggcgctacgcgaggggcgcccgcgcgtcggtgtgggagaacttccggagcagcccggtgttcgacatctcggcggagcgcccggcgacgtactacgaggacatgcagcgggcggtgttctgcctgtgcccgctggggtgggcgccgtggagcccccggctggtggaggcggtggtgttcggctgcatccccgtggtcatcgcggacggcatcgtgctgcccttcgccgacgccatcccgtgggcggacgtcggcgtgttcgtcgccgaggaggacgtgccgaggctggacaccatcctcacctccatcccgccggaggtggcgctgaggaagcagcggctcctcgccagcccggccgtgaagcgcgccgtgctgttcccgcagccggcgcagcccggggacgcgttccaccagatactcaacgggctcgcgcgcaagctcccgcacggcgacggcgtcttcctcaggcccgggcagacggtactcaactggacagctggcccgccgggggacctcaagccgtggtagatagctggttggtagccgtcaaattgccatggctgaattgacttcttttttttgtcttcttccgccatagaagatactagctgcgaactgttgtgatacgtacgtgaatgtccagcgtatgtgaatttcatagccaaaatttacagagatttttactcctggtacatgactc

SEQ ID NO: 17165 - protein, 341 aa, Panicum virgatum
  misc_feature: Ceres CLONE 1791420
  misc_feature (6)..(281): Pfam Name: Exostosin Pfam Description: Exostosin family
  misc_feature: Useful for making plants with altered carbohydrate content
  misc_feature: Useful for making plants with altered cell wall content and/or composition
MFAAEVFVHRSLLSSAVRTLDPEEADWFFVPVYTTCDLTSSGHPMPFDSPRMMHGAIRLVAERWPHWNRSEGADHFFVTPHDFGACFHFKEEKAVARGILPLLRRATLVQTFGQRRHACLKGGSITVPLYAPPARMKARRLPPGTPRSVFAYFRGLFYDAGNDPEGGRYARGARASVWENFRSSPVFDISAERPATYYEDMQRAVFCLCPLGWAPWSPRLVEAVVFGCIPVVIADGIVLPFADAIPWADVGVFVAEEDVPRLDTILTSIPPEVALRKQRLLASPAVKRAVLFPQPAQPGDAFHQILNGLARKLPHGDGVFLRPGQTVLNWTAGPPGDLKPW

SEQ ID NO: 17166 - DNA, 1901 bp, Panicum virgatum
  misc_feature: Ceres CLONE 1791427
  misc_feature: Encodes the peptide sequence at SEQ ID NO. 17167
aaacgccgcacggctcctctccgtctccggtgtcctcgacacgacccgctcctctcctcgtcgcccccgaatccgggccgccccacctcgtcgcccagagcccccagcccgtctcccgggcggcagttcctcgccggggtcgtggcctcgggcctcccctcctctccctccctcagaaaatatggatgggcaagtagagaactttgcggggcatgacgttggcgggatgcctggaaatccttacgatggagaacaaccaaacacatatgaggatgtggagaagcagtacggtgaagatctgggaaacacatatggcgaacaacctggtgcccagtacgatggtgggtccgggaatatgtacaatgaagaacaggcaaacttgtacagcaaggagaccgggaatcagtacaataaggagccggcaaattcttaccaggatgaagtgctggagaatgcgtacagtggggatgcgagtcaacaggaaaattcacaggttaatgttgaagataacagatggcctggttggccgggagagagtgtttttcgtatactagttccagcccagaaggtaggagctatcatcggtcgcaaaggggagtttatcaagaagatgtgcgaggagtccaaagcgcgcatcaaaatacttgatggcccacctggtgtaccagaaagagcagtaatgatttcagcaaaggatgaaccagatgcaccagtatctccagctattgatggcttactcagagttcataaaagaataactgatagttcagatggtgaatctggtcagcctcaaagaagtgctggtaatatcggaccaacacgacttctagtgccagcttcgcaagctggcagccttattggaaagcagggagcaactattaaatccatacaagattcttcaaagtctgctatacgtattgttgagaatgttcctcctgtcgcgttaaatgatgacagagttgtggagatacaaggtgagcctcttggtgtccacaaagcagtggaattgatagcaagtcacttaagaaagtttcttgttgaccgcagtgttcttccactatttgaaacacatatgaaaatgcacagtatgcagagggagcaaccaatgccacctccccagcattggggccctcctcaaccctggggccctcctccaaacctacttccaggtggtccaggttttggtggaaatccgcagttcatgcctccaaggccgcaagacaattattatcctcctcctgatgtcccccctgtgcctgtggaaaagcagccacactatggtatttctgcatatggacgtgaggccccacctagcggtgttcctgctgcaggaaatcaaccaccctctcatgcaggttctcaggtgacacataacatgcacattccccttgcctacgctgatgctgtgattggggcagctggtgctagtatcagctatatccgtaggcacagtggcgcaactgtaactattcaagaaagcagaggcgcacctggagagatgactgtggagataattgggactgcatcacaagttcaaaccgcccagcaactggtccagaatttcatggcagaagctgctcccccaggcccaccaccggcttctaaccctccagcaccgcccgtagttccgagctacgcatcttacccaccaccatatggaggtgctccgtcctatggttcttcggctgctgccgggccgcctcctaggtacaatggagggagctacggtggcccgacctaccctcccagctatggttattaggcagtagcagtaagccaagggtttgttttttatcttcttagggggttatggtaaggaatttgttgccgaataatgacaatgcagtgctgcatgccctcctgttaccttgtgtctgacaaagactatttacattagagac

SEQ ID NO: 17167 - protein, 526 aa, Panicum virgatum
  misc_feature: Ceres CLONE 1791427
  misc_feature (212)..(277): Pfam Name: KH_1 Pfam Description: KH domain
  misc_feature (120)..(182): Pfam Name: KH_1 Pfam Description: KH domain
  misc_feature (396)..(458): Pfam Name: KH_1 Pfam Description: KH domain
  misc_feature: Useful for making plants with modulated flowering time
MDGQVENFAGHDVGGMPGNPYDGEQPNTYEDVEKQYGEDLGNTYGEQPGAQYDGGSGNMYNEEQANLYSKETGNQYNKEPANSYQDEVLENAYSGDASQQENSQVNVEDNRWPGWPGESVFRILVPAQKVGAIIGRKGEFIKKMCEESKARIKILDGPPGVPERAVMISAKDEPDAPVSPAIDGLLRVHKRITDSSDGESGQPQRSAGNIGPTRLLVPASQAGSLIGKQGATIKSIQDSSKSAIRIVENVPPVALNDDRVVEIQGEPLGVHKAVELIASHLRKFLVDRSVLPLFETHMKMHSMQREQPMPPPQHWGPPQPWGPPPNLLPGGPGFGGNPQFMPPRPQDNYYPPPDVPPVPVEKQPHYGISAYGREAPPSGVPAAGNQPPSHAGSQVTHNMHIPLAYADAVIGAAGASISYIRRHSGATVTIQESRGAPGEMTVEIIGTASQVQTAQQLVQNFMAEAAPPGPPPASNPPAPPVVPSYASYPPPYGGAPSYGSSAAAGPPPRYNGGSYGGPTYPPSYGY

SEQ ID NO: 17168 - DNA, 645 bp, Panicum virgatum
  misc_feature: Ceres CLONE 1791433-R
  misc_feature: Encodes the peptide sequence at SEQ ID NO. 17169
cgccacaatgtcattcgaactggacttcgcaacatcagcatttcatactcaaggatctcccttgctgatattgccaagaagctcagactagactccgagaatcctgttgctgatgccgagagcattgtagccaaggccataagagatggtgcaattgacgccaccatagatcatgcgaatggctggatggtgtcaaaggaaactggcgatgtctactcgacgaatgagccgcagatcgcattcaactcaaggattgctttctgcctgaacatgcacaatgaggcggtcaaggcgatgaggttcccccctaattctcacaaggaaaaggagagcgcggagaagcgtcgtgagaggcttcagcaggaggaagaattggcaaaacacatggccgaggaggatgatgacgatttctaagttagctgcctttgagcagacaatgtgtggctgctcgattagggatggccaaggttgaaagcatttcctccgactccagtcatgcagacattaaagtttgaattcatctgctgtaacttttatggtgaccagattttgtattaactccatgaatgcctctgctaggccatttacgtttcgccctcccagaactgttggaatggagaatttgcctacaatgcaaggattttc

SEQ ID NO: 17169 - protein, 137 aa, Panicum virgatum
  misc_feature: Ceres CLONE 1791433-R
  misc_feature (70)..(136): Pfam Name: Rpn3_C Pfam Description: Proteasome regulatory subunit C-terminal
  misc_feature (1)..(67): Pfam Name: PCI Pfam Description: PCI domain
RHNVIRTGLRNISISYSRISLADIAKKLRLDSENPVADAESIVAKAIRDGAIDATIDHANGWMVSKETGDVYSTNEPQIAFNSRIAFCLNMHNEAVKAMRFPPNSHKEKESAEKRRERLQQEEELAKHMAEEDDDDF

SEQ ID NO: 17170 - DNA, 712 bp, Panicum virgatum
  misc_feature: Ceres CLONE 1791433
accgatccgccaccacaccacatcctccgcgtcggctcctcctactccccgccgccgccgccgccacgatgccggaagacgtgcagatgaacgaatcggagccccagccggcggcccctcctcccgccgcggcgccggcgctctccaccctccaccatctgaaggagatcgcgtccgtgatcgaggccggctccctgtccaaggaggtccgccggatctcccgcgccttccgcctcaccgtcgcgctccgccgccgcctcgccgcgcgggacgtctccgccttcctcggcttcgcgctccccgcgtcctctgaggcctacgctcgcctcaccgccctggtgcccaaggaagatgatactgagatggatgttgatgctgcggctccaacaacacagatttcaatcaagcatggtctccctgaaattgaaatatattgctacttgcttgtcctgattttccttattgatcaaaataagtatgatgaggctaaagcatgcgcaactgcgagcattgctcgtctgaagaacttgaaccggagaactgttgatgttttggcttctcgtctgtacttttattactccaatgtgtatgagcttaccaaccgccttgctgaaatccgtgggaatcttctcgcattgcacaggatggcaactttgcaccgtgatgagcttggccaggaaactctgctcaatctcctcctccgcatttacct

SEQ ID NO: 17171 - DNA, 1956 bp, Panicum virgatum
  misc_feature: Ceres CLONE 1791449
  misc_feature: Encodes the peptide sequence at SEQ ID NO. 17172
aaaccagcgcccgcctctaaccagttattaacgcctcccccctcccttccgttcccctcctccctcccccttccttcctcctctccgcattcccggccagggggacgcgacattgacgcctccgccgagctttggggatgactggcagtagaagggtccaagcctcaggctatcaattgtactgtcctggttggaattgcctggacagctggattgcaagtctgtgtccacgttaaagtcttctagtggaggataccatactgctatatcgactgaattgttctttgaagcttaggtagtgggatgttcaatggttattctgagaaatgaccaatggtttactaactagtgttcattaattgagtggtgaaacatgcggtggaaacgaaagatacatcatggaggaccatctaaacaacaacaggtcagtccacttgcggatgaagtatgtgccattgacaaggaggtttcccatctgtgtagaattaaatctgaaccaagtcagaggactcgtgcatccatttatgctggccagaagagacctgtctctacattcaagctattatctgggagagaatccaattgctcggggatgggcaggttctcttcagctgattgctcttatgctcttcagaaacacctaccagtgaaaggcccatggtgtgtggatgacatggatagtgaagcttacatctcacagttctctgcagatggttcacttttaattggtgggttccggggaagccacatcagagtctataactccgaaaaaaattggaaggttcataaagatataacctgcaaacgtctgcgctggacaatttcagatattgctctctcacctgatcaacagttcctggcttattctagtttgtcgcctactgttcacattgtaaatgtccagaatgctgtaagggaatcacatgctaacattacagaaattcatgagggtctggagttttctgacgatgatgacgaattctcctttgggatattctctgtaaaattctcaaaagatgggcgagaacttgttgtgggaaacaacaatgaatcaatatgtatttatgatcttggagcaaacaaagtaacagaacgcattaatgcacatgtggctgatgtcaatgtggtcaccttcgctgatgaaacaagtgatatcttgtactctggaagtgatgatagcctttgtaaggtttgggataggcgctgccacaagaaacaaaaaccagtaggtgttttgaccggtcatttagatgggattacatttattgatagccgtggagatgggcactattttatctcaaactgcaaggatcagactattaaattatgggatctcaggaaaatgtcctccactacaaaagactgcacacctaaagcgtatgaatgggattacagatggatgacatacccgtcagaagcccgatatttgaagcatccatatgatcagtcactagccacattcagaggccattctgtattgcgcacacttatccgttgttatttttcaccaatgcacagcacggggcagaggtacatatacacaggatccagtgaccaatgtgtctatatttatgatgtggcgacaggtaaggttgttgaaaaactgagatggcacgggtccatcattagagactgctcatggcacccgtacctccccacacttgtcagctcttcttgggacggctatttggtccggtgggaggcaacagaggatgacagagacccctccatgctcaggacagggaagcagaggatgcatccagagggatacacaatgtcgtttgtcctttagaagtgaagcttcgtttgtccttcagaagtgaagctctctagggtctcttgtggctccacttgttcaccttgcaggctccacaagcctctggctcgaaaaagtcctttttcttttcaaaatttcgtgctgtataaaagtgatcaagattgaattgttgaggcggt

SEQ ID NO: 17172 - protein, 472 aa, Panicum virgatum
  misc_feature: Ceres CLONE 1791449
  misc_feature (282)..(320): Pfam Name: WD40 Pfam Description: WD domain, G-beta repeat
  misc_feature (405)..(443): Pfam Name: WD40 Pfam Description: WD domain, G-beta repeat
  misc_feature (236)..(275): Pfam Name: WD40 Pfam Description: WD domain, G-beta repeat
  misc_feature: SWISSPROT Homolog: EC 2.3.1.48 Histone acetyltransferase
MRWKRKIHHGGPSKQQQVSPLADEVCAIDKEVSHLCRIKSEPSQRTRASIYAGQKRPVSTFKLLSGRESNCSGMGRFSSADCSYALQKHLPVKGPWCVDDMDSEAYISQFSADGSLLIGGFRGSHIRVYNSEKNWKVHKDITCKRLRWTISDIALSPDQQFLAYSSLSPTVHIVNVQNAVRESHANITEIHEGLEFSDDDDEFSFGIFSVKFSKDGRELVVGNNNESICIYDLGANKVTERINAHVADVNVVTFADETSDILYSGSDDSLCKVWDRRCHKKQKPVGVLTGHLDGITFIDSRGDGHYFISNCKDQTIKLWDLRKMSSTTKDCTPKAYEWDYRWMTYPSEARYLKHPYDQSLATFRGHSVLRTLIRCYFSPMHSTGQRYIYTGSSDQCVYIYDVATGKVVEKLRWHGSIIRDCSWHPYLPTLVSSSWDGYLVRWEATEDDRDPSMLRTGKQRMHPEGYTMSFVL

SEQ ID NO: 17173 - DNA, 1361 bp, Panicum virgatum
  misc_feature: Ceres CLONE 1791455
  misc_feature: Encodes the peptide sequence at SEQ ID NO. 17174
gtctctcccaaaacacaccccctccctcgccgcagacccgcagtcactgagccaagaacgagcagcgcgatgagaggaggagcggggcccacggtggcgtttatcgccggcgacccgcctccggatgcggcggcggaggaggaggtggaggacgacgagctggagctggggctctgcctaggctccaagaagcagcagcagcagcagcagcagcccccatcgccagcgccgtgccggatcctgacggccagggacctgcagccgggggccctgtctccggactcctccgtgtcctcctcctcccccgcagcaggggcagcggcggccagcaagagggccaaggcggatacagcgcccaacgccaccatctcgccggggacggtcgcttctggccacccacagagctttggagtggtgggatggccacccataagaactttcaggatgaacagcctattcaaccaggccaaagacaatgcttcagaggctagcaccaagaaggccgctgatgaatctgacatgcagaaagacaaggagagcgagaagaaagggcgggttgtcggttgggtgaaggtgaacatggatggagatatcattggaaggaaggtcgatcttaacgcccatcgttcgtataagactcttgcctcagcacttgagctgatgttcatgaagccatccatcagtctttacacttctagtagtgcaaagtctctgaatctattggacagctcatcggaatatcagctcacctatgaggactgggatggggattggatgctcgtcggagatgttccatgggagatgtttgtaggttcagtgaagaggctcaagatcatgagggcatcagatgctaatggtctgggttagattcttcgctctctcttcttcaacccaggcatagtaaaacatttgaaggtctgcgattccaaggggttcacagagctgcagctttcacaagagctagaacttgagaagcactgatggcgttcgatctagagagctataccactggtgaagcttgaaatttgtttcatatcacataacagcagtccgtatctttggcatagttgtgagattacttgtgtctagtggaaatagtagaagcgctgtgaaggagccacaccaccgtgttctattctattctttttacttgcccttcggtgccctctttcagggctcttctcatggctatgagcatcctccccgtctcttctgtccacactgtttttatctgaggcatggtcgcccaaagtgtcggtttttctttttttttccccttttgtgctgtggcaatagtatttgttccacttgtttcatattcatgtttatatctgaatggatgtgcaaattgttgcggtctc

SEQ ID NO: 17174 - protein, 265 aa, Panicum virgatum
  misc_feature: Ceres CLONE 1791455
  misc_feature (25)..(265): Pfam Name: AUX_IAA Pfam Description: AUX/IAA family
  misc_feature: The sequence is a functional homolog of SEQ ID NO 1149 in the 10/412,699 US patent application
  misc_feature: The sequence is a functional homolog of SEQ ID NO 742 in the 10/374,780 US patent application
  misc_feature: The sequence is a functional homolog of SEQ ID NO 1780 in the 10/412,699 US patent application
  misc_feature: The sequence is a functional homolog of SEQ ID NO 2008 in the 10/374,780 US patent application
  misc_feature: The sequence is a functional homolog of SEQ ID NO 678 in the 11/479,226 US patent application
MRGGAGPTVAFIAGDPPPDAAAEEEVEDDELELGLCLGSKKQQQQQQQPPSPAPCRILTARDLQPGALSPDSSVSSSSPAAGAAAASKRAKADTAPNATISPGTVASGHPQSFGVVGWPPIRTFRMNSLFNQAKDNASEASTKKAADESDMQKDKESEKKGRVVGWVKVNMDGDIIGRKVDLNAHRSYKTLASALELMFMKPSISLYTSSSAKSLNLLDSSSEYQLTYEDWDGDWMLVGDVPWEMFVGSVKRLKIMRASDANGLG

SEQ ID NO: 17175 - DNA, 1574 bp, Panicum virgatum
  misc_feature: Ceres CLONE 1791459
  misc_feature: Encodes the peptide sequence at SEQ ID NO. 17176
aagtaaatccggtgccagctgtcttcgttcggtgcgcaggcaggcagcacgcagcagtgctgcagctttgtctgaacaccacctgttcgacggaatgtccctgtgaaccgactccatggcggaggcttccggagacgcgcgggcggtctcggagggcgttgccggcgccgcgtgcaggatcaacgccctccccagccacgtcctcagccgcgccatctccttcctggacgcacgccagctcgtgcagacgtgcgtgctgtcgcggcggtggcgccacctctggcgctccgtgcctcggatcagcttctcgcgcgatgagttcgacggcatggctgagaccgaggacgagtgcgacgtgctgttcaaggagttcgtcaaccgcttcttgatgctccgtaaccctgcttccttggacgagttccggcttcagtacaacatacctgatgcgtcagatgaccttgaggccgacgcgaaagatgctaacctatggatccaccatgctttacagagcaatgcccggtctgttgaggttttcggtggggtcaatgacttgctgatcgatcctggggtgtttacttcaaactgctgcttcgtgacaagcatgctgctttgccttgctttgctggaaccacctttctttagaagcctccaaacaggctgcccagtattggaacgtctcatcttacaatgctgcaccatttatgaccctgacatttcctcccacacactgaaggttctgaccttggatggagagtgtcactgcacgtttgaaggacgggccactatttctattccaagcctcgttgaacttcgcttctttcctgacggtgcaagaatacctctactgaaaaatatggaatcactagtgaaagcatcggttcttgtcggtactgatccttctgaggttgatgatatctgtcagtttctgaggagcctttctggtgttactcatttgaaattccatggcaaaggattcaagctggagatggaacagaatttacaatggtggccaaaattcaacaatcttacaaccctgacacttggtaaccgttgtctgtatggagacttctatccactgatattcttccttcagaactcacctaatctggagcagcttactttggaactcatgcagagattccggcagatcgatctggaccaaacattcataggcgaccctgaagaaagatcgtttacttgtgagcaccttgtgatggttgatattgtttttaaatattatggctcgcagccaaagggtttggatgatgatgctgtgctgaacaacctgctgaaacatttgtacaataatggcgtaacccctgatcagattttcatcaaggacagaatcattcgttcaattgtgtctggttgaacatgatgtatgtcttggtaaaaaaactgttgccaaggcatgtttgctagagcaactatgttagatgtttgaagaacctttgattttgtacttgtagaagttgttatgttgaccagagctccaatgtctatgctatggcaaacttctgtgcttttatcatgtgggaatgctattgccaaagtaaataattccaattttctgc

SEQ ID NO: 17176 - protein, 418 aa, Panicum virgatum
  misc_feature: Ceres CLONE 1791459
  misc_feature (20)..(67): Pfam Name: F-box Pfam Description: F-box domain
MAEASGDARAVSEGVAGAACRINALPSHVLSRAISFLDARQLVQTCVLSRRWRHLWRSVPRISFSRDEFDGMAETEDECDVLFKEFVNRFLMLRNPASLDEFRLQYNIPDASDDLEADAKDANLWIHHALQSNARSVEVFGGVNDLLIDPGVFTSNCCFVTSMLLCLALLEPPFFRSLQTGCPVLERLILQCCTIYDPDISSHTLKVLTLDGECHCTFEGRATISIPSLVELRFFPDGARIPLLKNMESLVKASVLVGTDPSEVDDICQFLRSLSGVTHLKFHGKGFKLEMEQNLQWWPKFNNLTTLTLGNRCLYGDFYPLIFFLQNSPNLEQLTLELMQRFRQIDLDQTFIGDPEERSFTCEHLVMVDIVFKYYGSQPKGLDDDAVLNNLLKHLYNNGVTPDQIFIKDRIIRSIVSG

SEQ ID NO: 17177 - DNA, 2083 bp, Panicum virgatum
  misc_feature: Ceres CLONE 1791461
  misc_feature: Encodes the peptide sequence at SEQ ID NO. 17178
gccaccagctgccgctggtaaaaaaaaaatatcaatcacgctgctgatcgatgatctcctctcctctcctttcttccctccccacgtcaaaccaaggacgcccttgaaagcggataggaggcaaagggcactgaaccaaacagcctctctgtattgctgtcctgcaaaggcgcgacggtgaggcgcttcttgttactctcctcctccaacctcttcgctccccccatgaattccagcaggagcctcctctcgtcgcccctctttgcaagctcatctccaaacttcaggagcaatacttctatcccttccccgtccccatcacgaacctcagttcccatgatacatgacaacaccggaagagcatcgacgtcgtgccactactcaccgtcgcttgtagcagaagagcagcttcatggttccaaggatgcatcaaccttgaagggtgaaaaggctttgcttgagctgctgctcgacatagctctggaccagcatgtcaacggaaagaagctcattagtcaagagacagaagatagtgattttgagagctatttaagagatgcaacaagccgattgctttaccagccagcatttattgaagggggtgattctacttcacaaagctcttcagcatcaactgcggaaccagttgggagtttggaccttggcgcaccttcaatgacaccgacagaggaggtgatgtcgccagcagaagaatcgagcacttcacccacccagttggatgtaccacagcttcaccgtgtggacccaggcctctcatatgaggaactgctgggcaacggtcaggtgttcgttaggtccaaaaggttacttgagaggagatcaaagaaacgtaaggttcccagagcatcaagtaatgacgctctatgcagtgttgtcaactcaaagaagaaagagaagccaaagaagtttggcagagttcttgaaccagatgcgccttttaagttgtttctgcgggatcgcgagacgacagaattcttgacagcaaaagaggagaagcaaatgttcagtcaaatacagaatcttatgaaactagaggaggctcagcgcaaattagaagttcaatgcggccgtgagccgacagttggagagtgggctgaagctgtaggaatgagctgcagggagttgcagtcctctattcgtattggaagaagatgccgagagaagatggctcgctccaacttccgtcttgtgatacatgtagccaggaaatacgagggatatggtcttgacattcaggacctagttcaggatggatgctgtgggttgatgaagacctttgagaaattcaatccaagcaaggggtgtagattcccgacctacgcatactggtggatacgccaatcaattaaaaagtccattttcaagaattcaaggctaatccgattgccggagagtgtgtttgcgcttttgaggaaagtcgggaaagcaaggctggagtgcataatggaaggggagcagcccacaaatgaaaacgtggcaaggcgtgctggcatcacaattgagaagctggcaagactgagagcaaagaccagaaaaccacggtcgatgcaagaccgggtttggtcagatgacggtgtcacataccaggagatcacagaggaccccaacgttgagcccccggagctgagcgtggacaggctgatgatgaggcagcaggtccgcaacttcctggggatcctgaaccccagggagaaggagatcatcgagcaccgcttcggaatccgcgacggggagcccaagacacttcatgtgatcggcgacatgtacgggctgtcaaaggagaggatccggcaggtgcagaacaaagcactggacaagctgaaaaggagcgtatcggcacaggggtttgacgtttactttgatttgctaacgtgaagatcagaggccagaaaaaacttggtttccattccattgttgatgttgataccccctccccccacccaaaaaaaaatacaaagggattttagcagcaggtagacttgtatacgcccccaaattaaagccagtgaatgaccatgaccatgtaaaggaagcaaaaataatgcagtatttcttgtgctgt

SEQ ID NO: 17178 - protein, 519 aa, Panicum virgatum
  misc_feature: Ceres CLONE 1791461
  misc_feature (284)..(354): Pfam Name: Sigma70_r2 Pfam Description: Sigma-70 region 2
  misc_feature (451)..(504): Pfam Name: Sigma70_r4 Pfam Description: Sigma-70, region 4
  misc_feature (358)..(439): Pfam Name: Sigma70_r3 Pfam Description: Sigma-70 region 3
MIHDNTGRASTSCHYSPSLVAEEQLHGSKDASTLKGEKALLELLLDIALDQHVNGKKLISQETEDSDFESYLRDATSRLLYQPAFIEGGDSTSQSSSASTAEPVGSLDLGAPSMTPTEEVMSPAEESSTSPTQLDVPQLHRVDPGLSYEELLGNGQVFVRSKRLLERRSKKRKVPRASSNDALCSVVNSKKKEKPKKFGRVLEPDAPFKLFLRDRETTEFLTAKEEKQMFSQIQNLMKLEEAQRKLEVQCGREPTVGEWAEAVGMSCRELQSSIRIGRRCREKMARSNFRLVIHVARKYEGYGLDIQDLVQDGCCGLMKTFEKFNPSKGCRFPTYAYWWIRQSIKKSIFKNSRLIRLPESVFALLRKVGKARLECIMEGEQPTNENVARRAGITIEKLARLRAKTRKPRSMQDRVWSDDGVTYQEITEDPNVEPPELSVDRLMMRQQVRNFLGILNPREKEIIEHRFGIRDGEPKTLHVIGDMYGLSKERIRQVQNKALDKLKRSVSAQGFDVYFDLLT

SEQ ID NO: 17179 - DNA, 545 bp, Panicum virgatum
  misc_feature: Ceres CLONE 1791465
  misc_feature: Encodes the peptide sequence at SEQ ID NO. 17180
cccgtcggattctgtctcgaggatggatttccctcacgcggcggtgtcgccgatctggttcgcccgcagggagttcgtgaagaagaactacggggacatcaagtcgcgcaacccatccctccccttcctcgtgcgcgagtgctccggcgtccagccccagctctgggcgcgatacgaaatgggtgtggagagatgtgtgaacttggatggcctgacggaaccgcagattgataagaagctcgaggaacttgccaaggctggagaatctgccaaagccaagtaatgttggagttcctacaatctctcgccgtaatgttcacgaataagtgaaactttagcagtgagtttcgtgttgtcatgacttcggtgctaagaatgaaatgaagtcttgggtttgtataacttaatgcgagaaagatagactgttattcacatgtttgctacgcattcttcttgagtttatgcatattacattggtttaccagtactatatactgcatagttctgtactgtattcttttatatttcctgaattagaagttgcc

SEQ ID NO: 17180 - protein, 86 aa, Panicum virgatum
  misc_feature: Ceres CLONE 1791465
  misc_feature (7)..(80): Pfam Name: L51_S25_CI-B8 Pfam Description: Mitochondrial ribosomal protein L51 / S25 / CI-B8 domain
MDFPHAAVSPIWFARREFVKKNYGDIKSRNPSLPFLVRECSGVQPQLWARYEMGVERCVNLDGLTEPQIDKKLEELAKAGESAKAK

SEQ ID NO: 17181 - DNA, 721 bp, Panicum virgatum
  misc_feature: Ceres CLONE 1791466
  misc_feature: Encodes the peptide sequence at SEQ ID NO. 17182
acctcgatcgatccccatccatcgccgtggcgcacgaaactttcctctcccccgtaccagctatttgacgcggcaagggtgccaagccatggataagggtctcttcgccaacgacggctccttcatggagaggttcaagcagatgcagcaggagcaggagaaggccgccaccgccgccgcctcatcggcggcgcccaagcctgcgaaccccaaacaggggtttgctgtggcggcgaacaagaggccgtttgagctgaagaaggccggaccagtcgccacgggtggcaagctggccttcagcctcaagaaggccaaggtcgcaattgcgcctgttttcgcgcccgaagatgaagaggaggatgcggcagatgtcgacagggaggagcctgccaagcgccagaaatctgtgaaagctgatactcctgcggtggctgccccgaccggggctgttgcccccccaccaccaaatgatatgacagtgaggcaagttgctgacaaattagctagctttgttgccaaaaatgggagacagtttgagaatattacacggcaaaggaatcctggagatacaccattcaagtttctatttgacaagcactgtccagactacagatattatgagtttcgccttgctgaagaggaaaagattcttgcccaatcaaaggaggctgaagcatcaagaaatgcaaacaatgcaagctccaaagcacccgattgggct

SEQ ID NO: 17182 - protein, 210 aa, Panicum virgatum
  misc_feature: Ceres CLONE 1791466
  misc_feature (135)..(180): Pfam Name: Surp Pfam Description: Surp module
MDKGLFANDGSFMERFKQMQQEQEKAATAAASSAAPKPANPKQGFAVAANKRPFELKKAGPVATGGKLAFSLKKAKVAIAPVFAPEDEEEDAADVDREEPAKRQKSVKADTPAVAAPTGAVAPPPPNDMTVRQVADKLASFVAKNGRQFENITRQRNPGDTPFKFLFDKHCPDYRYYEFRLAEEEKILAQSKEAEASRNANNASSKAPDW

SEQ ID NO: 17183 - DNA, 685 bp, Panicum virgatum
  misc_feature: Ceres CLONE 1791466-R
  misc_feature: Encodes the peptide sequence at SEQ ID NO. 17184
taccaaagaagctgccgagaaggctaagattcaagcagacaatattgggcacaaacttctatctaagatgggctggcgggaaggtgagggccttggtagcgagagaagaggccgtgcggatcccattatggctggagatgtgaagaaggatcatcttggtgttggtgctgtccagcctggtgaggtcacatctgaagatgacatttacgagcaatacaagaagcgaatgatgcttggctaccgttatagaccaaacccactgaacaatccaaggaaagcatactactgatgcaagcgagttcatctggggggagatgtaaggcaccaatttttgctgcatttttgctcacagaactaactgttggttagaggatatcactaatggcattgaaagtttttgttcatcagcagaaaatccaagaagttcacttgttcaggatataacttgtagtgccaacagatctaaggcttctggggattctgctgcagctctgttctttgtttaatgttgatgcatgtatttttcaagtgcacgtgttgagttgtagataggttccaaacttgtgatgtattgctttctttatggatgactattttccttattattcaactttgattgttattattgtggagatatttgataaggataagccacaaaattattgcaagagttctatcttgtcag

SEQ ID NO: 17184 - protein, 95 aa, Panicum virgatum
  misc_feature: Ceres CLONE 1791466-R
  misc_feature (12)..(57): Pfam Name: G-patch Pfam Description: G-patch domain
TKEAAEKAKIQADNIGHKLLSKMGWREGEGLGSERRGRADPIMAGDVKKDHLGVGAVQPGEVTSEDDIYEQYKKRMMLGYRYRPNPLNNPRKAYY

SEQ ID NO: 17185 - DNA, 1622 bp, Panicum virgatum
  misc_feature: Ceres CLONE 1791475
  misc_feature: Encodes the peptide sequence at SEQ ID NO. 17186
aagaggaaaatcgaccacctcacctcggcttccatctctctccgcaatggcggccgccacagcagccgcggccgcagccctcctctccggcggcagcggcccaatccccagcacaacccttcaaatccagccctttgtttctccccttccctttcgccgccgtggtcgcaccgtacacgtctccaacgcctcgtcgtccccgtcttccccaccgacgccggagaaggaggcggtggccgaagcggttccgttgcctaccgcggaatcctgcgtcaatctcggcctcgagctcttctccaagggcagggtgagggatgctcttgaccaatttgagaatgccttggagctgaatccaacacctattgaagcccaggcagccctgtataacaaggcatgctgccatgcatatagagaagaaagcaaaaaggcagcagaatgtttaaggacagctttgcgggactacaatctcaaatttggtaccatacttaatgatccagacttggcgccgttcagagcatcgccagaatttaaggaacttcaagaagaggctttgcgtggtggagaagatattggttctgggttccaaagagacctgaaactcattagtgaagtacaagcaccattccgtggcgtcagaagattcttctatgtagctttaacagcagcagctggaatttcaacattctttaccattccccgacttatactagcagtccaaggaggtgatggtgctcctgatcttctggaaactgctgggaatgctgccatcaatattggaggtatttttgtgcttgtggctttgtacttctgggaaaacaagaaagaagagaagcaaatcacacaaatttctcgtaatgaaaccctttcaagattacctgtgcgcctgtcaactaatcgcattattgagcttgttcaactccgggacattactaggccagttatattggcaggctcgaaagcatctgttactcgggccatgcaaagagctgagaggtaccggactgaactgctcaaacgaggtgttcttctaattccagtgatatttggcgcttctcagaaagaccaaaccaaaccaaggggttttggtacaagaagagctgctgcatcagctccttcagttgggggtgactttgaaaaacgtactgaatctattgcggcaaagtcacgtttgaaagctaagtttcggtttaaggcagatattgtctctcctgaacagtgggaaagttggatacgtgaccagcaagagtctgaaggcgtcactcctggtgaagatgtctacataatccttcgtctggatggccgtgtcagaagatctggaataggtatgccaaactggaacgacatattgcaagaactgccacgacttgaagatcttatgagcaaacttgaacggtgaaaaaggttttaacctctgttgtcagtaacaaacagtttattgttagagatccaggaatatggtttatggtaaaccgatcggaggcgtggtcgccaatgggttgaatatattctgttcctggaacttcagtgcagatggtcgcttctcacaaacaaactaatctatgtatagaggaaccaatccaatctatccaaattataaaattcacggattgctcatgatgccc

SEQ ID NO: 17186 - protein, 449 aa, Panicum virgatum
  misc_feature: Ceres CLONE 1791475
  misc_feature (72)..(105): Pfam Name: TPR_2 Pfam Description: Tetratricopeptide repeat
MAAATAAAAAALLSGGSGPIPSTTLQIQPFVSPLPFRRRGRTVHVSNASSSPSSPPTPEKEAVAEAVPLPTAESCVNLGLELFSKGRVRDALDQFENALELNPTPIEAQAALYNKACCHAYREESKKAAECLRTALRDYNLKFGTILNDPDLAPFRASPEFKELQEEALRGGEDIGSGFQRDLKLISEVQAPFRGVRRFFYVALTAAAGISTFFTIPRLILAVQGGDGAPDLLETAGNAAINIGGIFVLVALYFWENKKEEKQITQISRNETLSRLPVRLSTNRIIELVQLRDITRPVILAGSKASVTRAMQRAERYRTELLKRGVLLIPVIFGASQKDQTKPRGFGTRRAAASAPSVGGDFEKRTESIAAKSRLKAKFRFKADIVSPEQWESWIRDQQESEGVTPGEDVYIILRLDGRVRRSGIGMPNWNDILQELPRLEDLMSKLER

SEQ ID NO: 17187 - DNA, 721 bp, Panicum virgatum
  misc_feature: Ceres CLONE 1791479
  misc_feature: Encodes the peptide sequence at SEQ ID NO. 17188
acccgttccccaaatcccacatgaacccaatctaaacgaagaaaccaggcgaattcgctgccgcggcaggtagaagcccgcaaacaaagtcacgcggctgctttcggggcgcggccgtcctcgctttttctcctcctcgacgccgggcggccggggcggtagtggtaggtgagcgctgtgccctcgtgccgccgcgccgtgggaggcccagagccggagatgcacagatcggggacggcgatggcgtggaacgtgttcaagttctgcacggcgttgcgggggttgggctccgtcatgatcctcctcgtcctcggcatcgtcggcgtcacctactacgcgctcgtcctctgcaactacgggccagcgctgctcgctgccacgggggcgcttgacgccctcgtcgcgctcgctgtcctcctcatcttccacttcttgcttgtcatgcttctctggagctatttctctgttgtgtttactgaccctggtggtgttccaccaaattggaggccagatgttgacgaagagaggggcgaaactgcaccattgtccaccacggagctcagtgatacagggagtccaaggataaggtactgcaggaagtgtaaccagctaaagccacctcggtgccatcactgttctgtttgtaagttttcccccagaacattaaatttggttatagattcgggcgtatttgggtcacggccaaacattgccacgtcat

SEQ ID NO: 17188 - protein, 160 aa, Panicum virgatum
  misc_feature: Ceres CLONE 1791479
  misc_feature (107)..(142): Pfam Name: zf-DHHC Pfam Description: DHHC zinc finger domain
  misc_feature: Useful for making plants with altered lignin content
  misc_feature: Useful for making plants with altered terpenoid content
MAWNVFKFCTALRGLGSVMILLVLGIVGVTYYALVLCNYGPALLAATGALDALVALAVLLIFHFLLVMLLWSYFSVVFTDPGGVPPNWRPDVDEERGETAPLSTTELSDTGSPRIRYCRKCNQLKPPRCHHCSVCKFSPRTLNLVIDSGVFGSRPNIATS

SEQ ID NO: 17189 - DNA, 638 bp, Panicum virgatum
  misc_feature: Ceres CLONE 1791479-R
  misc_feature: Encodes the peptide sequence at SEQ ID NO. 17190
ctctggctcgttgggtttcatcacatcagacttggtgtgccatcatgggaaatccatcgaagctcaagctgctcatggtccagttaccctccacttccgtgttcaccagaacggaggtgaaaccagtagggacagcatcgcttccatttttgcttggtcgtgaggacttgcacacagggcaaagctagatgtcaatgctaggctacttgactttgctctctaactcgaggctgcctgtgttggaactgtggagtctgggaagacgacacaagatttttcacttcttgttcacggatcttccaccgtcgtgagaagccattacttaacagtgccgagttccttgatgccgttgatgttgagttccgatcacaactggtcatccaattgagcttacaggaaacttttggctaatttactgcttccttcatcacggaccgctcctaagtcatttttgctacatcagcattgttattcgcgcttcgcaatggagcgaatgtgccttagggcctcttcgatgtaaagttaattcaagatgtttctagtgtttgcgttgcgcttttaataagggacatatatagatttattggccagtgttgtgatttggtttccaccaataagttgctccatagtatttgtgg

SEQ ID NO: 17190 - protein, 53 aa, Panicum virgatum
  misc_feature: Ceres CLONE 1791479-R
  misc_feature: SWISSPROT Homolog: EC 1.1.1.42 Isocitrate dehydrogenase (NADP(+))
SGSLGFITSDLVCHHGKSIEAQAAHGPVTLHFRVHQNGGETSRDSIASIFAWS

SEQ ID NO: 17191 - DNA, 2130 bp, Panicum virgatum
  misc_feature: Ceres CLONE 1791488
  misc_feature: Encodes the peptide sequence at SEQ ID NO. 17192
gaaattattgccaccccttccttggatcgcggccgccgcgtgcgtgaccggcaacgtgggcagcggcagagacgaaccccacccccctcctcggttcctgccaccaaaaaccattcgattcctccgcccccgccggcccaagccgaatccagctccgacaaaaaattcgccgccgcccgcaccggagccccgaccccgacgagcgttccatggactcgccccccgaatccgcgagggattagccagcgtcgcgatcgccccgccccgcccagacacctcggtggttttggacggaatccgagatgggtgtaattagcacagtgcttggtttctctggatttggctttgggttttcagctggtattgttattgggtacttcctcttcatctacgtccagccaaatgatgtcaaggatgtcaaagttcgtccgcttgtggaatatgattcaaaatctttggaatccatccttcccgaaattcctttgtgggtcaagaatcctgactatgatagaattgattggctgaacaggtttttggagttgatgtggccctatcttaacaaggctatctgcaaaactgcacaggaaatcgctaagccaattattgccgagaatactgcaaaatataagatagactcggttgagttcgaaactcttactttgggtagcttaccgccaacctttcaagggatgaaagtatacgtcacagaggagcaagagctgataatggaaccatgtcttaaatgggctgcaaatccaaatgtcactgttgctgtaaaagcttatggtttgaaagcaactatccagattgtggatctacaagtctttgctttacctcgtattactctgaagccattggtgcctacatttccttgctttgctaaaatccttgtctctctcatggagaagccacatgttgactttgggctaaaacttcttggagcagatgtaatggctattcctagtctttacagatttgttcaggagaccatcaagaagcaagtagcgagcatgtatttgtggccgaagacattagaagtacctataatggatccctcaaaagcatcgaaaaaacctgttggaattctacttgtgaaggttgtaagagcccagaatctgcggaagaaggatctgctgggtaaatcagacccatatgtgaaacttaagatgtcagataacaagcttccatccaaaaaaacaactgtaaagcgcagcaatcttaatccggagtggaatgaagatttcaaaattgttgtgacagatccagaaactcaggctcttgaagttaatgtctttgactgggaacaggttggaaaacatgaaaagatgggcatgaatagtgtcctattaaaagacctcccagcagatgagactaaagttattaccctcgacttgcttaagaccatggatccaaatgatgtacaaaatgagaagtctcgtggccagcttactctagagcttacatacaagcctttcaaggaagaagatatggagaaagaaggcacagagggtgccgatgtggtagagaaagctccagatggtactccagctggtggtggtctgcttcatgttattgttcatgaagctcaagatcttgaggggaagcaccatacaaacccatatgcgaaaataattttcaaaggcgaggagaagaaaacaaaggtcatcaagaagaatagggatccacgatgggaggatgaattcgaatttgtgtgtgaggaaccacctgtaaatgataagctacatgttgaagtcctaagtaaagccccgaagaaagggctgatacatggcaaggaaactttgggctacattgatatcagccttgcagacgtgatcagcaacaagcggattaatgagaagtaccatctcatagactcaaaaaatggccagatacagattgagatgcaatggagaacttcctagacagcagaaagaacttgaatgcctgaatgtagtacaggaatgagatatggatgtcgatgttcctattactcagtttgcggaattctgtaattgagctctagtcgatatttgctccgtttctagacatctgttgttgagatttttttctttctttggtcttatggaacttattctgtgagtaatacagatcatacaagtatactcagcg

SEQ ID NO: 17192 - protein, 539 aa, Panicum virgatum
  misc_feature: Ceres CLONE 1791488
  misc_feature (262)..(346): Pfam Name: C2 Pfam Description: C2 domain
  misc_feature (421)..(504): Pfam Name: C2 Pfam Description: C2 domain
  misc_feature: SWISSPROT Homolog: EC 2.7.11.13 Protein kinase C
MGVISTVLGFSGFGFGFSAGIVIGYFLFIYVQPNDVKDVKVRPLVEYDSKSLESILPEIPLWVKNPDYDRIDWLNRFLELMWPYLNKAICKTAQEIAKPIIAENTAKYKIDSVEFETLTLGSLPPTFQGMKVYVTEEQELIMEPCLKWAANPNVTVAVKAYGLKATIQIVDLQVFALPRITLKPLVPTFPCFAKILVSLMEKPHVDFGLKLLGADVMAIPSLYRFVQETIKKQVASMYLWPKTLEVPIMDPSKASKKPVGILLVKVVRAQNLRKKDLLGKSDPYVKLKMSDNKLPSKKTTVKRSNLNPEWNEDFKIVVTDPETQALEVNVFDWEQVGKHEKMGMNSVLLKDLPADETKVITLDLLKTMDPNDVQNEKSRGQLTLELTYKPFKEEDMEKEGTEGADVVEKAPDGTPAGGGLLHVIVHEAQDLEGKHHTNPYAKIIFKGEEKKTKVIKKNRDPRWEDEFEFVCEEPPVNDKLHVEVLSKAPKKGLIHGKETLGYIDISLADVISNKRINEKYHLIDSKNGQIQIEMQWRTS

SEQ ID NO: 17193 - DNA, 1758 bp, Panicum virgatum
  misc_feature: Ceres CLONE 1791498
  misc_feature: Encodes the peptide sequence at SEQ ID NO. 17194
acgaacccaccctccccgattcaaaccgtcgccgccgtcgccgagtgagtcgtgactccccccagcggcggcccgcgaccacccgttcccacccgtcgcgtctccgggaaccacatttgcgcccgccccctccgcttcctccccccctcgccgtggcccgagagctgaggctgagctgcctcgggcgggtggggtcgtcgtccgcccggcggctgcggcggttacgaggcagggcgaattccggcgcggggcgccgcgatccccgcagtgatgtgcggatcggagcatgggtgtgaccccaccgggaagtagcggcggctggcggagggctcggagcgggagctgcgtacacgaccatgtacatcgcgcgggaggcaaccaagctgtggaggaaggtgagcgcggagacgacggcggagctgcagcttctgctggagaagtggcaactgctgcttgcaggattggtgttccagtacattcatggattggctgctcgaggggtacattacttgcaccgacccggaccactgctccaggacttgggatttatggcccttccggaacttggacaagagaaaggttatcttagcgagagcgtattcactttcatcttcatttcctttctgttgtggagttttcacccttttatttatcatagcaaacgtttctacactgttctactgtggcgaagggtgctggcatttttagttgcttcacaatttttacggattgtcacattttactccactcaacttcccggtccaaattatcactgccgtgagggctcaaaacttgccactcttccaccaccaaataatgcacttgaagtgctcctgattaactttcctcgtggagtgctttttggttgtggtgatctgatattctcatctcacatgatctttaccctagtttttgtgcgcacatactataaatatggatcaaacaggttgattaagctccttgcttggctgatggctataattcagagtcttcttataattgcttctcgcaagcactacaccgtggatgttgttgttgcttggtacactgttaatttggttgtattctttgttgataagaagctgccagaaatgccagatcgtacaaatggattatctctgcttccagtgagctcaaaagatgaagacggcaggacgaaggaagggctccataaacttgatggaaggatgagggatgagttccataagttgttaaatgggaacactgtcgatgctacggatcggcgacaacgagtacagatgaatgggaagcatggagaagacatgagccacagtgtctctgatgccactcccactggtacctgatcagctgcttttcattgttctgtcgcctttaacgtcgacaggggaatctgccgggaaaacaaaacgaaaatgaaattgcctggtgtgcctctgcatgatgaaaggcttctcaaggtacctgcaaggctgcaacatcattttggttcggctcctttgcacggtatggtgacggataaatgaggtgtttgaactttgaaatagtggtagaaactgtaaaagaattagaatgccacggcttttctcagaggctggtgctacagttttgcatcctccagactttccaaaatggatgatattagagagaaaaattggtctgtgatgtatatatcaattagattcagcttagttccacttcaaaacaaaattcagctgtcgtgaattggtgattgctaatttatgctgattgacagtaattgagtaattgtacgtgagc

SEQ ID NO: 17194 - protein, 322 aa, Panicum virgatum
  misc_feature: Ceres CLONE 1791498
  misc_feature: SWISSPROT Homolog: EC 2.7.8.27 Sphingomyelin synthase
MYIAREATKLWRKVSAETTAELQLLLEKWQLLLAGLVFQYIHGLAARGVHYLHRPGPLLQDLGFMALPELGQEKGYLSESVFTFIFISFLLWSFHPFIYHSKRFYTVLLWRRVLAFLVASQFLRIVTFYSTQLPGPNYHCREGSKLATLPPPNNALEVLLINFPRGVLFGCGDLIFSSHMIFTLVFVRTYYKYGSNRLIKLLAWLMAIIQSLLIIASRKHYTVDVVVAWYTVNLVVFFVDKKLPEMPDRTNGLSLLPVSSKDEDGRTKEGLHKLDGRMRDEFHKLLNGNTVDATDRRQRVQMNGKHGEDMSHSVSDATPTGT

SEQ ID NO: 17195 - DNA, 1577 bp, Panicum virgatum
  misc_feature: Ceres CLONE 1791501
  misc_feature: Encodes the peptide sequence at SEQ ID NO. 17196
tgactctgactctgggtaagcaaggtcagctagctataggacgaagctgcagctagcgcggcagatcagatcgatcgagatggcggctgccttctcctccaccgtcggagctccggcctccaccccggccagcttcctcgggagcaagctcagcaggaagcagcaggcgaccgccgccgtgaactaccatggcaagagctccggcgccaaccggttcagggtcatggccaaggagatcgacgagtcaaagcagaccgacaccgacaggtggaagggcctggcctacgacatctccgacgaccagcaggacatcaccagggggaagggcctggtcgactccctcttccagacgcccacgggggacggcacccacgaggccgtgctcagctcctacgagtacctgagccagggcctcagggactacagtgcctgggacaacatgaaggacggcttctacatcgcgccggccttcatggacaagctcgtcgtccacctctcaaagaacttcatgacactgccaaacatcaaggttcccctcatcctgggtatctggggaggcaagggtcaaggaaaatccttccagtgtgagcttgtcttcgccaagatgggcatcactcccatcatgatgagcgccggcgagcttgagagcggcaacgccggcgagcccgccaagctcatcaggcagcgttaccgtgaggccgccgacatcatcaagaagggcaagatgtgctgcctcttcatcaacgatctcgacgccggtgccggtcgcatgggcggcaccacccagtacaccgtcaacaaccagatggtgaacgccaccctgatgaacatcgccgacaaccccaccaacgtgcagctccccggcatgtacaacaaggaggagaacccccgggtgcccatcgtcgtcacaggcaacgacttctccaccctgtacgcgccgctcatccgcgacggccgcatggagaagttctactgggcgcccacccgcgaggaccggatcggcgtgtgcaagggcatcttccgcaccgacggcgtccccgaggaggacgtggtgaagctcgtggacaccttccccggccagtccatcgacttcttcggcgccctgcgtgcccgggtgtacgacgacgaggtccgcaagtgggtcgccgagacgggcgtggagaacatcggcaggaagctcgtcaactcccgggagggcccgcccaagttcgagcagcccaagatgacgatcgccaagctgctggaatacgggcacatgctggaggcggagcaggagaacgtcaagcgcgtgcagcttgcggacaagtacctcagcgaggcggcgctcggcgaggctaacgaggacgccatgaagaccggcgccttcttcaagtagaaatttaggaaaccaaccggcctcttgctattgaattgctaggcggccaattaaggttgcattgcaagatggatgctgttttactcttgttcattgtactagttaaaggccggatctggccaagcgatagctggggatggaaatttttgtcaataatatataaaaatatattatatatgtgagcgacatatcgatttggtat

SEQ ID NO: 17196 - protein, 431 aa, Panicum virgatum
  misc_feature: Ceres CLONE 1791501
  misc_feature (154)..(352): Pfam Name: AAA Pfam Description: ATPase family associated with various cellular activities (AAA)
  misc_feature: Useful for making plants with modulated biomass
MAAAFSSTVGAPASTPASFLGSKLSRKQQATAAVNYHGKSSGANRFRVMAKEIDESKQTDTDRWKGLAYDISDDQQDITRGKGLVDSLFQTPTGDGTHEAVLSSYEYLSQGLRDYSAWDNMKDGFYIAPAFMDKLVVHLSKNFMTLPNIKVPLILGIWGGKGQGKSFQCELVFAKMGITPIMMSAGELESGNAGEPAKLIRQRYREAADIIKKGKMCCLFINDLDAGAGRMGGTTQYTVNNQMVNATLMNIADNPTNVQLPGMYNKEENPRVPIVVTGNDFSTLYAPLIRDGRMEKFYWAPTREDRIGVCKGIFRTDGVPEEDVVKLVDTFPGQSIDFFGALRARVYDDEVRKWVAETGVENIGRKLVNSREGPPKFEQPKMTIAKLLEYGHMLEAEQENVKRVQLADKYLSEAALGEANEDAMKTGAFFK

SEQ ID NO: 17197 - DNA, 1773 bp, Panicum virgatum
  misc_feature: Ceres CLONE 1791503
  misc_feature: Encodes the peptide sequence at SEQ ID NO. 17198
cgaaaaccaaacgtcgccgccgcctccgtctccgtctccgtcttcttctcatcccatctctctcctattccctcccgcaatcccacccctccctctaaacccgcacccgcagcggcgctcctagggtttgctccgccccgccgaacccagccctccgatcgctccggttccgaggcggcggctgcaagagagctcgcggcatggcggggtacccggaggacaaccagcacgcgctgaacgggtacgaggatgaggagatcgacgaggaggagggccaccccgggaggcggggaggccgggacgggggctccgggtacggcgacgccggcggagacgacgggaggggggccggcggcgactcgtcggggaagattttcgtcggaggcgttgcttgggagacgactgaagaaacgttctccaagcattttgagaagtatggggcaataactgattctgtaattatgaaggacaagcatactaagatgcctcgtggatttagatttgttacattttctgatccatctgttatagacaaggttttggaggatgagcacgttatagatggcagaacggttgaggtcaagaggacagtccctagggaagaaatgaccaccaaagatggccccaagacaagaaagatattcattggtgggctaccaccatcactaactgaagatgagttgaaggatcacttttcctcttatggtaaggtggttgaagaccagataatgcttgatcatagcactgggcgttctagagggtttggttttgtcacttttgaaagtgaggatgctgttgaaagggtcatatcagaggggagaatgcgtgatcttggtgggaagcaggttgaaataaagaaggctgaaccaaagaagcatggatctgatcacagtagtaatggtaggtctagccatgggggtggtggtggttaccgtaattcttaccgtagtggtggagctggcagcggcagcggtggcaacagtggtggtggtggtggtggcggcggtggttatgggtacggtggtgcttataggtctgctgctgcagcaggttatggatatgatggtggcgcaggagcgggatatggctatggcagagggtatggctatgcaggcaatgctggctttgggtctggttttggcggtgggtatggtggctccatgtacggaggcgcttatggtgcatatggtgcctatggtggtggtgcttatggagggggtgcttatggaggtggtgcttatggaggtggcgcctatggtggtggcccaggtggctatggcgctggtggatatggtggctacgggggtgctggtggagcaggtggtgctgctggtgggagttcgggtgctcggggttctagcaggtaccatccatatggaaaataagagacaagacaaatctggttttctagggcccagggttcctcatgcctcctagaagttcagttttcatgggatgtcacctaatcagcggcattggaacattgtttgggttgagctaagccactactagagcaactgtgtaattgcagttgctgagcccgcccgcctgcctgcctgcttttgtttgctgcagaagctacacatgaaacctgtgttgtattctttagtttggtatgcagagagcttagaaccctgtgaacaagcgttttatggtaggaacagtatttggtgcggtagaactatgttctgtgatgtaaaattgcttttgcaagcaattaactgttgccatctgtggcgattataattacgaactcgttacaggatttggttt

SEQ ID NO: 17198 - protein, 394 aa, Panicum virgatum
  misc_feature: Ceres CLONE 1791503
  misc_feature (147)..(218): Pfam Name: RRM_1 Pfam Description: RNA recognition motif. (a.k.a. RRM, RBD, or RNP domain)
  misc_feature (58)..(127): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature: Useful for making plants with altered alkaloid content
  misc_feature: Useful for making plants with modulated nitrogen use efficiency
  misc_feature: Useful for making plants with altered lignin content
  misc_feature: Useful for making plants with altered terpenoid content
  misc_feature: Useful for making plants with modulated phosphate use efficiency
MAGYPEDNQHALNGYEDEEIDEEEGHPGRRGGRDGGSGYGDAGGDDGRGAGGDSSGKIFVGGVAWETTEETFSKHFEKYGAITDSVIMKDKHTKMPRGFRFVTFSDPSVIDKVLEDEHVIDGRTVEVKRTVPREEMTTKDGPKTRKIFIGGLPPSLTEDELKDHFSSYGKVVEDQIMLDHSTGRSRGFGFVTFESEDAVERVISEGRMRDLGGKQVEIKKAEPKKHGSDHSSNGRSSHGGGGGYRNSYRSGGAGSGSGGNSGGGGGGGGGYGYGGAYRSAAAAGYGYDGGAGAGYGYGRGYGYAGNAGFGSGFGGGYGGSMYGGAYGAYGAYGGGAYGGGAYGGGAYGGGAYGGGPGGYGAGGYGGYGGAGGAGGAAGGSSGARGSSRYHPYGK

SEQ ID NO: 17199 - DNA, 1844 bp, Panicum virgatum
  misc_feature: Ceres CLONE 1791514
  misc_feature: Encodes the peptide sequence at SEQ ID NO. 17200
cgacgcctccagcaaaccatggcagtcgctgtgttcgcggttcagcaagagcttgcaggctcgatcgtttccagtatcgccgatgagctatttcgggcatatgcttcagactgcaacagatatgctgaaatccatggtatcgcctatgagcatgagaggccatcctctgcttcaccgatggtgtatcgagtcggttgtcggaagtcatgtgaagttttgaaggcctctgaattcagtaccgtggaaaccgttgaaaagagcatcgaatcatctgcgtcagttcataaaaaaattgtggagttcattggagaaagagctcgtgctcacaagacgcataggttactctgtacacaaaaacaaaaccttgatgagcatcacggaattgattggaacacacgctacaaaatgattaaggggacttgcgagggcttttcatacctccagaggcaactgcaacattgtatttatcattttgatgttaaagcagaaaatatattgctggatgcaaatatggtgccaaaaatcacagattatggcatgtcacggtgcttcggggaagaactagcacgaaacatgacaaattgtataggaacacaggggtacaaggagccagcgatgaatggaaagataacctcacatatgtccgacatatacagtttgggtgtcataatcttgagtatattgaagatttattggaggaacaagcaacaggcaaggcaaataatgttgatgcttgagtcatcttccgaacaaatgaagagattaaaccaaatagttttaagctgtctggaaaaaggcaaatccacgaaggttacgagaagcactgtttcttcaacgcgacgagcagcgcatgatatcatcgtcccagattctggtgttcgcatcagcgccatggttgacgtccccaaaacgaaaccttccccggcttgtattaacatagacaaggcaccatcaactcctgaagattcagtgatccttgtgcttgagtccggaagcagtaaattggctcaaacaccatctacgcatcgacatctcagtcatagtaaccagacagatgaacggagcaacaaaccactctctaatagagctccagcgaccaattcgtcagcagacaaaacacgcgctacaatggaacctaataagcttgctgatgatgaagctcacagtgaacctaattccagtgtcgacgaacgcgataccaatgaggtggcaaggagatcctgcaaatggtatgtcgcaaccggcgcagcacatcacgccacaggggaccgtggtcaaatcaccaacatggtggaactcgagaacgataacctttgtgttcaggcggcagatgggacgcccatgcctgtacgtggccgcggcaacgtggagaccgacaacgtggtgcttccggacgtctactacgtccccgggctttggacgaaccttgtttccgtcggccagcttgccgggctggattactgcgttgggtttagccgcggtgcgtgccacgtcagtgacgccgccggcacggtcgtcggtacggcccacgccaggggagacggcctgtatgaggtggaccatctgagagtgccacttgacatgcgatgaactgctgctgatgaatcatgaacgagtacgcaggcatatttacggttgtgcgagctagtgcgatcgatgtgtgtaacatgcaataagggcgaccgatccatgcactatattgctttctcgcttttgttgaaacttatttgtatgtcttcctgtatgtcttcctgatcagcccaattccactgcaccaactatgcaggaaaccatgttccatgaactggttatcattatatatgctattgcttatgtgttttttg

SEQ ID NO: 17200 - protein, 523 aa, Panicum virgatum
  misc_feature: Ceres CLONE 1791514
  misc_feature (43)..(280): Pfam Name: Pkinase Pfam Description: Protein kinase domain
  misc_feature: SWISSPROT Homolog: EC 2.7.11.1 Non-specific serine/threonine protein kinase
MAVAVFAVQQELAGSIVSSIADELFRAYASDCNRYAEIHGIAYEHERPSSASPMVYRVGCRKSCEVLKASEFSTVETVEKSIESSASVHKKIVEFIGERARAHKTHRLLCTQKQNLDEHHGIDWNTRYKMIKGTCEGFSYLQRQLQHCIYHFDVKAENILLDANMVPKITDYGMSRCFGEELARNMTNCIGTQGYKEPAMNGKITSHMSDIYSLGVIILSILKIYWRNKQQARQIMLMLESSSEQMKRLNQIVLSCLEKGKSTKVTRSTVSSTRRAAHDIIVPDSGVRISAMVDVPKTKPSPACINIDKAPSTPEDSVILVLESGSSKLAQTPSTHRHLSHSNQTDERSNKPLSNRAPATNSSADKTRATMEPNKLADDEAHSEPNSSVDERDTNEVARRSCKWYVATGAAHHATGDRGQITNMVELENDNLCVQAADGTPMPVRGRGNVETDNVVLPDVYYVPGLWTNLVSVGQLAGLDYCVGFSRGACHVSDAAGTVVGTAHARGDGLYEVDHLRVPLDMR

SEQ ID NO: 17201 - DNA, 1015 bp, Panicum virgatum
  misc_feature: Ceres CLONE 1791521
  misc_feature: Encodes the peptide sequence at SEQ ID NO. 17202
gcgcctgccactgccaggtccaggggacagccacagcccgagcacaagggggggcgccaggacactggtgcgcggcgcgccccggggaagagcagcggcggcagcggcggagcagaacacgccagcgcctcgccggctcgcgccaatggcggctccttcccgagcgtcgtcctcgtcgtccgcgcgcctcctcctcctgctgctctccctgctcgggtcctgcgtcgcgctgagccgccaggagtcgtcgtcgtcgtcgtcgtcgacggactcgtgcgccgcggcgaagctcgcggtcgccagcctcgtgcccttcgacaccgcggggttccggtgcgccgccaactggaagcagcaggacttcgtcctccggtacaagaacacggggccgagcgtgtggagcttcgtcctgtcggcgccggacaggggctcgtacgtggcggtcggcttctcggggaagggcgccatggtcgggagcaacgccgtcgccgggtgggcgtccggcggcaggggcgccgtcaagcagtactacctcgccgggaagagccccgacgaggtcgcccccaacaggggcctcctcaagctcgtcaggaacaagtccgccgtcgtctcccactcgggccgcctctacctcgccttccagctcagcaccgactacccgcagccgtacctgatctacgccgtcgggcccgacggcaacctgccgccgtccagcaccctgcagctgccgatgcaccagagcgtggcctcccgcgcctacagctacacctccgggatgtcttccagcttcggccccggcgacgggacgttcccggcggagcggaggcacgggctgctggccatgatggggtggggcttgctgatgcccatcggcatgatcaccgcgcgctacttccggcagctggacccgtgctggttctacagccacctggccatccaggtgtgcggctacgccagcgggcatcgggggccgtcgtcctcagcttccgcctcaacgggggacggactcaagaac

SEQ ID NO: 17202 - protein, 289 aa, Panicum virgatum
  misc_feature: Ceres CLONE 1791521
  misc_feature (71)..(181): Pfam Name: DOMON Pfam Description: DOMON domain
MAAPSRASSSSSARLLLLLLSLLGSCVALSRQESSSSSSSTDSCAAAKLAVASLVPFDTAGFRCAANWKQQDFVLRYKNTGPSVWSFVLSAPDRGSYVAVGFSGKGAMVGSNAVAGWASGGRGAVKQYYLAGKSPDEVAPNRGLLKLVRNKSAVVSHSGRLYLAFQLSTDYPQPYLIYAVGPDGNLPPSSTLQLPMHQSVASRAYSYTSGMSSSFGPGDGTFPAERRHGLLAMMGWGLLMPIGMITARYFRQLDPCWFYSHLAIQVCGYASGHRGPSSSASASTGDGLK

SEQ ID NO: 17203 - DNA, 673 bp, Panicum virgatum
  misc_feature: Ceres CLONE 1791521-R
gaccgcgcacaaggcgctcggcatcgccatcctcgccatggcgtcgctccaggtgctggcgatcctggcgcggccggacaagacgtccaaggtgcggcggttctggaactggtaccaccacaacatcgggcgcgcggcgatcctggtggccgtcggcaacgtcttcctgggcctctccatcgcgcaggagaccaacgcctacatcgtctcctacggcgtcttcgtcgccgtctgggtgatcgccgtcgccgccttcgaggtcaagcgctgctacgccgacgacgactgatccgctcgaccgaccgacccccttccaggcaggcaggcagcgataccagagtcgttattctggacaactctggccataggacgaaactgatgggcgtacgcagaatgaagcgttcacggccagtgacgtgacacacatacacacacctgttcttgttccttagctcacaactggacagtgcattcgggaaagcgtgcttggctggctaaaatttgattttttatttttgttttgggtataggatttgaggcaagggccggactgctgctctagcctagctggacgctctgattcatattcatatttgtacattggtacatggtcgtgtttgtgctgtacttgtacccattcagatgatagttttgtttcaccccgtcttggttc

SEQ ID NO: 17204 - DNA, 1466 bp, Panicum virgatum
  misc_feature: Ceres CLONE 1791523
  misc_feature: Encodes the peptide sequence at SEQ ID NO. 17205
gcttttcccagttttgcctaaacctcctccccagaccagaacacagccatggcgatctcccagatctcccgcggggccctggccgtcctcctcctcgccgccgccttcgccgccgccccggccgcgctcaccgacggcgacgacgtggtggccctcaccgagtccaccttcgagaaggaggtcgggcaggaccgcggcgccctcgtcgagttctacgccccctggtgtggtcactgcaagaagcttgctcctgagtatgaaagacttggcgcaagttttaagaaagctaaatccgtcttgatcgcaaaagttgattgtgatgagcacaagagtgtgtgcagcaagtatgaagtttctggttatccaacaatccagtggttcccaaaaggatccttggagccaaaaaagtatgaaggacaacgctctgcggaagcccttgctgaatttgttaatactgaagaaggcacaaatgtaaagctggcaaccattccttcaagcattgtggtgctcaccccagagaattttgactcagtcgtccttgatgaaaccaaagacgtccttgttgagttctatgccccatggtgtggtcactgcaagagtcttgctccgacttatgagaaggtggcttctgttttcaagttggatgagggagttgttattgcaaaccttgatgctgacaaacacagggatttggctgagaagtatggagttactggattccctacgttgaagtttttctcaaagggaaacaaagctggtgaagattatgatggtggcagggacttgggtgactttgtcaagttcattaatgagaagagtggtaccagccgtgatacaaagggtcaactcacctcagaggctggccgcatagcaagtttggatgccttggcaaaggaattccttggtgctgccagtgacaagcggaaggaagtccttgccagtatggaggaggaggtagctaagctcagtggttctgctgccaagcatggaaaggtctatgtaaccatcgcaaagaagatcctagataaaggcaacgactatactaagaaggaaactgagaggcttcagcgcatgttggagaagtccatcagcccctcgaaggcagatgaatttaccgtcaagaagaacgttctttcaacgttctcctcctaaggcaatggctggctccacttccgcgtttcagatataggcaaagagaactgcaagtttaggggatgtgataatgagagttgattgttggtagaactaattttggggctttcccacgagcatacctgatactttatcattttgtggttcgcagttcttttcggcgcacttacatgttttattacgtagcactatagtttacttttggatggagagaagagatggaaaacattgtgactacagaacagggttttttattccaataaggctcactttatgggcttatatacgagcttggaaagctgaatgcggccagt

SEQ ID NO: 17205 - protein, 367 aa, Panicum virgatum
  misc_feature: Ceres CLONE 1791523
  misc_feature (150)..(256): Pfam Name: Thioredoxin Pfam Description: Thioredoxin
  misc_feature (32)..(137): Pfam Name: Thioredoxin Pfam Description: Thioredoxin
  misc_feature (272)..(366): Pfam Name: ERp29 Pfam Description: Endoplasmic reticulum protein ERp29, C-terminal domain
  misc_feature: SWISSPROT Homolog: EC 5.3.4.1 Protein disulfide-isomerase
MAISQISRGALAVLLLAAAFAAAPAALTDGDDVVALTESTFEKEVGQDRGALVEFYAPWCGHCKKLAPEYERLGASFKKAKSVLIAKVDCDEHKSVCSKYEVSGYPTIQWFPKGSLEPKKYEGQRSAEALAEFVNTEEGTNVKLATIPSSIVVLTPENFDSVVLDETKDVLVEFYAPWCGHCKSLAPTYEKVASVFKLDEGVVIANLDADKHRDLAEKYGVTGFPTLKFFSKGNKAGEDYDGGRDLGDFVKFINEKSGTSRDTKGQLTSEAGRIASLDALAKEFLGAASDKRKEVLASMEEEVAKLSGSAAKHGKVYVTIAKKILDKGNDYTKKETERLQRMLEKSISPSKADEFTVKKNVLSTFSS

SEQ ID NO: 17206 - DNA, 1425 bp, Panicum virgatum
  misc_feature: Ceres CLONE 1791527
  misc_feature: Encodes the peptide sequence at SEQ ID NO. 17207
atttatccccggttccgccgcactccgatcctcctcccaaaccctagcagctcccaatccccacccccgcacttcccgattccccccgtctcctgatgcccccgccccgcggggcctaggggcggcggcagcagcggtcttccggcgggtgagcacgcgccgatggagccgcgcgtggccaacaagttccgcctcgggcgcaagctcgggagcggctccttcggggagatcttcctcggtactcacgtgcagacgaacgaggaggtcgcgattaagctggaaagtgtgaagacaaaacaccctcagttgctgtacgagtcaaagctgtataggatactgcagggtggaactggaattccaaacgtcaagtggtttggcattgagggtgactacaatgttcttgttatggaccttttggggccaagccttgaagaccttttcagcttttgcaaccgaaaattgtccttgaagactgttttgatgcttgccgatcaaatgatcaaccgggttgagtatgttcatcagaagtccttcttgcaccgagatattaagccagacaattttctcatgggccttggaaagagaacaagtcaggtatacataattgattttggactggcgaagaaatacagggacagtgcaacccaccagcacattccatacagagagaagaaaaatttgactgggactgcacgttatgcaagtgtaaacacgcatcttggagtcgaacaaagcaggagggacgacttggaatctcttggatatgtactcatgtacttcttaaaaggaagtcttccatggcagggtctaaaagctgggaccaagaaacagaagtacgataaaattagtgaaaggaagattgccacttcagttgatgctctctgtcgtggatacccttctgaatttcaatcctacttccattactgccgctctttacgttttgaagatatgcctgactatcaatacctgaagagattgttcagagaactttttattcgagagggatttcagtttgattatgtttttgactggaccattattaagtaccagcagtcacaaatggccgttccacctcgtgctatggctgcagcagcaggtcaaagctctgggctggctcctatggcaaataataacagactgtcaggcactgaagagggaaggagaagtgggtggtccgatgatcctttgcgacgtcagattccacctgcgggaataaatgcagttagcttctcaaaacagaaatctccagttaggcaagaacagtcctcatcaaaagatgctgtgttccccagttcaactttcttgggtcagtcaagtggatccttgaggtgtcctgctgtttctaatagccgagttccaactggcgaagctgaaatacgcagtcgtacaccagatgcaagcccagggactttccaaagaaatgct

SEQ ID NO: 17207 - protein, 420 aa, Panicum virgatum
  misc_feature: Ceres CLONE 1791527
  misc_feature (9)..(273): Pfam Name: Pkinase Pfam Description: Protein kinase domain
  misc_feature: SWISSPROT Homolog: EC 2.7.11.1 Non-specific serine/threonine protein kinase
  misc_feature: The sequence is a functional homolog of SEQ ID NO 32 in US patent 7179962
MEPRVANKFRLGRKLGSGSFGEIFLGTHVQTNEEVAIKLESVKTKHPQLLYESKLYRILQGGTGIPNVKWFGIEGDYNVLVMDLLGPSLEDLFSFCNRKLSLKTVLMLADQMINRVEYVHQKSFLHRDIKPDNFLMGLGKRTSQVYIIDFGLAKKYRDSATHQHIPYREKKNLTGTARYASVNTHLGVEQSRRDDLESLGYVLMYFLKGSLPWQGLKAGTKKQKYDKISERKIATSVDALCRGYPSEFQSYFHYCRSLRFEDMPDYQYLKRLFRELFIREGFQFDYVFDWTIIKYQQSQMAVPPRAMAAAAGQSSGLAPMANNNRLSGTEEGRRSGWSDDPLRRQIPPAGINAVSFSKQKSPVRQEQSSSKDAVFPSSTFLGQSSGSLRCPAVSNSRVPTGEAEIRSRTPDASPGTFQRN

SEQ ID NO: 17208 - DNA, 640 bp, Panicum virgatum
  misc_feature: Ceres CLONE 1791527-R
acgtaggacctcgcagatgctggagtatgcagaccccaggcttaggctttcatcgtctggcaggctcatgtccaacgcgaagaactatgagtccactttaaggggcatccaaggtctaaattttgatgccaatgataggatccactactagtatcttctagatccagtggacatgtatctatatgatctattgacaaccagatgaagtgcaaggatgtacttttggagctactctcagtctcatttacccccctgtgatcaacaagctacatgctggagctgcaaggcagcctgctgatccaaagcatcgcaggttggttggcaaaataatgggttatctatgctcttgagcagctttcgacaaaaagcatcatggccatgttttaggctctgtacaggttccaatgtgttcttattgcgctttaagattttgctttagtaccttccacataatattgcgtctcgagctgtcagctggctcgtactcaggctgctggtttctgaatgcaattcctgtttgtgaaggcttgcaaattgtaagtaaccaaagtgattgctattctagtatttgggggggcttgtcgtgtaggttgtggactttttgcatctaagaaaacgtgtaacgagaggatgcaatctc

SEQ ID NO: 17209 - DNA, 2293 bp, Panicum virgatum
  misc_feature: Ceres CLONE 1791532
  misc_feature: Encodes the peptide sequence at SEQ ID NO. 17210
tcccgatccgaaaccgccagaaatcccgcgcgcgcgatcccatcccccaacgaaaatttccaaatcccgcccgcccccgtcccggatttcaaaccgccggggattcccgggcccccaggccgatcagatctgacgccgcgccagtagtcagccagccgagcgagagccacccacccggcggagatggcggtgatcacggcgcggccgccgaagcgggcgcgggtgcgggtgacggcggggccgcggccgctggacatgcgcgcgttcccggaggggctgccgccgccgccgcggggggcgttccgggagtgcgtgcgggcgttcctggcgcgctgcgcggtgccggcgggcggcgcgtggcgggtcgggttccgcgccggggacggggacggggcggccctgcggatggaggtggtggaggaggacgtggccagggccggggccgcccgggtctactgcgagcactgcacagtcaccggctggagcaggcaccctgtttgtgggaggaggtaccacttcataatccggaatgaatatgccatacaggactacaaaacctgcaagcactgtgggcttatggcccagttgtttgaaacgaggtgcccgtcatgcaaccatgggatgtcttatgatgatccggaagattgggattataggcagttagataatccacgtcatttgcttcatggcattgttcatgacaatgggtttggccaccttgtccggataaatggcagagagggtggttccagtcttctgacggggattcaactgatggacttctgggatcggctctgcagatacctcagagtcagaaaggtctcattgatggatgtctctaagaagtatggaacggacttccgtatattacatgccatcaccactggtcattcttggtatggccaatggggattcaaactcagcaaaggaagctttggaatcacatcagaagaatacgttaaagctatagacaacctttcctcaactccattattgcacttcttcccacattcccgatctcctcgaaaccagctacaagataccatttcattctaccaatccctttcaaatcgccctctaaccacaattcgtgaacttttcctctatgtgctggggcttgccaccagcaagagggtgcatatccagtatgggtcaatgcataaaaaagaacaatcacatgcccatgttcaagacacatgggatgaggaggaaataaagagagcaacagacattgctctaaaggttcttcgagctgtcgataggacaaggtgggtggcgatgcgaaccttaaaggcagccatatcccatccaatcggttcacctcagctggttgattactgcctcaagacccttgctgcaagaacaattgatggaatgacagttgcagtgagatgcaacagcgagaccaaaacactagagtacaggcttacggatgaaaccaacttgatgcccaatgtatccatgccgacccaagaccatcttcgccgtgacataaagttcttgtatgacgttctcctctacccacatacaatgaatccttaccagccggaaaaagactatgagcatgccaagagatctgccatgatccttttggactgcaagcaattcaccaagcattatgatctggaacaggatttcttgccagaaaatccatccatgttgcacatttggtgccatgtagagctgtcagaccaggttggtgatccgccttccataccacaggagctcctaacacttccgcaaacagcaactgttgctgatctgaagatggaggcaacaaagacatttcgtgacatctatctgatgttacagatttttgtagccaaccagcttcttgattttggaatagcaagtgagtcaactcaagtcaaactcttatttggagcaaatgggactgttcgcatccaaagcaagtgtgctgggggtgaacacagggttggaatttaccggatggagagaggcgtggacaaatggacagtcagttgctcttgtggagccacggatgatgatggtgagagaatgctgtcttgtgactcttgccatgtgtggcagcacactaggtgtgctggtattagtgattttgatcaggtgccaaagcgatatgtatgtaaatcatgtaaatttctcaacaagcctaagaggcctaggccagtttatagtaatggcccaaacaaaagatgtaagactggcacaggcgccttaagccttgtaggtggcggatttttgaagcctcacatcttttgacatgtacatatctgtaacgattgagtgaatatgagatgtcaaattttcg

SEQ ID NO: 17210 - protein, 686 aa, Panicum virgatum
  misc_feature: Ceres CLONE 1791532
  misc_feature (600)..(648): Pfam Name: PHD Pfam Description: PHD-finger
MAVITARPPKRARVRVTAGPRPLDMRAFPEGLPPPPRGAFRECVRAFLARCAVPAGGAWRVGFRAGDGDGAALRMEVVEEDVARAGAARVYCEHCTVTGWSRHPVCGRRYHFIIRNEYAIQDYKTCKHCGLMAQLFETRCPSCNHGMSYDDPEDWDYRQLDNPRHLLHGIVHDNGFGHLVRINGREGGSSLLTGIQLMDFWDRLCRYLRVRKVSLMDVSKKYGTDFRILHAITTGHSWYGQWGFKLSKGSFGITSEEYVKAIDNLSSTPLLHFFPHSRSPRNQLQDTISFYQSLSNRPLTTIRELFLYVLGLATSKRVHIQYGSMHKKEQSHAHVQDTWDEEEIKRATDIALKVLRAVDRTRWVAMRTLKAAISHPIGSPQLVDYCLKTLAARTIDGMTVAVRCNSETKTLEYRLTDETNLMPNVSMPTQDHLRRDIKFLYDVLLYPHTMNPYQPEKDYEHAKRSAMILLDCKQFTKHYDLEQDFLPENPSMLHIWCHVELSDQVGDPPSIPQELLTLPQTATVADLKMEATKTFRDIYLMLQIFVANQLLDFGIASESTQVKLLFGANGTVRIQSKCAGGEHRVGIYRMERGVDKWTVSCSCGATDDDGERMLSCDSCHVWQHTRCAGISDFDQVPKRYVCKSCKFLNKPKRPRPVYSNGPNKRCKTGTGALSLVGGGFLKPHIF

SEQ ID NO: 17211 - DNA, 729 bp, Panicum virgatum
  misc_feature: Ceres CLONE 1791540
  misc_feature: Encodes the peptide sequence at SEQ ID NO. 17212
attcgcctgctgctgtacctgcagtgtgccaccaccagaccagacgctctgcccatggcggcggcctccgacaagctgctgcccgcgctcgccgcggccttcctctgctgcgcgctggcgcgggtcgcccaatgcggcggcggcgccccgcagaactacacctccatgttcagcttcggcgactcgctcacggacaccggcaacctgctcgtgtccagcccgctctccaaccacatcgtcggccgctacccctacggcatcacctacttccaccgccccaccggccgctgctccgacggccgcctcgtcgtcgacttcctagcgcaagcgttcggcctgccgctgctgccgccgtacctgcaggccaaggggaaggatctccgccggggcgtcaacttcgccgtcggcggcgccaccgccatggatccgcccttcttccaggagatcggcgcgtctgacaagctctggaccaacctctccctcagcgtccagctcggatggttcgagcagctcaagccgtcgctctgcaactcaccaaagagtctgttcacatttgcttcctttctctgtcagattctgcatttcggattctccaacaatacttctttttttttcttgttaacaaaaaaagaagttaccgataataaaacggcaaggctgattgcaaatttctgttcttgatgaatcgattctcgaaacagagtgcaaggagtacttcagcaagtccct

SEQ ID NO: 17212 - protein, 208 aa, Panicum virgatum
  misc_feature: Ceres CLONE 1791540
  misc_feature (38)..(207): Pfam Name: Lipase_GDSL Pfam Description: GDSL-like Lipase/Acylhydrolase
  misc_feature: SWISSPROT Homolog: EC 3.2.1.51 Alpha-L-fucosidase
MAAASDKLLPALAAAFLCCALARVAQCGGGAPQNYTSMFSFGDSLTDTGNLLVSSPLSNHIVGRYPYGITYFHRPTGRCSDGRLVVDFLAQAFGLPLLPPYLQAKGKDLRRGVNFAVGGATAMDPPFFQEIGASDKLWTNLSLSVQLGWFEQLKPSLCNSPKSLFTFASFLCQILHFGFSNNTSFFFLLTKKEVTDNKTARLIANFCS

SEQ ID NO: 17213 - DNA, 1715 bp, Panicum virgatum
  misc_feature: Ceres CLONE 1791544
  misc_feature: Encodes the peptide sequence at SEQ ID NO. 17214
aatggaggagctagctcttcttctctagcctttctcgtctccctttcgtccattgaccttcggtgagctcagtgctagctgctcggacactctactcgctgccccttccgatggacatgaattagagcggcgagaaagggatggagggcaacgcgtcctccgccggcgccggcatcccggtggagtggcaaacccaattcagcgccgccgccttcgcgtgcccgccggcgcagcagcagcagggacacatgatggactccgccttcgcgtccgccggcctgtgggcgtccacctcccagaccatggcgctctccgacgtcggcggcgccatgtccgccgcgcggggcggcggcggcggcttcttggcgccggtgcccgggttcctcccgcaaggcctcggccatttccccgtggactccggcttcatcgagcgcgccgcgcgggcgtcctgcttcggcggcggcgccggcggcggggtgatgtgcgccggcttcggtgcggctgatcagaacatgaacagcgcgttcagtggctcctcggaggctctcttggatcaccagaggaaggacggcaacgagaagggcgagccggagctcggcaggaacggccacgacgcggtgccgagctcggaggcggccggcggggactgctcgtccaaagggacgtcggactccaagaagaggagaaggcctaacgaggtgatgggcggcgatcaggttcagtcctccaacctgcctgcggattcggcgaacgagagcgtgcacagcaaggacaagggcgaggagagcagcccggcaacaaccaccggcggcaaatcgaaagggaagggaacgaaagagacctccgagtcccagaaggaagactacattcatgtccgggctcggcgcggacaggcgaccaacagccacagccttgcagaaaggttgaggagggagaagattagcgagaggatgaagcttctgcaggaccttgttcccggttgcagcaaagtcactggaaaggcggtaatgcttgacgagatcatcaactatgttcagtccctgcaaagacaagttgagttcttatcgatgaagctggcgacagtaaacccaaggcttgacctcaacatagaaggacttctgtcgaaagatcttcttcgcttccctggtgtcccttcatcttccctcggattctcccccgagatgatgcacccacaactacagctatcgcaaccaggcctgattcaggggggcgctgctggcatggccaatccggacgtcttcaggagaatcattcaggcacagctaagtgcaaaagacggatctcagatgccccacgcattgaacgggtcattcagcgacgtcgcgcagatggggtacccgtcgccgctggggccgcaggacttgagcatcaggccgtcgcaggacgggttccaaatgtgagcaacaggctggcccagctgcacatacgagcaaggctttccatctgatcgacgaacatgcaggagcacaggggggcacacatgaactggccccctgctgctgctggagcagcgctggccgccgcagtgctagctagctcatcgggccatgtttggttaaacatcccatcacaatttcacaaaaaaacgaatgcccgcatgcaatactaaatgaagtctatttgtaaaacctttttaagaatgggtataaattttcgagacgaatctaatgagccaagttttatcgtgattggct

SEQ ID NO: 17214 - protein, 426 aa, Panicum virgatum
  misc_feature: Ceres CLONE 1791544
  misc_feature (252)..(302): Pfam Name: HLH Pfam Description: Helix-loop-helix DNA-binding domain
  misc_feature: The sequence is a functional homolog of SEQ ID NO 864 in the 11/435,388 US patent application
  misc_feature: The sequence is a functional homolog of SEQ ID NO 1930 in the 10/374,780 US patent application
  misc_feature: Useful for making plants with altered lignin content
MEGNASSAGAGIPVEWQTQFSAAAFACPPAQQQQGHMMDSAFASAGLWASTSQTMALSDVGGAMSAARGGGGGFLAPVPGFLPQGLGHFPVDSGFIERAARASCFGGGAGGGVMCAGFGAADQNMNSAFSGSSEALLDHQRKDGNEKGEPELGRNGHDAVPSSEAAGGDCSSKGTSDSKKRRRPNEVMGGDQVQSSNLPADSANESVHSKDKGEESSPATTTGGKSKGKGTKETSESQKEDYIHVRARRGQATNSHSLAERLRREKISERMKLLQDLVPGCSKVTGKAVMLDEIINYVQSLQRQVEFLSMKLATVNPRLDLNIEGLLSKDLLRFPGVPSSSLGFSPEMMHPQLQLSQPGLIQGGAAGMANPDVFRRIIQAQLSAKDGSQMPHALNGSFSDVAQMGYPSPLGPQDLSIRPSQDGFQM

SEQ ID NO: 17215 - DNA, 2173 bp, Panicum virgatum
  misc_feature: Ceres CLONE 1791550
  misc_feature: Encodes the peptide sequence at SEQ ID NO. 17216
atgctgccgccgcttggcccatgcggccaccgcgaagcgccgcctcgggccgccgtcgcttgcgcccctggaggcgccgccacctcttgcgctgcggccaagcgctgcggccgagggccgctgctgcttgcacgcgtcctccaccaagccaagcgtcgctgccgtcgcggcctcctgtgtgtgccgttgcttgtgctgtgcgccgccacgaagagccggcaccccttgccacggcggagcgctagcgccggcggggccgcgcgcccctgccgcgcgccatcgaggtcagcgccgtggagcgacgccgtgcatcgctggtggagtgccgcttctccccctcattccatttttcttcttgcctcgatccgccccccttgtgcgccagttgtggcccggccgccggccttgtcagggcggcttgaccgagggtcgcctgcccgatgcgccgccgttgttgggcgccgctgtcgctgagtgccgtgtgcccgatgggccgcgccacacagcatggccggcaacccgtgaccgcgacgtggccgagaccacgggtgggtgagggggcgtcgtttgctgccgccggtggtgccgtgcttcctggtcgacggcgagggctccgatggtgagccatccagtgatcccgaccaccggcgaagcgtttgttgatgttcgttttggtgctgcagagatcatcgagtctctattcttacattttgggtgagtccatgactggaatcgtgaagccgcgaatgaaatttttaggcctcgtggcctctatcctttcttgcgatcttcttgcatgaactcggcgagttcctgtagtgttcttggttctcggcgagttttgttgtgcagggagcgtgaggccctctggcctcctccgttctttcgaacaactcagcgagttctgcaatcgcgagtcagtggagagtctggcgtgcgtgataacgtgttagtagtaaaagggattggaatgattgattgtattgattgatggtttagaccacttcttatatatgtacaagagggaaagggtgcctattctcgaagggacatgcccctttgtgaatggccccttcgggatgttggccctttcgataaaggtaaccgcctaatgactaaactaattaactattatagaaattgatcactaatactaatttcttcataacagaaacattctgtttgtagataaggatcatttataaaattgaagacaccattcttgttatttcaggttaggtaccgacccaatacacctttgattctgaaaggaattaatataagcatcagtggtggagaaaagataggagttgtaggaaggactggtagtggcaagtcaactttggtccaagcattattccggctcgtcgagccagcagaggggataatgattgttaatggaatagacatatgcacactgggtctccatgatctgaggtctcgcttcggcataattccacaggaacctgttctgtttgaaggaacaattcgaagcaacattgatccgattgggcagtattcagatgcagaaatatggcaggctctggagcgctgccagctgaaagatgtagtagtttcaaaacctgaaaaacttgatggtccagttgctgatagcagagagaactggagcgtaggccaaagacagctcctttgtcttggtcgtgtcattttgaagcagactcaaatcttatttatggatgaggctactgcttcagtcgactctcaaaccgatgcgacaattcagaggatcacgcgacaagagttttcatcatgtacaataattagcattgcgcacagaataccaacagtcatggactgtgatagagttttggttctggatgcctgtctggttaaagaatttgatgcaccatcaaggttgattgaacagccgtccctttttggtgcgatggttgaggagtatgctaaccgctcgtcgaacctataactccttccatgatactccggattttaagaaatataagagttagttttgatagtttgacacaatacatatgtagaatcctgtgctgagaataaaccatagaactagaaatttgacagtattgtaggaggtgagccacggtgaacccaagaactccttataatttgcggctttttgttacaagctcacataggggaagaaataagttgaaatttatcttttcaaaagtcc

SEQ ID NO: 17216 - protein, 185 aa, Panicum virgatum
  misc_feature: Ceres CLONE 1791550
  misc_feature (1)..(153): Pfam Name: ABC_tran Pfam Description: ABC transporter
  misc_feature: SWISSPROT Homolog: EC 3.6.3.44 Xenobiotic-transporting ATPase
MIVNGIDICTLGLHDLRSRFGIIPQEPVLFEGTIRSNIDPIGQYSDAEIWQALERCQLKDVVVSKPEKLDGPVADSRENWSVGQRQLLCLGRVILKQTQILFMDEATASVDSQTDATIQRITRQEFSSCTIISIAHRIPTVMDCDRVLVLDACLVKEFDAPSRLIEQPSLFGAMVEEYANRSSNL

SEQ ID NO: 17217 - DNA, 1692 bp, Panicum virgatum
  misc_feature: Ceres CLONE 1791551
  misc_feature: Encodes the peptide sequence at SEQ ID NO. 17218
acctccattgctgccatcgtctcggcttctcacctgtgcggtgaagcgagaaggcaagcatggaggagccgctcctcgccgcagcgacggggacgggaaagaacatcggagctggcgaggatcaggagagcccgcccgtgcgcgaggtcaagaagcagctgtacctcgccgggccgctcgtcgccgcgttcctcctgcagaacctggttcagatggtctccgtcatgttcgtcggccacctcggcgagctcgcgctggccagcgcctccctcgccaccgccttcgccggcgtcacgggcttcagcttgctggcaggcatggcgtgcagcctggacacgctgtgcgggcaggccttcggcgcccggcggcaccacatgctcggcgtctacaagcagcgcgccatgctggtgctcgcgctggtgagcgtcccggtggcggcggtctgggcctacaccggcgagatcctggcgtggtgcggccaggacccggagatcgccgccggggccggcagctacatccggtggatgatcccggcgctgttcgtgtacggggcgctgcagtgccacgtccggttcctgcagacgcagaacctcgtcgtgccggtgatgctcagctccggcgccaccgcgctgtgccacccggccatctgctgggcgctggtgcgcgggctcggcctcggccgcgacggcgccgcgctggccaacgccatctcctacctcgccaacctctccttcctggcgctctacgtccggctctcgccgtcgtgcagggccacctggacgggcttctccgccgaggcgttccgcggcgtccccgacttcctcaagctcgccgtgccgtccgccgtcatgatctgcatggagtggtggtccttcgagctccttgtgctgctctccggccttctccccaaccccaagctcgagacggccgtgctgtccatctgcctgaacactaacggcttcgcgttcatggtgccgctcggacttggtggcgccataagcacgcgcgtgtcgaacgagctcggcgcggggcggccggaggcggcccggctggcaacccgggtggtggtgctcgtggcgctggcggtgggcgcgtcggaagggctcgccatggtgctggtgcgcgacctctggggctacgcctacagcagcgaggaggaggtggcccggcacaccgccaggatgatgcccatcctcgccgtgtccatcgtcttcgacggcctgcagtgcgtgctctcaggtgttgtcaggggctgcggccgccagaaggccggcgccttcatcaacctcgcggcgtactacctcgccggcatcccctcggcgttcgtgttcgcctttgtttggcatctaggaggaatggggctctggttcgggatcatgtgtggattggtagtgcagatgctcctgctgctctccatcacattgttcaccaattggaacaaggaggcgttgaaggcgaaaaacagagtttccagttctgctcttcctgtggacattgcaacagcatgaggtggtctagtgtagaagtagaacatacacagggatgaggtaataacgctcaaggaggcatcgagtcaagtggccttgtgtaataatgcccacgctgtttatttttgagcagtcctgttcgtaaacccacgagatattccaacacagcaaaagacatcagtcacctgccatacaggacaaggtc

SEQ ID NO: 17218 - protein, 482 aa, Panicum virgatum
  misc_feature: Ceres CLONE 1791551
  misc_feature (260)..(423): Pfam Name: MatE Pfam Description: MatE
  misc_feature (39)..(199): Pfam Name: MatE Pfam Description: MatE
MEEPLLAAATGTGKNIGAGEDQESPPVREVKKQLYLAGPLVAAFLLQNLVQMVSVMFVGHLGELALASASLATAFAGVTGFSLLAGMACSLDTLCGQAFGARRHHMLGVYKQRAMLVLALVSVPVAAVWAYTGEILAWCGQDPEIAAGAGSYIRWMIPALFVYGALQCHVRFLQTQNLVVPVMLSSGATALCHPAICWALVRGLGLGRDGAALANAISYLANLSFLALYVRLSPSCRATWTGFSAEAFRGVPDFLKLAVPSAVMICMEWWSFELLVLLSGLLPNPKLETAVLSICLNTNGFAFMVPLGLGGAISTRVSNELGAGRPEAARLATRVVVLVALAVGASEGLAMVLVRDLWGYAYSSEEEVARHTARMMPILAVSIVFDGLQCVLSGVVRGCGRQKAGAFINLAAYYLAGIPSAFVFAFVWHLGGMGLWFGIMCGLVVQMLLLLSITLFTNWNKEALKAKNRVSSSALPVDIATA

SEQ ID NO: 17219 - DNA, 433 bp, Panicum virgatum
  misc_feature: Ceres CLONE 1791565
  misc_feature: Encodes the peptide sequence at SEQ ID NO. 17220
acgagcgacagccagtcaccacctacccgaagccgccgcgaccgatcgagccgagcgccccgcccccacgccgcgccgcgccgcgccgccaccgaaaccctagctcctcctcctcctcctcagccatggccaccgtctcgctcacgccgcaggtggtcttctccaccgagtcgggcggcgccctctcctccgccacaatcctccgtttcccgccaaacttcgtgcgccagctcagcaccaaggcccgccgcagctgcagcaacatcggcgtcgcgcagatcgtcgccgcggcgtggtcggactgccccgccggccgcccccactccggcggcggcggaggacgagccaacgcatgctgcgcctgctccgctcatacaacctcgtcaggtgtcggagggaagagggcgatgacagtcggtactcgagccggtac

SEQ ID NO: 17220 - protein, 102 aa, Panicum virgatum
  misc_feature: Ceres CLONE 1791565
  misc_feature: SWISSPROT Homolog: EC 2.5.1.48 Cystathionine gamma-synthase
MATVSLTPQVVFSTESGGALSSATILRFPPNFVRQLSTKARRSCSNIGVAQIVAAAWSDCPAGRPHSGGGGGRANACCACSAHTTSSGVGGKRAMTVGTRAG

SEQ ID NO: 17221 - DNA, 700 bp, Panicum virgatum
  misc_feature: Ceres CLONE 1791569
  misc_feature: Encodes the peptide sequence at SEQ ID NO. 17222
gaagtaccgcacgttcagttcagggaacagagcagcagcacaggcgtcgccatggcctcccagctctccgccgccgcgtccatgtccgccgccgtgccgcagttccacggcctccggggccggtccgtggcggcgctgccgccggcgagggccggcaggaagcgggcgcagggcatccggtgcgactacatcggctcggccaccaaccagatcatggtggtgtcgacgacgctgatgctggtggcggggcggttcgggctggcgccgtcggcgaaccggaaggcgacggcggggctgaagctcgagtcccgcgactccggcctgcagaccggcgaccccgccgggttcacgctcgccgacacgctggcctgcggcgccgtcggccacatcatcggcgtcggcatcgtgctcgggctcaagaacaccggcgcgctcgaccagatcatcggctaggtccagtgtctgcctttgccgctctcggcgccggcccggtgcccatgtaacctgcgtgtgtacatcgactctgcgctcatgcatctcgttccaatggacatagcttgtttgttgctcctttggccccagagttatcaggttcacgttcttacattaaaaaaaaataggcgggagagagagagagagagagcggtcgcagccgtcggccatggcggaggcggcgggagcccaagccccggcgcatggc

SEQ ID NO: 17222 - protein, 133 aa, Panicum virgatum; identical to SEQ ID NO: 12216
  misc_feature: Ceres CLONE 1791569
  misc_feature (48)..(128): Pfam Name: PSI_PSAK Pfam Description: Photosystem I psaG / psaK

SEQ ID NO: 17223 - DNA, 649 bp, Panicum virgatum
  misc_feature: Ceres CLONE 1791586
  misc_feature: Encodes the peptide sequence at SEQ ID NO. 17224
aggaggcgagcgaccggccgattcgagcagcagccagctagccatggcgacgcaggccgcgctgttcgctgggttctcgcagctcgccgcgcagccggcccgcgaccgcgccgggacgggggcgccggcgcgggttggcgtggcggcgatcgggggcgccagggcggggggcgtgaaggcgggggccgccgggcccgggtgggcggcggcgccccgcggggtgcggtgccgggccagcctgattgagcgcgacgtcgggcggctggtggacctggtggcgcccgaggagggcggccggcgcgcggccctgcggggggaggcggcgtccctgccgcaccggctgcgcctgggccgcgtcgacaaggagtggctccacgtcctgagcgaaggatgggccagcccgctgcaagggttcatgcgcgagcatgagttcctccaagcacttcatttcaacgccatccgcggcgcggatggcaggatggtcaacatgtccgtccccatcgtgctctccctcgaggacgcgcagcgacgggccatccaggccgacggcgccacgcgcgtcgcgctcgtcgacgaccgcgaccgccccctcgccgtattgagcgacattgagatctacaagcaccacaaggaagaaagaattgccagg

SEQ ID NO: 17224 - protein, 201 aa, Panicum virgatum
  misc_feature: Ceres CLONE 1791586
  misc_feature: SWISSPROT Homolog: EC 2.7.7.4 Sulfate adenylyltransferase
  misc_feature: The sequence is a functional homolog of SEQ ID NO 4 in US patent 7038109
MATQAALFAGFSQLAAQPARDRAGTGAPARVGVAAIGGARAGGVKAGAAGPGWAAAPRGVRCRASLIERDVGRLVDLVAPEEGGRRAALRGEAASLPHRLRLGRVDKEWLHVLSEGWASPLQGFMREHEFLQALHFNAIRGADGRMVNMSVPIVLSLEDAQRRAIQADGATRVALVDDRDRPLAVLSDIEIYKHHKEERIA

SEQ ID NO: 17225 - DNA, 659 bp, Panicum virgatum
  misc_feature: Ceres CLONE 1791586-R
  misc_feature: Encodes the peptide sequence at SEQ ID NO. 17226
gtgcaaatttctatattgttggaagggatcctgccggtatgagccatcctactgcgaaaagggacctttatgacgctgatcatggaaagaaggttttgagcatggctcctggccttgagaagctcaatatccttcctttcagggttgctgcatatgacacaaagcaaaagaaaatggatttcttcgatccatcaaggaaagatgattttctgttcatctctggcacaaagatgcgcactcttgccaagaaccgcgagagccccccagatggttttatgtgcccgggtggctggaaagttctcgtggaatactatgacagcttggtgccgtcagaggggagcagcaagctgcgcgagccagttgcagcctagaagctggaaatgcttaagataatggatactactgtatctcagcaagcggttctttgcgacatagaaccaatgttatatgattgtataccggtcgtaagacctacactgggcttgattcagacaattactgtgtggcttgtaattggtgtgcattatctgctggcagtgttgcacatgcaacgcagcccatctctcgtgttcagtgtcaataaggacgggctctgtatcctctgccagattgtacatatacgttgtggtgatatgtttacaaggcttgatatgctggct

SEQ ID NO: 17226 - protein, 122 aa, Panicum virgatum
  misc_feature: Ceres CLONE 1791586-R
  misc_feature (1)..(108): Pfam Name: ATP-sulfurylase Pfam Description: ATP-sulfurylase
  misc_feature: SWISSPROT Homolog: EC 2.7.7.4 Sulfate adenylyltransferase
  misc_feature: The sequence is a functional homolog of SEQ ID NO 4 in US patent 7038109
ANFYIVGRDPAGMSHPTAKRDLYDADHGKKVLSMAPGLEKLNILPFRVAAYDTKQKKMDFFDPSRKDDFLFISGTKMRTLAKNRESPPDGFMCPGGWKVLVEYYDSLVPSEGSSKLREPVAA

SEQ ID NO: 17227 - DNA, 2221 bp, Panicum virgatum
  misc_feature: Ceres CLONE 1791590
  misc_feature: Encodes the peptide sequence at SEQ ID NO. 17228
attgggagaagtcgtgccgtgccagtcgctgccgcctccctcccctccctccctccctccctccccgtttcttggccagattcccccgtctctggcgctggcgcccgtaatccccgattgggttcgttgattgacctgaccgccgatcgtgccgctaccgacgagagcccgattcttgccctgactcctccgcgggctgattggttggggaattgggggatggtccagtgtcttagtcgcccattgtgtagaggcctgagtccaagatcatcacaaatttgtttgagataaaagcattgggcagtgcaagttccagccgtggctgatggatgccacaaccagccgcggagcttcctcatctctccccctccacctcatcgtggatgacactcttgctcttgttactccattgcagcaatcatttcagcggtcgcagcgcctttgctttggtgactctgctccaggggaattcccattggctgcaaacccgtcaattgtcctccatgtcctcacatcgtgcaatctggaccctgaggacctcgcccacctggaggcaacatgcacattcttcaggaaacctgccaatttccctcccgatttcgatttgtcaatgtcggagctcgcagcgttggatttgtgtcagaaaagggctatctttaagcctatgactgcacatgaaagtgaactttttaagcaacgctgtggtgggagttggaagctagttcttagatttataatggcaggtgaagcatgttgccggagagaaaagtcacaggcaattgctgggcctggtcacagcattgctgtgacagcaagtggtgctgtgtatacttttgggtccaataactctggtcagcttggccatggaaatttagaagaggagtggagacctcgtgttgtcagatcattgcaggggattagaattattcaagcagcagctggagcaggacggacaatgcttgtcagtgatgctggtagggtgtatgcattcgggaaggactcctttggagaagttgaatatggcggtcaaggctccagggttgtgactacaccacaggtggtagaatcactgaaggacatatacgttgtccaggcagctattgggaacttctttactgctgtgttgtcccgggaggggcgtgtatatacgttttcatgggggaatgacacgagacttggtcatcagacagagccaaatgatgtgcaaccacatcttctcacaggggctcttgagaacattccagttgtgcagattgctgcaggctattgctatctccttgctctagcatgccaacctactggcatgtcagtttattctgttggttgtgggttaggagggaagcttggccatggttcacgaactgatgagaaatatcctaagttaatagaggaattccggaatttaaacatacagccagtggtagttgctgctggagcgtggcatgctgcagttgtaggcaaggatggacgtgtttgcacctggggatgggggcgttatggttgcttgggtcatggtaatgaggaatgtgaatctgttcccaaggtagttgaggctttgagtggtgtgaaggctgtccatgtagcaacaggggattacacaacatttgtagtatcagatgaaggtgatgtttactcgtttggatgcggtgaatcgtcaagtcttggtcacaacactataactgagggtaacaacaggcatactaacgtacttagccctgagttggtgacttctttgaaaagagttaacgaaaggatggttcaaatcagccttacgaactccatatactggaatgcacatacatttgcactcacagattcagggaaactatatgccttcggcgcaggggacaaagggcagctaggtaccgaacttgttgcccagcaaagcgagagggggaccccagagcgggtagaaattgacctcaactagctccaactacaatcaccctcttctccgcaaatacgctcatctaaccatcatggtctagtctgttggttcggcttagctcgccccctgcatatgtgcatgcattgtcaacctgcaggtcatctgatcattgtgaaaatagttaccagcaaggcaaacaacccgttgttgataagattggttctctttagcaaacctgtgtcgatagtcatgtaaatataacagtcaggtctcattgccagtcccatccaaacataagtgggtggcctgtgattgatgatttaacatgttgtg

SEQ ID NO: 17228 - protein, 534 aa, Panicum virgatum
  misc_feature: Ceres CLONE 1791590
  misc_feature (164)..(213): Pfam Name: RCC1 Pfam Description: Regulator of chromosome condensation (RCC1)
  misc_feature (380)..(429): Pfam Name: RCC1 Pfam Description: Regulator of chromosome condensation (RCC1)
  misc_feature: SWISSPROT Homolog: EC 2.7.11.1 Non-specific serine/threonine protein kinase
MDATTSRGASSSLPLHLIVDDTLALVTPLQQSFQRSQRLCFGDSAPGEFPLAANPSIVLHVLTSCNLDPEDLAHLEATCTFFRKPANFPPDFDLSMSELAALDLCQKRAIFKPMTAHESELFKQRCGGSWKLVLRFIMAGEACCRREKSQAIAGPGHSIAVTASGAVYTFGSNNSGQLGHGNLEEEWRPRVVRSLQGIRIIQAAAGAGRTMLVSDAGRVYAFGKDSFGEVEYGGQGSRVVTTPQVVESLKDIYVVQAAIGNFFTAVLSREGRVYTFSWGNDTRLGHQTEPNDVQPHLLTGALENIPVVQIAAGYCYLLALACQPTGMSVYSVGCGLGGKLGHGSRTDEKYPKLIEEFRNLNIQPVVVAAGAWHAAVVGKDGRVCTWGWGRYGCLGHGNEECESVPKVVEALSGVKAVHVATGDYTTFVVSDEGDVYSFGCGESSSLGHNTITEGNNRHTNVLSPELVTSLKRVNERMVQISLTNSIYWNAHTFALTDSGKLYAFGAGDKGQLGTELVAQQSERGTPERVEIDLN

SEQ ID NO: 17229 - DNA, 1226 bp, Panicum virgatum
  misc_feature: Ceres CLONE 1791618
  misc_feature: Encodes the peptide sequence at SEQ ID NO. 17230
ggggttaaggctgaggaggaggcctaatcactctcgctcgcagggtgccgctcggcttccgctctgcttcctctccgggcgggggaagagaggagaggcgacctgctccatcgatctcctcctcggtctactaagcggaatttcttatttttggtgagaatgaagcgcatgcacagaatgccaacgaggaagtcccactcatggtggtgggacagtcacattagccccaagaactccaaatggttagctgagaatttgcaagagatggataagcaagttaaagagatgctgaagctcatagaggatgaaggtgattcttttgcaaagaaggctgagatgtattaccaaagacggcctttgcttgtaacccatgttgagaacttctatcgcatgtaccgtgcacttgctgagcgttatgacaacgtgactggggaattgcgcaagaatcttccatcatctctgcagtctcaaggctctggtatatctgaaactgattccgagacgcaatcaatttccccatctccagagcctaacatggaacagaagacaccaaaacagaagcgcaaagcaagagcagttggctttgatgtgttccttggttctggtggaagctcagacatttcgaagaagggtagtgaaggatcatcgtcttcgtcttcttcagattctgattcagaggttgatgaaggaagtgaagaaaatggcaatggaatttcttatataatgaatggacggattaatgagctagaagaggagcttcaggaagcaaggcaacaaattgaggcacttgaggaaaagaacatgaactgccaatgtgaaaaacttgaagagagtctcaaacaagttagcagtgaaaaggaagatttggtagctgcagttctggcaaacaagaacgagattgagggtctaaaaggaaacctagcaaaagttacaggagagaaattgcagctcgaggcccaggtaaaggagcttgaacaagcatctcagagcttagacgattcttctgcagagattatgaagttacaagaaataatcaaggatctgcaagcaagattgcaaaatgattcaaatgagaaaagtatacttgaggaacgtgctatggagtttgagcaagttcgtaagcagttagaggattcaaggactgaggtcagggagctacaggctacaatcaagaacctgaaagatgacttagggaaaactctacaagagaaagcactgcttcagga

SEQ ID NO: 17230 - protein, 355 aa, Panicum virgatum
  misc_feature: Ceres CLONE 1791618
  misc_feature (14)..(87): Pfam Name: KIP1 Pfam Description: KIP1-like protein
MKRMHRMPTRKSHSWWWDSHISPKNSKWLAENLQEMDKQVKEMLKLIEDEGDSFAKKAEMYYQRRPLLVTHVENFYRMYRALAERYDNVTGELRKNLPSSLQSQGSGISETDSETQSISPSPEPNMEQKTPKQKRKARAVGFDVFLGSGGSSDISKKGSEGSSSSSSSDSDSEVDEGSEENGNGISYIMNGRINELEEELQEARQQIEALEEKNMNCQCEKLEESLKQVSSEKEDLVAAVLANKNEIEGLKGNLAKVTGEKLQLEAQVKELEQASQSLDDSSAEIMKLQEIIKDLQARLQNDSNEKSILEERAMEFEQVRKQLEDSRTEVRELQATIKNLKDDLGKTLQEKALLQ

SEQ ID NO: 17231 - DNA, 541 bp, Panicum virgatum
  misc_feature: Ceres CLONE 1791618-R
cagctgcacctggagcaagtcaagctgcttgaagaagcagatgtcgcacggaagactgtctcaggcctgcgtgcaagggtgtgcgagctcgaggaagaggttgagaagcagaaacttatgatatccgatagcgcagaagggaagcgggaggcgatcaggcagctgtgcttctcacttgatcactaccgccatgggtacgagcagctccggcagctccttcaaggccacaagaggcccatggtgatggcaacttgagtaagtagctcgtgggatccttcgttctggatgtccaaaattggtcccccggcggcttatcatgtaatttgagcgtctccttcccccgtccccccttttcctgtataatttgagtgaaacttatgctctgcagttactcgagcagttgagctactctctctctccccctctctctccctccctctccccctccctcccgctctccctctctctctcccgctctccctctctctctctctgtaatgtaatgagttatggataatcatggtaacggtattcccttctc

SEQ ID NO: 17232 - DNA, 2502 bp, Panicum virgatum
  misc_feature: Ceres CLONE 1791624
  misc_feature: Encodes the peptide sequence at SEQ ID NO. 17233
acccagagccagagagagctctcctcgtggactagggactagaagaggaggagagccatgtctgctgcagcctgcgcgccgacgccgctcgggatgctcacactcgcccaccggatggcgccgccgccgccgctggaggaggaggaggagccggcgccgggcgccggcgaggggtgcgtcgacgcgcagctctggctcgcgtgcgcgggctccatgtgcaccgtcccgcccgtcggcgccgcggtctactacttcccgcagggccacgccgagcaggccagcgccgccgtcgacatgtccgccgcgcgcggcgccccgcctttcgtcccgtgccgcgtcgccgccgtcaggtacatggccgagccgcacaccgacgaggtcttcgccaggatacgcctcgtcccgctccgccccggggagcccgtggcggacgccgccgacgccgacgccggggacgaccaccagcaccagcccaagccagcgtccttcgccaagacgctcacgcagtccgacgccaacaacggcggcggcttctccgtgccgcggttctgcgccgagaccatcttcccggagctggactaccgagcggagccgcccgtgcagagcgtctacgccagggacgtgcacggcgtcgagtggacgttccgccacatctaccggggcaccccgcgccgccacctgctcaccacggggtggagcaacttcgtcaacaagaagaagctgctggccggcgactccatcgtcttcctgcgcggcgagaacggcagggtccacgtgggcctgcgccgcgccaagcgcgggttcggcgtcggcgggggcgacgacggctccccctccctgtccgtgtccggctgggacccctacgggaacctggtgcggggcaatgcgggcggcggcgcgcgttcgccgagcggcaaggtcccgcccgaggacgtggtcgccgccgcgaggctggccgccgccgggcagccgttcgaggtggtgcactacccgcgcgccagcacgcccgagttctgcgtgcgcgcggccgcggtcagggcgtccatgcaggtgccgtggtgccccggcatgcggttcaagatggcgttcgagaccgaggactcgtcgcggatcagctggttcatgggcaccatctccggcgtccacgccgccgactccgcccgctggccgcagtcgccctggcgactcctccaggtgacctgggacgagccggagctcctacagaacgtcaagcgcgtgtgcccgtggctggtcgagcaggtgtcgagtatgcccaacctccacctgcccaacttctcgccgccgccgcgcaagaagcagcgcatcccagagttccccttcgagggccagccgcttttcgacccgcccgcccgcccgctccctccgctggcgccccacccgcacccgcacccgcacccgcacccacacccgctccccttcttccccttccccgacggcagcgctgctgcaggcatacagggagccaggcatgcgcaactcgctccattcttttcggatctccacaccggcaacctgcagcaaagcttgctgttttgcggcgtccgccccgccgatcaccacgcccctgccgcgccaaggatcagcaccgacctggcgatcggcaacccgccgccccgccgcgacgcgccgcgctctccaccagctgccgccaacaaggccgacgacgtcaagccagtggggataatgcttttcgggcgggcgatactgaccgaggagcagatgaagagcaacagcccgacctcgtcgccgggagccaccaggaaaaggtcacccaacacaccggatcgctccggctccggctccggcgtcaccgagggcagccctgcaaagaacaacctgttggacgcggggctggagcccgggcacgggcacgggcagtgcaaggccttcgtggagtcggacgccgtcggccggaacctcgacctctcggcgctgggctcgttcgaggagctgcgcgcccgcctgtcccgcatgttcctgatcgacgacgctgagctgaggatgagccatgtgctgtaccgcaccgccgccggcgaggtgaagcacgtcggcgatgagcctttcagtgcgttcatgagatcagcgcgaaggatcacaatactgggtgacgccggcagcgacaacacggggagccaatgagcacccgggatcagctgcaaataacttacggcgctacactcctaggacgcgcgcaataagccgggtgcacagctgaagaagctagctgcatctgcttgcggttttcttttttccgatcggcagaggcctagggagttcacagcttagccagggagctaggctgatgcgggtgttcagctaggttgattttcctcatcccttttaatcagtttagttcttgttgttgatgttttccccttctgataacgcaaacaggatgtaatctttggtccttaacctatatatccggttccccttttggatttcaatgttcaaactcgaagctctgtgctgctggttcag

SEQ ID NO: 17233 - protein, 700 aa, Panicum virgatum
  misc_feature: Ceres CLONE 1791624
  misc_feature (296)..(379): Pfam Name: Auxin_resp Pfam Description: Auxin response factor
  misc_feature (143)..(248): Pfam Name: B3 Pfam Description: B3 DNA binding domain
  misc_feature: The sequence is a functional homolog of SEQ ID NO 1185 in the 10/666,642 US patent application
  misc_feature: The sequence is a functional homolog of SEQ ID NO 442 in the 10/666,642 US patent application
  misc_feature: The sequence is a functional homolog of SEQ ID NO 1186 in the 10/666,642 US patent application
MSAAACAPTPLGMLTLAHRMAPPPPLEEEEEPAPGAGEGCVDAQLWLACAGSMCTVPPVGAAVYYFPQGHAEQASAAVDMSAARGAPPFVPCRVAAVRYMAEPHTDEVFARIRLVPLRPGEPVADAADADAGDDHQHQPKPASFAKTLTQSDANNGGGFSVPRFCAETIFPELDYRAEPPVQSVYARDVHGVEWTFRHIYRGTPRRHLLTTGWSNFVNKKKLLAGDSIVFLRGENGRVHVGLRRAKRGFGVGGGDDGSPSLSVSGWDPYGNLVRGNAGGGARSPSGKVPPEDVVAAARLAAAGQPFEVVHYPRASTPEFCVRAAAVRASMQVPWCPGMRFKMAFETEDSSRISWFMGTISGVHAADSARWPQSPWRLLQVTWDEPELLQNVKRVCPWLVEQVSSMPNLHLPNFSPPPRKKQRIPEFPFEGQPLFDPPARPLPPLAPHPHPHPHPHPHPLPFFPFPDGSAAAGIQGARHAQLAPFFSDLHTGNLQQSLLFCGVRPADHHAPAAPRISTDLAIGNPPPRRDAPRSPPAAANKADDVKPVGIMLFGRAILTEEQMKSNSPTSSPGATRKRSPNTPDRSGSGSGVTEGSPAKNNLLDAGLEPGHGHGQCKAFVESDAVGRNLDLSALGSFEELRARLSRMFLIDDAELRMSHVLYRTAAGEVKHVGDEPFSAFMRSARRITILGDAGSDNTGSQ

SEQ ID NO: 17234 - DNA, 1725 bp, Panicum virgatum
  misc_feature: Ceres CLONE 1791626
  misc_feature: Encodes the peptide sequence at SEQ ID NO. 17235
atccccgcttcccctgctgcccgcccctgctctgcagctgctcactgtgcgatatgcccctgcgagcgaccccctgcgagcccagggcatcctgctaatccattccccattgccgcttgcagctaccgccgccaccgcctcggctggctgtggctcccatatccacgccgccgcttccaagtaaagctgctgacaggccggtggcgccgcgctgttgttgctgaaggaagcggcaatggcggacgccgtggaggcgcttcctcctccggagagcggcgccgagtccgggaggtcgtcgccgtccccgaccgcgtcgcccgagttcgagttctggatggtgggcaggaacccgtccgcgttcccggccccggccctgctcaccgccgacgagctcttctccggcggcgtcgtgctcccgctccacaacctccaggcggcggccccagacggcgacggcgccactgctgccgctgaaggctgcgacgccgagggcgccggggccgactccaaggacgcggactccgcggcgcttccgctgccagaagcggaagcggaaggcgaggccgccgcgcagccgctcgcggagtccggcatcgcgccaacgccggacctccccgcggtcacgttcaagtggaaggacatcttcaaggcgggcggcggcgaggccaaggaccgcaagaaggtggagcgccgcgtcagcagcgtcagcgggaacgccgagctgatcaacatcaacatctggcccttctccaggagccgctccgccggccactccgcgggcggcgcggcgacgggctccttgagcagggccaagccagcaaatccgaatcccaacgccagcgccggctccagccggagcgccaacgccaatgccagtgcgaatgccagcgccgcgagcgcgccgccggccccggcgccagccccacgcaaggtgagcagcgccccgtgctcccgtagcaactctcgcggagagtcgtccggacctgctccagccattcccgccgccgctgcggatgcagcagcagcagctgctgctactgccgccgcagccgcagcacatgcaccagaagaagatgctacagcagccgaggcggcgccgttgcccacccctgcaaccgccgccgccaccaccaccaccagcagcagcgcctcgtccatgttgcggaggctggtgcccggacagggccgtaacaacaataacaccgcctccggcggcaccggcatccgcgtcggccgccccagcgcagtgtggcagctgcggcgcaacaagctgcagcaaaccgccgccgagcagaagcatgccaacgccaagaagaaggccacgcccgccccaaccgccgccgccgaagcagccgacgacaaggcgtcgccgagcgtggccgcgcccgcggccgggtgccggaacaacgcgggttgctcggagggcgccgccgaggaagggaacccgccgcaggggctcttcggactccgcaccttcttctccaagaaggtgtactgatccaccggcaccggcagagcagaccgcaacaacacgggcgttcagcgttgtacatacaaattcgagctctaggctcgttcttcgacatctttattaccttacgtccccctcttcctttttttttcctttttctccttcctctgctctaattcgactactactagtagcttcctcagctcgttctcgttactgtactgcaacctctgggcgcgtttagttccccattc

SEQ ID NO: 17235 - protein, 420 aa, Panicum virgatum
  misc_feature: Ceres CLONE 1791626
  misc_feature: Useful for making plants with altered carbohydrate content
MADAVEALPPPESGAESGRSSPSPTASPEFEFWMVGRNPSAFPAPALLTADELFSGGVVLPLHNLQAAAPDGDGATAAAEGCDAEGAGADSKDADSAALPLPEAEAEGEAAAQPLAESGIAPTPDLPAVTFKWKDIFKAGGGEAKDRKKVERRVSSVSGNAELININIWPFSRSRSAGHSAGGAATGSLSRAKPANPNPNASAGSSRSANANASANASAASAPPAPAPAPRKVSSAPCSRSNSRGESSGPAPAIPAAAADAAAAAAATAAAAAAHAPEEDATAAEAAPLPTPATAAATTTTSSSASSMLRRLVPGQGRNNNNTASGGTGIRVGRPSAVWQLRRNKLQQTAAEQKHANAKKKATPAPTAAAEAADDKASPSVAAPAAGCRNNAGCSEGAAEEGNPPQGLFGLRTFFSKKVY

SEQ ID NO: 17236 - DNA, 2225 bp, Panicum virgatum
  misc_feature: Ceres CLONE 1791630
  misc_feature: Encodes the peptide sequence at SEQ ID NO. 17237
agctcgcacgaccaccactcgcaacctatccttgcattcccagcatcgtcggcatcacgacgacttagtacgccatgaacggcgggctcctcgccgccgtgctgatcctcgtgttgcacccgccaccggccgacgcggctacgtcggcgacctgcgacagtagcggcggcgacggccgctacacgcccggcagcgcctacgaagccagcctccgccgagtcgccgacgctctccccaccaacgcctccacctccgccaacctctacgccaccgccgccgtcagcgccggcaccaaccagaccgtgtacgccgccgggctgtgccgcggcgacctggtcccctacacctgcctggtgtgcctccagtcgagcttcagcgacgcgcagctccagtgccccctcgacacggacgtgagcatgaactacgacgcctgccacatgcgcttcgccggcgtcgacttcctcgcctccaccaacaactcggtgcagctaccctacttcaccaacttccccgcggtggccgccgcctccgccgccggccgcttcaacggcctcgtggcggagctcctcgccgccaccgcaggctacgcggccgggtcggggaggaggttcgccaccggcgagatggacgtggacagcgactactcccaggggcagttctccaacatattcgcgacggcgcagtgcacgccggacctgacgccggcgcagtgccgcgcttgcctggccggcgccatggcggagatgccacgccaggtgttccccagcaactcgacgggggcgagcttcgtgggcgagcgctgcggcttgcagttcgccccgtatgcgttttataacggcgacaccatggtgaagctgcccattcggctgcaaggaaaaaagtcggcaacgactccagttcttgcaatagtacctgcagtattgggtggactattcgcactaacactaattgccctttgggtttggcggaagaagaggtcaccaagaaaaatgtcactcttcgtaaatgtagaagacatggaaagttttgagtccatatttatcggcctatccacgcttcagtcagcaacaaacaacttcgatgaaaacaacaaacttggcgaaggaagatttggtgttgtttataagggtgctctgccagatggacaagaagtagcagtcaagaggctttctgagagcacaacacaaggactaggccagatgaagaatgagctagctttgatagctaagctacagcacaaaaatcttgttaggattgtcggtgtttgcttggaagaaggtgaacaattgcttgtctacgagtacatgcccaacaaaagcctggacaccattatctttgatcccgataaaagtaaaaagctcgactggggagcgcgattcagaatactcaacggaattgctcgaggcctgcagtacctgcatgaacattcccagccgacgatagtccaccgggatctgaaagcgagcaatgttttacttgatgctgacatgaaacccaagatttcagactttggtctggcaaagatttttgatgatgaccaaacaaggcacatcacaagccgcatcattggaacactcggttacatgtctcctgaatatgccatgcgtgggcactactctacgaagttagacgtgttcagcttcggcgttcttgtcctggagatagtgactgggcgaagaaacaactacgcactgaacacactgtattctcaagacctcttctatcttgtgtggaaacactgggtcgagggaacaatcgcagaaatagcagacactagcctgggcaggcactacccaatggccgaagttctgaagtgcatcaacattgggctgctctgcgttcagcagaacccgacggaccggccatctatgtctgcgatcgtcgccatgctcggcagcgacacggtctccctggaagctccctaccggccagcctatgtcgacaggagcaggagctactcagagactgctgagcgtgtgaaggaagagctgtgctcggagcctcagacgtcgatcacggagctcacacctaggtagacagagaatttgacaaagaatttgcctgcagcaatatagtcagttcaacaggcacaaatatgaattcgaaggatgtgtgtattgtgtccgttgtgtatatatactgcacaaatagttatataataatgtacttgcaatgacattagtaaatcccgtggcaaaaatatacatgatgcaaacagttcgcac

SEQ ID NO: 17237 - protein, 653 aa, Panicum virgatum
  misc_feature: Ceres CLONE 1791630
  misc_feature (335)..(606): Pfam Name: Pkinase Pfam Description: Protein kinase domain
  misc_feature: SWISSPROT Homolog: EC 2.7.11.1 Non-specific serine/threonine protein kinase
  misc_feature: Useful for making plants with altered carbohydrate content
MNGGLLAAVLILVLHPPPADAATSATCDSSGGDGRYTPGSAYEASLRRVADALPTNASTSANLYATAAVSAGTNQTVYAAGLCRGDLVPYTCLVCLQSSFSDAQLQCPLDTDVSMNYDACHMRFAGVDFLASTNNSVQLPYFTNFPAVAAASAAGRFNGLVAELLAATAGYAAGSGRRFATGEMDVDSDYSQGQFSNIFATAQCTPDLTPAQCRACLAGAMAEMPRQVFPSNSTGASFVGERCGLQFAPYAFYNGDTMVKLPIRLQGKKSATTPVLAIVPAVLGGLFALTLIALWVWRKKRSPRKMSLFVNVEDMESFESIFIGLSTLQSATNNFDENNKLGEGRFGVVYKGALPDGQEVAVKRLSESTTQGLGQMKNELALIAKLQHKNLVRIVGVCLEEGEQLLVYEYMPNKSLDTIIFDPDKSKKLDWGARFRILNGIARGLQYLHEHSQPTIVHRDLKASNVLLDADMKPKISDFGLAKIFDDDQTRHITSRIIGTLGYMSPEYAMRGHYSTKLDVFSFGVLVLEIVTGRRNNYALNTLYSQDLFYLVWKHWVEGTIAEIADTSLGRHYPMAEVLKCINIGLLCVQQNPTDRPSMSAIVAMLGSDTVSLEAPYRPAYVDRSRSYSETAERVKEELCSEPQTSITELTPR

SEQ ID NO: 17238 - DNA, 1928 bp, Panicum virgatum
  misc_feature: Ceres CLONE 1791633
  misc_feature: Encodes the peptide sequence at SEQ ID NO. 17239
accatagtttgcagcatcagcatcagcctacctcgcgagtattagatcaacagtgcagtgaaactgtccaatgcggcagtgccagccaccaccaccggcactcatcacctccatcagattcagacctgcagctttgcctcgcattaatcaaggtatgtgtgtacgttggccgcaatatctcatactgctggtatatcattctgtgcaagttcttggtcgatttaatggcgtctgtggctaacgcacagctttcttccaacttcggtagctccgtgtgcttcctgcgtatcagatcaggatgtagctaacctgcaagtgcatgcctccgatcgtttgttgataggttttatttgcgagatggattatagcttcagcaacatgatcttgagcgagaccgcgtagagcggcggcggcgacggagggtcggtcttgctgccgccgccggaggtgggcggtgttggtggcgttggcgttggcgtcgaggggggcaacatgtcggtgctggagaggctagttctcgacgaggccctggcggcggcgatcctggagctgcagggcatccaggcgcccgccgcctgcgccggcaaggcgccggcggccggtggtggcgtggtcggggaggccgtcgccttccccgcgatggcgacgccaacgcccgcctacgcggacgttgacgcggatgtcctccagggacagcagcatcgccatcgccaccagggcgcgatggggatggcaccggactacgacctcacaccagcaacagccgctgtcgcggtaactactgcgccggctgccttcatcacaggcgccgcagcggcggttgacagcggcggcctcgtcgttgacgcgccggtcttctccggccacgagaccggcgcgccgggggccgcgacagcaacggcggcggtggccgtgacggcgacgacgacgagccagcggtgcgaagaaggaaaaggaggcggcggcttgaggcaacgccggcccaccaggaagcggaaagccgccgccgagccgtcctccgtgccggcgcaggagagcaccctgtgcagcctcctggcgtccaccacggcgggcgagggcggcggcatccagatcgccttcagcacgagcgctcaggctcccgccggcggcgccaagagggcgaagccgtcgctgagcggcagcgggtcgtcgagcatcagcttcgacggccggaacgccggggccggcaacggcggcggcgtggacgaccccatgtacgagccggacacggaggcgctggcgcaggtgaaggagatgatctaccgcgcggcggcgatgcgccccgtctccctcggctccgacgacgccggcgagcggccgcgccggcgcaacgtgcgcatctcctccgacccgcagacggtggcggcgcggcagcggcgggagcgcatcagcgagcgcctccgcgtgctgcagaagctcgtcccgggcggcgccaagatggacaccgcctccatgctggacgaggccgccaactacctccgcttcctcaagtctcaggtccgggagctgcaaaccctagaccgccggaactacgccagcaacgtgaacaacgccatagcggcgccgcctccaccatggccgggtcactgagctacaacgatggcaacggtgtgccatgcgctggccttcaatttcattctcggcagcagccgaaaccctacgaggaggagggggaggtgccgatcgagctagcagctgatttagtcacttagttggatgatgcatgatagatttgtaacactcatgcatgttgctgttaatactttttatgtctgtccaatgtgcgtgcatgagaccatcttatgatgtattcatcattgttagttcaaatactagggagatgatgatgatgatatcgatgatgggatctaccaatgcaacaaggatgcaaattggcttcatcagtc

SEQ ID NO: 17239 - protein, 372 aa, Panicum virgatum
  misc_feature: Ceres CLONE 1791633
  misc_feature (293)..(340): Pfam Name: HLH Pfam Description: Helix-loop-helix DNA-binding domain
  misc_feature: The sequence is a functional homolog of SEQ ID NO 1939 in the 10/374,780 US patent application
  misc_feature: The sequence is a functional homolog of SEQ ID NO 1831 in the 11/479,226 US patent application
  misc_feature: The sequence is a functional homolog of SEQ ID NO 296 in the 10/374,780 US patent application
  misc_feature: The sequence is a functional homolog of SEQ ID NO 8 in the 10/225,066 US patent application
  misc_feature: The sequence is a functional homolog of SEQ ID NO 914 in the 10/412,699 US patent application
  misc_feature: The sequence is a functional homolog of SEQ ID NO 1938 in the 10/374,780 US patent application
MSVLERLVLDEALAAAILELQGIQAPAACAGKAPAAGGGVVGEAVAFPAMATPTPAYADVDADVLQGQQHRHRHQGAMGMAPDYDLTPATAAVAVTTAPAAFITGAAAAVDSGGLVVDAPVFSGHETGAPGAATATAAVAVTATTTSQRCEEGKGGGGLRQRRPTRKRKAAAEPSSVPAQESTLCSLLASTTAGEGGGIQIAFSTSAQAPAGGAKRAKPSLSGSGSSSISFDGRNAGAGNGGGVDDPMYEPDTEALAQVKEMIYRAAAMRPVSLGSDDAGERPRRRNVRISSDPQTVAARQRRERISERLRVLQKLVPGGAKMDTASMLDEAANYLRFLKSQVRELQTLDRRNYASNVNNAIAAPPPPWPGH

SEQ ID NO: 17240 - DNA, 2067 bp, Panicum virgatum
  misc_feature: Ceres CLONE 1791645
  misc_feature: Encodes the peptide sequence at SEQ ID NO. 17241
gcatttccgcccctccgatctcctcctcctccccgcctcttctctttctctccatctccctccgcggagagtgctcgtgttcgtcactcctcccgcttcctttccccgcacttagatccgcggccgtttcccgatccccgcacctcgcgcggcgaggggcatcttgagccctaagcgcgtacgcgcgcgcccgcctggtggccggcaagcaccgagccggcctcctcccgctgaacacgggaccacctcgaggggattttttttcttcttctccgcggccgtcttcctcctcgtcccctctggcgggccggcgcggagcgaagcgaaggtccacccgtgcttggattggtttcttcgttcgttgtggttagaggcacatggtttgttctggccgaagctggtggtacatgtgaatagcagggcctatcttttgtctcagattttgcttctaagcaatggccaatgtaagcaaacacgtggaaccttcaagcacagcagcaaatgacaggaagtacaaaggcacattggttgcttctccagcaaaacccatttcacctaagtgcatgaatcgcattgtgccatcgaggcaactgatattgggtggtgattcactaggccatgtggcatcatttctgcttaaggttgttgttcttgaggcagtaagaagagtttctaaggcaagatgccctttcatatggaattctgttcaagcattgcaaattcttgtgtatcctccatttagctggattcaacgatgggcaccactcaaatttattgtgcaaggaattcagaaactatccatgccgctgttgtttctgtcagtgacaacaacattaagtgagcggtcttctaagcgtgatgatgaaccggacagcaataccagcacagaacattctgagacaccttctgaagcaaatgaatcagcatcaacttctagcacaagggatgtttctgatggcacaaaggaaatcgtgcaagagaattggcttgtgttacttttcagagaacttgagaagcaaggcatcactttgcctgagaggttcacggaagatgagttacgcagattttatgttgcggcaaatggtgacttttcaagtttactctcttcggttaagaagacaattcgttggagggaaacatttcacatacttacattgcaagaacttgataagtggtctcacttagtcttttggcatggatttgatacaatgcttcggccttgtttagtaattcgtcttggactggcatgctctagtataccacctcgtgatagacctcgttttggccaagcagtagtctctcaaattgaccacggtgttgtcaatttgatcaatgaagaagatccaagaattactgttttgctggattgccatgggatttctccattcagatttccgatgcaaatgttgaggtcatttatcactgtagttcaagaaaactacccaaatcgtctcggggtattgtttgtcctccgccttcctccagttgtcagagttattgcacagacatttctacaagtattgaaaccgtctacaaagcagaagttgcgttttgagggagattcatacaagaagactttggcagagttcttgcaggttgtgcctgcatttctaggcggcaaatgcagctgcccgcaatgtgagaaacctcgggataggtcagtaatacaggcaggggaagggagcaagagccagcctcgcctaatcagcgttggtgatggattacctgtcacagattttgacttcgatgaagcagagattctatcaccttacagctgtgagaatgccatcagggctgcgataattggcctgttgatggtttgcatcttcatcgcatttctggctgggatgaacgacccgacttcggttccgtccagtgcctgagttatggagttgcctgctctcctgtagcagatcttagagattgtcagctgtgtaatagagtatatatatacatgtgtttctgttagaatgctagggtcttggttttcttgtcaatttatcctcggttgtctccggaccgtcgtataatgctttgaattccaccaatgtgcagatgaataatacc

SEQ ID NO: 17241 - protein, 475 aa, Panicum virgatum
  misc_feature: Ceres CLONE 1791645
  misc_feature (243)..(416): Pfam Name: CRAL_TRIO Pfam Description: CRAL/TRIO domain
MANVSKHVEPSSTAANDRKYKGTLVASPAKPISPKCMNRIVPSRQLILGGDSLGHVASFLLKVVVLEAVRRVSKARCPFIWNSVQALQILVYPPFSWIQRWAPLKFIVQGIQKLSMPLLFLSVTTTLSERSSKRDDEPDSNTSTEHSETPSEANESASTSSTRDVSDGTKEIVQENWLVLLFRELEKQGITLPERFTEDELRRFYVAANGDFSSLLSSVKKTIRWRETFHILTLQELDKWSHLVFWHGFDTMLRPCLVIRLGLACSSIPPRDRPRFGQAVVSQIDHGVVNLINEEDPRITVLLDCHGISPFRFPMQMLRSFITVVQENYPNRLGVLFVLRLPPVVRVIAQTFLQVLKPSTKQKLRFEGDSYKKTLAEFLQVVPAFLGGKCSCPQCEKPRDRSVIQAGEGSKSQPRLISVGDGLPVTDFDFDEAEILSPYSCENAIRAAIIGLLMVCIFIAFLAGMNDPTSVPSSA

SEQ ID NO: 17242 - DNA, 1566 bp, Panicum virgatum
  misc_feature: Ceres CLONE 1791647
  misc_feature: Encodes the peptide sequence at SEQ ID NO. 17243
gacctggactttcatccgataaggcagagcccaggcaggccagcaggccatcataagcgcggcagagtaggccgagccactcttcctgagcgatcgaggaaggagcagcaggaagggcagccatggcgaagcccatctccatcgaggtgtgaaatcccagcggcaagtaccgcgtggtgagcaccaagtccatgccgggaacgcggtggatccgcctgctcaccgacaacgactgccgcctggagatatgcaccgaggccaagaccatcctctccgtcgacgacatcctggcgctcatcggcgaccgctgcgacgccgtcatcgggcagctcaccgaggactggggggaggtgctcttctcggccctcaagcgcgccggcgggacggccttcagcaacatggccgtcggctacaacaacgtcgacgtcgaggctgccaacaggaacggcatcgccgtcggcaacacgccgggcgtcctcaccgagaccacggctgagctcgctgcctccctcacgctggcagcagccaggaggatcgtggaggcggaccagttcatgagggctggcctctacgagggatggctcccgcacctgttcgttggcaacctgctcaagggtcagactgttggggtcatcggagctggtcgcatcggctccgcgtatgcacgcatgatgatcgagggcttcaagatgaacctcatctactacgacctctaccaggccacacgccttgagaagttcgtcacagcatatgggcagttcctcaaagccaacggtgagcagcctgtcacctggaagagggccgccaccatggaggatgtcctcagggaggctgatgtgataagcctgcatccagtgctggacaagaccacttaccatctcataaaccctgagaggctggccatcatgaagaaggaggcggttcttgtgaacgcaagccgggggcctgtgatcgatgaggttgccctggtggagcacctcaaggccaatcccatgttccgcgttgggctcgacgtctttgaggatgagccttacatgaaacctggactggctgacatgaagaacgctgtcgttgtaccacacattgcatcagcctccaagtggacacgtgaaggaatggcaacgctggctgctctcaacgttcttggtaagatcaagggttaccctgtttggggaaaccccaatcaagtggagcccttcttgaacgagagcgcgacgccaccgcctgcttgcccgagcatcgttaatgcgaaacaactcggcctgccatcttcaaagctttaggggccaatgacgttgctactgcatactaagttacaagtgaagtatacatacttggaaggcatctatctatatatcagaatgatgagcagctgcagtcagagcttcctctccattaatatcatatataatatcataatcgccctccaacttattaatcagctacatgttagtatatagcagtatctgcaacttaatttttgatccatgcatgtatgtatctggaataatgaagccatgcaccatgtatatatatatgtatgtatctttaatttcttctccatgg

SEQ ID NO: 17243 - protein, 363 aa, Panicum virgatum
  misc_feature: Ceres CLONE 1791647
  misc_feature (105)..(299): Pfam Name: 2-Hacid_dh_C Pfam Description: D-isomer specific 2-hydroxyacid dehydrogenase, NAD binding domain
  misc_feature (8)..(334): Pfam Name: 2-Hacid_dh Pfam Description: D-isomer specific 2-hydroxyacid dehydrogenase, catalytic domain
  misc_feature: SWISSPROT Homolog: EC 1.1.1.29 Glycerate dehydrogenase
MPGTRWIRLLTDNDCRLEICTEAKTILSVDDILALIGDRCDAVIGQLTEDWGEVLFSALKRAGGTAFSNMAVGYNNVDVEAANRNGIAVGNTPGVLTETTAELAASLTLAAARRIVEADQFMRAGLYEGWLPHLFVGNLLKGQTVGVIGAGRIGSAYARMMIEGFKMNLIYYDLYQATRLEKFVTAYGQFLKANGEQPVTWKRAATMEDVLREADVISLHPVLDKTTYHLINPERLAIMKKEAVLVNASRGPVIDEVALVEHLKANPMFRVGLDVFEDEPYMKPGLADMKNAVVVPHIASASKWTREGMATLAALNVLGKIKGYPVWGNPNQVEPFLNESATPPPACPSIVNAKQLGLPSSKL

SEQ ID NO: 17244 - DNA, 1198 bp, Panicum virgatum
  misc_feature: Ceres CLONE 1791651
  misc_feature: Encodes the peptide sequence at SEQ ID NO. 17245
gcccgtcacagtcgcattgctcgcaccgcatcgcttcgcttcgagttcgggtctcttcgcctcgcgtgcgcggagcatagtagcgggtctctccacttcgggttcgctcgctcggcccggtcgcttcgagaaggaaaaggaaaaagaaaaaaaaaagaaaaaaaggataagcaagcagcacggagacgactcgactcgagcggctaggaggcggaaataaaaaagaggataaggcgaggcgcggccgggcggccaccgcgcgctcccagatccgtccttctcccgcgcagatccagctcgccggcgcgccctcgagcggacgtcgtaccctcgcgccggatcccggcatcggggttcctgcttcttcagatccagcgttaccagatctgtgtcccgctggcgcctgggcacatgacaccgacggtcctaatggagtttgggcagcagaggcccataaaacgggcctacgaggaaatgaccttccggggcggggcgccagctgcgcctcgggggtatgcagagacagttgcggagtcggaatgtgtagctggcagccctgttcgtgttgattccgaggactcttcagcgccgaagcgcaagtgcatcagcctgaacagcgatggctttgacgtgaagcgggagatctttgtgccgtccaagatgtcatcatctgagcggcggtatcttcggaagagattccgggtggagcttgattctgtgcgagatctcctcaagaagccagagtttgcagcccctgttcctgtgagtcgggcacctgcgttgtcatcctcagcagcccctcgaaccaaaaaggtgcaccgtgggagcaatgttgcccgcggcgcaaagggacggttcttgcctactaaaccccggcctgaaccttctgcagagttatctgaagctgcagtgtttaagcagtgtgaagctattttgaagaagctcatgactcagaaatatagtcatatattcaatgttccagttgatgttgtgaagctgcaaattcctgattattttgacatcatcaagaccccaatggatcttggtactgtccagaagaagcttgaatctggctcatacacaagtccatcagattttgctgctgatgttaggctgacttttaacaatgcgatgacttacaatcctcgtggccatgctgtacatgacatggccatccagctgaacaagatgtttgaga

SEQ ID NO: 17245 - protein, 256 aa, Panicum virgatum
  misc_feature: Ceres CLONE 1791651
  misc_feature (161)..(250): Pfam Name: Bromodomain Pfam Description: Bromodomain
  misc_feature: SWISSPROT Homolog: EC 2.3.1.48 Histone acetyltransferase
MEFGQQRPIKRAYEEMTFRGGAPAAPRGYAETVAESECVAGSPVRVDSEDSSAPKRKCISLNSDGFDVKREIFVPSKMSSSERRYLRKRFRVELDSVRDLLKKPEFAAPVPVSRAPALSSSAAPRTKKVHRGSNVARGAKGRFLPTKPRPEPSAELSEAAVFKQCEAILKKLMTQKYSHIFNVPVDVVKLQIPDYFDIIKTPMDLGTVQKKLESGSYTSPSDFAADVRLTFNNAMTYNPRGHAVHDMAIQLNKMFE

SEQ ID NO: 17246 - DNA, 784 bp, Panicum virgatum
  misc_feature: Ceres CLONE 1791651-R
tgagactagtccagagcgctcccagggttatcaaccaggatctgtcaatccgttgttagaacaacttggacttttcatgaaagtagatgatgaggaagatgatgaagagccgagcagtgttcccggcgttaaagaagcagaggaaggagagatcaattgatggttctgtcttggctgccatgccctgtcacatgggctagaggctggtgccaacctattgattcaacaaagcaatcgcctctcgcagccaatgtttgcctggtgatggctggacagctgcacgtggtggatgctcaattgcttccaaactggtgcagggaaagccatcaattttgttgctgctgatgccgacctggaagaaatcaccttgaacaattgtaaaaatgagagatcatgtgcttcaggaaggcttactggaggttgagatcactgcggacagctccaaatgaacatatttatgtgcagacgacggtattttttttatgccaccaagaaagatggcgacatgatactcaaatgaatgaatgatgccgagctggctcattgtttgccgcaactcctctatttcaagcaactcctatttcaagcgggtttactctgcggcttatagcagttctcatcttctgttttccccccttatttttcttgttttagattttgtagttgcttcctgctgtaaatctgaattttgatgtagtgaaggaagccctagtttgtttgggcatgggcgaaaggaactgctctttgcttagcatttacaggaaaaagttgtttttgcagatgc

SEQ ID NO: 17247 - DNA, 544 bp, Panicum virgatum
  misc_feature: Ceres CLONE 1791654
  misc_feature: Encodes the peptide sequence at SEQ ID NO. 17248
cgcctggtcctcctccgcactggacaacagagccacctcaaccaagcggcgctcctccgccccgcgctcgggccgaagagacttagtggggcggtgctccctccgctagctccgcaaccgcttcgactcggtcctcaacacgcagaagatcaccgaggccatgaagctcgtggccgccgaccaggtcccgcacgcgcatgatgccgccgtctcgtcccgccacttctcggaggccctggtcgaggtgctctacaacatgaaccacgagatccacacggaggacatcgacctgccgctgacccgcacccgccacgtgaagaaggtctctctggtggtcctcaccggcgagcgctgcctctgcggcagcttcaacaacaacgtgctgaagaacgcatacgcccgtatcgactagctcacgcagctgcggctcgagtacaccgtcttcaccgtggggaagaagggcaacgcctacttcacgcgccgccactacatcacgatggagcgggagctggaggtgaacgtcgtgcccgcggcgaaggactcg

SEQ ID NO: 17248 - protein, 83 aa, Panicum virgatum
  misc_feature: Ceres CLONE 1791654
  misc_feature: SWISSPROT Homolog: EC 3.6.3.14 H(+)-transporting two-sector ATPase
MKLVAADQVPHAHDAAVSSRHFSEALVEVLYNMNHEIHTEDIDLPLTRTRHVKKVSLVVLTGERCLCGSFNNNVLKNAYARID

SEQ ID NO: 17249 - DNA, 693 bp, Panicum virgatum
  misc_feature: Ceres CLONE 1791655
  misc_feature: Encodes the peptide sequence at SEQ ID NO. 17250
gcgtgccactcccacaagcccatctctgtctctccctccgccccggctaccaaatcaatttggggagaggggcaagaagcccgcgctcgcttgtctgcttcgctgcgttcgtggtggtaggcggggaaggcttcgtcgcggcacgaagcggcgaggtttggtgtttgtagaattgcctaggtgaggtcctgctgcttggacacagccatggccaccggagtggcaccagctcctctcccacacgtccgggtgcgcgatggcggcatcgggttcaccaggagcgtagactttgctaaggtcttatctgttcccggcgttggcacgacgaggacaggctactcgaggggcagggcgctcgtggtgaagagctcgagtactggttcagataccatggagcttgagccatcatctgaaggaagcccacttttggtccccaggcaaaagtactgtgaatctattcatcagacaaggagaaggaaaactcgtactgtaatggtggggaatgtcccactcggtagtgatcatcccataagaattcagaccatggcgacttcagataccaaggatgttgccacaactgtagaagaggtgatgaggatagcagataaaggagccgatcttgttagaataaccgtccagggtaagaaggaagctgatgcctgctttgagatcaagaacaccctggttcagaaa

SEQ ID NO: 17250 - protein, 161 aa, Panicum virgatum
  misc_feature: Ceres CLONE 1791655
  misc_feature: SWISSPROT Homolog: EC 1.17.4.3 4-hydroxy-3-methylbut-2-en-1-yl diphosphate synthase
MATGVAPAPLPHVRVRDGGIGFTRSVDFAKVLSVPGVGTTRTGYSRGRALVVKSSSTGSDTMELEPSSEGSPLLVPRQKYCESIHQTRRRKTRTVMVGNVPLGSDHPIRIQTMATSDTKDVATTVEEVMRIADKGADLVRITVQGKKEADACFEIKNTLVQ

SEQ ID NO: 17251 - DNA, 628 bp, Panicum virgatum
  misc_feature: Ceres CLONE 1791655-R
  misc_feature: Encodes the peptide sequence at SEQ ID NO. 17252
gaagctgctgaccaggaatttgagttcctgagggacacatctttcaacttgcttcagggttgcagaatgcgcaacacaaaaactgaatacgtgtcttgtccttcatgtgggcgaacacttttcgatctccaggaaattagtgctgagattagggaaaagacctctcatctgccaggcgtctcgatcgcgatcatgggttgcattgtcaacgggccaggagagatggccgatgccgatttcggatacgttggaggcgctcctggaaagatcgatctttacgttggcaagaccgttgtgcagcgcggcatcgccatggaaggcgccaccgacgccctgatccagctgatcaaggaccacggccgatgggtggaccctccagccgaggagtaagggctgtagctgcccaccctcagtagtttatattctgtaaaaagtgaaacacgcaatgcgtgcggtaactgagcatacagatactgtgtacgtattcacgttgagtacatcgtccctgcactacacattttgtagcgcgtacatttattatattattcagaaataattaaaaattagaaatagggggtgtgaccgcaggtttgcagcatcacggtatacgtggaaataagattgtgcc

SEQ ID NO: 17252 - protein, 129 aa, Panicum virgatum
  misc_feature: Ceres CLONE 1791655-R
  misc_feature: SWISSPROT Homolog: EC 1.17.4.3 4-hydroxy-3-methylbut-2-en-1-yl diphosphate synthase
EAADQEFEFLRDTSFNLLQGCRMRNTKTEYVSCPSCGRTLFDLQEISAEIREKTSHLPGVSIAIMGCIVNGPGEMADADFGYVGGAPGKIDLYVGKTVVQRGIAMEGATDALIQLIKDHGRWVDPPAEE

SEQ ID NO: 17253 - DNA, 484 bp, Panicum virgatum
  misc_feature: Ceres CLONE 1791669
  misc_feature: Encodes the peptide sequence at SEQ ID NO. 17254
aatctctctcctccctccctcccaccctccgcccccttcccgatgcgccggcggaaaccctagctccgccgatctacctctctccggcgcagcacaccccaagggaggggatggcggcggcgccggcagcgggaggacagggcggcgggggcatggacaccgccctcctctacaacttcatgcgacccctgctcgaggtgcggaccgcgcgccccgggaagcgggtgcggctctccgaggcggagatccgccagctctgcaccgcctcccgcgacatcttcctcagccagcccaacctgctcgagctcgaggcgccgatcaagatctgcggtgacatccatggtcaatacagctatcttttaacgctttttgaatatggaggctttcctcctgaagccaactatctattcttaggtgattatgttgatcgaggcaaacaaagtttggagactatatgccttcttcttgcatacaaaatcaagta

SEQ ID NO: 17254 - protein, 124 aa, Panicum virgatum
  misc_feature: Ceres CLONE 1791669
  misc_feature: SWISSPROT Homolog: EC 3.1.3.16 Phosphoprotein phosphatase
MAAAPAAGGQGGGGMDTALLYNFMRPLLEVRTARPGKRVRLSEAEIRQLCTASRDIFLSQPNLLELEAPIKICGDIHGQYSYLLTLFEYGGFPPEANYLFLGDYVDRGKQSLETICLLLAYKIK

SEQ ID NO: 17255 - DNA, 599 bp, Panicum virgatum
  misc_feature: Ceres CLONE 1791694-R
  misc_feature: Encodes the peptide sequence at SEQ ID NO. 17256
ccagcgatctcataacatacatagaagtagcaagatcttcattctatgagatctttgcctcagcaactattcttttttgaagcatggttagttttttttccttatattactggctgcctgatactacatgagatgttccatgttgagctgaatgggtcttgttcagacagtgatttatatattctatggagtatggactatgtaaaccagaatttccttgcacatgtcatactactgcttgttgcttcagccgaagcaaatccatgagatcaaggacttcccccttactgctataaggaaggatgctcgctctgtgaaaatcaagaggagcaaagatgttgtgaagttcaaggtgcgctgctccaagtacctgcacaccctttgtgtcttcgtctcttcgacatggagaaggcgaacaagttgaagcaatcccttcccccaagttagcacaacattattcgtgtaacctcactttgattgaccatgttgggttgtctccaactgatgcttgctcttacctttcacaaaattgtttcttctggtggctttgtaaattgactgtcttagtcgcattctttctgtggagtcccttttgttcc

SEQ ID NO: 17256 - protein, 66 aa, Panicum virgatum
  misc_feature: Ceres CLONE 1791694-R
  misc_feature (10)..(60): Pfam Name: Ribosomal_L38e Pfam Description: Ribosomal L38e protein family
MSYYCLLLQPKQIHEIKDFPLTAIRKDARSVKIKRSKDVVKFKVRCSKYLHTLCVFVSSTWRRRTS

SEQ ID NO: 17257 - DNA, 694 bp, Panicum virgatum
  misc_feature: Ceres CLONE 1791694
ttcgaaaatcccaatacccacagctagggtttctcgcttcccgtccacaagccgccgccacagcaccccacgacgctccgccgccgcgaccaccagtcctcgaggaaagcggaggaacaaaaggggtgcggctttggctttcttcttctgggccttctcatcggtgtttcatgtcattcggtcctgacagattttagtgggggtaaagtgaaaagtaatcatggcgccggtggcagcgaccgttggcaaccaccgcaggaggagccgtgttccagcggccgccgccgccgccgccgccggaaacgatgatggcggggagcagcatctcaaccccttcatggacgcagctccatccacctcctcgagggtccagttcaggcgcaggaatgtggcctcacgcgcgcggtgggtggaagaggctggtgccggagaggtggtggagagcaagggcaagctatggctgaccaccggcgtcacccggggcagcaagctgtgctacaacgtcgaggagattgggttcttggttgaaaagggtgccttgattcttctcaatgacaaggatgaaatgataggaatagaagccatttacgaaaagattgctggaggaaaatatgggtgttcctgggatgccttctaagcttataaacacttgaaatcgcttggttatattgttggacgatacggtgttccctgg

SEQ ID NO: 17258 - DNA, 354 bp, Panicum virgatum
  misc_feature: Ceres CLONE 1791703
  misc_feature: Encodes the peptide sequence at SEQ ID NO. 17259
acgtcatcctcggcctcaaccacgccacccgcgcgcactccgccatcgacatcatcaaccgccgcaagatcccctccctccacatcaactaccagcccctcatgcacatctgcacgctcaagctccacctcctccattaatgtgctccgcctgctccaggttcccgctatgagaaccaagatttacatcatgcttgaattcctcaacctgggcgagctatttgattccatagctgtcaaaaagaaaatgatcgaacatgaggaagcgatgtctttccctgatctaattcacctctctactgactgccacaataaatgcgtctacgacacgcacctcaagccagatacacttctt

SEQ ID NO: 17259 - protein, 61 aa, Panicum virgatum
  misc_feature: Ceres CLONE 1791703
  misc_feature: SWISSPROT Homolog: EC 2.7.11.1 Non-specific serine/threonine protein kinase
MRTKIYIMLEFLNLGELFDSIAVKKKMIEHEEAMSFPDLIHLSTDCHNKCVYDTHLKPDTL

SEQ ID NO: 17260 - DNA, 1617 bp, Panicum virgatum
  misc_feature: Ceres CLONE 1791712
  misc_feature: Encodes the peptide sequence at SEQ ID NO. 17261
gcactcccaggccccagtctccaccgcgccactctcccagtctcgctccagctctcggcggcaggcggcgcccggcgaatcaccgattgccagtgaccggtctccgctcgccgactcaagcgtccgcgcacccgcgagcccccagccagcccgacagccgtcatgcggccaccaccgtcgcccctgctccaccacctccgcctcctcctcttcctcgccgccgtgccgagtgctctatccaagtcgacgctggagtcctgcgcctcggccaccgcctgcccggcgctcctctcctacacgctctacgcggacctgaaactggccgaggtcgcggcgctcttcgccgccgacccgctcgccatcctggccgccaacgccatcgacttcgcggcgcccgacccggccgaccgcatcctccccgccggcctgcccctccgcgtgccggtcccctgcgcctgctccgacggcatccgcaaggccacctccgcccgctacgtggcccgcgccggggacacgctggcgtccgtcgcagggtccgtctacgccgggctcaccaccgccgactggatccgcgactccaacggcatgcccgagggcgccgcgctcgacgccgggaccacgctcttcgtgccgctccactgcgcctgcttcggcggcgccgacgacggcgtgcccgcggtgtacctgacctacgtggtggccgggggcgacaccgtgccggccatcgcgcggaggttccggaccacggggaacgacctcatgagcgtcaacgacctggccaccgccgacgtcgccgccggggacatcatcgtcgtgcctctgcccgcgtgcgcgtcgtcgttcccggcgtacacgtccgacgccggcctgtccgtggcgaacgggacctacgcgatcaccgccaaccgctgcgtccagtgcagctgcggcccgggcaacctggacctgttctgcgtgccggcgccgctggcggagtcgacctgctccagcatgcagtgcggcaacagcggcatgatgctcggcaacttcacgctccagatgaccagcgccggctgcagcgtcacctcctgcagctacgggggatacctgaacgggacgatcctcaccacgctaaccacgtcactgaagcctcagtgcccaggcccgcaccagttccctccgctgatgccgccgccgacgtcgtccttcttcgagacgtacctcggcccgtcgccggcgccgatgccatctgaagggggcgtcggcccgcagatggctggcatggcgccgatgagcagcccgccggtgagttccgggagtcctgccccagcagcagaccggcgcgtcggggatgctcttgcactgttcgctctctgccttgtcgccgccaacttgctgcggtagctgggctgtgacgagcgtgtgagaagaatcatatggagcagcacagcatgtgagaaagggcattcttgtacaggagcagtcggctagcttttttctgggcgctgcgattgtgccaaattttgctgtttctcattcaattggtcgctcctgtaaaatggtgaacccacgctagcacacttgtctagcacgtttgtatttgttcattagtggatttagcttacaactttcagggcc

SEQ ID NO: 17261 - protein, 406 aa, Panicum virgatum
  misc_feature: Ceres CLONE 1791712
  misc_feature (177)..(219): Pfam Name: LysM Pfam Description: LysM domain
MRPPPSPLLHHLRLLLFLAAVPSALSKSTLESCASATACPALLSYTLYADLKLAEVAALFAADPLAILAANAIDFAAPDPADRILPAGLPLRVPVPCACSDGIRKATSARYVARAGDTLASVAGSVYAGLTTADWIRDSNGMPEGAALDAGTTLFVPLHCACFGGADDGVPAVYLTYVVAGGDTVPAIARRFRTTGNDLMSVNDLATADVAAGDIIVVPLPACASSFPAYTSDAGLSVANGTYAITANRCVQCSCGPGNLDLFCVPAPLAESTCSSMQCGNSGMMLGNFTLQMTSAGCSVTSCSYGGYLNGTILTTLTTSLKPQCPGPHQFPPLMPPPTSSFFETYLGPSPAPMPSEGGVGPQMAGMAPMSSPPVSSGSPAPAADRRVGDALALFALCLVAANLLR

SEQ ID NO: 17262 - DNA, 1892 bp, Panicum virgatum
  misc_feature: Ceres CLONE 1791713
  misc_feature: Encodes the peptide sequence at SEQ ID NO. 17263
acgttatccttgccaagaacccaagacacgccgcagctcgagccagaagccatggcgcgccggccggacgccgaggcgcccctgctcggcaagcccgatgccgcctccccgccggcgacgccgccgccgccgccgaagcgcaacaagtaccccttcttctgcgccgtgctcgcctccatgacctccgtcctcatgggctacagtacgcatcgccgcctggactagtatcaccatctctccatatatgtatctttgcatccccttcgtgagctgaaaattgcgcgggcggcagacgtggcggtgatgagcggcgcgcagatcttcatggcggaggacctgggcatcagcgacgcgcaggtggaggtgctctcgggcgtcatcagcatctactcgctcgccggcgcgctgctggcggggtggacctccgaccgcctcggccgccgcctcaccatcgtgctcgccaacgtcttcttcctcgccggcccgctcatcatggcgctcgcgggaggctacgccgcgctcatggcgggccgcttcgtcgccggcgtcggctccgggtacgcgctcgtcatcgcgcccgtctacgccgccgagatcgcgcccgcgtcgtcccgcggcctcctcacctcgcttcctgagatctttatcaacaccggggtgatgctgagctacgtttccaacctcgccttctcggggctgcccgtgcacctctcgtggcgggtgatgttcgcggcggcggcggtgcccacggtgttcctggcggccggcgtgctcaccatgccggagtcgccgcggtggctcggcatgaagggcagggtcgccgaggccaaggccgtgctcgacaggacgtcggacacgcccgccgaggccgagcaacggctgctggagatcgaggccgtcgtcaccagcggcggaggcggcgcgtggaaggaggtggccaccaaggccggcgtccgccgcgtgctggccatcgtgctcacgctgcagttcttccagcaggcgtcgggcgtcgactcggtggtgctgtacggcccgcgcgtgctggccatggccggggtcacctccaacaccctgctcctgagcctcaacgtcctcttcggcgccgccaaggcggggtccatcctcgtcgccatggtgctcgtcgaccgcgtcggccgccgcccgctcctcctcgcgagcacgggcggcatgacggtggccctgctcgtcctgggctccctgttcgccgcgttcaccggcgccaaggacgacgccgcggtggccgcggtgagcgtcgccgccgtggtggcgttcgtggtggccttctccgtcgggctcgggccgctggcctgggtgtacagctccgagatcctgccgctccggctgcgggggcagggcgccgggctcggcaccgccatgaaccggatcatgagcggcgtggttaccatgaccttcatctcgctctaccaggccatcaccatggccggcgcgttctacctctacgccgccatcgccgcggcctcgttcgtgttcgtctacgcgtgcctgccggagaccaggggccggagcctcgaggacatggaggagctcttccacaccaagtgattcgtgtgatctgaccgaaccatcgattcgactcgattcagtggcattgccaatttggcactgttggagctttgtctagaccttggtagctcgttaacacaaaatgctcctgcagatgcaaattgcaacactgtaaatttgcattcttttttgcaagaccatcgggaataaaagattttgatggctggtatgtcgattatttggtgaatagtgctgctagaattaccctccatgcatatactggacgtagtcatagaacagaggaacaattcatatatacacttgtattggtgcgtaaagatgggagc

SEQ ID NO: 17263 - protein, 426 aa, Panicum virgatum
  misc_feature: Ceres CLONE 1791713
  misc_feature (1)..(423): Pfam Name: Sugar_tr Pfam Description: Sugar (and other) transporter
  misc_feature (1)..(374): Pfam Name: MFS_1 Pfam Description: Major Facilitator Superfamily
MSGAQIFMAEDLGISDAQVEVLSGVISIYSLAGALLAGWTSDRLGRRLTIVLANVFFLAGPLIMALAGGYAALMAGRFVAGVGSGYALVIAPVYAAEIAPASSRGLLTSLPEIFINTGVMLSYVSNLAFSGLPVHLSWRVMFAAAAVPTVFLAAGVLTMPESPRWLGMKGRVAEAKAVLDRTSDTPAEAEQRLLEIEAVVTSGGGGAWKEVATKAGVRRVLAIVLTLQFFQQASGVDSVVLYGPRVLAMAGVTSNTLLLSLNVLFGAAKAGSILVAMVLVDRVGRRPLLLASTGGMTVALLVLGSLFAAFTGAKDDAAVAAVSVAAVVAFVVAFSVGLGPLAWVYSSEILPLRLRGQGAGLGTAMNRIMSGVVTMTFISLYQAITMAGAFYLYAAIAAASFVFVYACLPETRGRSLEDMEELFHTK

SEQ ID NO: 17264 - DNA, 711 bp, Panicum virgatum
  misc_feature: Ceres CLONE 1791717
  misc_feature: Encodes the peptide sequence at SEQ ID NO. 17265
accacacccctctgtccccagctctctcctcatggcttgctggaagctctcctctatgctgatggcgctcctcctggccatcgccgccggccctgggacgacgcggccggtggtggctgcgacgtcggcggcggcccacctgcacttctacatgcacgacgtgacgggtggcccgtcgcccacggcggtgcgtgtggtcaacgggccgcgcggcaccttcggcaacacggtggtgatcgacgacgagctgacggagggcacgtcaccgtcgtcggcctcggtgggccgcgcgcagggctactacatggtggcgtccgtgtccaacctggagctcatggtgaacatgaacgtcgtgctcacgtccggcctgtacgccggcagctcgctgacggtggtggggcgcgacgatgtgagcacgccggtgcgggagctctcagtggtcggcggcacggggcagttcaggatggcgcgcggctacgtgctctggaagaccgtcacccccgagatactcgacctcgaggtcttcgtcaacccttgagacaccactgctgtactagccaatgttttgattctgcttctggatgttttttttaaagcaaattcagcttccattaattagatcgtgctgaatcatcagcaataataaaaccaagcattagctagcgacgcgcgaaaaagaagagaaaaaaaacgttggactgctgcacccgc

SEQ ID NO: 17265 - protein, 168 aa, Panicum virgatum
  misc_feature: Ceres CLONE 1791717
  misc_feature (11)..(168): Pfam Name: Dirigent Pfam Description: Dirigent-like protein
MACWKLSSMLMALLLAIAAGPGTTRPVVAATSAAAHLHFYMHDVTGGPSPTAVRVVNGPRGTFGNTVVIDDELTEGTSPSSASVGRAQGYYMVASVSNLELMVNMNVVLTSGLYAGSSLTVVGRDDVSTPVRELSVVGGTGQFRMARGYVLWKTVTPEILDLEVFVNP

SEQ ID NO: 17266 - DNA, 1886 bp, Panicum virgatum
  misc_feature: Ceres CLONE 1791720
  misc_feature: Encodes the peptide sequence at SEQ ID NO. 17267
ctcttccggaactcccccccctcacattccccagccgcgaaccgcgagcgagcgcaaacccctcttcctcttcctcttcttcgcctcgactcctcgcgccgtcccccagatctcggggccgctcgccacctcatgaggtagggggagtccgaggcgcgccgggcggagtggtggcgaggtcgggcggcgccggcggggggacgggatggggctgatctccgggatggtgatgggggtgctggtcggcgtggccgtcatggccggctggagccgcgtcatgctccgccgcagcaggaagcgcgtcgccaagaccgcggacatcaaggtgctcgggtcgctcggcagggacgacctcaggaagctgtgcggcgacaacttccccgagtggatatccttccctcagtttgagcaggtgaaatggctgaacaagcatttaagcaaactttggccatttgttgcagaagctgcaacagcagtggttaaggagtctgttgaaccactgctagatgattaccggcctccaggaataaaatctctgaagttcagcaaattttctcttggaactgtgtcaccaaaaatagaaggtattcgtattcaaaatcttcagccaggccaaatcataatggatatagatttccgttggggtggcgatccaagcataatcctagctgttgatgctgtagttgcatcactacctattcagctcaaggatcttcaggcctatactgtcatacgtgtcgtgtttcaactgtcagaagagattccttgcatatctgctgttgtcgtggctctccttgctgatccagagccaaaaattcagtacaccctgaaggccgttggaggaagcctaaccgcagttcctggactttctgacatgattgatgatactgtcaactcaattgtttctgatatgctccagtggccacacaggctagttgttccacttggtgttaatgttgatacaagtgacctggagcttaaacctcaaggaagactttctgttactgtggtaaaagcaacttctttgaaaaacaaggagttgattggtaaatcagatccttacgtgagactgtatgtgcgaccaatgtttaaagtcaaaacaaaagtcatagatgacaacctgaatccagaatggaatgaaacatttgagctgattgtcgaagacaaagaaacccaatctgtcattcttgaggtttacgatgaagacaaacttcagcaagacaaaagacttggtgtggctaaactagcattgaacaatcttgaacctgagatcacccgtgaagtcactctgaagctgctgcattcagtagatccacttaaaaatagggataccaaggatagaggcacattgcatcttaaggtcatgtatcatccgtttacaaaagaagagcaatttgaagccctagaggcggaaaagcgggccatagaggagaggaagcgtctgaaggaggctgggataattggtagcacaatggatgctgttggtggcgctgcatcactagttggttctggtattggtgctggcgtcgggcttgttggctctggtattggtgctggcgtcgggcttgtaggcgcagtcggcagtggcctcggtaaagccgggaagttcatgggcaagactgtggcagggcctttcagcatgtcccgcaagaacggcagcagctctgctgcgccccagcctgatcaaccctctgcgtagtctgatgtacagtgaaagacgattcccatttatcacagggttaccgttatatgaaatatctgctggtttattttgttcgttgtaatggagcttttatagtaaagattactgtaaattggatcgctttgagagattgatgtaacaacgccgtcgtattgaaatttaagaaaagtctatgatgtgccag

SEQ ID NO: 17267 - protein, 497 aa, Panicum virgatum
  misc_feature: Ceres CLONE 1791720
  misc_feature (264)..(346): Pfam Name: C2 Pfam Description: C2 domain
  misc_feature: SWISSPROT Homolog: EC 3.1.1.4 Phospholipase A(2)
MGLISGMVMGVLVGVAVMAGWSRVMLRRSRKRVAKTADIKVLGSLGRDDLRKLCGDNFPEWISFPQFEQVKWLNKHLSKLWPFVAEAATAVVKESVEPLLDDYRPPGIKSLKFSKFSLGTVSPKIEGIRIQNLQPGQIIMDIDFRWGGDPSIILAVDAVVASLPIQLKDLQAYTVIRVVFQLSEEIPCISAVVVALLADPEPKIQYTLKAVGGSLTAVPGLSDMIDDTVNSIVSDMLQWPHRLVVPLGVNVDTSDLELKPQGRLSVTVVKATSLKNKELIGKSDPYVRLYVRPMFKVKTKVIDDNLNPEWNETFELIVEDKETQSVILEVYDEDKLQQDKRLGVAKLALNNLEPEITREVTLKLLHSVDPLKNRDTKDRGTLHLKVMYHPFTKEEQFEALEAEKRAIEERKRLKEAGIIGSTMDAVGGAASLVGSGIGAGVGLVGSGIGAGVGLVGAVGSGLGKAGKFMGKTVAGPFSMSRKNGSSSAAPQPDQPSA

SEQ ID NO: 17268 - DNA, 2676 bp, Panicum virgatum
  misc_feature: Ceres CLONE 1791726
  misc_feature: Encodes the peptide sequence at SEQ ID NO. 17269
gagccatttctcaccctgccccccctccgtccgtcgcacccgtcttctcatctccccaccgtcaccttcctattggcaaggcagcctcccccgacctcgtcctcaccttcctaccaggctctcctcctcccgcgacggacctgacggtttcattcctccatctggcctcctcgcctcgcgagctggtcgaccccctcccccgcgaccggcaggcgcacgtgcaaatgccgcgtggatcgagctgctgagcgctgatcacggttggagagctacccatctgtttcggcttccgggatagaacagtttctggcataattttcgcctaagatgcctggaattacagtggatggaggtgtcacagaggaggtgccgaacgggatgaattcctctcaaaacaacgagcatctgtccgccccaaagtcgacggcagcttcaacaatggctccaagcatgcagagcgaggcacttgagatgcatgttgagggttctggtgctggggagccctcaattgagcagctctataacaatgtgtgtgagatggagagctcaagtgagggtgggtccccatcacgcgaaagcttcggctcagatggggaggagtcaaggattgactccgaacttcgccaccttgtcgccggggagatggaagccatgaaggtcattgaggaggaagaagagaacagaagtgttgccaatgctctcccttcagcagagaatgggaccccagtccaggcacagtcttccaattcgtccaagaagtcaaagaaggcctcaaaatcacagctcgagtctgatgcctctgttggccccaatggaaaggcatccactgaggaaggcgagagcgagatcagcaaaccagcaagtcgagttggccgtcggcggaaatcaaatgccaatccacggaatggaacagaagatgctggacttgataacccagaccttggaccatttcttctcaaacatgcaagagacttgattgcctcggaaaacccacggcgggcgctgaaatatgctctccgtgccaccaagtcgtttgagaaatgtgctggtggaaagccgagcttaaacttggtgatgagcttgcatgttgttgcagcaatctactgcaatttgggaaaatatgaagaggcggtaccagtgctgcagcgatcccttgagatccctgtaattgaggaaggtcaggagcatgctcttgcaaaattttctggctgcatgcagttgggagacacctatggcatgctaggtcagactgcactctcactgcaatggtatgcttccgggcttgaaatccagaagcaaacattgggagagcaagacccaagggttggagagacttgccggtacttagccgaggcccatgtgcaggcactacaacttgatgaagcacaaagattgtgtcagatggcccttgacatacacagggagcacggcgagccagcctcactagaagaaacagctgataggaggctaatgggtctaatttgtgacaccaagggtgaccatgaagctgcactggagcatctagtgatggctagcatggccatggtagccaatggtcaggagacagaggtggcctcaatggattgcagcattggtgatatctacctctccttgggtcggtatgatgaggctgtgttttcttaccagaaagctcttacggtattcaagaccagcaaaggggagaatcatgcaactgtggcttctgtctttgtgcgtctagcggatctgtacaacaagacagggaagctgagggagtcaaaatcttactgtgaaaatgcattgaagatttaccagaaacctattccagggacttctctagaagaaattgccactggtttaactgatgtttcagccatatatgagacaatgaatgagcatgagcaagcactcaagttacttcagaaggccttaaagatgtacaacaattctgccggccaacagagcacaattgctggaattgaggctcagatgggcatcctgcactatattctgggtaattacggagagtcctatgattccttcaagagcgcgatcgcaaagctccgcacttgtggtgagaaaaagtctgccttctttgggattgccctgaaccagatggggttggcatgcgttcaaagatactcaataaatgaagctgcagaactgttcgaggaagctagaactgttctggaacaagaatatgggccatatcatccagatactctaggagtatacagcaatctcgcaggaacttatgatgcaatgggcagactggatgaggccattgagatcttagaatatgttgttggaatgcgtgaggagaagctgggcactgctaacccagatgttgacgatgagaagcggagacttggggagctgcttaaggaggctggccgggtgcgaagcaggaaggcgaagtccctggagaatctgcttgagaccaacccatacaccgtcaccaagagaaacacagttgcagcatgactgttctgatgaaaggtgacgattgttactaaggtattcaattggtttgttcgagtggggcaatgggaatagtggtgtttacctatctagaaatatgaaatgttcaaattgattgctgtaaagtttcaaatgctatcattggttacttgttcagtgccctttatagttgtgtttgcgaatgcgagcggtgactactgtttctctcctttttct

SEQ ID NO: 17269 - protein, 711 aa, Panicum virgatum
  misc_feature: Ceres CLONE 1791726
  misc_feature (416)..(449): Pfam Name: TPR_1 Pfam Description: Tetratricopeptide repeat
MPGITVDGGVTEEVPNGMNSSQNNEHLSAPKSTAASTMAPSMQSEALEMHVEGSGAGEPSIEQLYNNVCEMESSSEGGSPSRESFGSDGEESRIDSELRHLVAGEMEAMKVIEEEEENRSVANALPSAENGTPVQAQSSNSSKKSKKASKSQLESDASVGPNGKASTEEGESEISKPASRVGRRRKSNANPRNGTEDAGLDNPDLGPFLLKHARDLIASENPRRALKYALRATKSFEKCAGGKPSLNLVMSLHVVAAIYCNLGKYEEAVPVLQRSLEIPVIEEGQEHALAKFSGCMQLGDTYGMLGQTALSLQWYASGLEIQKQTLGEQDPRVGETCRYLAEAHVQALQLDEAQRLCQMALDIHREHGEPASLEETADRRLMGLICDTKGDHEAALEHLVMASMAMVANGQETEVASMDCSIGDIYLSLGRYDEAVFSYQKALTVFKTSKGENHATVASVFVRLADLYNKTGKLRESKSYCENALKIYQKPIPGTSLEEIATGLTDVSAIYETMNEHEQALKLLQKALKMYNNSAGQQSTIAGIEAQMGILHYILGNYGESYDSFKSAIAKLRTCGEKKSAFFGIALNQMGLACVQRYSINEAAELFEEARTVLEQEYGPYHPDTLGVYSNLAGTYDAMGRLDEAIEILEYVVGMREEKLGTANPDVDDEKRRLGELLKEAGRVRSRKAKSLENLLETNPYTVTKRNTVAA

SEQ ID NO: 17270 - DNA, 1946 bp, Panicum virgatum
  misc_feature: Ceres CLONE 1791727
  misc_feature: Encodes the peptide sequence at SEQ ID NO. 17271
atcttccctggtattaaaaggcctgtggcctgtggcacacgtccgtgctagccactggtacagtagcacttctcacatctctccactactgaccttctgcactgcagcagcagcataggcaagatcaggcaaccaatggcggcgccttggttctccttcctcgagctctccctctccttgctctgcttcgcggtcttctactactaccacatcagttcgaagcggaagaaccctgtgatccctctggactggccttttgcgggcatgctcccgggcctcctcgccaacctccaccacctccacgagtggatcacctccatcctcgtcgccagccccctcaacttcctcttcacgggcccgccgcgctccggcatgcagttcttggtcaccgccgacccggccaacgtccgccacgtcttcacctccaacttcgccaactaccccaagggccccgacttcgaggagatcttcgacatcctcggcggcggcatcttcaacgccgacggcgagtcgtggcgccgccagcgcgccaaggcgcagctgctcatgtccggcgccccgttccgggcgttcgtgtcccggtacagccgcgacaaggtcggcaccgccctgctcccgctgctggctcacttcgccggcaccggggaggcgttcgacctgcaggacgtgttcctccggctgaccttcgacacgacgacgacgctggtgttcggcgtggacccggggtgcctgtccgtgggcctgccggaggtgccgttcgcgcgcgccatggacgacgcgatgcacgggctcctgctccgccacgtcgtcccgatgacgtggtggaagctggcgaggcggctggggatcggacacgagcggacgatggcgacggcgcggcgcaccatcgaccagttcgtcgccgacacgatcgcaaggcggcgggccgagaagcgggagaggggcgccggcatcgagggcccggcggacctgctctcctcctacatcaacgacgacgacgacgagaacgagggcgcgggcaccaccaccgtggacgcgttcctgcgcgacacgaccatcaacctgatgctggccgggcgcgacacgacggggtcggctctgtcctggttcttctacctcctgacgcagcacccgcgcgtggtggccaggatcctgcaggagctggagtccgtgaagggcggcgcctccagcacccccggcggcgacggcatggcgaccttcgacccggacgagctggggcggctgccgtacctgcacgcggcgctgtgtgagtcgctccggctgtacccgccggtgccgcaggagctgaaggaggcggcggccggcgacgtgctgccgagcgggcacgaggtggcggccggcgacaaggtgctggtgtgggtgtacgcgatggggcggatggaggatgtgtggggcggcgactgccgggagttccggccggagcggtgggtggaggaggacggtcgggcgcggtacgtgccgtcgtaccggttcatgtccttcaactcggatccccgcacctgcctcggcaaggacatggcgttcgtgcagctcaaggccgcggcggccgccgtgctgtggaacttcgaggtggaggccgtgcccgggcacgtcgtggagcccaagctgtccatcatactccacatgaagaacgggttcatggccaccgtgaggagaaggcgccaggctccggcggcgcagcagcttgcctgaatcctgaattcctgatgatgggctgagatggatcatagtccttcctagtacgtgctcaatcatgaccaccagtcggtgtacgttagctgacacgtatgtacgtactctcggttgtgtacgtacgtgtaccgtgtactacgttccctcgatgtgtcgtctttgcttatctactagaacgaactgaaagctggtgttacgtgtacgcacgacacgcacgtacgttctcgcttcag

SEQ ID NO: 17271 - protein, 525 aa, Panicum virgatum
  misc_feature: Ceres CLONE 1791727
  misc_feature (33)..(512): Pfam Name: p450 Pfam Description: Cytochrome P450
  misc_feature: SWISSPROT Homolog: EC 1.14.14.1 Unspecific monooxygenase
MAAPWFSFLELSLSLLCFAVFYYYHISSKRKNPVIPLDWPFAGMLPGLLANLHHLHEWITSILVASPLNFLFTGPPRSGMQFLVTADPANVRHVFTSNFANYPKGPDFEEIFDILGGGIFNADGESWRRQRAKAQLLMSGAPFRAFVSRYSRDKVGTALLPLLAHFAGTGEAFDLQDVFLRLTFDTTTTLVFGVDPGCLSVGLPEVPFARAMDDAMHGLLLRHVVPMTWWKLARRLGIGHERTMATARRTIDQFVADTIARRRAEKRERGAGIEGPADLLSSYINDDDDENEGAGTTTVDAFLRDTTINLMLAGRDTTGSALSWFFYLLTQHPRVVARILQELESVKGGASSTPGGDGMATFDPDELGRLPYLHAALCESLRLYPPVPQELKEAAAGDVLPSGHEVAAGDKVLVWVYAMGRMEDVWGGDCREFRPERWVEEDGRARYVPSYRFMSFNSDPRTCLGKDMAFVQLKAAAAAVLWNFEVEAVPGHVVEPKLSIILHMKNGFMATVRRRRQAPAAQQLA

SEQ ID NO: 17272 - DNA, 698 bp, Panicum virgatum
  misc_feature: Ceres CLONE 1791740
  misc_feature: Encodes the peptide sequence at SEQ ID NO. 17273
tctctcattttccgcgctcgcgcgctcccgccacacacaccccccaaccttcctcgcttctccagactctagcctcgccaaggcttcctgatcaggttgggagcgcaggagaggagcttggaaggatggcgtcggtttccagggctgtctgcggcgtgcagatgccgtgcttgaacggcagggaggcgcccgccggccgccgatcggtcgcggcgccgaaggcccggaacgccaagcggggcgtcatccgctccgtgtcggtctccggctccggctccggctccggctccgtctccggccgcggccagcattgcgcgcctgccaacgccgtcgccgacgccgcgccaattacagcgacaaagagggtgttccccttcggcaaggacaagagcgagggcaacaggggcatgaaggatctgctgggcgggaagggcgcgaacctggcggagatgtcgagcatcgggctgtcggtgccgccggggttcacggtgtcgacggaggcgtgccagcagtaccaggaggccgggcgcgcgctgccggcggggctctgggcggagatcctcgacggcctggcgtgggtggaggagtacatgggcgcgcgcctcggcgacccgcagcgcccgctcctgctctccgtccgctccggcgccgcggtgtcgatgcccggcatgatggacacggtgctcaccctggggctc

SEQ ID NO: 17273 - protein, 190 aa, Panicum virgatum
  misc_feature: Ceres CLONE 1791740
  misc_feature: SWISSPROT Homolog: EC 2.7.9.1 Pyruvate, phosphate dikinase
MASVSRAVCGVQMPCLNGREAPAGRRSVAAPKARNAKRGVIRSVSVSGSGSGSGSVSGRGQHCAPANAVADAAPITATKRVFPFGKDKSEGNRGMKDLLGGKGANLAEMSSIGLSVPPGFTVSTEACQQYQEAGRALPAGLWAEILDGLAWVEEYMGARLGDPQRPLLLSVRSGAAVSMPGMMDTVLTLG

SEQ ID NO: 17274 - DNA, 2615 bp, Panicum virgatum
  misc_feature: Ceres CLONE 1791749
  misc_feature: Encodes the peptide sequence at SEQ ID NO. 17275
ggggggctgtggcaggtcaaagcggataaggagctctgtgcccgatggcaggcagtcgagacgcaatcaactgggagaaaccactcgtcccgtatcttcagtatcaggaacactcatcgtcggcagaagacccggccggggtgggtggggtgggggtctccataaaacctgcagcccatccggccatcccaacggcctcccgccaccctctccgatccccccggccgggccggcttctctgcactgcccctgctgttcgtttgctcaccagattggatcaggctggttgcttggcttggtcgaccattgtttagtcgccggttacctgaccaggtgttgaatattgctggcagctcggattccggttccggcgcggccccccggagaggagctgctgctgctgctggtcctggagcggaggtatctattctattcagcgatttggtgtcagtgtgttttggctctctctatatcttcctcccttgtcagtttcttgactcccccggtgttgacttgtgtgtgctctggccgtcatctctgatttgccgtcttcctcttcttctccgtcatcgtcgttggctgctgctgcttctttctcgctgtcctgcctgtctggctgcctctctctttctttctttctttctttctttcagggaagagaggctgctgaacaagacgtgtgtgagtgtgcctggaaggaagagaactagaggggcgaggaacttgcttcccggggtgagaggaaatcaggcggagcgggaagggggggctcggagatggcaggcgggttcggcggcggcggggcggcccccgggagggcggagctctacgagggcaggatcaccagctacttcatcctcgcctgcatcgtcggctccttcggcggatccctcttcggctatgatctcggagtctccagcggcgtgacgtccatggacgacttcctgaagaagttcttcccggacgtgtaccaccggaagcaggcgcacctgcgcgagacggactactgcaagtacgacaaccaggtgctgacgctcttcacctcctcgctctacttcgccggcctcgtctccaccttcggcgcctcctacgtcaccaagcgccgcggccggcgcgccagcatcatggtcggcgccaccagcttcttcctcggcggcgccgtcaacgccgccgccgtcaacatcgccatgctcatcgtcggccgcgtgctcctcggcgtcggcatcggcttcggcaaccaggccgtcccgctctacctctccgagatcgcgccctaccgcatccgcggcgccgtcaaccagctcttccagctcaccacctgcctcggcatcctcgtcgccgacatcatcaactacttcaccgaccgcctgcacccgtgggggtggcgcctctcgctggggctcgccatgggccccgccaccgccatcttcgtcggcgcgctcttcctgccggagacgcccaacagcctcgtcgagcgggggctgttcgaggaggcccgccgcgtgctggagaaggtgcgcggcacgcacaaggtggacgccgagttcgaggacctcaaggaggccagcgaggtggcgcgcgccgtcaagggcacgttccggaacctgctcgccgcgcgcaaccgcccgcagctcatcatcggcgcgctcggcatcccggcgttccagcagttgtcgggcatgaactccatcctcttctactcgcccgtcatcttccagagcctcggcttcggctcctccgccgcgctctactcctccatcatcacgggctccatgctcgtcgtcggcgcgctcatctccatggtcaccgtcgaccgcctcggccgccgattcctcttcatcgaggccggcgtccagatgatctcatccatggtggttgtggccgtgatcctggcgctcaagttcgggcacgacgaggagctgtccaagggcgtgagcacggtgctggtggtggccatctgcctcttcgtcgtcgcctacggctggtcctgggggccgctggggtggcttgtccccagcgagctgttcccgctggagatgcggtcggcggggcagagcgtggtggtgtgcgtgaacctcttctggacggcggccgtggcgcagtgcttcctcgccgcgctgtgccacctccggtggggcgtgttcgtgctcttcgcgtcgctcatcgtcgtcatgtccatcttcgtcatcctcctgctgccggagaccaagcaggtgcccatcgaggaggtctggatgctgttcgacaggcactggtactggaagcgcatcgtccgcaaggaccccaagtaccagggaaacctccaccagcagcaggagatggcgcgagcttgacgatgatactaagtttcaataaggtgcatgtgggatgtttactagacagaccaagttgtgattatgttcttgatgcaatgcaaagaggagctaggattggagatgctgcttaattgcctttgtcgtccatggtttcgtgttcttggaagttcaggcttgtggggcaaaaagttgtcccaacgtgtatttggtggcaggtagatgctaaatgtgctaggcctctatgaatctatgatgttactcgctgttcggatttgattgagatcgaatttatatcttatg

SEQ ID NO: 17275 - protein, 518 aa, Panicum virgatum
  misc_feature: Ceres CLONE 1791749
  misc_feature (29)..(489): Pfam Name: Sugar_tr Pfam Description: Sugar (and other) transporter
MAGGFGGGGAAPGRAELYEGRITSYFILACIVGSFGGSLFGYDLGVSSGVTSMDDFLKKFFPDVYHRKQAHLRETDYCKYDNQVLTLFTSSLYFAGLVSTFGASYVTKRRGRRASIMVGATSFFLGGAVNAAAVNIAMLIVGRVLLGVGIGFGNQAVPLYLSEIAPYRIRGAVNQLFQLTTCLGILVADIINYFTDRLHPWGWRLSLGLAMGPATAIFVGALFLPETPNSLVERGLFEEARRVLEKVRGTHKVDAEFEDLKEASEVARAVKGTFRNLLAARNRPQLIIGALGIPAFQQLSGMNSILFYSPVIFQSLGFGSSAALYSSIITGSMLVVGALISMVTVDRLGRRFLFIEAGVQMISSMVVVAVILALKFGHDEELSKGVSTVLVVAICLFVVAYGWSWGPLGWLVPSELFPLEMRSAGQSVVVCVNLFWTAAVAQCFLAALCHLRWGVFVLFASLIVVMSIFVILLLPETKQVPIEEVWMLFDRHWYWKRIVRKDPKYQGNLHQQQEMARA

SEQ ID NO: 17276 - DNA, 652 bp, Panicum virgatum
  misc_feature: Ceres CLONE 1791762
  misc_feature: Encodes the peptide sequence at SEQ ID NO. 17277
acgcgagccacgacccaccacactctccagcacccggcggagcaagcggccagcgagatcgagatccagaggcagcagccatggccaccgtcagcgccgccgcggcgaccaccgtcgttgcccgcgccaccctagggctgccgcagctgagggcgaggagcgagagggtgcggtgcagctactccagggacgccaagagcgcggcggccgccgtgagcgctaggggcgccggcgcgtcgctgctggccgcggcgggcgcggtgacctcgtcggcggggccggcgctggcgctcgtggacgagaggatgtcgacggagggcaccgggctgagcctggggctcagcaacaacctgctggggtggatcctcctgggggtcttcggcctcatctggtcgctctacaccgtctacacctccgacctcgacgaggacgagaagtccggcggcctctcgctctagatcatgtccatcctctgctcctgttactacgactgctccggatgtaaacatggcggtggtcatcggtgtaatgtggattcgaatcggatacggatgaaataaaatcgacactgccacacggatcgatcgacgacccacctgcgcttcgttgcgtggcaagccagtcacgactcgcaaggagtagcgagagcgat

SEQ ID NO: 17277 - protein, 125 aa, Panicum virgatum
  misc_feature: Ceres CLONE 1791762
  misc_feature (1)..(125): Pfam Name: PsbW Pfam Description: Photosystem II reaction centre W protein, PsbW
MATVSAAAATTVVARATLGLPQLRARSERVRCSYSRDAKSAAAAVSARGAGASLLAAAGAVTSSAGPALALVDERMSTEGTGLSLGLSNNLLGWILLGVFGLIWSLYTVYTSDLDEDEKSGGLSL

SEQ ID NO: 17278 - DNA, 1849 bp, Panicum virgatum
  misc_feature: Ceres CLONE 1791767
  misc_feature: Encodes the peptide sequence at SEQ ID NO. 17279
ggcgccgccgctgcccgtggatcctcaccctccccggcggcggatctcgagggtcgaggccctccctccctccctcccctcccaccaggcgcgagcatggacgatgaccccgagaggggcggcgcggtggccgggctccccgacgacccgctcgtggagatcctctcccgcgtccccttcaagtccctctgccggttcaagtgcgtctccaaggcctggcgcgacctcatcgccgaccccctccaccgccggaagctcccccagaccctggagggcatcttcggcgtcccagggtacggcaacctcatcgccgaccccctccaccgccggaagcttccccagaccctggagggcatcttcggcgcccccgggtacggcgacgattgggatggagacgacgatgatgccttctgcggcgactgcggcgactgcagcgactgcggcgactcgcttgactacgtcttcatagacctggtggggcggtccgcgccactcgtggacccttccttctccttcctgtcggagaagctgccgggtatcaagcacttcaggatccttcgttcctgcaatgggctcctcctcctcaggccctgcccggatccgtacgctgacacgcacacgctgggctatgtggtgtgcaatccggccacgcaggaatggatggccgtgcccagctccggctggattcactcgtatccgccggaaggggaagaagatgaggtggacggcgatggggaaattggtgaggacacctatctgatcttcgaccctgcgctctcctcgcacttcaagttgctccagttcttgcagaaagctagtattctgaacgaggtagggctgcgcatctactcgtcagaaactggggtgtggactgatagatcaggtgagcggaggagatggaaattgggaggtgaaatcccacagttgggtatttttgggatcatatcctcctcgttgggcagcgcctttgttaacggcatgctgcattttgtcgtccaccacatttatcagaacctgattgctgcggttgatcaggaagggaagacacgcaggctcatcagctgcccgcagaatcacagttgtagcgggtccaagcctgtatttcttggtcaatctcaagggcatctctattgcatcagtgaacagatacaaggcgactctgagcagctcaccatttgggttattgaggactatgataaagaagaatgggtcatgaagcacagtgtgagctctttgcagctctttggaagtattaaatggcgtctccggtttgactacactctggtcaccattcatccagatcgcaatttgattttcatttgtcacgaggaccaaaatctgatatcttataacatggatagcaaggaagtgcaagctgtcagcacagccagagacgactatggcattacgccatatgtcccctatttttcagaatcaccagtgctctcaaataaactctgaaagcgttccttatggggatgcaatggatgttggactggaatttcatatccatgtgtagagaaagtatcaatttggataaatcttctggagtcatggcatgcatatgctgctgcttggatatactccttcatgcttttgttccaagtatttgttcaagaaataaaataagtcaattgagacatagatgtaagcttgctttacaatttagattgcacatgcaagctcttatgctgaatgtattgatgtagcttcgagattgctgaactgaatgctctacctcaaaaaatctgcctagttgttcagatttccatgtatgtaccttaccggcaacttgaaagaggacatctttacatatagcagattatcttatatactctgatcgctgatt

SEQ ID NO: 17279 - protein, 454 aa, Panicum virgatum
  misc_feature: Ceres CLONE 1791767
  misc_feature (9)..(56): Pfam Name: F-box Pfam Description: F-box domain
MDDDPERGGAVAGLPDDPLVEILSRVPFKSLCRFKCVSKAWRDLIADPLHRRKLPQTLEGIFGVPGYGNLIADPLHRRKLPQTLEGIFGAPGYGDDWDGDDDDAFCGDCGDCSDCGDSLDYVFIDLVGRSAPLVDPSFSFLSEKLPGIKHFRILRSCNGLLLLRPCPDPYADTHTLGYVVCNPATQEWMAVPSSGWIHSYPPEGEEDEVDGDGEIGEDTYLIFDPALSSHFKLLQFLQKASILNEVGLRIYSSETGVWTDRSGERRRWKLGGEIPQLGIFGIISSSLGSAFVNGMLHFVVHHIYQNLIAAVDQEGKTRRLISCPQNHSCSGSKPVFLGQSQGHLYCISEQIQGDSEQLTIWVIEDYDKEEWVMKHSVSSLQLFGSIKWRLRFDYTLVTIHPDRNLIFICHEDQNLISYNMDSKEVQAVSTARDDYGITPYVPYFSESPVLSNKL

SEQ ID NO: 17280 - DNA, 2137 bp, Panicum virgatum
  misc_feature: Ceres CLONE 1791773
  misc_feature: Encodes the peptide sequence at SEQ ID NO. 17281
aagcaaaagggggagaccgggggagggcaattctcccaacggtcacctcgtccggcgcccgcccgcccgccgtgtaggtgtagccagatcgcctcctcctccgccatcgtcatccacctgcctccgccctcgaggtccccgccccccttccccggccggaggagaaggggaagggaactacctccgccccgatcgccgccattaactcccccttcccccacccctaggaaagcgccaccggatccgacccctcctcgaggcccgtctccctttatccccacctcacggaaccccgccccagcccgccttttaatagtttcgccgcacatgcgtggcgcgggtgccgccgccgcctcccgacgaagcagccgcggccgtaccagcagcgatgtcgcgtagcggggtggaggtggtcgccagcagggggtgcgcgcggctggtgctccccgggatgcaccaccacatcccctcctccgccgcctcctccgcctcgcgcggcggggccgccgccgccgccgatgggcccttctcgggcctcgtcatctgcgtcaccgggctgtccaaagaggccagggctcaggtaaaggaggcggcagagcggctggggagcgagtacagcgggagtctgcaccccaagtgcacgcacctcgtggtgcagaactttgctgggcgcaagttcgagcatgcactgaagcatggtccgaggaacgggctattcgttgtaacgctgggttggttcgttgattgtgtgcggagaaacatgaggttggatgaatccttgtatgctataaagaatattggggagaatggtttgccactcggggagttcaaccgctttattggagttcctgttgacgggaagtcttgccttccgccgatgatttttcaagacaaggcgtgctcagatacgacccagaagcatccaactcagactcctaggaaagaaagtggcaatgctgagctggtttttatgaatgacacaatctacattgaccatgggatatctggtgagatgaagaaaaagatatctgatgctgctacaagagaaggtgcaaagttgctagagcactggtttattggctgtcctgccacttatgttgtgtgtgaggatgcttctattaagagatatgtaggccactcggacaacattgtaactccactttggatcttgaaaacagtgaaggaaaaaaacttgcaacgtcttgtccatttgtcttcggacctagccaggcatgttgccatggttctgcaaaacgtccggacatctgaagagaatagaaaacttgggagtgttccttctatgaactccaatggacatccattgacccaagaggagattgatgagatccatctagagaggcaaaaatttgttgaagttgcaaagaaagaagttcgagaccgtcgtgctcgtcgtatgcagtcatgtgaggtgccaattcatccaatcacaccagctacacttttggattcgatttgctggacaatctctgagccaacttcatccacgtctatttatatggattcttcatggtctgatgatgccaatgagcagcaaggcaccacatgttttgatgcaaacggtgatgtgagggatccagatcaaccaactgataatttttcccgcccactgaaagaaagtgagcgaagtgagttgatcttcaagaatcactttcttaccatactcttccctattgatcggtttggagagcttggaccttcctcaaagacgttctataacaatggtggttttacacgtatacaagtgctggatcacatctacaacttctaccaggagaatatgtcgaccaatgaggtagagatggccttgcatacagattctcggcatgctgatcgacttcgatctttatattcgagtgctgaatcagcagagaaaggagtagcttttaaaagagtagacttcttaggaagcagaagaagttttgaggcactaaagcgcctcaacagggagaataatagcaatgtatatgagcttgtgattagggcatgaatgcaccactctcaggtgccatttggcgaaacttatctgttgctttcaaaaagaaaaaaacatatatagtgaggaaggatgtactatgtttgctgaaaaaatgcgggaaataaatccatagtttattag

SEQ ID NO: 17281 - protein, 539 aa, Panicum virgatum
  misc_feature: Ceres CLONE 1791773
  misc_feature (42)..(121): Pfam Name: BRCT Pfam Description: BRCA1 C Terminus (BRCT) domain
MSRSGVEVVASRGCARLVLPGMHHHIPSSAASSASRGGAAAAADGPFSGLVICVTGLSKEARAQVKEAAERLGSEYSGSLHPKCTHLVVQNFAGRKFEHALKHGPRNGLFVVTLGWFVDCVRRNMRLDESLYAIKNIGENGLPLGEFNRFIGVPVDGKSCLPPMIFQDKACSDTTQKHPTQTPRKESGNAELVFMNDTIYIDHGISGEMKKKISDAATREGAKLLEHWFIGCPATYVVCEDASIKRYVGHSDNIVTPLWILKTVKEKNLQRLVHLSSDLARHVAMVLQNVRTSEENRKLGSVPSMNSNGHPLTQEEIDEIHLERQKFVEVAKKEVRDRRARRMQSCEVPIHPITPATLLDSICWTISEPTSSTSIYMDSSWSDDANEQQGTTCFDANGDVRDPDQPTDNFSRPLKESERSELIFKNHFLTILFPIDRFGELGPSSKTFYNNGGFTRIQVLDHIYNFYQENMSTNEVEMALHTDSRHADRLRSLYSSAESAEKGVAFKRVDFLGSRRSFEALKRLNRENNSNVYELVIRA

SEQ ID NO: 17282 - DNA, 911 bp, Panicum virgatum
  misc_feature: Ceres CLONE 1791776
  misc_feature: Encodes the peptide sequence at SEQ ID NO. 17283
atcaggtcatctccaaccacacaaccgaagcatcacacactgcaatctgcagaagcagctaccgactctcgagagcttagctgaggccgtcagtttctgtgcacgcgtacgccgagagaggccagagggaaagttttgctctgctgaccagatcatcaggaagcaatggagatgtacatggacgacaagcagtgggcgaagctgtcctccggctccaagaagaaggggagccggaggtcggcggcggtggcgccggcggcagccgacgaggggagcccgagaggcgtcaaagcccgggcggcgtcgaggggcctggcggccaggtcgtcggtgccggggcggctggccagcatggtgagggaacagcgggcgaggttctacatcatgcgccgctgcgtcaccatgctcgtgtgctggaaggactagcactacactagctgctgcttctgggcttctggctgacaccgccagaaggctgtgggcttgtagggccgggtcgggccggcccatcatgcgctctacagaagcaacgggccctgatgggcccagcccaacctgagggagagagagagggagagatgtgcctatgttttctgtggccatcctgtggatcctttttttttatggcgtcatcccgtggttcctgatagtgtttgtagtgtgtcaacatgcaccctgttctgctggctggtgctgaaatgttgtgagagaaaattactgctggctggctggtgctggaagctaatgctggaatgttgtgagacgaaattactgttggctggtgctggagcagaacagcagaacagggtcaatagcttggatttaattgctgcctgaagcgcagcattgttgtaaaaatgctaagccattgttactactagtttcatgaacacgccccttctttttctgtt

SEQ ID NO: 17283 - protein, 86 aa, Panicum virgatum
  misc_feature: Ceres CLONE 1791776
  misc_feature (65)..(83): Pfam Name: DVL Pfam Description: DVL family
MEMYMDDKQWAKLSSGSKKKGSRRSAAVAPAAADEGSPRGVKARAASRGLAARSSVPGRLASMVREQRARFYIMRRCVTMLVCWKD

SEQ ID NO: 17284 - DNA, 545 bp, Panicum virgatum
  misc_feature: Ceres CLONE 1791777
  misc_feature: Encodes the peptide sequence at SEQ ID NO. 17285
gacttggtgacttcgtctcgcacggcgcggcggcggccacgctcccatggaagcggccggccaggcggccgcggtgagccgcgagcttccgccattcggcgggcagcgggacggctgacggcggggtcgtccgcttcggcttcggcctcggcggctcgcgcggcgggcgtcggcgcggagcgccggcctgccggccccgacgccggccggcgggaggccggccacgagcccaccacgcacgacggcttcatgggtcccatctcgagggatgcgccgcataagcggttcttcaacaacgcgccagcggcggcgctgatgtttgtcttcgtattcaccttcgtcgctggtgccattgtcgccggtggccgcaaggacaacttgtccatcctgcagctgcttccccaaggaccgttggctactgaggaatcaagcctccagcgacgagcgcgtcgcgcgctcagcctacataggaaccctccctctgtgacaaccaatgcacaccttcacgctgccaggccttgcgtaggggcctcgtggaggaccag

SEQ ID NO: 17285 - protein, 98 aa, Panicum virgatum
  misc_feature: Ceres CLONE 1791777
  misc_feature: Useful for biocontainment applications
MGPISRDAPHKRFFNNAPAAALMFVFVFTFVAGAIVAGGRKDNLSILQLLPQGPLATEESSLQRRARRALSLHRNPPSVTTNAHLHAARPCVGASWRT

SEQ ID NO: 17286 - DNA, 1278 bp, Panicum virgatum
  misc_feature: Ceres CLONE 1791781
  misc_feature: Encodes the peptide sequence at SEQ ID NO. 17287
gcgtctccatcccaatcatactccttcgtctccctctcctcccaagaagcgaagcgcccgcccccgaccatacgttctccggcgccccacgcggacggcgagccgctgctggtcttgccggaggagggtggccgctgctgggaccggcgggaggaggaggagaaggacgccgctgagtggcccgggcgcctggggctgtgccacatgccgctctgggggaccgcgtccgggccgccggccgccgacggcaaggccgccggcgcgccgcccaggtccagtggcggcggcggcgtcaaggtgatccggtcgctgctccccacccggcgccgcctccggctcgacccgcccgccaagctctacttcccatatgaacccgggaagcaagtccggagcgctgtcaggatcaagaacatcagcaagtcccatgtggccttcaagttccaaacaacagcgccaaagagttgcttcatgaggcctcccggcggcatacttgctccaggggaaagcatcatagcaacagtgttcaaatttgtggagcatccggagaacaatgagaagccgctagaccagaagtgcaaggttaagttcaagattgtcagcttgaaagtcaaaggaccaatggagtatgtccctgaattgtttgatgagcaaaaggaccaggttgccgtcgagcaaatcttgcgggtagtattcttggatgctgagcgtccgagcccacaaatggacaagctaaagcgccagcttgctgaagcagaagcagcacttgaggcacgcaagaaacctccagaggacaatggtccccgcattgttggcgaaggccttgtgattgacgaatggaaggaacgaagagagagataccttgctcgccagcagatcgaaggtgttgattcagtgtagacacgacgcagcgctgtaaattctgccaattgaacatacctttttatcgacgccaacatactgtcctttcgaattttcaaatggttttggagcttaatttgtgaaggtccgtattgtagcaatcaaacatgaatgaggctttgtgtaattaggatttgagcttcatgctgtacttgtcccttgggtctgcatgtgtgtagataaccagtcactgcttgatgataataccttctatgctaagccatgtatttggaattgtggaacgtggacatgtgaatgcgatgcattcccttagctgctggcctatcaacattggaattgtaatgtaatctcaggcactctccaaggtgtttaatgaaagttctcctatcatgttacatt

SEQ ID NO: 17287 - protein, 230 aa, Panicum virgatum
  misc_feature: Ceres CLONE 1791781
  misc_feature (42)..(155): Pfam Name: Motile_Sperm Pfam Description: MSP (Major sperm protein) domain
MPLWGTASGPPAADGKAAGAPPRSSGGGGVKVIRSLLPTRRRLRLDPPAKLYFPYEPGKQVRSAVRIKNISKSHVAFKFQTTAPKSCFMRPPGGILAPGESIIATVFKFVEHPENNEKPLDQKCKVKFKIVSLKVKGPMEYVPELFDEQKDQVAVEQILRVVFLDAERPSPQMDKLKRQLAEAEAALEARKKPPEDNGPRIVGEGLVIDEWKERRERYLARQQIEGVDSV

SEQ ID NO: 17288 - DNA, 1369 bp, Panicum virgatum
  misc_feature: Ceres CLONE 1791806
  misc_feature: Encodes the peptide sequence at SEQ ID NO. 17289
gtattccgcgtcgcttcctatccaatccgaatcctctcctccctccccccgcggcggtcgcgctcgcggcaagacagcctccctcccctcgccgcggaggcgcctgagatgcaggccacggcggcggtcttcctcgcccgcccgcacccgcggctcctccgcatcggaagatggggcccggatggcattgcgttggtgcgcggcggcatcgtcgcgctgccgccgcggctgcggggcccgcggtgctccatgagcctctccgtcggcggtggtgccggcgccagcgaagaccgcgggttcagctacgagcatgttccagtgttcccaagataccgaattcgtgatccctacaagcttcttggtgttgatcgtgacgcatctgaagaagagatccgaagtgcaaggaattttcttattcaacaatatgctgggcatgaaccgagtgaagaagctattgaaggcgcttatgaaaagataattatgaagagctaccagcagcggaagaagacaaaaatcaatctgaaaaccaagttaaagaagcgagtagaggaatccccatcatgggtcaaggcacttcttggttactttgaggttccatcaatggatattatttccagaagattgttcttctttgctttcattgctgggtggagcatagcaacttctgctgagaatggacctgcattccagaacttagtaacctgatgaaattttataacaaccatttggtgaatgattcttcaagaaagcgttggcatcaaccatctagtatactatggaaatacatgacctgataaatcctagataagtacatctgaaactgaaatacttgccatcttgaggttcactgaactgatgaatggttttcatgtgtagctcgcgatatcactcttctcatgcatatacttcctcaacgacaagatgaagaacctcctcagggcatcaaccaccgggtttggagtacttgttggcggctggattgttggctctctattggtcccactgatcccgacattcatgatccctccttcatggtccctagagcttctcacctcgctggttgcttacgttttcttgttcctgggatgcacattcctcaaatagaactcctagcccgaaactgtagaatcgtttgaaaaaaaaaattgtgatgactgacatccctgtatctgagttccagaaagtttctgcacgtgctggcgtcactcttgagcattaaatctgggttttcgacctcctgttcgaatattttagtgagctcatgtacactagtgctttctccgtagtgacagtgcaaggaggaaggtgatgttccgtccttccagcggtcaattttgtgctttgtatgtgccgagagcacatatctgct

SEQ ID NO: 17289 - protein, 198 aa, Panicum virgatum
  misc_feature: Ceres CLONE 1791806
  misc_feature: Useful for making plants with altered protein content
MQATAAVFLARPHPRLLRIGRWGPDGIALVRGGIVALPPRLRGPRCSMSLSVGGGAGASEDRGFSYEHVPVFPRYRIRDPYKLLGVDRDASEEEIRSARNFLIQQYAGHEPSEEAIEGAYEKIIMKSYQQRKKTKINLKTKLKKRVEESPSWVKALLGYFEVPSMDIISRRLFFFAFIAGWSIATSAENGPAFQNLVT

SEQ ID NO: 17290 - DNA, 2450 bp, Panicum virgatum
  misc_feature: Ceres CLONE 1791811
  misc_feature: Encodes the peptide sequence at SEQ ID NO. 17291
ggcacacccgcacaggcacgggaaacagctcagtcgcggcaagctcccgggtctccagcgagctagcagagcaggaggagagagcgcgaaggggccggcgtgggatcccgccgaggctctccgcggcgcctcggcgcaatgctgtcctcctccgggggcagatcgggctgagtcgcggtcgcggctctcgaatcggcgccgtcctcgcgtggttccggcgggaggtcggatcttgcggcggaagacgcgagaagagagagtgggaggaggccgtctctggattttcggcccgccggagaggattgaagttctgatgggaaagcttctatagtattgctgaatccaattctcttcaacaagtctcaaccatgcaacctcttactgtgatagcctttgtggctgcttctctccttcttgcaagcattcctcatgccaaaagtgctgatctcaactctgacaagcaggctcttcttgcatttgctgcttcactgccccatggcaggaagctcaactggagctccacaacacctgtctgcacatcttgggtcggggtgacatgcacaccagacaagagccgtgtgcatacactgcggctacctgctgtaggactctttggtccaataccatcggacactcttggaaagcttgatgccttggaggtattgagccttaggtccaatcgccttactgttgacctccctcctgatgtaggatctattcctgccctccattccctctaccttcagcataataacctgtctggaatcataccaacttcgctctcttccagtttaacattcttagacctgtcatacaacacttttgatggagaaatcccattgaaagtgcaaaatcttactcaacttactgcattgcttctccaaaacaactcactttctgggcccatccctgacctccaactccccaaattgagacatttgaatttgagcaacaataacctcagtgggccaataccgccttcgttgcagaaatttccggcaagttccttcttggggaatgcttttctctgtggatttcctttggaaccatgtccaggaaccgcaccttctccttctccagtatcaccaccatcacccagtaagaccaagaagagcttatggaaaaagatcaaaactattgtgataattgcacttgctgctgttggaggagtattattgcttattttgattcttgtgctcttgatatgtattttcaagagaaagaggcacactgaacctaccacagcttcgtccaaaggaaaggctgttgcgggtggcagggcagaaaaccctaaggaagactacagcagtggtgttcaggaagcagagaggaataagttggttttcttcgagggtagttcatataatttcgacttggaagatttactgagagcttctgctgaagttcttgggaaaggaagttatggaaccacctacaaagctgttcttgaggatggcaccacagttgtggtcaagagactgaaggaagtggtggtgggcaagaaggagtttgaacagcagatggagataattggcagggttggccagcaccaaaatgttgttccattgcgtgcttactattactccaaggatgagaagctattggtgtttgactatgtcccgtctggtagccttgctgctgttttgcatgggaataaaactgctggacgacctccattggactgggagacaagggtcaagatatcacttgatgtagccagtggtattgctcatcttcatgcagagggaggtgggaagttcatacatggcaacatcaaagcatcgaacgtcctcctatcacagaaccaggatggttgtgtgtctgagtttggcttggcacagctcatgaccactccacaggcgcccccacggcttgtcggataccgagcaccggaagtccttgagacaaaaaaaccaactcaaaagtccgacatctacagcttcggtgtcttgctcctcgaaatgctaacgggaaaagcccctctcagatctcccgggcgcgaggattccattgaacaccttccaagatgggtgcagtctgtggttcgtgaagaatggaccgccgaggtcttcgacgtggagttgttaaggcatcccaacgtcgaggacgagatggttcagatgctccaggtcgcaatggcatgcgtggccattgcccccgatcagcggcctaagatggaggaggtgataaggaggatcacggagatccggaactcctactcttcagggacaaggacgcccttagaggagaagccggagactgcccaagcaccatgaggggtacagcatagtttagccagagatggtagctaggttgcatagtgaattgcctatagagcttcagcaaagttgatagccgcctgcgcatcgcagttttctgtcgatccccgatcgttttcagtaaatctgttcattttttccatcttattctagcgatctgattgataatcc

SEQ ID NO: 17291 - protein, 635 aa, Panicum virgatum
  misc_feature: Ceres CLONE 1791811
  misc_feature (341)..(610): Pfam Name: Pkinase Pfam Description: Protein kinase domain
  misc_feature (27)..(65): Pfam Name: LRRNT_2 Pfam Description: Leucine rich repeat N-terminal domain
  misc_feature: SWISSPROT Homolog: EC 2.7.11.1 Non-specific serine/threonine protein kinase
MQPLTVIAFVAASLLLASIPHAKSADLNSDKQALLAFAASLPHGRKLNWSSTTPVCTSWVGVTCTPDKSRVHTLRLPAVGLFGPIPSDTLGKLDALEVLSLRSNRLTVDLPPDVGSIPALHSLYLQHNNLSGIIPTSLSSSLTFLDLSYNTFDGEIPLKVQNLTQLTALLLQNNSLSGPIPDLQLPKLRHLNLSNNNLSGPIPPSLQKFPASSFLGNAFLCGFPLEPCPGTAPSPSPVSPPSPSKTKKSLWKKIKTIVIIALAAVGGVLLLILILVLLICIFKRKRHTEPTTASSKGKAVAGGRAENPKEDYSSGVQEAERNKLVFFEGSSYNFDLEDLLRASAEVLGKGSYGTTYKAVLEDGTTVVVKRLKEVVVGKKEFEQQMEIIGRVGQHQNVVPLRAYYYSKDEKLLVFDYVPSGSLAAVLHGNKTAGRPPLDWETRVKISLDVASGIAHLHAEGGGKFIHGNIKASNVLLSQNQDGCVSEFGLAQLMTTPQAPPRLVGYRAPEVLETKKPTQKSDIYSFGVLLLEMLTGKAPLRSPGREDSIEHLPRWVQSVVREEWTAEVFDVELLRHPNVEDEMVQMLQVAMACVAIAPDQRPKMEEVIRRITEIRNSYSSGTRTPLEEKPETAQAP

SEQ ID NO: 17292 - DNA, 1685 bp, Panicum virgatum
  misc_feature: Ceres CLONE 1791813
  misc_feature: Encodes the peptide sequence at SEQ ID NO. 17293
ctctccctccgcagtatccttgtccccaccgcagcaaaaccctagagaagagatggcccccggcggcgatggcaaggcgaacccgggcggcggcgccaagggtggtgggaggaagcgcaagttcctcccccacgggaagccggtgcggaagggggcgtacccgctgcgccccggcgtgcagggcttcttcatcacctgcgacggcggccgcgagcgccaggccacccgcgaggctctctccctcctcgactccttctacgaagatctggtggatgggaaaggatcggatgacaaacccaaaggcattcctgacaagccactgaacaaaaagataaagtttgaggactctgattcctcagatgatgaagatgaagaccattccggtgaggaagctgacaatgggaatgggaatgatgtggagaaaggtgaaactgctccagccgagcagcaacaggaggtacttaacacctctgttcctggcagtaaggatggtgtggaacaagcaagcaccgctgaagaaccaaaagaaaagaagcaacgtgtggaagaccctccagtttctgaacagccagaacaaaaggaggctgctgatgaattaaaggagtccactgataaaccaaaagagtccactgataaaccaaaagattccggtgaaaggaacattgatgatttaattgatgaggacttgaaagaacttggagacaggaaaaagaggctctttgcaagccttgagtcaggctgcaatggttgcatattcattcaaatgcataaaagagcaggagaccctggtccagttgaggttgtacaaaacattatgtcatcggctgcttcaactcgtaaacatatgtcaagatttattctgcgagttttgcctgctgaggttgcatgctatgcatctgaagaggaaatatcaaaagcaattagcccccttgttgaaaagtacttcccaaaagaatgtcctacgagtcataagtttgcagttttatatgaagcaaggtcaaacacaggaattgatagaatgaaaattataaatgcagtagcgaaatctgtaccgcaacctcacaaagttgacctgaaaaatccggacaaaactattattgtccagattgcaaagaccatatgcatgatcggagttgtcgaaagatacaaagagctcgcaaagttcaacctaaggcagctgacctcatcagagtcggagaagtagcctttgggcgacaaaatcttccaggcaacatctgggccgacttaaatctgctggagcatctggtggttaggcgttagctaattaattaagttaccaaaagatccagatgtgctatcttgttggcctgtgaggtcgttgaaaagcctccccgaaatctttattgcttcacagcgcaacaaccttggtcagtagagatctagacttgtacgatgatgatgggctgtgaccacgggtggttagtggttgctgggttggttcatctttatgcatccttgttttgagttctatagaaaaaactgatgtccacagaggctcgccaaaggtgtaatctgtctttgatgctgcttctttttctgaacttttatagtggctgaacaagtatttgtgcaaggttccatacgtggaacctggagtttaaaagggtgagaaccgatgatttttcttgtggaagattcagccattcattaaattgtcgatcccg

SEQ ID NO: 17293 - protein, 383 aa, Panicum virgatum
  misc_feature: Ceres CLONE 1791813
  misc_feature (271)..(363): Pfam Name: THUMP Pfam Description: THUMP domain
MAPGGDGKANPGGGAKGGGRKRKFLPHGKPVRKGAYPLRPGVQGFFITCDGGRERQATREALSLLDSFYEDLVDGKGSDDKPKGIPDKPLNKKIKFEDSDSSDDEDEDHSGEEADNGNGNDVEKGETAPAEQQQEVLNTSVPGSKDGVEQASTAEEPKEKKQRVEDPPVSEQPEQKEAADELKESTDKPKESTDKPKDSGERNIDDLIDEDLKELGDRKKRLFASLESGCNGCIFIQMHKRAGDPGPVEVVQNIMSSAASTRKHMSRFILRVLPAEVACYASEEEISKAISPLVEKYFPKECPTSHKFAVLYEARSNTGIDRMKIINAVAKSVPQPHKVDLKNPDKTIIVQIAKTICMIGVVERYKELAKFNLRQLTSSESEK

SEQ ID NO: 17294 - DNA, 1837 bp, Panicum virgatum
  misc_feature: Ceres CLONE 1791825
  misc_feature: Encodes the peptide sequence at SEQ ID NO. 17295
tctccaccaatagcatcccacagctcgctcggtcattgcctgccgcagcctgacagccatcagcagccaaatcagcctcgctcgctagcttccaggagcaacagcattgtcgtggtggtttcttgactcgcacatcgcaatgccggccatgggcccatggtggaggaggcccgggcggcggcggcgcccgggccgcacttcctggtggtgaccttcgcggcgcagggccacatcaacccggcgcgccacctcgcgcgccgcctgctccacgccacggcgggggcgcgggtcaccatctccaccaccgtgtccgcgttccgcaagatgttccctggcgacgaggcggcggcggccggcggcgagggccaccgcgacgcctcgggggtgtggtacgtgccctactccgacggctacgacgccgggttcgaccgcgccgtgcacgaccacacgcactacatgagctaggtcagggccgtcggctcccgcacgctcggggccgtcctcgaccgcctccgcgccgcggggcggcccgtcacgcaagtcgtctacacgctgctgctgtcgtgggtcgccggcgtggcgcgcggccacggcgtgcccgccgcgctctactggatccagccggccaccgtgctcgccgcgtacctgcacttcttccgcggcaccgacggcgtcgacagggccatcgccgcggcgggcggcgaccccatggccaccgtccgcgtcccgggcctcccgccgctccgcatccgcgacctgccgtcgttcatcaccagcaccgccgaggacggcccttacgcgttcgtcggcgacatgttccgcgagcttgtcgacatgctcggccgcgacgacagccccagcgtgctcgccaacacgttcgacgccatggagcccgaggcggtggcgtcgctgcgcgagcacggcgtcgacatcgtccccgtcggccccgtgctctccttcctcgacgccaagagcggcggcggcggctgcggcaacgacctgttcaggcaggacggcacgggctacctcgagtggctggacgcgcaggcgcccggctcggtggtgtacatctcgttcgggagcctgtcgatgataagcaggcggcagatcgaggaggtggcgcgcggcatggcggcgagcgggcggccgttcctgtgggtgctgcgggaggacaaccgccgcagcgagggcgccggcggcgacgcggcggcgctcggcggcatggtggtggagtggtgcgaccaggtgcgggtgctgtcgcacccggcggtggggtgcttcgtcacgcactgcggctggaactcgacgctggagagcgtggcgtacggcgtgcccgccgtgggggtgccccagtggacggaccagggcatcaacgcgtggctggtggagcggatcggcgccggggtcagggccgccgtcagcgacaaggacggcgtgctggaggccgacgagctgcggaggtgcctcgacctggccacgtccgagacggtgcgcgccaaggccgccgtgtggagggacaaggcgcgcgccgcggcggcggagggcggctcgtcggagcggaacctcagggcattcgtcgggaagcagctcgccggcggcaactagctagcctgtcgccctcgctctctcggtcgcgtcgtcgatgcattgctctatgccaacaaggatggcatggcatagtaggatgatggatggagtctacaaggatctagctaaaagacacctacattttacacctaataatatactggacttttttttttgaaaagaacctaatatactggacttacattgctgtatccggttctactcaagtaaaagcatcaatattgtcacc

SEQ ID NO: 17295 - protein, 298 aa, Panicum virgatum
  misc_feature: Ceres CLONE 1791825
  misc_feature: SWISSPROT Homolog: EC 2.4.1.121 Indole-3-acetate beta-glucosyltransferase
  misc_feature: Useful for making plants with altered carbohydrate content
MATVRVPGLPPLRIRDLPSFITSTAEDGPYAFVGDMFRELVDMLGRDDSPSVLANTFDAMEPEAVASLREHGVDIVPVGPVLSFLDAKSGGGGCGNDLFRQDGTGYLEWLDAQAPGSVVYISFGSLSMISRRQIEEVARGMAASGRPFLWVLREDNRRSEGAGGDAAALGGMVVEWCDQVRVLSHPAVGCFVTHCGWNSTLESVAYGVPAVGVPQWTDQGINAWLVERIGAGVRAAVSDKDGVLEADELRRCLDLATSETVRAKAAVWRDKARAAAAEGGSSERNLRAFVGKQLAGGN

SEQ ID NO: 17296 - DNA, 1076 bp, Panicum virgatum
  misc_feature: Ceres CLONE 1791830
  misc_feature: Encodes the peptide sequence at SEQ ID NO. 17297
acacaccaccgctcgctcacctcgccggacaccacagcctcgatcagcaaccgcgagcacccaaggacaagcaccccctagcccagcttgctcctcggttccagcagccgcgcttggttgctcgctcgctcggaggagacaagaaaccagagggtgcgagctcggcagtatggcgccgcacaacggccccaagcacgtgccgccgatggaggtgtcggtggaggccggaaacgccggcgccgccgattggcttgacgacgacggccgcccccgccgcacgggcacgttctggactgccagcgcccacatcatcaccgccgtcatcggctccggcgtgctctcgctagcctgggccatcgcgcagctcggctgggtcgccggccccgccgccatgctgctcttcgccttcgtcacctactacacggccacgctgctcgccgagtgctaccgcaccggcgacccggagacgggcaagcgcaactacacctacatggacgccgtgcgctccaacctcggcggcgccagggttgttttctgcggcgtcatccagtacgccaacctcgtcggcgtcgccatcggctacaccatmgcgtcgtccatcagcatgcaggccatcagcagggcggggtgcttccacaagaacggccacggcgacccgtgcaagagctccagcaacccctacatgatcctcttcggcatcgtgcagatcctcttctctcagatacccgacttcgatmagatttggtggctgtccatcgtagccgccgtcatgtccttcacctactcttccatcggcctcgccctcggaatcgcacagaccgtctcaaatggtaaattcatgggcagcctcaccggcatcagcatcagcgccgacgtctcctcgactcagaagatctggcacaggctgcaggccttcggcgacatcgccttcacctactccttctccaacatcctcatcgaaatccaagacgccatcagagcgccgccgccgtctgaggctaatgtgatgctgaaggcgacgcggctgagcgtggccaccacgaccattttctacatgctctgccggtgcatgggct

SEQ ID NO: 17297 - protein, 302 aa, Panicum virgatum
  misc_feature: Ceres CLONE 1791830
  misc_feature (36)..(302): Pfam Name: Aa_trans Pfam Description: Transmembrane amino acid transporter protein
  misc_feature (190)..(190): Xaa is any aa, unknown, or other
MAPHNGPKHVPPMEVSVEAGNAGAADWLDDDGRPRRTGTFWTASAHIITAVIGSGVLSLAWAIAQLGWVAGPAAMLLFAFVTYYTATLLAECYRTGDPETGKRNYTYMDAVRSNLGGARVVFCGVIQYANLVGVAIGYTIASSISMQAISRAGCFHKNGHGDPCKSSSNPYMILFGIVQILFSQIPDFDXIWWLSIVAAVMSFTYSSIGLALGIAQTVSNGKFMGSLTGISISADVSSTQKIWHRLQAFGDIAFTYSFSNILIEIQDAIRAPPPSEANVMLKATRLSVATTTIFYMLCRCMG

SEQ ID NO: 17298 - DNA, 108 bp, Panicum virgatum
  misc_feature: Ceres CLONE 1791830-R
tcccaggtagatcaaggggggagtattcattgtaaggacgagtggtgttaactaagtgcattgcaggaagtgcctgtttatcaagagtttgttgtatagcgtttgcat

SEQ ID NO: 17299 - DNA, 713 bp, Panicum virgatum
  misc_feature: Ceres CLONE 1791833
  misc_feature: Encodes the peptide sequence at SEQ ID NO. 17300
aactaacagcggcttctttcgctagccaccaccagcgcccctcctggctgcctcccctggcaggcgcctctctacaaaaggacccggccggagacccagctaacacgcccaagacatcatcgatcagagtaggtcttgcctcggtttcgtgtcaccccagctcctgtagctcaaaagcataccagcaggttgcaagaaattaaaatagttaatcgagtctcttctgcttgtccggccatctagtgtgtgtgcttcagtagttcagatatagctacatagtacagtgctagcctaggtatataatcatcgaccggctgaccggcaggatcgagctaggggatggggctgagggagatcgagtccacattgccgccggggttcaggttctaccccagcgacgaggagctggtctgccactacctctacaagaaggtgaccaacgagcgcgccgcgcaggggacgctggtcgaggtcgacctgcacgcgcgcgagccatgggagcttccaggtgagccactccggccccggtcatcttcatctcttcttttttttttctttctcccagcagaccccctgctgggagaaagtcaggtgtccagcgttccttcttctctcaccacaaccccgtctttccccttttcttttgtcacacctgtgaactttatggaatttccgttcttggaatgggaatgggggatggcctcgtttcaaaa

SEQ ID NO: 17300 - protein, 124 aa, Panicum virgatum
  misc_feature: Ceres CLONE 1791833
  misc_feature (10)..(105): Pfam Name: NAM Pfam Description: No apical meristem (NAM) protein
MGLREIESTLPPGFRFYPSDEELVCHYLYKKVTNERAAQGTLVEVDLHAREPWELPGEPLRPRSSSSLLFFFFLPADPLLGESQVSSVPSSLTTTPSFPFSFVTPVNFMEFPFLEWEWGMASFQ

SEQ ID NO: 17301 - DNA, 676 bp, Panicum virgatum
  misc_feature: Ceres CLONE 1791845
  misc_feature: Encodes the peptide sequence at SEQ ID NO. 17302
agcctcttcctctccgccccatccgccgccgccgcatctgcccggtgctcgctcgatcgctcgccgctagccccggccgcgggtcacccgtcgcccggcaccggcgccggcgcgctgcccccgctggccgctactacttcgggagcaggggacgcttcgacaccgagtgcctgccgccgctgctccgactccgccagcatcgctccgtagctcgacctcccggcacagtgcgtcatcctcaggcctcggcggtactcttggcagaagcgaagatggcgcgtcgagggttgatggagcaggatctgaggaagctcgacgtcaccaagctgcaccctctggcgccagaggtgatttcacgccaggcgacgatcaacatcggtaccattgggcatgtggcccatgggaagtctactgttgtcaaagcaatctcaggtgtacagactgttcgattcaagaatgaactggagcgcaatatcactataaagcttggttatgctaatgcaaaaatctataaatgtgaagatgataagtgcccacgcccaatgtgctacaaggcttatggcagtggcaaagaagatagccctctctgtgacgttccagggtttgaaaattgtaggatgaagctactgagacatgtttcatttgttgattgcccggggcatgacattctcatggc

SEQ ID NO: 17302 - protein, 134 aa, Panicum virgatum
  misc_feature: Ceres CLONE 1791845
  misc_feature: SWISSPROT Homolog: EC 2.1.1.43 Histone-lysine N-methyltransferase
MARRGLMEQDLRKLDVTKLHPLAPEVISRQATINIGTIGHVAHGKSTVVKAISGVQTVRFKNELERNITIKLGYANAKIYKCEDDKCPRPMCYKAYGSGKEDSPLCDVPGFENCRMKLLRHVSFVDCPGHDILM

SEQ ID NO: 17303 - DNA, 555 bp, Panicum virgatum
  misc_feature: Ceres CLONE 1791845-R
  misc_feature: Encodes the peptide sequence at SEQ ID NO. 17304
tcaggttctcggtgaagttggatcactgcctgatgtttacatcgagttagaggtgaacttcttcctcctaaggaggctgttgggggtgaggactagtggaacagaaagggcaagcagggtctcaaagctcgccaagggtgagatcctgatgcttaacattgggtcgatgtccacgggagcccgtgttcttgctgtcaagaatgatcttgcaaagttgcagctgactgctccggtgtgcaccagcaagggtgagaagttggcccttagccggcgcattgagaagcactggcgtctcattggttggggcacaatccaggcgggcaccacactcgatgtcccaccctgcccgctctgaatcggacaccacctctttgacgctagagtttgaaagaagagagttacctgcttgggtttttattcttccatctgcagttttgtattgttattatgcgatggatgagtcacgtcatagtgtttacttgggcagcgtacttataagcatgaatattaaattgaacaatttcaggcttcagttcagagcagtcaaaattgccg

SEQ ID NO: 17304 - protein, 117 aa, Panicum virgatum
  misc_feature: Ceres CLONE 1791845-R
  misc_feature (13)..(104): Pfam Name: eIF2_C Pfam Description: Initiation factor eIF2 gamma, C terminal
QVLGEVGSLPDVYIELEVNFFLLRRLLGVRTSGTERASRVSKLAKGEILMLNIGSMSTGARVLAVKNDLAKLQLTAPVCTSKGEKLALSRRIEKHWRLIGWGTIQAGTTLDVPPCPL

SEQ ID NO: 17305 - DNA, 1823 bp, Panicum virgatum
  misc_feature: Ceres CLONE 1791851
  misc_feature: Encodes the peptide sequence at SEQ ID NO. 17306
aaacccaaaacgcgcaaaccctagcttcggcttccccggcctcaccctctcctccgcagaccagtttacctgtcctgccggccaagatgtcgtcgtcgggcggcggcggggggcagcagttccgctatacgcagacgccgtcgaaggtgctccacctgcggaacctgccgtgggagtgcgcagaggaggagctcgtcgagctctgcaagcccttcggccgcatcgtcaacaccaaaagcggcgttggcgccaaccgcaaccaggccttcgtcgagttcactgatgttaatcaggcaatctcaatggtttcttactttgcatcatcttcggaaccagcacaaattcgaggcaaaactgtttacattcagtattcaaataggcaagaaataattaacaacaagagccctggagagactgctggaaatgtgttgcttgttaccatagagggtgttcaagctagtgatgtcaccattgatgtaatccatatggttttctcagcatttggatatgttcacaaaatagccacctttgaaaaggctgcaggttttcaggcattgatccagtatactgatgcagccactgcttcggctgctagagaagccttagatggaaggagcatcccaagttacttgcttccacagcatgtaacatcctgctgcttgcgaatttctttctctgcacatcaggatttgaacatcaagtttcagtcaaaccgcagcagggattataacaatccatatcttccaattaactattctgccatggatggtacattacagcctgctgttggtgctgatggaaagaaagtggaggctcaaggcaatgttcttcttgcatcaattgaaaatatgcaatatgccgttacagtagatgttcttcatactgttttctcagcgtttggtgcagtccaaaaaatagctatttttgagaagaatggtggcacacaagctttgattcagtatcctgatgcaactacagctgcagttgcgaaggaagcattggaaggtcattgcatctacgatggtggctactgtaagcttcacctgtcatactctcgtcatactggtctgaatgtaaaggcacatggtgacaagagcagggattacacaattccgcctggtgtaatccaaggggtgccacaaccacctggtgcagcagctacatccactgggtggcaaggtaatattcaaggagctggggcatatgccccacccggtgtccctgcccaaagccacaacggcaatggacaagtaccaagttggaattccggcaactcagggtatcccccagccccaggagcatatccaggtcagatgtactcatctccagcaccgtatgcagcatccgggggcttccctaataccccacccgctgctcctccgcattacgctgcatcatggggcttgccgacccatcttgctgctccgcggcatgagttgcacacttcacagcagatgccacttcagcatggaggaaatcagtctggaccggcaggcgcacctgcaaccagtcaaccaccaccaccaccatcgtactatcattaagaaggtggtgtcgacgcttcgtttctggaggatgtaactgctccaaagcaaacatctggagtgcaaacaatacactattcgcatcagccagcagtatttttctttcacaacaaatcagcagcagccaccagacaccagtcagccatgagcactgctgctgatttgttgtgagagaataatactgctgcattctttagttggtgtctggtggctattgatgatttattgttagagaaaaatactgttggttggctgatgcgaatagagtgaattctggag

SEQ ID NO: 17306 - protein, 485 aa, Panicum virgatum
  misc_feature: Ceres CLONE 1791851
  misc_feature (22)..(93): Pfam Name: RRM_1 Pfam Description: RNA recognition motif. (a.k.a. RRM, RBD, or RNP domain)
MSSSGGGGGQQFRYTQTPSKVLHLRNLPWECAEEELVELCKPFGRIVNTKSGVGANRNQAFVEFTDVNQAISMVSYFASSSEPAQIRGKTVYIQYSNRQEIINNKSPGETAGNVLLVTIEGVQASDVTIDVIHMVFSAFGYVHKIATFEKAAGFQALIQYTDAATASAAREALDGRSIPSYLLPQHVTSCCLRISFSAHQDLNIKFQSNRSRDYNNPYLPINYSAMDGTLQPAVGADGKKVEAQGNVLLASIENMQYAVTVDVLHTVFSAFGAVQKIAIFEKNGGTQALIQYPDATTAAVAKEALEGHCIYDGGYCKLHLSYSRHTGLNVKAHGDKSRDYTIPPGVIQGVPQPPGAAATSTGWQGNIQGAGAYAPPGVPAQSHNGNGQVPSWNSGNSGYPPAPGAYPGQMYSSPAPYAASGGFPNTPPAAPPHYAASWGLPTHLAAPRHELHTSQQMPLQHGGNQSGPAGAPATSQPPPPPSYYH

SEQ ID NO: 17307 - DNA, 3643 bp, Panicum virgatum
  misc_feature: Ceres CLONE 1791858
  misc_feature: Encodes the peptide sequence at SEQ ID NO. 17308
accggtctctcctctccccctccccggttcctccgcggctccgcctgccgctcgccagtcccttgcatctgctgtgccggcgacgcgctccactccgaccgaccccgccgcctcgctccctctctgagctcgccgccgcgctccccgccgaccccgcagcgtcccctccgaccccgccgccgcgctccctctccgaccccgccgccgcgctagccgccgactgaccgcggccaccgctgcctgcgcggctcgtcggcagcaacgtcaaggaggtcatcttcaacaacctcctgttcgaggttgtcagtatggaacagacaaatccatctccttatccacctctatcttccagtcagcaaccatggtcctcggccagtgggtcagtatcagtttcatggaataaccaagtggataaacctagccaggatacagtttactatgatccacaaagggatgtatcagttgcaggagggaatcaaaatgtaggtagcaatgtgccttattctgcccagtcgagtatggggatggcagatgcatctcactctcatgtgccttactccagttcagttcaacatagctacaatcctgtagaatatgccaactattattatggctacccacaagctgcaaatgattcttctgtccaccaaggagcaaaccaacatccagactgtgccaggatatggaagcagcagctactactatcagaacaacacatgggattctggaagctcaggaaataattatactcaatcgtaccaaaactactcttcgtctgatacaaatgcactccagagttccacttcaatgcctgccaattccgtaccatatcagcagcagtataaccagtggccgtactattacaatcaatctgtgccaagtgcttctagtaatccagttgctggaaacagtactgcagataatgtagcagttaacacccctgctggttattcctatccatctagccagccacctccaccaggcacgacgtcatggaaaattaattcagttgcttctgttgcacctccaatgcaggctccaggtgtttcaggacctcaaaatcaatacgctaaccaggcacaagatcatcatgccaaccaggcgccaggtgttcaatggtctcaaaaccattatgcctaccaggcacaggcatactctcagaagactatgaattcgaatcatgcacctctaggcaacccggaagatccgcagaggaccgtagaccctataggtcgaagctcgaatactttgttgaaccatgtttctgaaaattttcaaccaaacttgcagggttccatgacaacaaatacttccagcgaaagcaaaatacagattccaaccaatcctcgaattgctcctggtttctccatggtgataccgaagagtgagaagaaaaatttaggacctgatttatccaagaagcctgcctatgttagcgtctccatgccaacaaatgatgctaaagcaactcaagttggtcatgatgctagatctatcccattttcactccgtaattatactatgaggaacctcaatcgttgtaaagatgatgcccaaagggctgcctgccgatgtataatggaagagatcacaagaaaagctatcgctgatggaacccttcttactaagaattgggatactgaaccactactccctttgccagaaagtgttgtgggcacaactgaggcaagcagtgcaaaccattcaagtctcttctcatcaacacctaccccaaggaaacgtgtgaaaagtaggtgggagcctgctgtggatgaaacagttaccaataaggtggaacaaatagcaaaaggattgttcaacagtaatatacacaattccttcgaacctaaaaatagaacgggtagcagttgggatcacgggaagtttatccagtctcaccaagcatctttaaacaaagtcaatcagaggccggccaagaagcaaaaattcactagtaattcaagtcaaatacagaatggaaacgcttcaagtgacagtgataaggagcaggatctaaccaaatattatgccagtgcaactgcactagcaaattcaccagaggaaaagaaacgcagggagcatagatctaagcgttttgaaaggtgtcaggattcatcattaaaatcaaggaactcttctgcaaataaagatgcaattgctaatatgcatagaagaaatgcagtttcttcttatcttagtagaacttacgaagaaggcactagagctgtggaggatatggattgggatgccctgacaatcaagggaacatgtcaggaaattgagaaaaactatctacggcttacatcggcacctgatccttccatagtaaggcctgaagaagtcctggagaaggcccttgcaattgttgaaacatctcaaaagaattatttttacaagtgtgatcaattaaaatctattcgccaagatcttacagttcagagaatccagaatgaactaactgtaaaggtatacgaaactcacgcccgtttagcaatgcaagctggcgatttacctgaatataaccagtgccagtcgcaactgaagaggttatacgcagaaggaatcaagggttgctattttgaattttctgcttacaatttgctctgtgtcatgctgcactctaataataaacgagacttgctgtcatcaatggcgagcttatcaaaagaagccaaacaagatgcagctgttaagcatgcccttgcagttcattctgccgtttcatctggcaattatgtccaattttttaaactatacaagagggcacccaatttgaactcgtgcctcatggatctgtatgtggagcggatgcgctttgaagccatgaaatgcatgtctagatcatatcgcccaactttacctgtgggatatgctgtgcagattttgggattcgttagaacagatagtgaaggttgtatggctgatggggatgatggtgtagaagaatgcgagaaatggttgaaagcgcatggaacagttctttcagtagataacagtggagaattgcagatagatatgaaggcttcttctgccacactttacatgccagagccagagaatgctgttgcacatggtgatgcatcacttgccgttgatgactttttggcacggacatcgtaaaagttgtagtaatgacagaccagcagtgggtacttattggtgctgagctgtcggaggtactgcactttttccgtagaaaaatatgcaacgggagcatcaaatggagcagctcaagcatgcttgcacaggtcaagagtctggatgtgctcatctggttctgggctttcggcacttgttatagtcgatccttcatccagagtgcatgcactctgaagagcttagttgagagggcaaaccctgaactctgaagcagggctacccgacacgaacaggagccaccatcatggagctgcaagtttatgtgcggatgtggcatatcacaggcttacatataccaattagaaggccttaaatgtaggaaatattgagaaacatgacctagcacatacagaatacatgcgtgtttttcggcaccttttttctggctgtggctgcccccatttccgttagaagagtgttgtaaaactatttttttcttgcacataacgttgttttccaatagaaatatatcttacatcattcg

SEQ ID NO: 17308 - protein, 841 aa, Panicum virgatum
  misc_feature: Ceres CLONE 1791858
  misc_feature (571)..(766): Pfam Name: SAC3_GANP Pfam Description: SAC3/GANP/Nin1/mts3/eIF-3 p25 family
MPTIIMATHKLQMILLSTKEQTNIQTVPGYGSSSYYYQNNTWDSGSSGNNYTQSYQNYSSSDTNALQSSTSMPANSVPYQQQYNQWPYYYNQSVPSASSNPVAGNSTADNVAVNTPAGYSYPSSQPPPPGTTSWKINSVASVAPPMQAPGVSGPQNQYANQAQDHHANQAPGVQWSQNHYAYQAQAYSQKTMNSNHAPLGNPEDPQRTVDPIGRSSNTLLNHVSENFQPNLQGSMTTNTSSESKIQIPTNPRIAPGFSMVIPKSEKKNLGPDLSKKPAYVSVSMPTNDAKATQVGHDARSIPFSLRNYTMRNLNRCKDDAQRAACRCIMEEITRKAIADGTLLTKNWDTEPLLPLPESVVGTTEASSANHSSLFSSTPTPRKRVKSRWEPAVDETVTNKVEQIAKGLFNSNIHNSFEPKNRTGSSWDHGKFIQSHQASLNKVNQRPAKKQKFTSNSSQIQNGNASSDSDKEQDLTKYYASATALANSPEEKKRREHRSKRFERCQDSSLKSRNSSANKDAIANMHRRNAVSSYLSRTYEEGTRAVEDMDWDALTIKGTCQEIEKNYLRLTSAPDPSIVRPEEVLEKALAIVETSQKNYFYKCDQLKSIRQDLTVQRIQNELTVKVYETHARLAMQAGDLPEYNQCQSQLKRLYAEGIKGCYFEFSAYNLLCVMLHSNNKRDLLSSMASLSKEAKQDAAVKHALAVHSAVSSGNYVQFFKLYKRAPNLNSCLMDLYVERMRFEAMKCMSRSYRPTLPVGYAVQILGFVRTDSEGCMADGDDGVEECEKWLKAHGTVLSVDNSGELQIDMKASSATLYMPEPENAVAHGDASLAVDDFLARTS

SEQ ID NO: 17309 - DNA, 2676 bp, Panicum virgatum
  misc_feature: Ceres CLONE 1791860
  misc_feature: Encodes the peptide sequence at SEQ ID NO. 17310
accacgagctcgcgtgccactcccacaagcccatctccgtctctccctccacccagctgtttgtctgggaggggaagaaaaaactcgcgctcgcttgtctgctccgctgcgttcgtggtggtgagcgggggaggcttcgtcgcggcacgaagcggcgaggtttggtgtttgtagaattgcctaggtgaggttctgctacttgcacacagtcatggcaaccggcgtggcaccagctcctctcccacatgtccgggtgcgtgatggcggcatcgggttcaccaggagcgtcgactttgctaaggtcttatcagttcccggtgtcagcactatgaggaccagctcctcgaggagcagggcgttcgtggtgaagaactccagtactggttcagataccatggagctcgagccagcatctgaaggaagcccacttttagtccccaggcaaaagtactgtgaatctacacatcagacaaggagaaggaaaactcgtactgtaatagtgggggatgtcccactcggtagtgatcatcccataaggattcagaccatggcgacctcagataccaaggatgttgccaaaactgtagaagaggtgatgaggatagcagataaaggagccgatcttgttagaataaccgtacagggtaagaaggaagctgatgcctgctttgagatcaagaacaccctggttcagaagaattacaacattccactagtggccgatattcattttgcccctgcagtagctttaagagtggcagaatgctttgacaaaattcgcgtgaaccccggaaattttgctgatcgacgtgctcaatttgagcagcttgaatatacagacaacgagtaccaaaaagagctcgagcatattgagaaggtattttctccattagttgagaaatgcaagcagtatgggagagcaatgcgcataggaacaaatcatggaagcctctctgaccgcataatgagttactatggtgattctccacagggaatggttgagtctgctttggaatttgctaggatatgtcggaagttggacttccacaactttgtgttttcaatgaaagctagtaaccctgttgtcatggtccaagcataccgcctgcttgttgcagaaatgtataacctaggatgggattatccattgcacttgggtgttacagaagccggagagggtgaagacggaaggatgaagtctgctattggcattggaacacttttaatggatggcctgggtgacacaatccgcgtctccctcacagaaccaccagaagaagagatcgatccttgccggagattggcaaatcttgggacacaggctgcaaatcttcaaatcggggtggcaccatttgaagagaatcacaggcactattttgacttccagcgtaggagtggtcaattacctttgcagaaggagggcgaggaagttgactacagaaatgtactgcatcgtgatggctctgtactgatgtcagtttcattggaccaattgaaggctcctgagctcctttataggtctcttgcagcgaagcttgtggttggcatgcctttcaaggaccttgctactgtagattccattcttttgagggagctcccccctgtagaagatgctgaagctagacttgcactcaaaagattagttgacatcagcatgggagtgttgacccccttgtcagagcagttgacaaagccactcccacatgcaattgcgcttgtcaaccttgaggaactgtcaagtggggctcacaaacttttgccacaaggtactagacttgctgtcacccttcgtggagatgaatcatacgagcagctagatatccttaagggtgttgatgatataacaatgctgctacatagtgttccatatggtgaggagaagactggcagagtacatgctgctaggaggttattcgagtacttacagaacaatggcttgaactttcctgtaatccatcacatagagttccctaaaaccattggcagagatgatcttgtcattggtgctggggcgaatgttagtgctctcctagtcgatggtcatggtgatggtgtacttcttgaagctgctgaccaggaatttgagttcctgagggacacatctttcaacttgcttcagggttgcagaatgcgcaacacaaaaactgaatatgtgtcttgtccttcgtgtggacgaacactctttgaccttcaggaaattagtgctgagattagagaaaagacctctcatctgccaggcgtctcgatcgccatcatgggttgcattgtcaacgggccaggagagatggccgatgccgattttggatatgtgggaggcgctcctggaaagattgatctgtatgttggcaagaatgttgtgcagcgcggcatcgccatggaaggcgccaccgacgccctgatccagctgatcaaggaccacggccgatgggtggaccctcccgccgaggagtaagggctgtagagactgcctagcctctgtagtttattctgtaaagtgaaacacgcaatgcgtgcggtaactgagcatttatacagtgtacgtattcatgttgagtacatcgtccctgcactgcacacattttgtaccgtgtacatctattattgagaaataattaaattaaaaatagggggtgaccgcaggtttgcagcatccccggcgaagcgtatgcagttcag

SEQ ID NO: 17310 - protein, 746 aa, Panicum virgatum
  misc_feature: Ceres CLONE 1791860
  misc_feature (89)..(443): Pfam Name: GcpE Pfam Description: GcpE protein
  misc_feature: SWISSPROT Homolog: EC 1.17.4.3 4-hydroxy-3-methylbut-2-en-1-yl diphosphate synthase
MATGVAPAPLPHVRVRDGGIGFTRSVDFAKVLSVPGVSTMRTSSSRSRAFVVKNSSTGSDTMELEPASEGSPLLVPRQKYCESTHQTRRRKTRTVIVGDVPLGSDHPIRIQTMATSDTKDVAKTVEEVMRIADKGADLVRITVQGKKEADACFEIKNTLVQKNYNIPLVADIHFAPAVALRVAECFDKIRVNPGNFADRRAQFEQLEYTDNEYQKELEHIEKVFSPLVEKCKQYGRAMRIGTNHGSLSDRIMSYYGDSPQGMVESALEFARICRKLDFHNFVFSMKASNPVVMVQAYRLLVAEMYNLGWDYPLHLGVTEAGEGEDGRMKSAIGIGTLLMDGLGDTIRVSLTEPPEEEIDPCRRLANLGTQAANLQIGVAPFEENHRHYFDFQRRSGQLPLQKEGEEVDYRNVLHRDGSVLMSVSLDQLKAPELLYRSLAAKLVVGMPFKDLATVDSILLRELPPVEDAEARLALKRLVDISMGVLTPLSEQLTKPLPHAIALVNLEELSSGAHKLLPQGTRLAVTLRGDESYEQLDILKGVDDITMLLHSVPYGEEKTGRVHAARRLFEYLQNNGLNFPVIHHIEFPKTIGRDDLVIGAGANVSALLVDGHGDGVLLEAADQEFEFLRDTSFNLLQGCRMRNTKTEYVSCPSCGRTLFDLQEISAEIREKTSHLPGVSIAIMGCIVNGPGEMADADFGYVGGAPGKIDLYVGKNVVQRGIAMEGATDALIQLIKDHGRWVDPPAEE

SEQ ID NO: 17311 - DNA, 340 bp, Panicum virgatum
  misc_feature: Ceres CLONE 1791867
  misc_feature: Encodes the peptide sequence at SEQ ID NO. 17312
gcctcacgagcgccagccagtcacctaccccgaagccgccgcgaccgatcgagccgagcgccccgccccacgccgcgccgcgccgcgccgcgccgcaccgaaaccctagctccttctcctcagccatggccaccgtctcgctcacgccgcaggtggtcttctccaccgagtcgggcggcgccctctcgtccgccaccatcctccgcttcccgccaaacttcgtgcgccagctcagcaccaaggcccgccgcaactgcagcaacatcggcgtcgcgcagatcgtcgccgcggcgtggtcagactgccccgccggccgcccccactccggcggcggcgggac

SEQ ID NO: 17312 - protein, 71 aa, Panicum virgatum
  misc_feature: Ceres CLONE 1791867
  misc_feature: SWISSPROT Homolog: EC 2.5.1.48 Cystathionine gamma-synthase
MATVSLTPQVVFSTESGGALSSATILRFPPNFVRQLSTKARRNCSNIGVAQIVAAAWSDCPAGRPHSGGGG

SEQ ID NO: 17313 - DNA, 587 bp, Panicum virgatum
  misc_feature: Ceres CLONE 1791867-R
  misc_feature: Encodes the peptide sequence at SEQ ID NO. 17314
tcaccatgtagtggtggcgttctgaacccaaatgctgcctacctgatccttcggggcatgaagacactgcatctccgtgtgcaatgtcagaataacactgctctgcggatggcccaatttttagaggaacatccaaagattgcacgtgtctactatcctggtttgccgagtcaccctgaacatcacattgccaagacccaaatgactggctttggtggtgttgtcagttttgaggttgctggggattttgatggtacaaggagattcattgattctgttaagataccctatcatgccccttcttttggaggctgtgagagcattatcgaccagcctgccatcatgtcttactgggattcgaaggagcagagggacatatacgggatcaaggacaacctgatcaggttcagcattggagtggaggattttgaggatctgaagaacgatcttgttcaggcccttgagaaggtctaagcacttgattcgttcactttaatatgtatatcagatcatggttgtcctggatcttgagagatctgtgagaatatttgagccgatggctgccaataaattttctccttttgctt

SEQ ID NO: 17314 - protein, 157 aa, Panicum virgatum
  misc_feature: Ceres CLONE 1791867-R
  misc_feature (1)..(155): Pfam Name: Cys_Met_Meta_PP Pfam Description: Cys/Met metabolism PLP-dependent enzyme
  misc_feature: SWISSPROT Homolog: EC 2.5.1.48 Cystathionine gamma-synthase
SPCSGGVLNPNAAYLILRGMKTLHLRVQCQNNTALRMAQFLEEHPKIARVYYPGLPSHPEHHIAKTQMTGFGGVVSFEVAGDFDGTRRFIDSVKIPYHAPSFGGCESIIDQPAIMSYWDSKEQRDIYGIKDNLIRFSIGVEDFEDLKNDLVQALEKV

SEQ ID NO: 17315 - DNA, 1556 bp, Panicum virgatum
  misc_feature: Ceres CLONE 1791877
  misc_feature: Encodes the peptide sequence at SEQ ID NO. 17316
accggatttcgcttccatcgaatcctctcttcgacgtcctcaccaaacaaccccccatctcgtctcccaccgcagccgtccaccacggccgccgccggcgctgcagccatgcacggccgccgccacctcgcggcctccctggcgcgggccctgacccaggccccctcccgctgcatctcctccaccccgtcgctcctccaaaccctcgactcgtccgtgtcctcgcctccgtccgcgcctccgtcggcggggcggctcgcggagctgcgcgcgcggctgcaggcggatgcgccgtcgctgggggacttcacgtactcggtggaggtggggacgcggaagcgcccgctgcccaagcccaagtggatgaaggagaccgtgccgggtggcgccaagtacgcggccatcaaggccaagctgcgggagctgaagctgcacaccgtctgcgaggaggcacggtgccccaacctcggcgagtgctggtccggcggcgagaccggaaccgccaccgccacaattatgatccttggggacacctgcacgcgcggctgcagattctgcaatgtcaagacatctcgaactcctccaccaccagatcctgatgagccttccaatgtcgctcaagctattgcctcatggggccttgaatatatagtcatcacgagtgttgaccgggatgatttacctgatcagggcagtggtcactttgctgaaacaatacaaaagttaaaggctttgaagccagagatgcttattgaagcacttgtacctgatttccgtggagatccaagctgtgtagagaaggttgcaacttctgggttgcatgtttttgcacacaacattgaaacagtggaggagctgcaaagaagtgtccgagactatcgtgcaaatttcaaacaatctatagatgttctgaaaatggcaaaagagtatgctcctcctggtacccttacgaagacatcagtaatgctgggttgcggggagactccggatcaagttattagcaccatggaaaaagtgcgggatgctggtgttgatgttataacatttggccagtacatgaggccatcaaaacgtcacatgcctgtttctgagtacgttacacctgaagcttttgagaagtatagggcccttggtgttgaaatgggtttccgttatgttgcatctgggcctatggttcggtcctcctacaaggctggtgaattctacatcaaagctatgattgaagctgatcgagcaaaaggatccactgcagagtcaagtgcataattgaccccttgacattgctatgctgcaaataagctccccactgcttcattgtcggaaagccatgctgatttctgccaccacacatttctcctttttttatcatagaataactcctgcgggctcctttatgccactctgcattgcttcgcgctccctcgcgagttgaaacacttgtgcttcagcagatcaattttctccccttttgtggtcagattcatttgttgtaacatcactttaggccatcgccacctgtgtattttgattgtacagaatgtgaatacagggcttgg

SEQ ID NO: 17316 - protein, 385 aa, Panicum virgatum
  misc_feature: Ceres CLONE 1791877
  misc_feature (137)..(303): Pfam Name: Radical_SAM Pfam Description: Radical SAM superfamily
  misc_feature: SWISSPROT Homolog: EC 2.8.1.8 Lipoyl synthase
MHGRRHLAASLARALTQAPSRCISSTPSLLQTLDSSVSSPPSAPPSAGRLAELRARLQADAPSLGDFTYSVEVGTRKRPLPKPKWMKETVPGGAKYAAIKAKLRELKLHTVCEEARCPNLGECWSGGETGTATATIMILGDTCTRGCRFCNVKTSRTPPPPDPDEPSNVAQAIASWGLEYIVITSVDRDDLPDQGSGHFAETIQKLKALKPEMLIEALVPDFRGDPSCVEKVATSGLHVFAHNIETVEELQRSVRDYRANFKQSIDVLKMAKEYAPPGTLTKTSVMLGCGETPDQVISTMEKVRDAGVDVITFGQYMRPSKRHMPVSEYVTPEAFEKYRALGVEMGFRYVASGPMVRSSYKAGEFYIKAMIEADRAKGSTAESSA

SEQ ID NO: 17317 - DNA, 1828 bp, Panicum virgatum
  misc_feature: Ceres CLONE 1791902
  misc_feature: Encodes the peptide sequence at SEQ ID NO. 17318
attcctccatcccttcccttcccagatcggcagatccgcccccacctacccccgcgcgcggcgcgcctcccggatggccaccgtctcccccgcccgccccgggccgccgtagcatgggcatctccccctcctccctctccaaatccagcaccaactccccgccgcgccgcagcaggtcgctctccccgatggcgccgccgccgcggccgcgggcgaccgtgcccgtgcaggtcgccgcgtggggcagcggcagctcctcctcctgcctgttcgacccgcccgcgtgggactacacgcaggacctgcccgacgagatcctcgcgctcgtcttcgcgtcgctctcgcccgccgaccgcagcgcctgctccctcgcctgcgtgcgctggaaggaggtcgacgccgccacgcgccaccgcctctccctcgacgcgcgggccgggctgggccacgccgcgcccgacctcttcgcgcggttcgcggccgtcaccaagctcgcgctccgcagcgcgcggggctccggcgccgacagcctcgccgacgacggcgcggcggcggtggccgccgcgctgccctcggaccgccttgccaggctcaagctccgcgggctgcggcagctatctgacaccgggctgtcctcgctcgccgccgccgcgccggctctccgcaagctctctgttgcttcctgcaccttcgggcccaaggccttcgtcgccgtgcttcaggcctgcccactcctcgaggacctctccgtcaagcgcctccgcggcctaccagacacggccggtgccgctagtgccattactgaggagatcaaatttccccaggcgttatccttgcgttcagtttgccttaaggatctatacagcgccctgtgctttgtgccgcttgtggcgtcctcgccaaacctccgctcgctcaagatattgcggtgctctggcgcctgggacctgccattggaggtcatcactgcgcatgctcctggtcttgttgagcttcaccttgagaagctccaggtgggtgaccgtggccttgctgtgctctcggcctgcagaaatctggaggtgctgttccttgtcaagacccctgagtgcactgactcgggcatcatcagtgttgccgagaagtgccacaaactccgcaaactgcatattgacggatggcgcacaaaccgaattggggatttcgggctcatggctgtggcaagaggatgtccggatctgcaggagctcgtcttgattggggtcaaccccactgtgttgagcctccggatgctcggtgaacactgtcgtgcgttggagcggcttgcactttgtggttgtgaaaccgtaggggatgcggagatcatctgcctggctgagcgatgtgctgcgctcaagaagctctgcatcaagggatgtccggtgtctgatcgtgggatggaagcactgaatgggggctgccccagtttagtcaaggtgaagctgaagagatgccgtggagtgtcctacgagtgcgtcgagagtctgaagattaccagggggggatcattttccatcagcttggatattgtgttggagcatgatgctgggagtgctagtgaaaatggtgtccaggagacaggccaagcacaaatcaccgagctgaccgatcagatggctggcattggcatggaccttccaaccaatgctgctggcgcacaatcatccacgcatactattagcagggtgaggagtgtcgtgtcagcaatccgccgtaggtttggcaaccctcaaccacagtgatatgagatggcaattttatgaactgttgttatccattcccattttctaatcacatattcatgtttccc

SEQ ID NO: 17318 - protein, 548 aa, Panicum virgatum
  misc_feature: Ceres CLONE 1791902
  misc_feature (59)..(105): Pfam Name: F-box Pfam Description: F-box domain
MGISPSSLSKSSTNSPPRRSRSLSPMAPPPRPRATVPVQVAAWGSGSSSSCLFDPPAWDYTQDLPDEILALVFASLSPADRSACSLACVRWKEVDAATRHRLSLDARAGLGHAAPDLFARFAAVTKLALRSARGSGADSLADDGAAAVAAALPSDRLARLKLRGLRQLSDTGLSSLAAAAPALRKLSVASCTFGPKAFVAVLQACPLLEDLSVKRLRGLPDTAGAASAITEEIKFPQALSLRSVCLKDLYSALCFVPLVASSPNLRSLKILRCSGAWDLPLEVITAHAPGLVELHLEKLQVGDRGLAVLSACRNLEVLFLVKTPECTDSGIISVAEKCHKLRKLHIDGWRTNRIGDFGLMAVARGCPDLQELVLIGVNPTVLSLRMLGEHCRALERLALCGCETVGDAEIICLAERCAALKKLCIKGCPVSDRGMEALNGGCPSLVKVKLKRCRGVSYECVESLKITRGGSFSISLDIVLEHDAGSASENGVQETGQAQITELTDQMAGIGMDLPTNAAGAQSSTHTISRVRSVVSAIRRRFGNPQPQ

SEQ ID NO: 17319 - DNA, 2509 bp, Panicum virgatum
  misc_feature: Ceres CLONE 1791910
  misc_feature: Encodes the peptide sequence at SEQ ID NO. 17320
ggattggaggttggaggcctgaagggggaggtgggtcgccggacagggacggggagacggcgagagggcgttccgcaggagccgttcccgtgcttcctccaccgaccgggccgacgcgccgcgccgctgtttcaggttcccgcccctgcatttttctgcttgtgcttgcgctagttgcgagggtaggttgcggcgttagagattggttcgcggcttctgtgcggcgctgtgtttgtttggccagatccgcgtgtgtgctgctgactcttcgtgatttcctcttctgtttgagctttccttgctcggctttgtgctgctgcctgcctgctgcttctttttctggccactgcatttgggttgtgtgccgcgctacttatcctgctctgcttgtgtttaagattacagctcgtgtttctttcaacgatattttcacctttgtttcatcacttgggaagctggtgccgtaaaagagtctgctaaaccatgctaactttagcgaaattactgttactccagctgtccagcatgttccttccttcatcttagtgaaaataaagtatgttgtggcatactggtatggatctgtgcattgctgagctcctctgtttacaggttccagaatttcaagtattggccgctttaggatactatgggaaagtccccggggaagtggatcaagtctgtgctcttggggaagaaatcgactaaatccggttctaccaaggcaaatgagtcggctacaaataacaatggacactcagctggggaggagcgtgcattttctgaaaattctccagtgatctctgagccggtgcttgttgaagcccacaaaaatggagctgtttcagttaatgggaaggctgaagatgtcaatttgccaagtgacagggctggccaacaagatctgcagaaccaaagtattgttgagtccgaaacatcagttcctgggcaattgggagaagaccaagctgcagtgaaggcacaggcagcatttcgcggttacctagcacgaaggtcattccgtgcattgaaaggtatcataagactccaggcactgattcgagggcatcttgtaaggagacaggctgtttcaacccttcaaactacttggttgattgtgaagtttcaatctctagttcgtggaagaaatgtcagactctctggtgctgacattcaactcaatgtgaagcttggccaacataaccttggtggcactagatcatctgatgcatggaaagagaagttatcttcaaatgcctatgttcggaagcttctgtcttcaccaatagtgctagaacctcttcacttccagtatgacaagagggatcccaattcaacctataactggctagagagatgcaccataggctgcatctggaagcctgtttttcaaccaaaaagagttcctgatgggaaactgctggtaaggaaggctagttatgcaatggaaactgaatcagccaagttaaagcgcaacattaggaagggctctgctgctacagttgagagtttccatacaagagtgactggtgaatctgagaaacttaaacgtaatccaaagaaattctcaaacttccctgctgactcagtaccagatagccagttatctgaacttgagaaggttaaaaggaacctgaggaaggtaactgattccatggctgaagcctcaaagatctctagttccagggttgattcctcaaaggtatctgattctacacctgatgctccaaaagtatctaatcctgtggccgaaatctcaaagacatctagtctcctgaacgggatctctgaccatcaagacagccaatgtgaaaaagcactacagaatacacgtgaggcttcatttcctcttgaaactcaagattactctggcaatggtcagctattggaatattcagatatggataacttcgacttggtacctggtttgaaaagtgatctggaaactcagcttgattcagtttctataggagaaaatgttgatgagcccactgttggtgcttcagcagctgaaggtatgccactgcagaacattgataagcccaatagtttagggaagaaagaggaagcaaggtccaaggaagagcatctgtctaatggaagccttagaactggcaagagaaagtcttcatccccatacaaatcagaatatgtggaaaacgggactcacactactcctgctcagccaaggaagccaagctatatggctgcaacggagtctgcgaaggcgaaattacgagcacagaattcacccagggtggattctgattcatcagcagaaaagaatggcttcactcgacgccactctcttccttccggtacaaacagtagggcgatcaaagctgaatggaagcgctgaggaggcattggcttgaattgaatagtgcgattgtctgaatctctgctgggtgaactctgccgctgcttgctcctttttatttatcctgcgatgtaaagagaagacgttgtccctgtattgaacaatctttgtgatgagtgcgtctggttc

SEQ ID NO: 17320 - protein, 569 aa, Panicum virgatum
  misc_feature: Ceres CLONE 1791910
  misc_feature (105)..(125): Pfam Name: IQ Pfam Description: IQ calmodulin-binding motif
MGKSPGKWIKSVLLGKKSTKSGSTKANESATNNNGHSAGEERAFSENSPVISEPVLVEAHKNGAVSVNGKAEDVNLPSDRAGQQDLQNQSIVESETSVPGQLGEDQAAVKAQAAFRGYLARRSFRALKGIIRLQALIRGHLVRRQAVSTLQTTWLIVKFQSLVRGRNVRLSGADIQLNVKLGQHNLGGTRSSDAWKEKLSSNAYVRKLLSSPIVLEPLHFQYDKRDPNSTYNWLERCTIGCIWKPVFQPKRVPDGKLLVRKASYAMETESAKLKRNIRKGSAATVESFHTRVTGESEKLKRNPKKFSNFPADSVPDSQLSELEKVKRNLRKVTDSMAEASKISSSRVDSSKVSDSTPDAPKVSNPVAEISKTSSLLNGISDHQDSQCEKALQNTREASFPLETQDYSGNGQLLEYSDMDNFDLVPGLKSDLETQLDSVSIGENVDEPTVGASAAEGMPLQNIDKPNSLGKKEEARSKEEHLSNGSLRTGKRKSSSPYKSEYVENGTHTTPAQPRKPSYMAATESAKAKLRAQNSPRVDSDSSAEKNGFTRRHSLPSGTNSRAIKAEWKR

SEQ ID NO: 17321 - DNA, 736 bp, Panicum virgatum
  misc_feature: Ceres CLONE 1791915
  misc_feature: Encodes the peptide sequence at SEQ ID NO. 17322
gccttctctccgcgccgcgacgctaccccgccccatccgccaggccgtcgccgccagcagtctccccaccctcgacccgctccgccgtcgcgcttccggaggaggcagataggagaaggtgatcggctgcgatggcccgcttgtacgtcgggaacctggatcctcgggtgacggcacgggagctcgaggacgagttccgcacctttggagttcttcggagtgtttgggttgctcggaaaccacctggctttgcatttattgattttgatgacaagagggatgctgaggatgcaatccgtgatcttgatggcaagaatggatggagagttgagctatcacgtagtgccagcagtggtcgtggtggtcgtgatcggtatggtgggtctgagtctaagtgctacgagtgtggtgagactgggcactttgctcgtgagtgtcgtttgaggattggttctggaggtctaggcagtggaaggcgccgaagcaggagccgcagccgcagccgcagccccagataccgacggagtccaagttatggaagaagaagctacagtcctgcaacacgctctccaaggcgtcgtagcgtgtcaccagccccagctcgtggacgcagctatagcaggtcaccacaccgtgcacgggagacgtctcctaacggataccgccgcagcaggagctagagccagatatttttctgtgacagatattgctctttggcccatcatctatgatcaat

SEQ ID NO: 17322 - protein, 182 aa, Panicum virgatum
  misc_feature: Ceres CLONE 1791915
  misc_feature (4)..(70): Pfam Name: RRM_1 Pfam Description: RNA recognition motif. (a.k.a. RRM, RBD, or RNP domain)
  misc_feature (87)..(104): Pfam Name: zf-CCHC Pfam Description: Zinc knuckle
  misc_feature: SWISSPROT Homolog: EC 5.2.1.8 Peptidylprolyl isomerase
  misc_feature: Useful for making plants with modulated flowering time
MARLYVGNLDPRVTARELEDEFRTFGVLRSVWVARKPPGFAFIDFDDKRDAEDAIRDLDGKNGWRVELSRSASSGRGGRDRYGGSESKCYECGETGHFARECRLRIGSGGLGSGRRRSRSRSRSRSPRYRRSPSYGRRSYSPATRSPRRRSVSPAPARGRSYSRSPHRARETSPNGYRRSRS

SEQ ID NO: 17323 - DNA, 1548 bp, Panicum virgatum
  misc_feature: Ceres CLONE 1791919
  misc_feature: Encodes the peptide sequence at SEQ ID NO. 17324
actaggcgaattgcgatggagggagaaacccggactgcccgaggaggatgacgccaaccccctgcgtcctgcccgcacggcgggaggaagtccccggcgcggcggcggcttcaccggccgcaagacacgctcgtttttacaatgattgcaatggcaagtgaagaacatatagttgcgtgttcaactgctacaaggatcccactagatgttattaaggagatacttctcagacttcccgtgggccctctactgagactgcgtagagtttgcaggcaatggcgcgacatgatcagtgacccccacttcatcaaagaacatgcctatcgtggacctaagcacctcctttacttgcataaattgcatatatcagcaattcccaatcccaagactgtcagctatacaacgatcatcgatgataaatggtctccatcgacatgggtgacatcacatatggaccctgatgatcacctctttgcatcatgcaatggcctgctttgcttctacaagaaattcacactgaaggtagtcaaccctgcaactggtcaatggctgcatctttcgaaaccggacgggatattgttgcacgacttccactatctgtacagctttggatttcacccgacaactggagaatacaagctcatgcactttctgcgtgaaccccagtgttacaaatcaggtcagcctttccgtttcgacaccattcaagtgtacacccttggtgatggcaaatggagaaatatacaagcaccaagaacatgctgcatggtgcattttggagttgttaatgtggacggagcgatgtactggctaatagaaggtgaaggaacaaactatggcatggcagttatgtcattcgatctcaaggaagaaacgtttacaacgattcaacttccaccattggaggtgaaagaaacagtctcttgtgccaaccctagaaacgcgtactatataactgagatagatgagaaggtatgcatagttactataccataccagagacatgtaccaaggtggcgctgctacaatgcagagctttctggcggggcggacgtttgggctcttgaaagtcaggttgagcacaggtggttcctaaaatatagcatccagtcaccatggttaccccggtatgttgctcagccatgtttcatccacagggagaagatcttactgcaggactgcgagggtaacgtgtggtaccatgatttgcgaagcaagaacgtgcacattgagcaacgcaaggagatgaagcttttgcacttaggaccccacagattctatgagacacagtcccacttttacaaggagacacttgttcccttgagcctgtatgcaggggcagccactgttcgtacatctccttggcttcttgctcctgcagttgcttcgcattagtttgtacgaggctcctgcactttgaatgtttgtcggcatatgtgatgagttagtgagcatagtctgtagcttaggaaggtgttcttgcctgatacagaaattatggtgtaatcttcgcatcacaattgataatgtctgtcaaaggttcatccg

SEQ ID NO: 17324 - protein, 417 aa, Panicum virgatum
  misc_feature: Ceres CLONE 1791919
  misc_feature (14)..(61): Pfam Name: F-box Pfam Description: F-box domain
MIAMASEEHIVACSTATRIPLDVIKEILLRLPVGPLLRLRRVCRQWRDMISDPHFIKEHAYRGPKHLLYLHKLHISAIPNPKTVSYTTIIDDKWSPSTWVTSHMDPDDHLFASCNGLLCFYKKFTLKVVNPATGQWLHLSKPDGILLHDFHYLYSFGFHPTTGEYKLMHFLREPQCYKSGQPFRFDTIQVYTLGDGKWRNIQAPRTCCMVHFGVVNVDGAMYWLIEGEGTNYGMAVMSFDLKEETFTTIQLPPLEVKETVSCANPRNAYYITEIDEKVCIVTIPYQRHVPRWRCYNAELSGGADVWALESQVEHRWFLKYSIQSPWLPRYVAQPCFIHREKILLQDCEGNVWYHDLRSKNVHIEQRKEMKLLHLGPHRFYETQSHFYKETLVPLSLYAGAATVRTSPWLLAPAVASH

SEQ ID NO: 17325 - DNA, 523 bp, Panicum virgatum
  misc_feature: Ceres CLONE 1791924
  misc_feature: Encodes the peptide sequence at SEQ ID NO. 17326
attctccctcctctttctcataaactccctcccataaggtcttggagggaagaaaacaaaacttaacccagcaaccaggccggcaagcaaaaatggctatctgcatcacgcacaccaccgcctccctgcactccccatgcgaaacagacacaaacacacgattcacgcagaaacaattcatcttcttccccaccaacaggagaagcggcaaaggggatggagggggaagaacctttcacgtttcatgctccctctagaagccagtggtgatcggcctggcggcaaactcaagaagctcgaagagtaccttcatgcgccgtctcaccagtgtgtttggtggtgctgcagagccacacaagggtggcaaccccgactcccacaccctcatcattgacaccaagacaatgatatgccttgatgactaccactccatgcacataaccagcacaaaggagaacggtgtgaccgccctcgaccccatggccaacaactataatctcatgtatgagcacgtgaacgcaat

SEQ ID NO: 17326 - protein, 70 aa, Panicum virgatum
  misc_feature: Ceres CLONE 1791924
  misc_feature: SWISSPROT Homolog: EC 2.7.1.19 Phosphoribulokinase
  misc_feature: Useful for making plants with altered lignin content
MRRLTSVFGGAAEPHKGGNPDSHTLIIDTKTMICLDDYHSMHITSTKENGVTALDPMANNYNLMYEHVNA

SEQ ID NO: 17327 - DNA, 2003 bp, Panicum virgatum
  misc_feature: Ceres CLONE 1791940
  misc_feature: Encodes the peptide sequence at SEQ ID NO. 17328
gccagagcacacagctgtaatgcaatggcgggcggaagctccgaaccgaaagcatcaatgcggtcacacagttctcccaatctttttgttcctccccacctccctccctccctccatggtgctgtaattccgttacctcaccctcacgaggcgggagatgctttacttcctcacacctgtaacgccgcaccaggccgcggcacgccgcgctgcacgtttcggctagcgctacgctacagaacctccattggccattgccagccagctgcgcgccgcgctttggccctgctctgctctgcttctgcgtataagttccttccttggccgcttccgcgctcgccgttcttctcctcccttcgccgtcacctcccctccctcccagatccattctttcccgtgctcacgcctcccccgcggcgaggcgggacagagcagagccggggagggcaaagaaccatggcttctcgtgttgtcgccgtgattcttgccgtccttgtgggagcaagcgccgccgcccctggctcggagccgtggtggaacgagacgcaggtgtacggcaccgacgccaactccggcggcagcaccggcgtcttcgttggcctcacactcatccagtcggcggccgccaagggagccgtgtgcttggatggaagcttaccgggttaccacctgcaccgaggatttggatcaggagcaaacagttggcttgtcaacctggagggtggaggctggtgcaatgatgttagcagctgtgtgctccgcaagggcaatcgccgtgggtcgtcaaatcatatggagaggcagctccagtttactgggataatgagtaacagacctgaagagaatcctgatttctacaactggaacagagtgaaggtccggtactgtgatggtggatccttcactggcgacggttctaattcggctgcaggcctttatttccgaggtcagcgcatttggcaggctgctatggatgacctgatggcccaaggaatgcgttatgctaatcaggcccttcttgctggatgctctgctggtggtgtttctaccatacttcactgtgatgaattccgtggattgtttccatcaaataccagagtcaaatgcctggctgatgctggaatgtttcttgacactgttgatgtttctggtcgtcgggaaatgagatcattcttcaatggcattgtgagattgcagggttctggaagaagtttgcctaggtcttgcacctcccgcatggacaaaacctcgtgctttttcccgcagaacgtagtgccaaacatccagaccccaactttcattttgaacactgcctatgatgtgtggcagcttcaacaaagcgtggcccccaaaaccgctgacccccaaggtctatggtcaaaatgtaggacgaaccatgcctactgtaatagcaaccaacttcagtttttacaaggtttcaggaaccaaatgcttgattctgtaaggggtttctctgcgtcaaggcaaaatggcatgttcatcaactcatgctttgcgcactgtcagagcgagaggcaggatacatggtacgcaaacaactcaccacgtctcggtaacaagagaattgctgaagctgtcggtgactggttcttcgagaggggtgtcgccaagtacacagactgtgcatacccttgcgataacacttgccatcacctcgtgttcaggggagaccattaagactaattattctttaccgcccacgattcggatggcgaaaggaacattaccccccaacgggtatagaatcaaaagttgaaaaaaggatacagatatagagagggtgcaggcgtcccgaaaaatgcgaggaggtccctgcgttagcttcacaaccatgatatcgattctttttcattgaacacaccattcatcatgtgcctgaacatttaattagaccctatcattgtactgtatgatgctatatattcatgtaagaaacgtgattatagtatgaaggaaaattgtgcgtggagtttagttacctc

SEQ ID NO: 17328 - protein, 413 aa, Panicum virgatum
  misc_feature: Ceres CLONE 1791940
  misc_feature (31)..(394): Pfam Name: PAE Pfam Description: Pectinacetylesterase
  misc_feature: Useful for making plants with altered carbohydrate content
  misc_feature: Useful for making plants with altered cell wall content and/or composition
MASRVVAVILAVLVGASAAAPGSEPWWNETQVYGTDANSGGSTGVFVGLTLIQSAAAKGAVCLDGSLPGYHLHRGFGSGANSWLVNLEGGGWCNDVSSCVLRKGNRRGSSNHMERQLQFTGIMSNRPEENPDFYNWNRVKVRYCDGGSFTGDGSNSAAGLYFRGQRIWQAAMDDLMAQGMRYANQALLAGCSAGGVSTILHCDEFRGLFPSNTRVKCLADAGMFLDTVDVSGRREMRSFFNGIVRLQGSGRSLPRSCTSRMDKTSCFFPQNVVPNIQTPTFILNTAYDVWQLQQSVAPKTADPQGLWSKCRTNHAYCNSNQLQFLQGFRNQMLDSVRGFSASRQNGMFINSCFAHCQSERQDTWYANNSPRLGNKRIAEAVGDWFFERGVAKYTDCAYPCDNTCHHLVFRGDH

SEQ ID NO: 17329 - DNA, 747 bp, Panicum virgatum
  misc_feature: Ceres CLONE 1791954
  misc_feature: Encodes the peptide sequence at SEQ ID NO. 17330
atccccttgcccttcaccaccaaggcaagcccccaccagcgcagccgcgtctccggacctcgtcgtcttcgcctccctgcctcgccatttcgtcagccccgctccgcttttgctgcctccccgccggcgagccgcctccgcccccgagcctccgtgtccgcgtcggccgccccgtccaaggactacgagttcactgatgggaatggagaagtggagctcagactggatgtccaaaagctcggcatcgagagttcaaaagatgttttcgttgatgttgatgatacatctctattgatcagagctaagtctgatgggacactgagaactttgatgaatgtccaaacactgtttgataggatcaagtcttccgagaccatatggtttattgatgaggatcagctggtggtaattttgaagaaagtcgagcaagagttgaaatggcctgatattgatgaatcctgggagtccctcactgctgggatcacccagttattgacagggatcagcgtccatattgttggtgattctacagacatcaatgaggcagttgctaaagagattgctgagggcattgggtgcgtgcttctcatttgtatactaccgtacgattcaaccgctgtacaattagattgtatgctgtgcaaattacattctgatcttggctacccattctactccattagtaaaagtcatcagaacccattatatgaattattaaactttatgatctactcctgagtttactgt

SEQ ID NO: 17330 - protein, 245 aa, Panicum virgatum
  misc_feature: Ceres CLONE 1791954
  misc_feature (60)..(140): Pfam Name: CS Pfam Description: CS domain
IPLPFTTKASPHQRSRVSGPRRLRLPASPFRQPRSAFAASPPASRLRPRASVSASAAPSKDYEFTDGNGEVELRLDVQKLGIESSKDVFVDVDDTSLLIRAKSDGTLRTLMNVQTLFDRIKSSETIWFIDEDQLVVILKKVEQELKWPDIDESWESLTAGITQLLTGISVHIVGDSTDINEAVAKEIAEGIGCVLLICILPYDSTAVQLDCMLCKLHSDLGYPFYSISKSHQNPLYELLNFMIYS

SEQ ID NO: 17331 - DNA, 734 bp, Panicum virgatum
  misc_feature: Ceres CLONE 1791955
  misc_feature: Encodes the peptide sequence at SEQ ID NO. 17332
actcgatctgcctgcatctacttcccctcctccaccaaaccctagccgacgcgcagagctcagggggcgcatctaggcggactaggtcagagcatcggcagcagcgctcccatggcggcgcccaagcccatctgggtgcgccaggccgaggaggccaagctcaagtccgaggccgagaccgccgccgccgccaaggccgccttcgaagcgaccttcaaggcgctcgccgccgggtccggcgacgacgaccaggaccccgaccccgccccgccttccccggacgagccagcctcccccggctccgacgacgacgcccccgccccgcccggcccggtcgacccgtccaagtgctccgccgcggggcccggcatcgctggcggcaacgccggcacgcccgccaccttcaccgtcatcgccaaggaccgccacagccggaggctcaccgccggcggcgcgcgcgtgcgcgtgcgcgtctcccctgccgcgggggtcggcggggacgacctcgacggcgccgtcaaggacaacggggacggatcctacacggtgacctacgccgtccccaagcgcggcaactacatggtccatgtcgagctcgacggctcccccgtcatggggaaccccttccccgtcttcttcagcggctccaccgccacaaccacgtctgctttcccctccgcacttccgtccgtcagctcagcctacccaaacatggtcaaacagaccatggccaa

SEQ ID NO: 17332 - protein, 207 aa, Panicum virgatum
  misc_feature: Ceres CLONE 1791955
  misc_feature (74)..(173): Pfam Name: Filamin Pfam Description: Filamin/ABP280 repeat
MAAPKPIWVRQAEEAKLKSEAETAAAAKAAFEATFKALAAGSGDDDQDPDPAPPSPDEPASPGSDDDAPAPPGPVDPSKCSAAGPGIAGGNAGTPATFTVIAKDRHSRRLTAGGARVRVRVSPAAGVGGDDLDGAVKDNGDGSYTVTYAVPKRGNYMVHVELDGSPVMGNPFPVFFSGSTATTTSAFPSALPSVSSAYPNMVKQTMA

SEQ ID NO: 17333 - DNA, 2006 bp, Panicum virgatum
  misc_feature: Ceres CLONE 1791968
  misc_feature: Encodes the peptide sequence at SEQ ID NO. 17334
aaaacagctagcaaagggattcagctgctgagcatctcacgtcaaagcttttttttttccttctttttcctgccagccttcatatcgtcgtccatccttttgctcgcgaaaggaaaaatcccccctcatcaagtcctcaactcagtctccccgtaaggccgtaactgccacctcgacggcggctcgacgtcgccgccgccgctgtcgaccttgtccaaacgaacccagaaagaaaggcggagcaatgggcaactgcttcaccaagacgtacgagcacgagatacccatcaccgaggagccgccgccgccgcggcggccgtggtcgcagccgcagtaccggccgccccacgagcacaagacgcgggacgtgccgctatcctcgggaacgggctcgcgccgcgcgcagacgctgccgcggccgcggcggccggccttcccgtcatcgggcgcggggtcgatgatgggccggcgggcgtcgtccggcggcggcgaggtgggcccagtgctgcagcggccgatggtggacgtgcggacgctgttccacctggagcggaagctagggagcgggcagttcgggacgacgtacctgtgcacggagcgcgcgacggggctcaagtacgcgtgtaagtccgtgtccaagcgcaagctggtgcgccgcgccgacgtggaggacatgcgccgggagatcaccatcctgcagcacctcagcgggcagcccaacatagcggagttcaagggcgccttcgaggacgccgacgccgtgcacctcgtcatggagctctgcaccggcggcgagctcttcgaccgcatcacagccaagggcagctactcggagcgccaggccgccgccgtctgccgcgacgtcctcaccgtcgtccacgtctgctacttcatgggggtcatgcaccgcgacctcaagcccgagaacttcctgctcgccagccccgccgatgacgcgccgctcaaggccatcgacttcggcctctccgtcttcatcgaagaaggtaacgtttacaaggacattgtggggagtgcatactacgtggcgccagaggtactgcgccggaattacggcaaagaaattgatgtgtggagcgccggagtgatcttatacattcttctgtgtgggtcaccgcctttctgggcagaaacagagaagggcatatttgatgctatactgttcggccagcttgatttaagctccctcccgtagccctccatatctgaaagtgcaaaggatctcattaggaaaatgttggacagagatcctcagaagcgaattactgcagcacaggccctacaacatccgtggctcaaagatgcacctgacagacctattgatagcgcggtcctgtcaagaatgaagcaattcaaggcaatgaacaagctaaagcaactagcactcaaggtgatcgcggagaacctatcgccagaggagataaagggattgaagcagatgttcaataacatggatacagacaagagtggcacgatcacagtcgaagaactgaaggaaggactgagaaagctaggatcgaagattagtgaagcagaggttcagaagcttatggaagcagttgacgtggacaagagtggcagcattgattacacggagttccttactgccatgatgaataaacataaactggaaaaggaggaggatttaatccgtgcatttcaatactttgacaaagataacagcgggtacataacaagagacgaactggaacaagccatggcagagcatggaatgggtgatgaagcaagcatcaagcaagtactagacgaagttgatagagacaaggatgggaatatcgactatgaagagtttgtggaaatgatgaggaagggaagttatacctgagacaactctctggtctaatgatggaagaggttgtatatatatgtttgtttcaacaaatactgcaagtacaagcaacaatgcaagtttaatcagaacaagttgcttatgcatttatggtccagcactactatttaaatttgtt

SEQ ID NO: 17334 - protein, 322 aa, Panicum virgatum
  misc_feature: Ceres CLONE 1791968
  misc_feature (99)..(321): Pfam Name: Pkinase Pfam Description: Protein kinase domain
  misc_feature: SWISSPROT Homolog: EC 2.7.11.1 Non-specific serine/threonine protein kinase
  misc_feature: The sequence is a functional homolog of SEQ ID NO 2 in US patent 7084323
MGNCFTKTYEHEIPITEEPPPPRRPWSQPQYRPPHEHKTRDVPLSSGTGSRRAQTLPRPRRPAFPSSGAGSMMGRRASSGGGEVGPVLQRPMVDVRTLFHLERKLGSGQFGTTYLCTERATGLKYACKSVSKRKLVRRADVEDMRREITILQHLSGQPNIAEFKGAFEDADAVHLVMELCTGGELFDRITAKGSYSERQAAAVCRDVLTVVHVCYFMGVMHRDLKPENFLLASPADDAPLKAIDFGLSVFIEEGNVYKDIVGSAYYVAPEVLRRNYGKEIDVWSAGVILYILLCGSPPFWAETEKGIFDAILFGQLDLSSLP

SEQ ID NO: 17335 - DNA, 1514 bp, Panicum virgatum
  misc_feature: Ceres CLONE 1791972
  misc_feature: Encodes the peptide sequence at SEQ ID NO. 17336
acttcctgcatcgctggaaaaaaaaaaaagctcctcctctggcctctctctctctccctctctcccaaccttcttgcggcggaagcaaagcgagggcggctcagcggcggcgagatggacggagccggagaggacgggaagcagcagccgcacctggtgctggcgcacaagctattcttgctgtcgcaccccgatgtggacgacctcgccaaggtcgacctccgcgccgacgttctcgcggctgtcaaatccgacgatatggcggcgctgtacgagtcgctggcggccgacggcgtgctggagatggacgcggcgctgctggccgagatgcgcgccaggatcgacgaggagatccggaagctcgacgagaaaattgctgatgctgaggagaacttgggtgagagtgaagtgcgggaggcccatcttgccaaatccttgtatttcataagggttggggagaaggaaaaagctctggagcagcttaaagttactgaaggaaaaaccgtagctgttggccaaaagatggaccttgttttctatacgttgcaaattggatttttctacatggactttgatctcatctcaaagtccattgacaaggccgaaaacctgtttgaggagggtggcgatagggagaggaagaatagattgaaagtgtatgaaggattgtactacatggcaactagaaacttcaagaaagctgctagcttatttttggattcgatttcaacattcacaacttatgagctgttcacctacgatacattcatcttctacacagtcctcacaagtgttatctcactggatcgtgtttctctaaagcagaaggttgtagatgcacctgagatcctcgctgtaattggcaaagtacctcacctatccgagtttctcaattcgctctacaattgccagtacaagtcattttttattgcattctctggcttgacggaacagatcaagttggaccgttaccttcagcctcatttccgctactacatgcgtgaagtgcgcactgtcgtctactcacaatttctggaatcgtacaagagtgtgacaatggaagcaatggctgctgcttttggcgttaccgttgatttcattgaccaagaattgtcgcgctttattgctgctgggaagctccactgcaagatagacaaagttgctggcgtcttggagacaaaccgacctgatgccaggaatgccttctaccaggcaaccatcaagcaaggcgacttcctgctgaaccgcatccagaagctatcacgagttattgacctgtaggcaagcccgtttgagccctttgacagaacttattgctcgagctcccgtgcaatgacttgcattgtattatttactttggctcctgaggatacgagcagcatttgacttacagcggtaacagttggtcaagagctttagggatatttgtgttctgagaaattgtgttttgcacttttgtagcctaactacatggaaccaagaaaaatataggcattgcttgtagacgtttcttc

SEQ ID NO: 17336 - protein, 388 aa, Panicum virgatum
  misc_feature: Ceres CLONE 1791972
  misc_feature (253)..(357): Pfam Name: PCI Pfam Description: PCI domain
MDGAGEDGKQQPHLVLAHKLFLLSHPDVDDLAKVDLRADVLAAVKSDDMAALYESLAADGVLEMDAALLAEMRARIDEEIRKLDEKIADAEENLGESEVREAHLAKSLYFIRVGEKEKALEQLKVTEGKTVAVGQKMDLVFYTLQIGFFYMDFDLISKSIDKAENLFEEGGDRERKNRLKVYEGLYYMATRNFKKAASLFLDSISTFTTYELFTYDTFIFYTVLTSVISLDRVSLKQKVVDAPEILAVIGKVPHLSEFLNSLYNCQYKSFFIAFSGLTEQIKLDRYLQPHFRYYMREVRTVVYSQFLESYKSVTMEAMAAAFGVTVDFIDQELSRFIAAGKLHCKIDKVAGVLETNRPDARNAFYQATIKQGDFLLNRIQKLSRVIDL

SEQ ID NO: 17337 - DNA, 732 bp, Panicum virgatum
  misc_feature: Ceres CLONE 1791973
  misc_feature: Encodes the peptide sequence at SEQ ID NO. 17338
atatacctcctcggattctctgcgtgctgccgcaggagaggggagagagcttcccgtttcacatcatctaccacctcgaaggaatgttgcagcagtcagtctccactctccactcccccagttcgtgctcacttctattgtcgggggcggcggcccgccgcggttcgtactgctccgcggcggcttcttggtcctatctccgtttgtagcgtgttcctccgtgcgcgtgtcaggaaaggaatgaagaaagggctcttcattgaggacaaaatcagctttgcttgagagcttccggagtataccttcttcacagctaatcagatccttgggtgcaacaatatgttgcccaagcgaccacatggcgtggttatgctgttaatgctcatggttttcgatgtttcaggcgcatttgttggtatcactattggcaacgaaatgtcaaacctaccatcagcaacagacatagtggctatccttaaagaaaagaagattcagcatgttcgtctgattgattcaaaccatcagatgttgactgcccttgcaaatactggaatagaagtcatggttggggttcccaatgatcagctgctatgtgtggggcagtctcgttccacagctgctgattggattaacaagaacgtcgctgcttatgttcaagcaactaacatcacatatatcgcagtgggtgatgaggttcttactaacattccaaatgcagccccttgttcttgt

SEQ ID NO: 17338 - protein, 130 aa, Panicum virgatum
  misc_feature: Ceres CLONE 1791973
  misc_feature: SWISSPROT Homolog: EC 3.2.1.39 Glucan endo-1,3-beta-D-glucosidase
  misc_feature: Useful for making plants with altered carbohydrate content
  misc_feature: Useful for making plants with altered cell wall content and/or composition
MLPKRPHGVVMLLMLMVFDVSGAFVGITIGNEMSNLPSATDIVAILKEKKIQHVRLIDSNHQMLTALANTGIEVMVGVPNDQLLCVGQSRSTAADWINKNVAAYVQATNITYIAVGDEVLTNIPNAAPCS

SEQ ID NO: 17339 - DNA, 1853 bp, Panicum virgatum
  misc_feature: Ceres CLONE 1791983
  misc_feature: Encodes the peptide sequence at SEQ ID NO. 17340
ttccttccgttttccctctcatattcaaaactcggctcctcctctaaccgccgtcacctcgcctcactcgtgtagtcgtgtgccttattctcactaccagcgtccgcccgccacccaggtccggcgatgggcaaggcggcgcggtggttccgcagcttcctgggcaagaaggagcaggccaaagaccagcagaggcgccagcgggaggaccaccagtcgctgcccccgccagccagcgccaagcgctggagcttcggcaagtcctcccgggacacggcggaggccgccgccgccgccgccgctgcccaggccgcgcccgtctcggtcggcaacgcggcgatcgcgcgcgcggccgaggccgcgtggctccggtccgcggcctacgccgagaaggaccgggagcgggagcagagcaagcacgccatcgccgtggccgcggccaccgcggcggcggcggacgcggccgtcgcggcggcccaggcggccgtcgccgttgtacggctcaccagcaagggacgcgctgcggccgcgctcgtcctcgccaccgccggcgggcgcgccgccgccgccgtcaggatccagacggcgttccggggattcctggcgaagaaggcgttgcgcgcgctcaaggcgctggtgaagctgcaggcgctggtgcgcggctacctcgtgcgccggcaggcggccgccacgttccagagcatgcaggccctcgtccgcgcgcaggccgccgtgcgcgcgcgccgcgccggcgtccccgtcctcccgcagctccaccacccgcccgtccggccgcgctactcgctgcaagagcggtacgcggacgacacgcggagcgagcacggcgcggcggcgtacggcagccggcggctgtcggcgagcatcgagtcctcgtcgtacggatacgacaggagccccaagatcgtggaggtggacccgggccggcccaagtcgcggtcgtcctcgcgccgggcgagctccccgctgctcgacaccggcagcagcggcggcgaggagtggtgcgccaactccgcgtgctcgccgctgccgtgctacctgtccgccgggccgccgcgcatcgccgtgccgacgtcgcgccagttcccggaccacgagtggtgcgcgctggagaaggcccggccggcgacggcgcagagcacgccgcggtacctgcacgtgcacgcgcacgcgccggcgaccccgaccaagtccgtggcgggttactccccgtcgctccacggctgcccgaactacatgtcgagcacgcaggcatcggaggccaaggtgcggtcgcagagcgcgccgaagcagcggccggagctcgcctccgcctgcggcggcggcgcgcggaagcgggtgccgctgagcgatgtggtggtggtggagtcgtcccgcgcgagcctgagcggcgtcgtgggaatgcagcgcgggtgcggcgccagagcgcagggggggttcagcttcaagacggccgtcgtcggccgcatcgaccgcacgctggaggtggccggcgtcgagaacgacaggctggcgttcctgcagaggaggtggtgatgaggccagcagagcaggctcggtgcattggggtgccagcgagacgacgagagctttgggggggagtaattagcaataagaatgcgttttcgtgtgttcttgcaagctctcgtccttttcgttcttcttgttcttgagtgtttgcaatgtgatcaatcatgcaacttttgtgtttcttctctctgttttttttatgtttatttctggtaaacaagtgtatgaggaaaatttgattcatactgcacttgggatgtaaattcttgctcctatcatcaatgctcttcttcgatcgtgtcctc

SEQ ID NO: 17340 - protein, 475 aa, Panicum virgatum
  misc_feature: Ceres CLONE 1791983
  misc_feature (145)..(165): Pfam Name: IQ Pfam Description: IQ calmodulin-binding motif
MGKAARWFRSFLGKKEQAKDQQRRQREDHQSLPPPASAKRWSFGKSSRDTAEAAAAAAAAQAAPVSVGNAAIARAAEAAWLRSAAYAEKDREREQSKHAIAVAAATAAAADAAVAAAQAAVAVVRLTSKGRAAAALVLATAGGRAAAAVRIQTAFRGFLAKKALRALKALVKLQALVRGYLVRRQAAATFQSMQALVRAQAAVRARRAGVPVLPQLHHPPVRPRYSLQERYADDTRSEHGAAAYGSRRLSASIESSSYGYDRSPKIVEVDPGRPKSRSSSRRASSPLLDTGSSGGEEWCANSACSPLPCYLSAGPPRIAVPTSRQFPDHEWCALEKARPATAQSTPRYLHVHAHAPATPTKSVAGYSPSLHGCPNYMSSTQASEAKVRSQSAPKQRPELASACGGGARKRVPLSDVVVVESSRASLSGVVGMQRGCGARAQGGFSFKTAVVGRIDRTLEVAGVENDRLAFLQRRW

SEQ ID NO: 17341 - DNA, 712 bp, Panicum virgatum
  misc_feature: Ceres CLONE 1791989
  misc_feature: Encodes the peptide sequence at SEQ ID NO. 17342
atccgccaccgccctcccccacctctccccgctccgctccgctccgctcccgcgtctcctccacctcctcgtcgtcctcttcgcgcccgcccgggggatcgagcccgccgtcgacccgtctcaggcatacaagcaaggagaagtcaacagggaggtcattatgcgccggtggttttgctgcacgcagtttcatgcatcataccgtgaacatgaaaatgaactccccatcagtccagatgagaaagaaggaaatggttttgctgccaatagcaatcctatcaaagcaccacctcctattgaagtccctgaattatcatttgaagaactgaaagaaaagaccgacaattttggatcaaaggctttgattggcgagggatcatatggaagagtgtattacgctattctggacagcgaaaaacatgttgctgttaaaaagcttgatgcttcaacagaccctgaacttgacaatgagtttctgacacaggtatccattgcctcaaagctaaaacatgataattttgtggaaatgcttggatattgtgtggaaggaaatcagcgtttagtggcctatgaatttgctacaatgggttctctacatgatattttgcatggaagaaagggcgtaccaggtgcacagcctggcccagcacttgactggatgcagcgggttaagattgctatagatgctgctaaagggctagagtatcttcat

SEQ ID NO: 17342 - protein, 183 aa, Panicum virgatum
  misc_feature: Ceres CLONE 1791989
  misc_feature (51)..(183): Pfam Name: Pkinase_Tyr Pfam Description: Protein tyrosine kinase
  misc_feature: SWISSPROT Homolog: EC 2.7.11.1 Non-specific serine/threonine protein kinase
MRRWFCCTQFHASYREHENELPISPDEKEGNGFAANSNPIKAPPPIEVPELSFEELKEKTDNFGSKALIGEGSYGRVYYAILDSEKHVAVKKLDASTDPELDNEFLTQVSIASKLKHDNFVEMLGYCVEGNQRLVAYEFATMGSLHDILHGRKGVPGAQPGPALDWMQRVKIAIDAAKGLEYL

SEQ ID NO: 17343 - DNA, 639 bp, Panicum virgatum
  misc_feature: Ceres CLONE 1791989-R
  misc_feature: Encodes the peptide sequence at SEQ ID NO. 17344
catacaatgcctagaggtcagcagagtctggttacatgggcaacacctcgattgactgaggatacagtgaaacaatgtgtagatccaagattgaagggagagtatcctccaaagggtgttgccaagcttgcagcggtggcggcactctgtgtgcaatacgaatctgaatttagacccagcatgagcatcgtagtcaaggcactctctccccttctccaacataagccgcaaccaccaccagctgcagctcttgatgcaaaagcaccttcacgtgcctgactttctcagtccgacaagaatgtaaagagataaccacttcctcttcggtgcgttcgccggtcttgccgtactgccatgtgcatatgaagtagtagttccacacagataacggcattgtgaactaatgcatgtcttcacctttatataggctgctacaaacttgaggcttttccttgtcattaccgtgtgctaagctgagtggcgtgttgcctttttcgttggccgggcgaggtgtgctttggttggccagcggtcgtgatcacctaattaccgtgttctgggtctattctgtaaaatgggaaggttctaacttctcgtgcttgattcctttttgtttgttttgtctgattttgagctgat

SEQ ID NO: 17344 - protein, 92 aa, Panicum virgatum
  misc_feature: Ceres CLONE 1791989-R
  misc_feature: SWISSPROT Homolog: EC 2.7.11.1 Non-specific serine/threonine protein kinase
HTMPRGQQSLVTWATPRLTEDTVKQCVDPRLKGEYPPKGVAKLAAVAALCVQYESEFRPSMSIVVKALSPLLQHKPQPPPAAALDAKAPSRA

SEQ ID NO: 17345 - DNA, 2291 bp, Panicum virgatum
  misc_feature: Ceres CLONE 1792002
  misc_feature: Encodes the peptide sequence at SEQ ID NO. 17346
acagtgccgggcgggcgccagtgtacgccactggcctccccagtcaccgcccacccgcccaatccgatccggtcgcgtcgcgtcggcagctagctggagcgcacggcgcgagcaacggatttaacggccgccgccgatgtccgcgatggcgcgcaggctgagctccagctgcggccgggccgtcgcctccactccctcctcttcctccttctcgccacctccgccgcggcgcatatataccctccctccccgcccgctgctcctcgcatcctcctcctcgccgcgcccgcgcgctccgcctccgcgctcggtccctccgccttccctcccgcctcggtgctcgttcgggactctcgcggcgaccaaggggccgtcgtcgtcgtcgccggcggcagcgccgttcagcaacgtggtcccgccgccccagcagcagcagcagcagccgcggagtaggaggcaggaggaggagatgacgatttcctcgtccgtcaagctcgccggcaggaccctgtcggtccgcggccggacggtgctgtccggcgtgccggacgcggtggtggcgtcgtcggccgcggcggggggagcggttgacgggatcttcctcggcgccgacttcacggagccggccgcccggcacgtcgtctccctcggcgcactaaggggcgtgcgattcatggcgtgcttccggttcaagctctggtggatggcgcagcggatggggaagaagggcggcgacgtcccgctcgagacgcagttcctgctcgtcgagtccagggccgccggcgaggacgcggaggcggcgtacgtcgtgttcttcccgctcgtggagggcgcgttccgggccagcctgcagggcggcgcgggcgacgctctggagctctgcgtcgagagcggggacgccgacacgcgcgcggcgtccttcgaccgcgcgctcttcgtcggcgccgcggagtccgacccgttcgcggccatcgccggagccgtcgccgccgccaagtccgcgctcaagacgttccgggtcagcgccgagaagaagctcccgggcatcgtggactacttcgggtggtgcacctgggacgccttctaccaggacgtcacccaggagggcgtcgaggccgggctccgcagcctcattgccggcggcgcgccgcccaagttcgtcatcatcgacgacggctggcagtccgtcggcaccgaccagtccgcagccgacgagcctgctggcggggacgagccgacccgcctgtctcggctcaccggcatcaaggagaacagcaagttccagaacgccgacgacccggccgccggcatcaagacggtggtgcgcgcggcgaaggagcagtacgggctcaagtacgtctacgtctggcacgccatcaccggctactggggcggcgtccgccccggcgcggccggaacggagcactaccgctcgagcttgcagttccccaaggtgtcgccgggcgtcgtggagaacgagcccggcatgaagaccgacgtgctcaccctccaggggctcggcctcgtgcacccgcgcgccgtgtaccgcttctacgacgagctccacgcgtacctcgccgccgccggcgtcgacggcgtcaaggtggacgtgcagtgcatcctcgagacgctcggcgccggccacggcggccgcgtgcagctcaccaggcagtaccaccaggcgctcgacgcctccattgccaagaacttcccggagaacggcatcatcgcttgcatgagccacaacaccgatgccctctactgctccaagcagacggcggtggtgagggcgtcggatgatttctacccaagagaccccgtctcgcacacgatccacatcgcctcggtggcatacaacagcgtgttcctcggcgagttcatgctgccggactgggatatgttccactcgctccacccggccggcgactaccacggctcagcccgcgcgatcagtggcggcccggtctatgtcagtgatgccccagggaagcacaacttcgagctgctgaagaagattgtcttgcctgacggctccattcttcgcgcacgactgccaggccggccgaccaaggactgcctgttcaccgacccggcacgcgacggcgtcagcttgctcaagatatggaacatgaacaagttcaccggcgtgcttggcgtgtacaactgccagggcgcggcgtggagctccgtggagaagaagaacgccttccaccagactggcaccgaggccctgacctgcggcgtcaagggcagcgatgtccatcacatctccgaggcctcgacggaccccg

SEQ ID NO: 17346 - protein, 607 aa, Panicum virgatum
  misc_feature: Ceres CLONE 1792002
  misc_feature (7)..(607): Pfam Name: Raffinose_syn Pfam Description: Raffinose synthase or seed imbibition protein Sip1
  misc_feature: SWISSPROT Homolog: EC 2.4.1.67 Galactinol--raffinose galactosyltransferase
  misc_feature: Useful for making plants with altered carbohydrate content
MTISSSVKLAGRTLSVRGRTVLSGVPDAVVASSAAAGGAVDGIFLGADFTEPAARHVVSLGALRGVRFMACFRFKLWWMAQRMGKKGGDVPLETQFLLVESRAAGEDAEAAYVVFFPLVEGAFRASLQGGAGDALELCVESGDADTRAASFDRALFVGAAESDPFAAIAGAVAAAKSALKTFRVSAEKKLPGIVDYFGWCTWDAFYQDVTQEGVEAGLRSLIAGGAPPKFVIIDDGWQSVGTDQSAADEPAGGDEPTRLSRLTGIKENSKFQNADDPAAGIKTVVRAAKEQYGLKYVYVWHAITGYWGGVRPGAAGTEHYRSSLQFPKVSPGVVENEPGMKTDVLTLQGLGLVHPRAVYRFYDELHAYLAAAGVDGVKVDVQCILETLGAGHGGRVQLTRQYHQALDASIAKNFPENGIIACMSHNTDALYCSKQTAVVRASDDFYPRDPVSHTIHIASVAYNSVFLGEFMLPDWDMFHSLHPAGDYHGSARAISGGPVYVSDAPGKHNFELLKKIVLPDGSILRARLPGRPTKDCLFTDPARDGVSLLKIWNMNKFTGVLGVYNCQGAAWSSVEKKNAFHQTGTEALTCGVKGSDVHHISEASTDP

SEQ ID NO: 17347 - DNA, 688 bp, Panicum virgatum
  misc_feature: Ceres CLONE 1792002-R
  misc_feature: Encodes the peptide sequence at SEQ ID NO. 17348
gaggcctcgacggaccccgagtggaacggcgactgtgccgtgtaccgccatgccggtggcgaccttgtcatcctcccgaacggcgcggcattgcccatctctctgaaggtcctggagcacgacgtactcaccgtgtcaccgatcaaggacttggcacctggtttcagattcgcacccatcggtctggtcgacatgttcaacagcggcggcgcggtggacggcctgacctaccacctcctcgacggcgcaaagttgctcgacggcaatggcgccacctctggctccgaggcggtcggattggtgtgcatggaagtgaggggttgcggaaggttcggagcctactcttcagtgaggccacgaaagtgcatgatgggttcatctgagctggagttctcctatgattcttcctccggtctggtgacgctgcagctggaggccatgcccaaggagagggttcacaagattgttgttgagttgtagggtggtactggtagccatcagtgcatcagaaatccatagtattctgccatgagtgatccgtccactgatgaatttagagaccactctgatagcatgttgatggtagggactggagtggggcatgattttatagtgcaaacctggttcttgattcagttggacttgattcagttggaaggaatatacgcgcatatgtctgttgtctggc

SEQ ID NO: 17348 - protein, 159 aa, Panicum virgatum
  misc_feature: Ceres CLONE 1792002-R
  misc_feature: SWISSPROT Homolog: EC 2.4.1.67 Galactinol--raffinose galactosyltransferase
  misc_feature: Useful for making plants with altered carbohydrate content
EASTDPEWNGDCAVYRHAGGDLVILPNGAALPISLKVLEHDVLTVSPIKDLAPGFRFAPIGLVDMFNSGGAVDGLTYHLLDGAKLLDGNGATSGSEAVGLVCMEVRGCGRFGAYSSVRPRKCMMGSSELEFSYDSSSGLVTLQLEAMPKERVHKIVVEL

SEQ ID NO: 17349 - DNA, 321 bp, Panicum virgatum
  misc_feature: Ceres CLONE 1792008
  misc_feature: Encodes the peptide sequence at SEQ ID NO. 17350
gtctcattccttaccacctcctctccctcttccccttcctcctccttcccaggctctgttcctggcgccgccgggcatggcctgtctcgcctaccttgacaacttcaacatctccgattccgctaataatatcatccttcattatgtatggatcggtggatctggcctggatctcaggagaaaggggaagacccactccggcccggggatcgatcccaccaagctgcccaagtggaactacgacggttcccgtaccggccaagctcccggtgaggacatcgatgtcatcctgtaccctcaggatatcttcaaggaaccatt

SEQ ID NO: 17350 - protein, 81 aa, Panicum virgatum
  misc_feature: Ceres CLONE 1792008
  misc_feature (17)..(81): Pfam Name: Gln-synt_N Pfam Description: Glutamine synthetase, beta-Grasp domain
  misc_feature: SWISSPROT Homolog: EC 6.3.1.2 Glutamate--ammonia ligase
  misc_feature: Useful for making plants with modulated water use efficiency
MACLAYLDNFNISDSANNIILHYVWIGGSGLDLRRKGKTHSGPGIDPTKLPKWNYDGSRTGQAPGEDIDVILYPQDIFKEP

SEQ ID NO: 17351 - DNA, 2478 bp, Panicum virgatum
  misc_feature: Ceres CLONE 1792009
  misc_feature: Encodes the peptide sequence at SEQ ID NO. 17352
agatctggcccctcccacacgcccagtctcctaaaccctactcatctctctctcggcgacggcaattgccatcgccatggccgggaggcgccctgccccggcggctctcctcgtcctcctcctcgccgcggccttcgctcccatctcatccgccgtccgcccagtatccgacgcgcacagatccgcggccgccgagctcttcgccccctccgccgacggatccttcggcgatttggagaggacgtatgaggcggtgaggacgttccagatactcggattggaaaagtacaagagtgtgaccggggaggcgtgcaagtttgccgcggagaagttggcctcccccgcttcatccgctacgaaagatctgttccacgccgcccggattagcggcgttctcggatgcagtgttgatgccggcgtgtatgatggtgtcgtcgcgaggctcaaggcagtgattaaggacaccaactccctgctggagttctactattccgtgggaggtctgcttagcatcaaggaacaaggacacaacattgttctatctgatgcagagagcacatttcacgccattaaggcacttagccaaagtgatgggagatggcgttatgacactaacagtgctgaatctagcacatttgctgctggtatcgcactaaaagctttggcgggtgttgttgctctagcagatgctgaggttgatccatccatggtaggagtggtaaaaaatgacatcgtgaagctgtttgacactatcaagagttatgatgatgggaccttctacttcgatgagaagcatgttgatgctactgaatacaagggccctataatgacttctgcttcagttgtacggggtgttacctcttttgcaactgttgctcctgggaaattgaatatccctagtgagaaagtacttggcttgggaaaattctttcttggtatagggcttcctggtagcacaaaggactgttttaatcagattgagtctttgtcattcctggagaacaatagggtcttcactcctttgatactgtcacttccttccaaagtattttcattgacttcaaaagatcagcttaaggttgaagtcacaacagttttcggatctgctgcacctccgctcaaagttaatcttgtacaggtgctgggttctgattctaaggtcatcaccagtgagaacaaggaacttcaatttgaccttgacaacaatgttcattacttggacattgctccattgaaaatagatgttgggaaatactctctagtttttgagatttcacttaaggaaccagagcatgaaagtgtttatgctactggagggagaaacactgagaatgtatttatcacaggactgatcaaagttgacaaggcagacattggaatttctgacaatgatgctggaaccgttgagtcagtccaaaagttagatcttctgaaagatgcaaaagtatctctttctgcaaaccatctgcagaagttgcgcttgtctttccagctaactacaccgcttgggcacacatttaaacctcaccaggtgttcttgaagttgaagcatgaaagcaatgttgaacacttatttgtggtgccaggttctgcaaggcagttcaaaattgttctagacttcctaggtttggtggagaaattttactacctttctggaagatatgaccttgagcttgcagttggtgatgctgcaatggaaaattcatttctgcgacctctaggccacttggagttggacctgccagaagccccagaaaaagccccgcgccctcctgcacaagctgttgacccattctcaaaatttgggccaaaggcagagatttcccacatattccgttcaccagagaagaggccccccaaggaactctcacttgcattcacgggtctcacacttctgccttttatcggattcttgattgggctcgtgcgtcttggagtgaacttgaagaacttcccatctttgccaggaccggctgcatttgcatcgcttttccatgcaggaataggagcagtcctgctgctctatgttctcttctggctcaagttggatcttttcacaactttgaagtaccttggcttcctcggcatcttccttgtgtttgtgggccattggaccctgtcctacctttcctcagtgtcgacaaaacagaagactgcatagtgaacaatgcaatcagatgtttccccatcatcaatttttgaggtggcaattggagtccttgggttctcaatgtatttgcttggtactctgaccgctcccaagattttcttgagcaacttgagttttgagggaagacttggtttatttcagttggattttcaaaatcctgatactagtagatgagtagtaggaccttaccttatgtattgttggtgtatatgttagcccatgtatagaggctcatctagaagcccatgtataggatttatatatcccacccttttaggatttggaggaatataagtaattatcctctc

SEQ ID NO: 17352 - protein, 694 aa, Panicum virgatum
  misc_feature: Ceres CLONE 1792009
  misc_feature (6)..(688): Pfam Name: Ribophorin_II Pfam Description: Ribophorin II (RPN2)
  misc_feature: SWISSPROT Homolog: EC 2.4.1.119 Dolichyl-diphosphooligosaccharide--protein glycotransferase
MAGRRPAPAALLVLLLAAAFAPISSAVRPVSDAHRSAAAELFAPSADGSFGDLERTYEAVRTFQILGLEKYKSVTGEACKFAAEKLASPASSATKDLFHAARISGVLGCSVDAGVYDGVVARLKAVIKDTNSLLEFYYSVGGLLSIKEQGHNIVLSDAESTFHAIKALSQSDGRWRYDTNSAESSTFAAGIALKALAGVVALADAEVDPSMVGVVKNDIVKLFDTIKSYDDGTFYFDEKHVDATEYKGPIMTSASVVRGVTSFATVAPGKLNIPSEKVLGLGKFFLGIGLPGSTKDCFNQIESLSFLENNRVFTPLILSLPSKVFSLTSKDQLKVEVTTVFGSAAPPLKVNLVQVLGSDSKVITSENKELQFDLDNNVHYLDIAPLKIDVGKYSLVFEISLKEPEHESVYATGGRNTENVFITGLIKVDKADIGISDNDAGTVESVQKLDLLKDAKVSLSANHLQKLRLSFQLTTPLGHTFKPHQVFLKLKHESNVEHLFVVPGSARQFKIVLDFLGLVEKFYYLSGRYDLELAVGDAAMENSFLRPLGHLELDLPEAPEKAPRPPAQAVDPFSKFGPKAEISHIFRSPEKRPPKELSLAFTGLTLLPFIGFLIGLVRLGVNLKNFPSLPGPAAFASLFHAGIGAVLLLYVLFWLKLDLFTTLKYLGFLGIFLVFVGHWTLSYLSSVSTKQKTA

SEQ ID NO: 17353 - DNA, 741 bp, Panicum virgatum
  misc_feature: Ceres CLONE 1792014
  misc_feature: Encodes the peptide sequence at SEQ ID NO. 17354
ggcgggctcgcaggagtagacagggggctgcacgattccgtcgcctcattggccgctcctgccaggccgcgtgctcctcttgccgcgtctcttcctccaccgggttgcgcgttcctcagggtggagcatcatcctgcacatatcttggataaactcttgacacgctcaggagacgtttgaaaccgtccttcagcgtcatataacaagcagatcaacgagagcttgatcctactcctacatcagtacgcgatgggtttcttgtcattgcttctggtggcttctatgccaatcatccaggtcctgctcattggtgtcgttggagcttacctgtcctccggcttcagcaatgtcctgaccacaagtgctcgaagggacatgaacaaggttgtttttaccgtattcaccccatctctgatgttcgctagccttgcaaagacggtcacgctcgaggatgtcatttcgtggtggtttatgccagttaatatagcaatcacgttcatggtcggtggcgttctgggttggatagcatgcaacgttctgaagccaccacagcacttcaggggcctgatcatggccttctgctcagcaggaaatctcggaaacctgctcttgatcattgtcccggccgtttgcgatgaagatgggaacccattcgggaaggatcggagcatttgccgctcacgcgggctctcctactcgtcattgtccatggctctgggtggccttttcatatggacatac

SEQ ID NO: 17354 - protein, 163 aa, Panicum virgatum
  misc_feature: Ceres CLONE 1792014
  misc_feature (9)..(163): Pfam Name: Mem_trans Pfam Description: Membrane transport protein
MGFLSLLLVASMPIIQVLLIGVVGAYLSSGFSNVLTTSARRDMNKVVFTVFTPSLMFASLAKTVTLEDVISWWFMPVNIAITFMVGGVLGWIACNVLKPPQHFRGLIMAFCSAGNLGNLLLIIVPAVCDEDGNPFGKDRSICRSRGLSYSSLSMALGGLFIWT

SEQ ID NO: 17355 - DNA, 677 bp, Panicum virgatum
  misc_feature: Ceres CLONE 1792014-R
tccaactgatgggcaatggcacgattccttgcatcaccctcatcctaggtggaaacctgacgcaagggcttcggaagtcggggctcaagcgcacggtgatcatcgcgatcgtctgcatacgcttcgtgatcctgccgctgatcgggatcgccgtggtccatgccgcgtacggagtcgggttcctgtcccacgacccgctctaccgctacgtgctcatggtgcagttcgccctgcctcctgcgatgaacattggaaccatggctcagctgtttgatgttgcacaagaggaatgctccgtgatctttctctggacgtacctcgtagcggcgattgcgctgacgacgtggtcgacgatcttcatgtccattctgtcttgagccaccgcaggtgcaggaggcatggtcgtatttgcgagcctgtgctgcgcaaagattcagcttagcacagcagtatagctatagatagtacgtggtatgcagtagattatgatccaatgatcatttaggtaattatttgttgtttgtatttgtgttgatctgatgcctgacctgatggtcggcatagttcaaacaattcatgggagttcggttgcagttttgaccatgtacacaggtagaaacaaggaattgtctgaaaagaaaagaaatgaagaaatgtagtataaagatacttgtctc

SEQ ID NO: 17356 - DNA, 2040 bp, Panicum virgatum
  misc_feature: Ceres CLONE 1792025
  misc_feature: Encodes the peptide sequence at SEQ ID NO. 17357
gcaaggaatccaaaacaagatggcatccctgagttcttcctggactctccagctcctgcatctcttcctgctcctaccagtcagcaacaccatcaaattcagcatcagcaacagatgctccgacaccatatggccagccgctgtgccgggcggtggcgtgaaactcgaccctggagagtcctggaccctcaacatgccggccggcactggacccgggcgtgtgtggccgcgcacgggctgctcatttgacagcaccggtaaggggtcatgccagacaggagactgcggcggcgtgctggcctgcacaaacagcggtcagccacccgtcacgcttgctgagttcaccatcggaggagggacggatttctttgacatctccctcgtcgatggcttcaacgtgcccatggacttcatgccgatgccagcaaacggacagggagggcaagcatgcagcagggggcctcgctgtgcagcaaatatcacatcgcagtgcccagagaatctgaaggtgcctgggggctgcaacagcgcgtgtagagtgttcaatcaagacaagtactgctgcaccgggaatgtcagcagcacctgcgagcccaccacctactcagtgttcttcgtgcgtgggtgccccgatgcctacagttactccagggatgatagctcgagcactatcttcagttgcccatcgggcaccaactatcaggtcattttctgtccccctgttgacatttcagcttcgcctccaactacaaatcctcctgcacctgatgttactggatcaacacgcacgaaccactcatcttttacaaaaagcagagttttgggtgcggttctaggttccataggcagtttgatagtacttttcggatttgtcactttttttgcatataaactaagaaggcagcgacaccaggagatgcatgaaggggatgaagagttcggagagctaccaggaatgccaacgaggttcacatttcagcagctacaagaagcaactgaccaattcagacacaagcttggggaaggaggatttgggtctgtttttgaggggcaatacggtgaagaaagaattgcggttaaacgtttggatcgagctggtcagggtaagagagaatttttagcagaggttcagacaattggcagcatccatcacattcatctagtgaggctgattggtttctgtgcagagaaatcacataggcttttggtgtatgagtatatgcccaaagggtccttggataggtggatctattactcacatgacaatgatgctcccttgctggactggcaaactagatgcaaggttatttctcacattgctaggggtttatgctatctacatgaggagtgcatgaagaagattgctcacttggacatcaaaccacaaaacatcctcttagatgaaaacttcaatgctaaaatttctgatttcggattaagtaagctcattgatcgggataagagccaagtgattacaagaatgagaggcacacctggatatttagctcctgagtggttgacatcccaaatcacagaaaaagccgatgtatatagctttggcgttgtggtcatggaaatcattagtggcagaaagaatcttgacacttcacggtctgaagaaagcatccatcttattaccttactggaagaaaaggtgaagagtgatcagttagcagatttgattgacaagtacaatagtgacatgcaagcacacaagcaagaagtattagaaatgatgaggcttgcaatgtggtgtttacaaattgatgctaaaagaaggcctcaaatgtctgaggtgatcaaagtcttggaaggtcacatgaaggcagaaagcaaaattgatcataactttgtcgcaacaagtcaaacaatgtttggtattgttgaaaatacaggttcctcagatccacctcaagcctcacatttatcagcccccaggtgaaatggggtaactgtgagaagtttgtagcctaggttagacacagatatgtgtatctaggaaaatccattatcagttttatattttttccaagttactat

SEQ ID NO: 17357 - protein, 640 aa, Panicum virgatum
  misc_feature: Ceres CLONE 1792025
  misc_feature (31)..(233): Pfam Name: Thaumatin Pfam Description: Thaumatin family
  misc_feature (327)..(597): Pfam Name: Pkinase Pfam Description: Protein kinase domain
  misc_feature: SWISSPROT Homolog: EC 2.7.11.1 Non-specific serine/threonine protein kinase
MASLSSSWTLQLLHLFLLLPVSNTIKFSISNRCSDTIWPAAVPGGGVKLDPGESWTLNMPAGTGPGRVWPRTGCSFDSTGKGSCQTGDCGGVLACTNSGQPPVTLAEFTIGGGTDFFDISLVDGFNVPMDFMPMPANGQGGQACSRGPRCAANITSQCPENLKVPGGCNSACRVFNQDKYCCTGNVSSTCEPTTYSVFFVRGCPDAYSYSRDDSSSTIFSCPSGTNYQVIFCPPVDISASPPTTNPPAPDVTGSTRTNHSSFTKSRVLGAVLGSIGSLIVLFGFVTFFAYKLRRQRHQEMHEGDEEFGELPGMPTRFTFQQLQEATDQFRHKLGEGGFGSVFEGQYGEERIAVKRLDRAGQGKREFLAEVQTIGSIHHIHLVRLIGFCAEKSHRLLVYEYMPKGSLDRWIYYSHDNDAPLLDWQTRCKVISHIARGLCYLHEECMKKIAHLDIKPQNILLDENFNAKISDFGLSKLIDRDKSQVITRMRGTPGYLAPEWLTSQITEKADVYSFGVVVMEIISGRKNLDTSRSEESIHLITLLEEKVKSDQLADLIDKYNSDMQAHKQEVLEMMRLAMWCLQIDAKRRPQMSEVIKVLEGHMKAESKIDHNFVATSQTMFGIVENTGSSDPPQASHLSAPR

SEQ ID NO: 17358 - DNA, 1690 bp, Panicum virgatum
  misc_feature: Ceres CLONE 1792032
  misc_feature: Encodes the peptide sequence at SEQ ID NO. 17359
ccaaattccccttctcttttctgcttgctttgggctctcgccgccgttagggcagggcagggcagggtaccaagcgatcacttcgtcccggcggcggcggcggcggcggcggcggagggggaggagatgatgcggctaaccgtggagcaggcggcgcgcgaggcgggcttggacgggagcggcgctaaggccctcaacctctcccaccgcgcgctctccgacgtgtcgtgcctgagaagcttcaacaagctggagcgccttgacctcggctacaactgcctcgtcaccctcgagggcttatcatcttgtgccaacctcaagtggctttcagttatcgaaaacaagcttgtgagcttaaaaggcgtcgaaggactatcaaagctgcaagtgctgaatgctggcaagaacaaacttacaaaaatggatgaggtcgcatccttaacaagcctgggagcattgattctgaacgataacaatatttcttccatctgcaagcttgattggctgcaacagttgaatacacttgttctctctaagaatcctgtttttaccatcggcaatgctctggccaaggctaagtctatgaaaaagctatccttgtctcactgccaaatagaacatgttggatcttcccttgctgcgtgcgtggaattgaaggaactcaggctttcccacaacaagatcactacaatcccttcggatttggctaaaaatgtgaagatcctgaaccttgatttagggaataacttgattgagaggagttcagatctgaaggtactttctgaattgcgctacttgaggaaccttaatttgcagggaaatcctatttctgagaaagacagtcttgtcaaaaaggtaaagaaatttgtgccaaccttgagaatcttgaatggaaagcccctagagcccagctccaagagtgataagagcagtggaaaagataatattccaagcaaatatgatccagttgagattgatagaaaaaaggataaaaggcagcagtcgaaacaacatctaaagggccctgaagagcctgaagtcaagactatttccccaggtgtcaccacttctgcacttggcaaatctgaagttctggatggcaaggaaaggaaaagggacaggaaggaagcaaagaagtctgtggaagaacctaccaatgacggcaaatcaaagaggaaggatgatgtagatcatactggtagaaaggataagaaggatgccaagaggaagaaatttgttgacgaagaagatgctgaagtaatcgacaatactgatatctcatttgctgatttagtgttctccaaacaaaacaattcagagcccaaactaaaggacagttcagcccaggaagtagctccagacgggaagtttggagaattggtaattgatcacacaaagaagaaaaataagtcaaaaggggcagtcaccatcaccgattcctcagttcttaagatgatatcctctgttccagaggtgggttcaggcggactcggtctgtcaggatgggatgattagtgccttgtaataagttttatggtgatcagtagcgtttattgtagttcttttttgtagcatcaccttgcaagcagatttatttggcgacatttgtttgccaagtgttgtggtttagaatgaagcaatggtgaaaacctcgattttaacgtgaaatcagcagcatgctttcttttcc

SEQ ID NO: 17359 - protein, 462 aa, Panicum virgatum
  misc_feature: Ceres CLONE 1792032
  misc_feature: SWISSPROT Homolog: EC 2.7.11.1 Non-specific serine/threonine protein kinase
MMRLTVEQAAREAGLDGSGAKALNLSHRALSDVSCLRSFNKLERLDLGYNCLVTLEGLSSCANLKWLSVIENKLVSLKGVEGLSKLQVLNAGKNKLTKMDEVASLTSLGALILNDNNISSICKLDWLQQLNTLVLSKNPVFTIGNALAKAKSMKKLSLSHCQIEHVGSSLAACVELKELRLSHNKITTIPSDLAKNVKILNLDLGNNLIERSSDLKVLSELRYLRNLNLQGNPISEKDSLVKKVKKFVPTLRILNGKPLEPSSKSDKSSGKDNIPSKYDPVEIDRKKDKRQQSKQHLKGPEEPEVKTISPGVTTSALGKSEVLDGKERKRDRKEAKKSVEEPTNDGKSKRKDDVDHTGRKDKKDAKRKKFVDEEDAEVIDNTDISFADLVFSKQNNSEPKLKDSSAQEVAPDGKFGELVIDHTKKKNKSKGAVTITDSSVLKMISSVPEVGSGGLGLSGWDD

SEQ ID NO: 17360 - DNA, 730 bp, Panicum virgatum
  misc_feature: Ceres CLONE 1792039
  misc_feature: Encodes the peptide sequence at SEQ ID NO. 17361
gcagagcatcctcgtccacaagacggacgaggacaaggtgatggtcctcgactcgcacaagctgatgggcgcctcgggggagcccggcgaccgggtgcaattcacggagtacatacagaagaacctccacctgtaccagttccgcaacaccaccccgctctccaccgccgccaccgccaacttcacccgcggcgaactcgccacagccctccggaagaatccatacatggtcaacgttatacttggtggttatgataagaatgttggcgcttccttgtactacatcgactacattgcaaccttgcacaagattgacaagggtgcttttgggtacggctcctacttctgtttgtcgctaatggacaagctgtaccacccggacatgactgttgaggaagcagtagatcttgttgacaagtgcatcaaggagatccgtctgattgatcgcgaacaagcagaggaaatgcaagttaataatgaggcgccactagggggcctcaagccaaatatttctcagtataactctccagagcagagaggtggaattgaaggagttcctgagaataatgaaaaaaggagtgatatggttgttgcggaaaaagcctgggaggcgtctcttgttcccaactcaggccttagcagacccttttaccgacaagaattttatgcttggccatatatttattcagattaccaaatggtgcgtcagccactaccttatggattcgag

SEQ ID NO: 17361 - protein, 242 aa, Panicum virgatum
  misc_feature: Ceres CLONE 1792039
  misc_feature (2)..(157): Pfam Name: Proteasome Pfam Description: Proteasome A-type and B-type
  misc_feature: SWISSPROT Homolog: EC 3.4.25.1 Proteasome endopeptidase complex
QSILVHKTDEDKVMVLDSHKLMGASGEPGDRVQFTEYIQKNLHLYQFRNTTPLSTAATANFTRGELATALRKNPYMVNVILGGYDKNVGASLYYIDYIATLHKIDKGAFGYGSYFCLSLMDKLYHPDMTVEEAVDLVDKCIKEIRLIDREQAEEMQVNNEAPLGGLKPNISQYNSPEQRGGIEGVPENNEKRSDMVVAEKAWEASLVPNSGLSRPFYRQEFYAWPYIYSDYQMVRQPLPYGF

SEQ ID NO: 17362 - DNA, 2400 bp, Panicum virgatum
  misc_feature: Ceres CLONE 1792047
  misc_feature: Encodes the peptide sequence at SEQ ID NO. 17363
gagtagtgtcctaaagcaagatgtggcaaggttctccagccgctctgcttctttcgggccttcagctctcaaggatctccgtccaaacgcgggtcttgccgtcttacggcgcgcgcctcttggtggcatggcgcgacacctccacggcggccacgagctcgtcgcgcacctccgcgcgtcttcgccgctggccgacctcctccgcgctgcggcgagcctccccgccgcccgagccgcgcacgcgggcgtcctcaagtctcccttcgccggcgagacgttcctgctcaacacgctcgtctccgcgtacgcgcgactgggccgcctccgcaacgcccgcagcgtgttcgacgggataccgctcccgaacaccttctcccacaacgctctcctctccgcgtacgcgcgcctgggccgccccgacgaggtccgcgcgctgttcgatgccatcccggaacccgaccagtgctcctacaatgccgctgtcgcggcgttcgcgcggcacgggcgcgggcacgggcacgccggggacgcgctccggttcctcgccgccatgcacgccgacgacttcgtgctcaacgcgtactccttcgccagcgcgctgagcgcctgcgccgcggagaaggacccgcggaccggggagcaggtgcacgggctcgtcgccaagtcgccgcatgcggaggacgtgcgcatcgggagcgcgctcgtggacatgtacgccaagtgcgagcgcccggaggatgctcgcagggtgttcgacacaatgccggagcggaacgttgtttcctggaacagtttgatcacttgctacgagcagaacggtcccgtgggcgaggctctcgttctgtttgtcgagatgatggatgcgggtttcattcctgatgaggtgacgctggcgagcattatgagcgcgtgtgcaggcctctttgcggagagggaaggacagcaggtccatgcccgtgtggtaaagtgcaataggtttatggaggacatggtgctgaacaatgctctggtggacatgtatgcaaagtgtggaaggacaagggaggcaagatgtgtctttgattccatggcttccaggagtgtcgtgtccgaaacttccatgctcacagggtatgcaaagtcttcaaatatggaaggtgctcaggttgtattctcgcagatgattgagaagaatgtcattgcttggaatgtgctaattgcagcgtatgcacagaatggtgaggaggaggaagcacttcggctctttgtcaggctgaaaagagagtcagtttggccaacacattacacatatggaaatgttctcaatgcatgtgggaatattgctgatcttcagcttggtcagcaaactcatgttcatgtcctcaaggaaggtttccgcttcgacttcgggccagagtctgatgtgtttgttgggaactcccttgtagacatgtacctgaagacaggctcaatcgatgatggtgcaaaggttttcgagagtatggcagcgagagataatgtgtcctggaatgcaatgattgttggttatgcacagaatggccgtgcaagagatgcattgcaactttttgagagaatgctgcgcagcaaagagaggccagactctgtcacgatgattggggttctgtcagcctgtggccattctgggttagttgaggagggcaggaggtactttcagtccatgactgaggatcatggaattactccatcacgagatcactacacatgcatgattgacttgcttggtcgtgccggtcatctcaaagaagttgaggagctcataaagaacatgccgatggaacctgactctgtgctctgggcttcactgctaggtgcttgcagacttcataagaacgttgagttgggggaatgggcagctggaaaattgtttgagattgatcctgggaactctggaccctatgttcttctctccaatatgtatgctgagatggggaaatggacagatgtttttagagtgaggagatccatgaaggacaggggtgtcagtaagcagcctggctgtagttggattgagataggcaggaaaatgaatgtctttctcgcacgagataatcgacatccatgcaggaatgaaataaacgataccttaagaatcattcagatggagatgggcagaatgagtatagatgctgagattgctaattgcttatcgaattactgctctgaagcctgtggctgcaattgaaagtcagatgacttctgaagtcggtgttgacaagttgatattatattgttgatggcctgttgagtcgtaacatcattgatcattggttgcttctctggcctcagttagaaagttgaaatgccacttgcacagaaaacaatttgtactgtcaatatttgatagcacttacctgaaagtttacaagataacgtttacgg

SEQ ID NO: 17363 - protein, 691 aa, Panicum virgatum
  misc_feature: Ceres CLONE 1792047
  misc_feature (218)..(252): Pfam Name: PPR Pfam Description: PPR repeat
  misc_feature (351)..(385): Pfam Name: PPR Pfam Description: PPR repeat
  misc_feature (458)..(492): Pfam Name: PPR Pfam Description: PPR repeat
MARHLHGGHELVAHLRASSPLADLLRAAASLPAARAAHAGVLKSPFAGETFLLNTLVSAYARLGRLRNARSVFDGIPLPNTFSHNALLSAYARLGRPDEVRALFDAIPEPDQCSYNAAVAAFARHGRGHGHAGDALRFLAAMHADDFVLNAYSFASALSACAAEKDPRTGEQVHGLVAKSPHAEDVRIGSALVDMYAKCERPEDARRVFDTMPERNVVSWNSLITCYEQNGPVGEALVLFVEMMDAGFIPDEVTLASIMSACAGLFAEREGQQVHARVVKCNRFMEDMVLNNALVDMYAKCGRTREARCVFDSMASRSVVSETSMLTGYAKSSNMEGAQVVFSQMIEKNVIAWNVLIAAYAQNGEEEEALRLFVRLKRESVWPTHYTYGNVLNACGNIADLQLGQQTHVHVLKEGFRFDFGPESDVFVGNSLVDMYLKTGSIDDGAKVFESMAARDNVSWNAMIVGYAQNGRARDALQLFERMLRSKERPDSVTMIGVLSACGHSGLVEEGRRYFQSMTEDHGITPSRDHYTCMIDLLGRAGHLKEVEELIKNMPMEPDSVLWASLLGACRLHKNVELGEWAAGKLFEIDPGNSGPYVLLSNMYAEMGKWTDVFRVRRSMKDRGVSKQPGCSWIEIGRKMNVFLARDNRHPCRNEINDTLRIIQMEMGRMSIDAEIANCLSNYCSEACGCN

SEQ ID NO: 17364 - DNA, 517 bp, Panicum virgatum
  misc_feature: Ceres CLONE 1792055
  misc_feature: Encodes the peptide sequence at SEQ ID NO. 17365
acgcgaagcaggttggtgctctctaccccgggcgcagcgttgatggcaacggcaccggcgccggcgcccgcggacccgaaggcggaggccgccaagatggacctcctggaggacgacgacgagttcgaggagttcgagatcgaccaagaatgggacgacaaggaagaaggcaatgaagctgtccagcagtgggaggatgactgggatgatgatgacgttaatgatgatttctcgaagcagctgaggaaagaactggagggaacccagaagagctgaagtgttttcttctgtagtataaatgttactcttgtatggccgttactttctgaacctctgtgtgcttcagacagttatgggtgtgcttctgggagcaccacctaatttgcggaatatttctacatgaaagtttatggtcgtgctatagtttccataatgtcggtgaatttctatatgaactgtatgataccagaaagtataggaacatgcggcaatttgccctactttctttcttttggag

SEQ ID NO: 17365 - protein, 77 aa, Panicum virgatum
  misc_feature: Ceres CLONE 1792055
  misc_feature (12)..(74): Pfam Name: DSS1_SEM1 Pfam Description: DSS1/SEM1 family
MATAPAPAPADPKAEAAKMDLLEDDDEFEEFEIDQEWDDKEEGNEAVQQWEDDWDDDDVNDDFSKQLRKELEGTQKS

SEQ ID NO: 17366 - DNA, 709 bp, Panicum virgatum
  misc_feature: Ceres CLONE 1792066
  misc_feature: Encodes the peptide sequence at SEQ ID NO. 17367
attcagctgagtgtgctcgatcatcaagcaatcaacaaagcctcccaattatcctttcatcagatcatcttccttcttccaaattgtcttgcagctgcggatcaagctgcaactgcggctccaactgcaagtgcggcaagatgtaccctgaccttgaggagaagagcagcggcggcgctcaggccaccatcgtcctcggcgtggccccggagaagaaggccggccaattcgaggcggcggcggagtccggcgagaccgcccacgcctgcaagtgcggtaacagctgcagctgcgacccctgcaactgctgatttcgatggggaacgtcagaacacacctgcatgcatgctagctactacctactactctgcttgtgtgtgacttgatgattgaacaagaataaggatgagcctgagccatcatgtctcatgtatcggtttggctccggcctcatcaagcatgcatgcgtcgtctgcccctctgtgtgctttgcgtccgtcctgtctgtatgtgttgatcattgcaaagaaaccatgcaggcatacatctctgcatgtgtctctgtaatgatcggtccagagtgatgaatatataggtcacgcacgccaaatccgccggacagcgcgagcgcaggcgaaggcaaacctctccggcgcgcctcctcgcggctcacgaggctccaatgcccccgcctcccctgctcccgcgc

SEQ ID NO: 17367 - protein, 102 aa, Panicum virgatum; identical to SEQ ID NO: 11990
  misc_feature: Ceres CLONE 1792066
  misc_feature (28)..(102): Pfam Name: Metallothio_2 Pfam Description: Metallothionein

SEQ ID NO: 17368 - DNA, 1564 bp, Panicum virgatum
  misc_feature: Ceres CLONE 1792089
  misc_feature: Encodes the peptide sequence at SEQ ID NO. 17369
agttcccatacgggcgctcggccattcttgacagagcattttcctctatctgtcaccaaacatggccagccaccacaaattggtcattgccaaatgcctcctcttcctgatctcttacgtagcgaggatactagctatcactgcttaccagacaatccaacattctacaacataccacccgcggccgcaggacttcccaaacgagcgactctaccgcgcctacctcgttatccagagcttcaagaagaccatctcttctgaccctaagaatatcaccactacttggaccggcagcaacatctgtggcaacgagacctatctcggcttctactgcacggatcttccagggcgatcaaaggagctaaccgtcacggaagtcttattgaatggctttggcctgcgggcaccgaagctgcaaggtttcgtcgacaggctccctgaccttgcatttttccatgctgcatcaaacaatttcggcggcgacatccccaggctatctggtcttgaatacctgtacaagctcaatgtcgctaacgatatgcaatatcggcattctgcttccagttcggcatatgggaccattacctcggatgtcacgacaccttgcagtcgcgctactctaacctttagttttaacattagaacaccagacatgaagagatggggcattcctcatggcgctaccgattctaaggcgctcctccttaactacaacaacctatctgggccccttccatcggacctcggcttctccaaggtgagctatctcgccctcgccaacaacaggctcacggggccaatccctccgtcgatcgagcacctgcaagactccctcttcgagctgctgctcctcaacaaccagctctccggctgcctcccccacgagctcggcatgctccacaaggcggccgtcatcgacgccggcatgaaccagctcaccggcccgatcccgtcatccttctcctgcctcagcagcgtcgagcagctcaacctcgccgggaatcgcctctacggcccggtgcccgacgcgctctgcaacctcgccgggcccgccggccgcctcgccaacctcacgctgtccggcaactacttcacctccgtcgggccggcgtgcgcggcgctgatcaaggacggcgtgctggacgtgaagaacaactgcatcccgggcctcgccgaccagaggcgcccggcggagtgcgcggcgttccagagccagcccaagacgtgcccggcggcgagcacccagcaggtggcgtgccccgccgcagctgccgcgggcgcggcggcgccgggggagaggaaggctagggactactccagctacgtgacctacgctactctgcatgagtgatgagcagcctcagctcggcatgcagtaggagacagatcgtctcggtggcgtttacttgttctttgtattcttatgtagtgccccgtgtgtgtgtgtgttggtgtgattgtgattgttgtctattttctccgcacgtacgttgctgtccaggttgctgtcacacctagatctatctttgtatccatttgagtgaaaaattgttgttgttgttgc

SEQ ID NO: 17369 - protein, 429 aa, Panicum virgatum
  misc_feature: Ceres CLONE 1792089
  misc_feature: SWISSPROT Homolog: EC 2.7.11.1 Non-specific serine/threonine protein kinase
MASHHKLVIAKCLLFLISYVARILAITAYQTIQHSTTYHPRPQDFPNERLYRAYLVIQSFKKTISSDPKNITTTWTGSNICGNETYLGFYCTDLPGRSKELTVTEVLLNGFGLRAPKLQGFVDRLPDLAFFHAASNNFGGDIPRLSGLEYLYKLNVANDMQYRHSASSSAYGTITSDVTTPCSRATLTFSFNIRTPDMKRWGIPHGATDSKALLLNYNNLSGPLPSDLGFSKVSYLALANNRLTGPIPPSIEHLQDSLFELLLLNNQLSGCLPHELGMLHKAAVIDAGMNQLTGPIPSSFSCLSSVEQLNLAGNRLYGPVPDALCNLAGPAGRLANLTLSGNYFTSVGPACAALIKDGVLDVKNNCIPGLADQRRPAECAAFQSQPKTCPAASTQQVACPAAAAAGAAAPGERKARDYSSYVTYATLHE

SEQ ID NO: 17370 - DNA, 1652 bp, Panicum virgatum
  misc_feature: Ceres CLONE 1792107
  misc_feature: Encodes the peptide sequence at SEQ ID NO. 17371
actcccgcgagctcggcggcctccgcttccaagcgcctcggcgaagcgcctcctccatcctcccccggcgtccctacccgtggctctgcgccggcgtcgacgcgtctcgcagcagcatggttgactgcatgcggctgcttctaccggccgcgcggttcaccgccgccgttcactacccctgcggcaccgctcgcagtagcttcaacccggggcgttccaccttctccgtttgtttcaaccgccgccgccgccggagctctgttcctgtgcaatctgcatccgctgggaccggaagcgaatcgagtgttgcagaggaaccggaggctgtcgaatgggctatgcaggatttttacgccttgcggaaggaggttgagttggctgtagagcgtgtcagtgaagtcaggcagtctgcaggtttggaacagcttatggaggggattgcttcgcttgagaagaagtcagcagatagttctttgtgggatgatccttccaaggcacaggggatactagtttctctgactgaggtcaaagacagagtcaagcttctcaacgattttaagtcacaggttgaagaagcagagaccattgtgaagcttactgaagaattagactccatagatactggtcttcttgaggaggcctcaaagattataaagtcattaaataaggcaatagataactttgagatgacacagcttctttctggaccatatgacaaggaaggtgctgtaattaatatttctgctggtgctggtggcactgacgctcaggattgggctgacatgttactaaggatgtatgtaaggtggggagagaagcagcgttacaagacaagagtagttgagaaatcacctggtgaagaggctggtataaaatcagcaacagttgaactagagggaagatatgcctatggctatctctctggtgagaaagggacacacaggattgtccgtcagtcaccatttaacgccaaagggcttcggcagacaagctttgctggtgttgaggttatgcctcttctaccggaagaatccatggctgtggaaatacctgaagaggacctggagataagcttcacaagagctggaggtaaaggaggccagaacgtgaacaaggtggaaacggctgttcgcatggtccatattcctactggcattgcagttcgttgctcagaggagaggagtcagctggccaacaaaataaaggctctcagtcggctcaaagctaagctgctggtgatcgcagaggaacaacgtgcatcggagatcaagcagatccgtggcgacatggtgaaggcggaatgggggcagcaaatacgcaactacgtcttccacccctacaagctcgtcaaggacgtccggactgggtgcgaaacttcagacatcaccggtgtcatggatggtgaactcgacccctttgtcaaagcgtacctcaggtacaagctcaccgcagcaacttccagctgatgttgaggagcaaattaaagcgacaagtgactgcccccctatccagtagtatccatttttggtacaaagttcatcgtttttttttcttttcctgatgtagtacactttcattcatagtagtcgcatcttatttcctgatttatgaatcgtaacggataaaaccaaaatggatgggttgcacctttg

SEQ ID NO: 17371 - protein, 449 aa, Panicum virgatum
  misc_feature: Ceres CLONE 1792107
  misc_feature (302)..(415): Pfam Name: RF-1 Pfam Description: Peptidyl-tRNA hydrolase domain
  misc_feature (159)..(271): Pfam Name: PCRF Pfam Description: PCRF domain
MVDCMRLLLPAARFTAAVHYPCGTARSSFNPGRSTFSVCFNRRRRRSSVPVQSASAGTGSESSVAEEPEAVEWAMQDFYALRKEVELAVERVSEVRQSAGLEQLMEGIASLEKKSADSSLWDDPSKAQGILVSLTEVKDRVKLLNDFKSQVEEAETIVKLTEELDSIDTGLLEEASKIIKSLNKAIDNFEMTQLLSGPYDKEGAVINISAGAGGTDAQDWADMLLRMYVRWGEKQRYKTRVVEKSPGEEAGIKSATVELEGRYAYGYLSGEKGTHRIVRQSPFNAKGLRQTSFAGVEVMPLLPEESMAVEIPEEDLEISFTRAGGKGGQNVNKVETAVRMVHIPTGIAVRCSEERSQLANKIKALSRLKAKLLVIAEEQRASEIKQIRGDMVKAEWGQQIRNYVFHPYKLVKDVRTGCETSDITGVMDGELDPFVKAYLRYKLTAATSS

SEQ ID NO: 17372 - DNA, 1758 bp, Panicum virgatum
  misc_feature: Ceres CLONE 1792113
  misc_feature: Encodes the peptide sequence at SEQ ID NO. 17373
aaacctcccaaaccctcccccgatctccgccgctccaaaatgtggcgccgccacctcctccgctttctcccgtctccggcccccggcgccacggccgccacgccccattcgcccttcctgcgccacctctccacctccaccacacccgctctgaccaactccctcgcatcgtccctcgcggcggcgctcgccgcgctctccacgaccccgccgcccgccaccaccgcggacgcctacttctcgctccatttctccgacgtgcgccccaccaacgcgctcctcgccgaggcgctcgcgctctccccgcccgactcctcgcgcgcagccgccgacctcttccgcttcctcgtccgccgccgctcgctccacccctccgacggcgcgctcgcgcccgtcgtccggcacctcgcgcgccgccgcgacttccccgccgtgcgcgctctcatccaggagttccccaccgcgctcgggcccgccacgctcgacgcttacctccgccagctcgccagagccagccgccccacggatgccgtcaaggtgttcgacgaattgcccgagcagctccgtaaccgcgaggcgctcacttcgttggtctcctcgctttctgctgaaggcttcccttcgcacgcagaacgtgctaccaagaaggtcgccaatgagatcttcccggatgacaatatctgcactttgctggtatctggatatgccgatgctggaaagctcgaccatgcactgaggttgattggcgagacacggcgtggtgggtttcagccagggttggattcatacaatgctattcttgactgtgtttgccggctctgccgcaagaaggacccgctgaggatgtcagtggaagcggagaagttcttagttgacatggaggccaacggcattccccgggatgcagggacatttcgggtgctgatcacaaatctttgcaagatccgcaagacggaggatgccatgaatctcttccgccgtatgggtgagtggggatgctcaccggatgctgacacatacttggtgctcatcaggagcttgtaccaagctgctcggatttcagagggggacgagatgatgacatggatgcgttctgccggatttggagataaacttgataggaaggcgtattacggattcatcaagatcttgtgtgggattgagcgggttgagcatgctgtcaaggtattccgtatgatgaaaggatatgggcatgctcctggagtgaagtcgtatagcttgctgattgagaaccttactaggcacaatttaggggatcgtgcaagtgcactgttcagggaggcagttgcacgtggtgtaactgtggcaccaagagagtataagactgaaaagaggtttgtgaaggcaaagaaggagaagaaggtgaagaaggggctcactttgccggagaagatgagattgaagagcaagaggctatacaagctcagaatgagttttgtcaagaagcccaggcgtcgaatgagaatttaagcaaaatttttgtttggttggagcagatggccatgggagcgaaacatcatcgggagttagatttattaatcctgaagatcagaaaattgttgtcctcgacttgtgcctgccattgtgactggctattcaacagtaatgttttccaatgtaagggctacgtatggtttatgtttcaatgtctggtggctctggtgatgtttggtgcgactccttgcatttcattctaaataatgtaccatttcacttctttttgtttacccttctagc

SEQ ID NO: 17373 - protein, 483 aa, Panicum virgatum
  misc_feature: Ceres CLONE 1792113
  misc_feature (290)..(324): Pfam Name: PPR Pfam Description: PPR repeat
MWRRHLLRFLPSPAPGATAATPHSPFLRHLSTSTTPALTNSLASSLAAALAALSTTPPPATTADAYFSLHFSDVRPTNALLAEALALSPPDSSRAAADLFRFLVRRRSLHPSDGALAPVVRHLARRRDFPAVRALIQEFPTALGPATLDAYLRQLARASRPTDAVKVFDELPEQLRNREALTSLVSSLSAEGFPSHAERATKKVANEIFPDDNICTLLVSGYADAGKLDHALRLIGETRRGGFQPGLDSYNAILDCVCRLCRKKDPLRMSVEAEKFLVDMEANGIPRDAGTFRVLITNLCKIRKTEDAMNLFRRMGEWGCSPDADTYLVLIRSLYQAARISEGDEMMTWMRSAGFGDKLDRKAYYGFIKILCGIERVEHAVKVFRMMKGYGHAPGVKSYSLLIENLTRHNLGDRASALFREAVARGVTVAPREYKTEKRFVKAKKEKKVKKGLTLPEKMRLKSKRLYKLRMSFVKKPRRRMRI

SEQ ID NO: 17374 - DNA, 1628 bp, Panicum virgatum
  misc_feature: Ceres CLONE 1792114
  misc_feature: Encodes the peptide sequence at SEQ ID NO. 17375
gcccttatttcattcgctcgccccgtcgccaccgctcgctcgcctctccgaacgcaaagcaaggaacccagttccttcctctccttgcctgagcggcgcggcacgaggctgaggagcgggatgcagtcggacgcgtccacctccccgcggcggcggagcacgagctgctacagcgacagcggcgactcctcttgctccgagcccttcagcgagtgcggcagcgacgacctctccttcacgcccgcggccgccgcgggcatccaccgcctgctgctgtcctgcgtggcggaggcgtcggaggacgccatctcgtccctcatggccgagctggagtcgccggcgccgtcgctggactcgctccggcgcgcggccatggagctccggctgctggccaagcacaacccggacaaccgggtccgcatcgccaaggccgggggcgtgcggccgctcgtcaagctgctgtcgcacgcggacccgctgctacaggagcacggcgtcacggcgctgctcaacctctccatctgcgacgagaacaaggcgaccatcgtcgaggccggcgcgatacggccgctggtgcaggcgctcaagtccgccacgtcgcccgccgcgcgggagaacgccgcgtgcgcgctgctccggctctcccagctcgacggcgccgccgcggccgccatcggccgcgccggcgccatcccgctgctcgtctccctcctcgagaccggcggcccgcgcgggaagaaggacgccgccacggcgctctacgcgctctgcagcggcgcccgcgagaaccggcagcgcgccgtcgaggccggcgcagtgcggaccctgctcgacctcatggccgacccggagtccggcatggtggacaaggccgcctacgtcctccactccctggtgggctcgggcgagggccgcgccgccgccgtcgaggaaggcggcatccccgtgctcgtcgagatggtggaggtcggcagctcgcggcagaaggaaatcgccacgctctccctgctacagatctgcgaggacaacgccgtgtaccgcaccatggtcgcccgcgagggcgccatccctcccctcgtcgccctctcccaatcgccctccgcccgccccaagctcaaaaccaaggtggagtcgctgatcgagatactgcggcagccgcggagcccgagcctccgcgcgaggccagcggcggtagttgcggcggagtgacgacccgttcctcaatcgggcgatcccatccccaccttggtcgtgcgtccccagcctcccttcacctcttcggcgagacgagccggcgcgcgtgtaaatagcaagcagcgtgtttgcgtccgagagcgagtgtacagtttcctcaagcgagatgtcgtccggaggaccgaagaacagtctagcctcctctgcccgcaattacctccctccccgcccagcctcactttccagtttcgacttccggtttggttgcttcctcgccgccggccgtggcgaggcaaagcagagcgaagggtgtgtgccgcgaagctgcggaaaagcttcgagttcgcgtgtgcccgtgtgggttggattgtgctagtctctgtgtgtacgtgtgtgctgcgtttggaacgaatcaattgcggtaattttgctgc

SEQ ID NO: 17375 - protein, 362 aa, Panicum virgatum
  misc_feature: Ceres CLONE 1792114
  misc_feature (135)..(176): Pfam Name: Arm Pfam Description: Armadillo/beta-catenin-like repeat
  misc_feature (94)..(134): Pfam Name: Arm Pfam Description: Armadillo/beta-catenin-like repeat
  misc_feature (178)..(218): Pfam Name: Arm Pfam Description: Armadillo/beta-catenin-like repeat
MQSDASTSPRRRSTSCYSDSGDSSCSEPFSECGSDDLSFTPAAAAGIHRLLLSCVAEASEDAISSLMAELESPAPSLDSLRRAAMELRLLAKHNPDNRVRIAKAGGVRPLVKLLSHADPLLQEHGVTALLNLSICDENKATIVEAGAIRPLVQALKSATSPAARENAACALLRLSQLDGAAAAAIGRAGAIPLLVSLLETGGPRGKKDAATALYALCSGARENRQRAVEAGAVRTLLDLMADPESGMVDKAAYVLHSLVGSGEGRAAAVEEGGIPVLVEMVEVGSSRQKEIATLSLLQICEDNAVYRTMVAREGAIPPLVALSQSPSARPKLKTKVESLIEILRQPRSPSLRARPAAVVAAE

SEQ ID NO: 17376 - DNA, 1677 bp, Panicum virgatum
  misc_feature: Ceres CLONE 1792136
  misc_feature: Encodes the peptide sequence at SEQ ID NO. 17377
gatccagaatttttttcgcatccaactcagtttcatggctactgttcatatctatccctaatcccccaaaatcacggccaattcccccaaaatcacggcgtcctcccgcagctccttcatccgccgcctcactccaccaccgaccaccaaaggccacagctcacaacaaccaagcactcacgccatggccgcgcccgctggtgctcccgtggaagccgccgccggacgccgcttcgactacgacgtgatcgtggtcggcgccgggatcatgggcagctgcgcggcgcacgccgcggcgtcccgcggcgcgcgcaccctgctcctggagcgcttcgacctgctgcacggcctcggctcctcgcacggcgagtcgcgcaccatccgcgacgcctacgcggacgcgcgctacccgccgatggtgcgcctcgcccgccgcctctgggagagcgccgaggccgagtccgggcgccgcgtcctcaccccggcgccgctgctctccctgggcccgcgcagcgacgcttcagtcctcgccgccgccgggaacgccggcgcggaggaggtgggcgacctggccgcgaggtggggcggcgcgttccgggtccccgatgggtgggtagccgccgtgagcgagcgcggcagcggcgtcctgaacgcgaccgaggcggtcaggatgttccaggcgctcgccgccgagaagggcgccgtggtgagggacaacgcggaggtcgtgggcatcaggaagggggcggggggaggcgtcgtggtggcgacgagcaccggcgaggagttcggcggcgccaagtgcgtcgtcacggtgggcgcgtggacgggcaagctggtcaggtccgtcgccggcgtggacctccccgtccagccgctgcacacgctggtcctgtactggcgcatcaagcccggccacgagcgcgagctcacggcggaggccggcttcccgacgttctcgagctactgcgccccgcacttcgtgtacagcacgccgtccctggagcgcccgggcatgatcaagatcaactaccacggcgggccaccgtgcgatccggacagccgcgacctcgtctccggcggcggcgatgtcgtggagcgggtagccaggtggattgatgagttcatgccggggcgcgtggagaccgccggcgggccggtcgaccgcctgccgtgcatgtactccatgacgccggacgaggatttcgtggtcgacttcctcggcggggagttcggcgaggacgtggtgatcggggccgggttctccggccacgggttcaagatgggtccggcagtggggagtatcttggccgagatggccatggacggtgaggcgaggactgcggcagtggccggcgtggagcttggtcacttcaagatcaaccgtttcgataacaaccccatgggaaatgccaaggatttgtgagctcgatcatggatgtgtgtcattgtggcgtgtcctactgtctctgtgattaattagctatgttttgtggttagcctggggattagggacatttgaagatttggatagaaggctgccaggggaggatggtcgtaattcagatggtgcaaaagggcacaccaatacacatgctgcttatctgcaaattgaaaaaaacaattgaatatattatattaagttcggcaataaaatctttaatgttgtttgtttat

SEQ ID NO: 17377 - protein, 413 aa, Panicum virgatum
  misc_feature: Ceres CLONE 1792136
  misc_feature (20)..(378): Pfam Name: DAO Pfam Description: FAD dependent oxidoreductase
  misc_feature: SWISSPROT Homolog: EC 1.5.3.1 Sarcosine oxidase
MAAPAGAPVEAAAGRRFDYDVIVVGAGIMGSCAAHAAASRGARTLLLERFDLLHGLGSSHGESRTIRDAYADARYPPMVRLARRLWESAEAESGRRVLTPAPLLSLGPRSDASVLAAAGNAGAEEVGDLAARWGGAFRVPDGWVAAVSERGSGVLNATEAVRMFQALAAEKGAVVRDNAEVVGIRKGAGGGVVVATSTGEEFGGAKCVVTVGAWTGKLVRSVAGVDLPVQPLHTLVLYWRIKPGHERELTAEAGFPTFSSYCAPHFVYSTPSLERPGMIKINYHGGPPCDPDSRDLVSGGGDVVERVARWIDEFMPGRVETAGGPVDRLPCMYSMTPDEDFVVDFLGGEFGEDVVIGAGFSGHGFKMGPAVGSILAEMAMDGEARTAAVAGVELGHFKINRFDNNPMGNAKDL

SEQ ID NO: 17378 - DNA, 1680 bp, Panicum virgatum
  misc_feature: Ceres CLONE 1792137
  misc_feature: Encodes the peptide sequence at SEQ ID NO. 17379
acccctcctcatctccttgggttcccctttgcgcgcgccgccatgccggacgtgcagccgctcgtcagagacttcgtcctcaagctcaagcgacgaaaggtggagggctcgcatgccgtggcgcgccagacagcggagcttctgcggtcggtggtatcgcagcaccggatgggcagcagcgccaaccaggcggccgcgctcgctgatgccgtacgcgccgtcggggagcagctcatcgccgccaatcccatcgagcttgctgttggaaacattgtgagacgtgttttgcatataataaaagaggaggatatatctgctacagcagttggtattgaaggcctttctgttaccgttgacagcgatgacgaatatgacagtgaacatgatgatcgcccttcattgtctgctgctgttcttgctgcacatgctagaaatgctcttcgggcaccttctttgcagactctcctagaagatattcctgtgagtcctgcaatttcacgcactgcgtcatcagctggggactcagacggaaaaagtaaatctggagataagagctcaactaggaaactgaagcatgatgtgattgcagccattagtgatcttattgatgagattgactcatgctatgagccgatttctgagcaagctgtggaacttattcaccaaaatgaggtaatcctcactttaggtcgttctagaactgtcaaggagtttctgtatgctgcaaaggagaagaagagatcttttcgtgtatttgttgcagaaggtgctccaagatatcagggccatattcttgcaaaagaactggttgagaaaggtgtacaaactactgttataacagattcagcagtttttgctatgatctctcgagttaacatggtcatagttggagctcatgctgtaatggcaaatggtggagtcattgcaccagtagggatgaacatggttgcacttgctgcccaaaggcatgctgtgccctttgttgtagttgctggtagtcacaagttgtgtcctttgtatccacacaacccagaggtttcgctgaatgagcttaaatcaccgtctgatttgctcgacttcggcgagttttcagattgtatgaatttcagtactcaggatggtagtctcctactgaacgttgtcaacccgacatttgactatgtgccgccgaagcttgtgagcctattcatcactgatactggagggcatagtccatcttatatgtaccggcttattgctgagtattactcagctgatgatctagtagtgcgacgcaagtcaacatcttgaaggagcagaaaagcattctaaaaaggcaacttcactacaggtgtttcagtgctcattatcacaatctttgtctgcgccctacagatgttgctctctttggtgaaatcgccaattgtgcgttcagttactgtcgaactgtaggaaattgatgcaagcattctcctttcggtagctgtatcgattgcggcattttgggtgtaaactgtcgagcaaatgggggtgtgacctatcatgggtggttatttagctatagaagatatagagtgtagagagtagctgtttcatatccgtgcagcctggcctgggttgggccaaattttgtctgttctaaattcaagctgtttcatgtgtatcaattactattgagcactcagatggaattttctgagc

SEQ ID NO: 17379 - protein, 415 aa, Panicum virgatum
  misc_feature: Ceres CLONE 1792137
  misc_feature (19)..(391): Pfam Name: IF-2B Pfam Description: Initiation factor 2 subunit family
  misc_feature: SWISSPROT Homolog: EC 5.3.1.23 S-methyl-5-thioribose-1-phosphate isomerase
MPDVQPLVRDFVLKLKRRKVEGSHAVARQTAELLRSVVSQHRMGSSANQAAALADAVRAVGEQLIAANPIELAVGNIVRRVLHIIKEEDISATAVGIEGLSVTVDSDDEYDSEHDDRPSLSAAVLAAHARNALRAPSLQTLLEDIPVSPAISRTASSAGDSDGKSKSGDKSSTRKLKHDVIAAISDLIDEIDSCYEPISEQAVELIHQNEVILTLGRSRTVKEFLYAAKEKKRSFRVFVAEGAPRYQGHILAKELVEKGVQTTVITDSAVFAMISRVNMVIVGAHAVMANGGVIAPVGMNMVALAAQRHAVPFVVVAGSHKLCPLYPHNPEVSLNELKSPSDLLDFGEFSDCMNFSTQDGSLLLNVVNPTFDYVPPKLVSLFITDTGGHSPSYMYRLIAEYYSADDLVVRRKSTS

SEQ ID NO: 17380 - DNA, 750 bp, Panicum virgatum
  misc_feature: Ceres CLONE 1792139
  misc_feature: Encodes the peptide sequence at SEQ ID NO. 17381
aacaagaaatacctgctggcgggctggctgttgagtgttcaccccgttagcccatcgcacaccacagagctcggtgagcggccggtgtctcgcgcaccgccgtctccattcgtccgtttaagagacctagctagctacgtacgcgagctccctcccactctgcttctgctcctccatcagacactcctcgtgcgcattggtgcctagctcgcacgaccatgaggctgccggggaaccgttgctcctcctcgctggcggcgcgatggtccctcgcgctcctggccgccgtcctcgggggcggcggcgggccggcggcggcgctcggctgctacacgcgcatcttcagcttcggcgactcgctgacggacacgggcaactacgtccgcctgacggccacgagccacagcccctacggcgcgccgccgtacgggcggacgttcttcggccgccccaccggccgcgccagcgacggccgcctcgtcatcgacttcatcgcggaggagttcgggctggcgaacgtgacggcgatccagacgggcacggcgccggcggacttccggaacggcgccaacttcgccatcatctcggccaccgccaacaacggcaccttcttcgcgggcaacggcatgaacatcaaccccttctcgctcgacacgcagatgctctggttccggacccacctccgcgagctcgcgcaggccgcggcggcggcggggccggggcacaagcggaaagccagcaccggcgcgc

SEQ ID NO: 17381 - protein, 177 aa, Panicum virgatum
  misc_feature: Ceres CLONE 1792139
  misc_feature: SWISSPROT Homolog: EC 3.2.1.51 Alpha-L-fucosidase
MRLPGNRCSSSLAARWSLALLAAVLGGGGGPAAALGCYTRIFSFGDSLTDTGNYVRLTATSHSPYGAPPYGRTFFGRPTGRASDGRLVIDFIAEEFGLANVTAIQTGTAPADFRNGANFAIISATANNGTFFAGNGMNINPFSLDTQMLWFRTHLRELAQAAAAAGPGHKRKASTGA

SEQ ID NO: 17382 - DNA, 643 bp, Panicum virgatum
  misc_feature: Ceres CLONE 1792139-R
  misc_feature: Encodes the peptide sequence at SEQ ID NO. 17383
cgggtactgggactacgacgcctcgacggggtgcctggcctggttcaaccgcttcgccgagtaccacaaccgggtgctcaccaagcagctggacaggctccggcggcgccacccgggcgtcaccatcgtctacgccgactggtacggcgccatgatgagcatcttccgagcaccccgggagctaggtttcacgaacgccctgcggagttgctgcggcaaccagacggtgccgtgcggcaagcccgggtgccgcgtctgcgacgacccgtcgacgtacgggtcctgggacggcacgcacccgacggaggcggtgtacaaggtgatcgccgacggggtgctgcacggaccgtacgcgtccccggtccctctcaccgagacctgctgacaatcgaagcagacttctctgtctccgggtggtccgctgatccttattacaagatccattgttattaagctgtagaatggtaacacatcggagttacgtgtgtagctgcaatgacgttacaggcaacttggtctcagggacagggtacagtaagctaaggttgacagatttcactagaacagaagtggtacagtgagaatttgggtttgtagcagtacaaagattgattgatgtgatccatgactccgtgagcgttgg

SEQ ID NO: 17383 - protein, 127 aa, Panicum virgatum
  misc_feature: Ceres CLONE 1792139-R
  misc_feature: SWISSPROT Homolog: EC 3.2.1.51 Alpha-L-fucosidase
GYWDYDASTGCLAWFNRFAEYHNRVLTKQLDRLRRRHPGVTIVYADWYGAMMSIFRAPRELGFTNALRSCCGNQTVPCGKPGCRVCDDPSTYGSWDGTHPTEAVYKVIADGVLHGPYASPVPLTETC

SEQ ID NO: 17384 - DNA, 2272 bp, Panicum virgatum
  misc_feature: Ceres CLONE 1792149
  misc_feature: Encodes the peptide sequence at SEQ ID NO. 17385
aacggttcgctgcggacctgttttcgcggcggctgctgaggcggtaggtagcaggcggctcgtcgtccctgcgccgcgcggccgcgcttccgatctgactggcggcttcgggtcgacgcggagatgcagaggcaggggcggcacctggagcggtccaactcgaagcgggcgctcgaccatggtggcggcggcggcggctgcgacgacgatgaccgcgcgcctaagcgcccgcgcgtccccgccctcgcgagtgtcattgtagaagccctcaaggtggacagtttacagaagctttgctcatcactggagccgattctacgcagagttgtcagtgaagaagtagagcgtgctttaaccaaattggccccggctggtcctgctaggatccaaggaaggagcagctctcccaagcaaattgaaggccctgatggtagaaatctccagcttcagtttaggactaggttatcccttccactctttactggagggaaagtagaaggcgagcagggagcagcaattcatgttgtgctgctagatgcaaacactggacatgccattactgcaggacctgagtcatctgcgaaactggatattctagtgcttgagggagattttaataaagaggaagatgcgggttggactgaagaagactttgaaagtcacatagttaaagaacgtgaagggaagaggcctcttttaactggtgacctccaggtgacccttaaagaaggtgttgggaccattggagagcttatttttactgacaattccagctggataagaagccggaaatttagacttgggttaagagtctcttcagggttttgtgaaggaattcggattatggaggcaaaaacagaggcttttactgttaaagaccacagaggcgaattgtacaagaagcactatcctcctgcactaaaggatgaggtatggagattagaaaagactggaaaggatggttcattccacaagagattaaactcaagtggaatttatacagttgaacactttcttcaatttcttgttagagaccagcagaagttaagaagtattcttggcagtaacatgtcaaataggatgtgggaaagtcttgttgagcatgcgaagacttgtgttttgagcggcaagcattatatatattactcaagtgatgccagaagtgtcggtgcaattttcaataacatatatgaattcactggtttgatcgctgatgatcagttcatttctgctgaaaatctcactgaaaaccagagggtttttgctgacacgttggtgaagcaagcatatgatgattggatcaatgttgtagaatatgatgggaaggcactattgagattcaagcagaaaaagaaatctgttatgactagaagtgaaacagcaaagtcttcatcaagtgaccctgcatcaaatggtttaatgcattcgcagaaacaattagtaggaggtcctgcaaatgctgaacagtcttccctgagcaatattagtgaagatgcaactagaatcgcatccatcgggaatcaagtagcaagaggttatgcagccaatcctcaggacgccccaagtatgaccatgcagtttgacatgagttcgttggcccctgaaggccagttcagcggttcgtccatccaaactcaagcttcaagaagctccaacttgctagcactgcgccctatgcagcagcagcagccgctgctgcaaaactttgagttctccaggcttggtggtcagtccatccaaccttcagctctcaacccttacgaggactggtcgcggttacaggagaaccacggaggtgccgatgactacttgatggaggagataagggcgaggagccacgagatactggagaacgatgagatgcaacagatgttgcgcattttgagcatgggcggggcaccgaccggcctcagcaatgttgacagcttcccttcgtacccatctcctgccccagccttcagcttcgaggacgaccgctctcgctctcgctcgtccggtaaagccgttgttgggtggctgaagattaaggccgcgatgcggtggggcatcttcgtcaggaggaaagcggccgagagacgagctcagcttgttgagcttgaagactagcgggtgcggggctggagtgttcagcttatttccgcagagggctagcagatgctgcaatgttgtaattgtaacacgcctccgttgcacaatagctccattgatatttgtaactaatggcaacattggatgggatgacgattaagaccgagcttttacaaatgaactc

SEQ ID NO: 17385 - protein, 660 aa, Panicum virgatum
  misc_feature: Ceres CLONE 1792149
  misc_feature (104)..(407): Pfam Name: Calmodulin_bind Pfam Description: Calmodulin binding protein-like
MQRQGRHLERSNSKRALDHGGGGGGCDDDDRAPKRPRVPALASVIVEALKVDSLQKLCSSLEPILRRVVSEEVERALTKLAPAGPARIQGRSSSPKQIEGPDGRNLQLQFRTRLSLPLFTGGKVEGEQGAAIHVVLLDANTGHAITAGPESSAKLDILVLEGDFNKEEDAGWTEEDFESHIVKEREGKRPLLTGDLQVTLKEGVGTIGELIFTDNSSWIRSRKFRLGLRVSSGFCEGIRIMEAKTEAFTVKDHRGELYKKHYPPALKDEVWRLEKTGKDGSFHKRLNSSGIYTVEHFLQFLVRDQQKLRSILGSNMSNRMWESLVEHAKTCVLSGKHYIYYSSDARSVGAIFNNIYEFTGLIADDQFISAENLTENQRVFADTLVKQAYDDWINVVEYDGKALLRFKQKKKSVMTRSETAKSSSSDPASNGLMHSQKQLVGGPANAEQSSLSNISEDATRIASIGNQVARGYAANPQDAPSMTMQFDMSSLAPEGQFSGSSIQTQASRSSNLLALRPMQQQQPLLQNFEFSRLGGQSIQPSALNPYEDWSRLQENHGGADDYLMEEIRARSHEILENDEMQQMLRILSMGGAPTGLSNVDSFPSYPSPAPAFSFEDDRSRSRSSGKAVVGWLKIKAAMRWGIFVRRKAAERRAQLVELED

SEQ ID NO: 17386 - DNA, 1173 bp, Panicum virgatum
  misc_feature: Ceres CLONE 1792159
  misc_feature: Encodes the peptide sequence at SEQ ID NO. 17387
gaagcgtttctcagagcaaagctgctcgtgcaacaagcgaagaggcgaaagagagagagagttggtggcaactggcaaggcagatggcgtccccgtcgtcgtcgctgtgctccggcttcgcctccctgcggacggcctcccttggccaccgccgcggcctcgtcttctccacccccaggaaagcattccaagtgagggcatcagctcgggttgacaagttctcaaagaatgacatcattgtgtccccctccattctatctgcaaacttttccaagcttggtgaacaggtaaaagctgtggaggtggcaggatgcgactggattcatgttgacgtcatggatggacgatttgtgccaaatatcacgattggacctttggttgttgatgctctccgtccagtgactgatcttccattggatgtacatctgatgattgtggaacctgagcagcgagtcccagattttattaaggcgggtgctgatattgttagtgtccactgtgaacaatcatcaaccatccatttgcaccgaacagtcaatcagattaaaagtctaggagcaaaggcaggagttgttttgaatccagcgactccactcactgcaatagattacgttcttgatgttgtcgacctggtcttgattatgtctgtgaatcctgggtttggtggccagagctttattgagagtcaagtaaagaaaattgcagagttgagaagattatgtgcagagaagggagtaaacccctggattgaggttgatggtggtgttggtccacaaaatgcctacaaggtcattgaagctggggcgaatgccattgttgctggttctgcagtttttggggctccagactacgctgaagctatcaaaggaatcaagaccagcgaaagacctgtagcagtaccagcatgaggaactggaactgcactcaattaccgtgtaagtttagcagtgctgcgacttgtgtcttgatgagtcatacgttatattggacattaaagaagactggaggcggtgaagaaatatccctcttctgccctcatttcctcaagggtgcctgccttgtactggttcccagaatgttgtgtgatattaaaacgtatacgggatcattcttggcgaaaatccagccatgggtacatcggcagttgatcgaaaccctggtaccagggcgttc

SEQ ID NO: 17387 - protein, 274 aa, Panicum virgatum
  misc_feature: Ceres CLONE 1792159
  misc_feature (52)..(254): Pfam Name: Ribul_P_3_epim Pfam Description: Ribulose-phosphate 3 epimerase family
  misc_feature: SWISSPROT Homolog: EC 5.1.3.1 Ribulose-phosphate 3-epimerase
MASPSSSLCSGFASLRTASLGHRRGLVFSTPRKAFQVRASARVDKFSKNDIIVSPSILSANFSKLGEQVKAVEVAGCDWIHVDVMDGRFVPNITIGPLVVDALRPVTDLPLDVHLMIVEPEQRVPDFIKAGADIVSVHCEQSSTIHLHRTVNQIKSLGAKAGVVLNPATPLTAIDYVLDVVDLVLIMSVNPGFGGQSFIESQVKKIAELRRLCAEKGVNPWIEVDGGVGPQNAYKVIEAGANAIVAGSAVFGAPDYAEAIKGIKTSERPVAVPA

SEQ ID NO: 17388 - DNA, 727 bp, Panicum virgatum
  misc_feature: Ceres CLONE 1792162
  misc_feature: Encodes the peptide sequence at SEQ ID NO. 17389
acacagccaaggctagagcatcaacacctgaatcggctgcttccagcgcctctctcctccccctccctcttccgatccacgcatctctagcccccgctgctctcgtcgttcgatcggcgctggtcggccactgaccatgacgaagcacggcgtggtgctcggccccgaggacgccgtcgtcccggcggcggcggcggccgcgcggcatttctcgttcccgccgccgaggacggggggcgactcgtgcaggaagctggcggcgcaggtcgacctcggcgccgccgtgatgggatcctggctcgactccatgaaggcctcctcgcccaggcacaggctcagggcgcccctgaccggcgccgccgacgcggagcacgacgactggatggagcggcacccgtcggcattggaccggttcgacgcgctggcggcggcggccaaggggaagcaggtcgccgtgttcctggactacgacggcacgctgtccccgatcgtcgaggaccccgaccgcgccgtcatgaccgacgagatgagggaggcggtgcgcggcgtggcggcgcgcttcccgacggcgatcgtcagcgggcgttgctgtgacaagatgttcggcttcgtgcggctggcggagctctactacgccgggagccacgggatggacatccgagggcccaccgccggccccaacaccacggcgaggagggcaagtcggtgctgtgccagcgggcgagcg

SEQ ID NO: 17389 - protein, 196 aa, Panicum virgatum
  misc_feature: Ceres CLONE 1792162
  misc_feature: Useful for making plants with modulated drought sensitivity
MTKHGVVLGPEDAVVPAAAAAARHFSFPPPRTGGDSCRKLAAQVDLGAAVMGSWLDSMKASSPRHRLRAPLTGAADAEHDDWMERHPSALDRFDALAAAAKGKQVAVFLDYDGTLSPIVEDPDRAVMTDEMREAVRGVAARFPTAIVSGRCCDKMFGFVRLAELYYAGSHGMDIRGPTAGPNTTARRASRCCASGR

SEQ ID NO: 17390 - DNA, 1558 bp, Panicum virgatum
  misc_feature: Ceres CLONE 1792167
  misc_feature: Encodes the peptide sequence at SEQ ID NO. 17391
aaaccaaaccccgaaaccccaccgaggagcggagggcggcgaaaccccacctctcggcggcggcctcagagacgattagggcgggcacgacggcggcgccggcgacgacgctgatggagtccctggaggccctcgtggcgcacatccaggggctctcgggcagccccgaggagctggcgcacctccacagcctcctcaagcaggcggacggcgactccctgcgcgcccacgccgccgcgctcgtccccttcctcgggcaactcagccccggggcccactccctcggctacctctacctcctggaggcgtgcgcgacttcgggcgccaatctgagggacttggccgacggggacttcctcgtcaccatggcggatttcctcaccgcgtgctcggcggaccagatacgcctagcgcccgacaaattcctgaatgtgtgtagggtgctcaaggatcaggtcatgcagctcaacgcgcccatcagggggatcgccccactccgtgcggctgtccgtaagatccaggcttcacccgagcagctgaccccggttcacgctgactaccttctcctgtgcctgctggcgaagcagtacaaggctggcttgagcgtcctggaagatgacatattcgaagtcgaccagccgcaggacttgttcctttactgctactatggagggatgatatacattgggctcaagaagtttcctaaggctttggagcttcttcacaatgctgttactgctccaatgtcatcattgaatgcaattgctgtggaagcttacaagaagtacatccttgtgtcgctcatccagaatggacaggtcccatcattcccgaagtatacatctgcaactgctcaaagaaatctgaaaaatcacactaagatttatgttgatctttgtacaagctatggcaatggtcgctacagtgacttggagatattcgttgaatcaaatgctgctgtgtttcaatcggacaacaacctagggctggtgaagcaagtgctctcctcaatgtacaaacgaaacatccaaaggctgacccagacttacttaactctgtcacttgaagatattgctagatctgttcaacttgaaacaccaagggatgctgaaatgcatgtacttcgcatgattgaagatggagagatccatgcaaccataaaccaaaaggatggcatggtcagctttcacgaagaccctgaacaatataaaagtgttgagatggtggagcatatcgactcttctattcaaagtttgacggctctgtccaagaagttggcttcaattgatgagaacatggcatgcgatcctgcatatttacagaagactggacgggatcgtggaagattcgactacgaggacttcgacactgttccacacaagtacaacttttgagatgatccaagcccttgcggctcgaaagtacaatcgtcgagctagggtgccattccttattattaattcgatccatctatggctttttgaaaattgatgagatgctgtaaattttggtttgaagaacgggtccgtcggagaaggcagatgcttctgttccagtt

SEQ ID NO: 17391 - protein, 426 aa, Panicum virgatum
  misc_feature: Ceres CLONE 1792167
  misc_feature (256)..(360): Pfam Name: PCI Pfam Description: PCI domain
  misc_feature: Useful for making plants with modulated light quality sensitivity
  misc_feature: Useful for making plants with modulated low light sensitivity
MESLEALVAHIQGLSGSPEELAHLHSLLKQADGDSLRAHAAALVPFLGQLSPGAHSLGYLYLLEACATSGANLRDLADGDFLVTMADFLTACSADQIRLAPDKFLNVCRVLKDQVMQLNAPIRGIAPLRAAVRKIQASPEQLTPVHADYLLLCLLAKQYKAGLSVLEDDIFEVDQPQDLFLYCYYGGMIYIGLKKFPKALELLHNAVTAPMSSLNAIAVEAYKKYILVSLIQNGQVPSFPKYTSATAQRNLKNHTKIYVDLCTSYGNGRYSDLEIFVESNAAVFQSDNNLGLVKQVLSSMYKRNIQRLTQTYLTLSLEDIARSVQLETPRDAEMHVLRMIEDGEIHATINQKDGMVSFHEDPEQYKSVEMVEHIDSSIQSLTALSKKLASIDENMACDPAYLQKTGRDRGRFDYEDFDTVPHKYNF

SEQ ID NO: 17392 - DNA, 1712 bp, Panicum virgatum
  misc_feature: Ceres CLONE 1792176
  misc_feature: Encodes the peptide sequence at SEQ ID NO. 17393
aggcactccttttcagtttggcttgctccagcctccagaaacctcacaacccctcgccagcaatccggccccggtccctcccccagacactgaatctaaaggggggcgttgttgcagcaggaatcccgaaattctcgagccaaatttggtcttgttccgctcaaattgccttcctttcgctgtgttcttgtgggccatgtctctgtacggcgggctcgccggagtttatccgcaagaggaggaagaccgacacgacgtccagatgggtgactcggactacgaggacgacgagtcggaccaatctacttctaaggcgacagaagacacaacccttatggatgtgaagaaagggaaggatatacaagggatcccttggaacaggatgaacactacaagagacaggtacaggcaggcaaggttgcagcagtatgccaattttgagaacatacctaattccggaagaacctcggagaaggaatgcacaccagcagagaaaggccaactctactacgagtttcagcacaacacaagatcggtgaaatctaccattcttcatttccagttgagaaatttagtgtgggcaacgacaaggcatgatgtgtatcttatgtcatactattctgtgcttcattggtcggcattgactcgtgagaagcaagaaatcattgatcttcaggggcatgtcgcaccatgtgagaagcaccatgaaaatttctctgagggattttatcatactcaagtcagtactttggctgtgaaaaacaacttgcttgttactggtggatttcatggcgaaataatatgcaagtttttggatcgtcgaggaataagctattgttgtaagtcaacaaatgatgacaatggtattactaattctttggagatatacgagaaacctagtggttctctacacttcttggcctcaaacaatgattgcggagttagagacttcgacatggaaaagtttcaaatctgcaacaacttccgatttgcttggcctgtcaatcatacatcacagaatcctgatggcaaacttgctgtgattgtgggggacaatcctgatggacttctggttgatgctaattcagggaaaacggttcatgatctccgtggccatttggattactccttcgcatcagcatggaacccagatggccgaacattcgccactggaaaccaagacaaaacatgcagggtatgggacatcaggaatctctccaaatcagttgctgtattgggtggcaatatcggagccatcaggtcaattcgctacacttccgatgggaagttcttggcgatggcagagcctgcagattttatccacatctttgatgttgatagtgggtacagcaggaagcaggaactggatttctttggtgagatcgctggcatatcattcagtcctgacactgaatctctctttgttggtatgcatgatcgtgcatacagcagcctcctccagttcaaccgccaacgattctactcataccttgattcagcactgtgaagttgctaccggcagggatctgtgagtgagatccagatcacaggttgtagaaactagaaatgggtgtatatgtttggaggtggcgtttgcttttgctgaacaaggtgtagatattcaactagccttttttttctgaactggctgtagatattcagagccatcttttcggagatttgtgctgtttctgttgctgtaatgttgttgt

SEQ ID NO: 17393 - protein, 436 aa, Panicum virgatum
  misc_feature: Ceres CLONE 1792176
  misc_feature (298)..(336): Pfam Name: WD40 Pfam Description: WD domain, G-beta repeat
  misc_feature: SWISSPROT Homolog: EC 2.3.1.48 Histone acetyltransferase
MSLYGGLAGVYPQEEEDRHDVQMGDSDYEDDESDQSTSKATEDTTLMDVKKGKDIQGIPWNRMNTTRDRYRQARLQQYANFENIPNSGRTSEKECTPAEKGQLYYEFQHNTRSVKSTILHFQLRNLVWATTRHDVYLMSYYSVLHWSALTREKQEIIDLQGHVAPCEKHHENFSEGFYHTQVSTLAVKNNLLVTGGFHGEIICKFLDRRGISYCCKSTNDDNGITNSLEIYEKPSGSLHFLASNNDCGVRDFDMEKFQICNNFRFAWPVNHTSQNPDGKLAVIVGDNPDGLLVDANSGKTVHDLRGHLDYSFASAWNPDGRTFATGNQDKTCRVWDIRNLSKSVAVLGGNIGAIRSIRYTSDGKFLAMAEPADFIHIFDVDSGYSRKQELDFFGEIAGISFSPDTESLFVGMHDRAYSSLLQFNRQRFYSYLDSAL

SEQ ID NO: 17394 - DNA, 2123 bp, Panicum virgatum
  misc_feature: Ceres CLONE 1792186
  misc_feature: Encodes the peptide sequence at SEQ ID NO. 17395
aaacatcgatcagcttcctctttctcactcattctcacacaaaaacatactccatgttaggagctgttcaagagaccactcaggatagagagaaagagagagatgatgtaagacagtaagagggggttagattttggaacatgcatgtcaaatcacagcgtttgatgcaccaggagagttggaagcaaggggtcgtatctgctgcttgacacagaggcacatgtcccttttggtgggtaatgatggtgtgcaggtggatgtgatgatagattgcctcatccggggactgagacattccatccaaggccgcccagtgtcatgcggcctcacattcacagctatcacccctggctgctgcaatattccatttgtttgctaatgtcttgtgtcaagatgcctcggatatgaggatgtcctgtcacggaagctgcagctgcgagcccagatgctgccgccgctactgctggacgtcgtgctcccctattaaacccgccaggagatgcacgccctcctcctccaccccctcatgctcctcgcctgccaccgccgccgactccggccgccgctcctccgcgggctcgcgccggtgaagaagcagaacgaagctagctgcagccgggaaccgccgaagctatgttcggctcactccaccaccactcctcctcctcctccgacaccgacaacaacaatgacaacaagagcagcggcggcggcggcggcggcgkccgcgggggcgcggcggcgccctccgcgcgggacctcgtgctggcctccgccgacctgctgcagcgcggggacctccccgccgcgcgccgcgccgcgggggtcctgctgtctgcggcgtccccgcgcgccgacgccgccgaccgcctcgcctaccacttcgcccgcgcgctcgcgctccgggcggacgccgcgggccgcgtcgtcgccccggccggcctggtgcccgccgcgcggccggcatcgtccgccgcctacctcgccttcaaccagatcgcgcctttcctgcgcttcgcgcacctgacggcgaaccaggcgatcctcgacgccgtcgagggcgcgcgccgcgtccacatcctcgacctcgacgccgcgcacggcgtgcagtggccgcccctcctccaggcgatcgccgagcgcgccgacccggcggcgggcccgccggaggtccgcatcaccggcgccggcgccgaccgcgacaccctcctccgcaccggcagccgcctccgcgccttcgcccgctccatccagctccctttccacttcacgccgctcctgctctcctccgccgccacccagcaccagccggtcgccggcgggagcaccacgaccgcctcgagcgaggccacgacgagcctggaccttcacccggacgagacgctcgccgtgaactgcatcatgttcctgcacaagctgggcgggcaggacgaggtcgccgccttcttgaagtgggtgaaggccatggcccccgccgtggtgaccatcgcggagagggagacggtcggcgggggctacgaccgcatcgacgacctgccccagcgggccgcggtggccatggatcactactcggcggtcttcgaggcgctcgaggcgaccgtgccgccggggagccgggagcggctgacggtggagcaggaggtgctcggcagggagatcgaggccgcgctgggacccgccggtgggaggtggtggcgcgggctcgagcggtggggggccgcggcccgcgccgccgggttcgcggcaaggccgctcagcgcgttcgccgtgtcgcaggcgcggctgctgctgcggctgcactacccgtcggagggctacctcttgcaggaggcgcgcggcgcgtgcttcctcgggtggcagacgcggccgctgctgtccgtgtcgtcgtggcagtagcccagcgccgccgccggcggctacctgctgcatgcacggattcatgccggcggcgaagacgaaggcggcggcctagggtttgcttgctcacagtcgtcactgccgcacatatagagctagcgtatatatgagcattgcattttgttgcaataatattaattggcttcttgtagtaagattatctcatggtgattttggaggatgcatgatgatcattctgttgggtt

SEQ ID NO: 17395 - protein, 420 aa, Panicum virgatum
  misc_feature: Ceres CLONE 1792186
  misc_feature (14)..(331): Pfam Name: GRAS Pfam Description: GRAS family transcription factor
  misc_feature: Useful for making plants with modulated biomass
  misc_feature: The sequence is a functional homolog of SEQ ID NO 1326 in the 10/374,780 US patent application
  misc_feature: The sequence is a functional homolog of SEQ ID NO 1325 in the 10/374,780 US patent application
  misc_feature (31)..(31): Xaa is any aa, unknown, or other
MFGSLHHHSSSSSDTDNNNDNKSSGGGGGGXRGGAAAPSARDLVLASADLLQRGDLPAARRAAGVLLSAASPRADAADRLAYHFARALALRADAAGRVVAPAGLVPAARPASSAAYLAFNQIAPFLRFAHLTANQAILDAVEGARRVHILDLDAAHGVQWPPLLQAIAERADPAAGPPEVRITGAGADRDTLLRTGSRLRAFARSIQLPFHFTPLLLSSAATQHQPVAGGSTTTASSEATTSLDLHPDETLAVNCIMFLHKLGGQDEVAAFLKWVKAMAPAVVTIAERETVGGGYDRIDDLPQRAAVAMDHYSAVFEALEATVPPGSRERLTVEQEVLGREIEAALGPAGGRWWRGLERWGAAARAAGFAARPLSAFAVSQARLLLRLHYPSEGYLLQEARGACFLGWQTRPLLSVSSWQ

SEQ ID NO: 17396 - DNA, 1870 bp, Panicum virgatum
  misc_feature: Ceres CLONE 1792210
  misc_feature: Encodes the peptide sequence at SEQ ID NO. 17397
atcctttccttccccatcctcttctctctctgcctgctgctggtttggtgtcgctgccgcctgccagtccgtctggtctgctggtggtggtggtagttgttggaacgagagcgtcagctggcagtagagccaatcaatggcggggctggggaggtgaaggtcttcgccgcttccaggagaaggcgccggccccaaccccaaggaacaagaggggtctccaggtgggctgctgtagatccttcctccggcgatcgtttcttttttctctctctactcgtggtcgaggaattggggattttttccccgcagcaagtagcagcacgtttgaggctcgctgctgcaggtaggcagagcatgcgccacgtccgggtgtcctcccaccaggcccccgtccacaagctcggccacgcgcagatggcgctcacgcccaagttccgcctcgccaccgccgcccccgcgccgccctcgcccacggaggcccagcagccggcctgggagacgccgctgatcccggggctccccgacgacgccgcgctcggctgcctcctccgcctccccgtcgaggcgcacgcggcctgccgcctcgtgtgccgccgctggcgccgccacctcgccgacaaggcgcgcttcttcgcgcagcggcgggcgctgggcctccgcaccccctggctcttcaccctcgccttccaccgctgcacgggcaagatccagtggaaggtgctcgacctcggccacctcacctggcacgccatccccaccatgccgtgccgggaccgggcgtgcccccgggggttcggctgcgtcgccatccccagcgacggcacgctcctcgtctgcggcggcctcgtctccgacatggactgcccgctgcacctggtgctcaagtatgacatctacaggaacaggtggaccgtcatgacgaggatgctcgccgcccgctccttctttgccggcggcgtgatcgatggccgggtttatgtcgccggaggctatagcaccaaccagtttgagctcaattccgcggaggttcttgatccggacaagggcgtttggcagccaatcgctagtatgggcatcaacatggcctcctcggactctgctgtcatcagtggtaggctctatgtcactgaaggttgcgcgtggccgttcttctcgtcgccgagaggacaggtttatgatccgaagatcgaccggtgggaggcaatgccggttggaatgcgcgaaggttggacgggacagagtgtggtcatcgatgggcatctgtttgtcatttcagagtatgagaggatgaaggttaagatctatgatccgcagacggattcatgggactcggtcagtggtcctccgatgcccgagcggattatgaagcccttctccgtcagttgtctggacagcaagattgtcgttgttggccgaggtctccatgtagcgattgggtatgttgagaagcaacctgctgctggtggcaattctggtagcaggagttcaagctactccatttgttggcaagatgtggatgttcctaaggaattcagtgatctgacaccttcgagcagccagattctgcatgcttaatttatcttcgagcccgccgtggtgattcatctgcaaaagtaccccagctgatcaaccttctccggtactgtctatgactgatctgatcaactccttaaattgcccctttgagctgtacaattgttgtgttctgtatagtaggctcttttccagtcagatctctatgatctggagctgttgtaccttgttgtaaagaaataaatcgagtttctctagaacagagacaaattaagaccccgttgtaagtatatgcttgtcagttttttttttgagattatatgcttgtcagttcttg

SEQ ID NO: 17397 - protein, 386 aa, Panicum virgatum
  misc_feature: Ceres CLONE 1792210
  misc_feature (125)..(172): Pfam Name: Kelch_1 Pfam Description: Kelch motif
  misc_feature (174)..(220): Pfam Name: Kelch_1 Pfam Description: Kelch motif
  misc_feature (30)..(77): Pfam Name: F-box Pfam Description: F-box domain
MALTPKFRLATAAPAPPSPTEAQQPAWETPLIPGLPDDAALGCLLRLPVEAHAACRLVCRRWRRHLADKARFFAQRRALGLRTPWLFTLAFHRCTGKIQWKVLDLGHLTWHAIPTMPCRDRACPRGFGCVAIPSDGTLLVCGGLVSDMDCPLHLVLKYDIYRNRWTVMTRMLAARSFFAGGVIDGRVYVAGGYSTNQFELNSAEVLDPDKGVWQPIASMGINMASSDSAVISGRLYVTEGCAWPFFSSPRGQVYDPKIDRWEAMPVGMREGWTGQSVVIDGHLFVISEYERMKVKIYDPQTDSWDSVSGPPMPERIMKPFSVSCLDSKIVVVGRGLHVAIGYVEKQPAAGGNSGSRSSSYSICWQDVDVPKEFSDLTPSSSQILHA

SEQ ID NO: 17398 - DNA, 615 bp, Panicum virgatum
  misc_feature: Ceres CLONE 1792230
  misc_feature: Encodes the peptide sequence at SEQ ID NO. 17399
atcttctggaaacccagccccgtattctatccgctccaccaatcctcggccaccccgtgctggtactgctcctccaacctaacggtggactcaaatcacatggcggcatggtcgtcgtcaccatcccttcgccaccacctcctcctccgcccgcgcgtacctctcggaccacctgatctcgcgtgctccttctccggccgatgcatccgcagacacagccgccgccgcctcttctcctccgcttcctcctctacgctgacccacggccaccacgcctccacccatgccgatgccgaccgcgtcgtcgacgtctgcccgccgcgcggcacccgggacttccccccggacgacatgcgcctccccacctgtctgttcgatcacttcagggacgtctcccgcctcatggccttcgaggaggtggacttccccgtcctcgaatccgaggcgctcttcgtccgaaaggaaggggaggagatcacgcagcatctctaccacttccatgataaaggaggtcgccgtgttgttctcatgccccaactcaccccttcccttgcgcgcctagtaataaagcacgggacaatgttggcgatacgagtcaatgaccagaggaacaat

SEQ ID NO: 17399 - protein, 171 aa, Panicum virgatum
  misc_feature: Ceres CLONE 1792230
  misc_feature: SWISSPROT Homolog: EC 6.1.1.21 Histidine--tRNA ligase
MAAWSSSPSLRHHLLLRPRVPLGPPDLACSFSGRCIRRHSRRRLFSSASSSTLTHGHHASTHADADRVVDVCPPRGTRDFPPDDMRLPTCLFDHFRDVSRLMAFEEVDFPVLESEALFVRKEGEEITQHLYHFHDKGGRRVVLMPQLTPSLARLVIKHGTMLAIRVNDQRN

SEQ ID NO: 17400 - DNA, 669 bp, Panicum virgatum
  misc_feature: Ceres CLONE 1792241-R
  misc_feature: Encodes the peptide sequence at SEQ ID NO. 17401
ccccttacacccgcaggaatggtagttgccaagatatcaacgagtgtttgaagataccctacttatgtaatgaaacatgccataacctggaaggaagctacaattgcaccagctgccctcaaggcacatctttcgatcctgtagaaaggcaatgcactcccagtaaacatcacagccttgtttttgctgttgctattggacttggctctggctttggagtcttggctctcacgttaagtacaaccatattaatccaacaatggaggagacacatccgaaggacaattcgaagggcacacttccggagaaacaaaggcctactcctggagcagctaatcttgtctgaggaaactgctacccagagcacaaaaatattttccttagaagaactggagatgacaacaaatagctttgactcgacacgaattgttggctgtggtggtcatggtacagtttacaagggcattttatcagatcaacgtgtggtagccatcaaaaggtccaaaatcgtggagcagagtgagatcgatcaatttataaatgaggttgccatcttgtctcaaattattcatcgcaatgtgatgaagctttttggctgctgccttgaatctgatgtacctttgcttgtgtacgaattcatctcgaatggcacactttatgatcttcttc

SEQ ID NO: 17401 - protein, 222 aa, Panicum virgatum
  misc_feature: Ceres CLONE 1792241-R
  misc_feature (11)..(51): Pfam Name: EGF_CA Pfam Description: Calcium binding EGF domain
  misc_feature: SWISSPROT Homolog: EC 2.7.11.1 Non-specific serine/threonine protein kinase
PYTRRNGSCQDINECLKIPYLCNETCHNLEGSYNCTSCPQGTSFDPVERQCTPSKHHSLVFAVAIGLGSGFGVLALTLSTTILIQQWRRHIRRTIRRAHFRRNKGLLLEQLILSEETATQSTKIFSLEELEMTTNSFDSTRIVGCGGHGTVYKGILSDQRVVAIKRSKIVEQSEIDQFINEVAILSQIIHRNVMKLFGCCLESDVPLLVYEFISNGTLYDLL

SEQ ID NO: 17402 - DNA, 580 bp, Panicum virgatum
  misc_feature: Ceres CLONE 1792241
agttaagatcctgaaacacaagtacactagaatcccgcgcgcaagctagagtaggaaactttgtagcaacatgcctcgtatggaggcatctactaccatccgcgctacccagcggtggtggttcgagttattggcatgcctagccctcatggctgcagccaccgccgtgctgggggtatctgccgcgccccccaccgccgccgacctcgcgcactgccccaaatcctgtggaggcgtttacatctcgtaccccttcggcatcgggcggggctgcttccgcccgggcttcgaggtcacctgcaacaacagcaccagacctcccaaactcttcctggccaacaccacgactaccaccgagatcgtccagcaatatccatggggcgctgctgacgcgtctatcgtcttcaacaccgccaccaggccaagtgcgtctggcaattacagctggtcgtgggaggctcctggaaagaaccttattatctttgaagacacagctgtggtaattgtcgggtgcggcgttgaggcctttttgttcgaccacaataatactggtcccggcaacctgatgggatactgcacc

SEQ ID NO: 17403 - DNA, 1234 bp, Panicum virgatum
  misc_feature: Ceres CLONE 1792243
  misc_feature: Encodes the peptide sequence at SEQ ID NO. 17404
acgccacagaaataagctcacgagacctcccattccatctccggctgagaaaggcgaaagccggaaaaatatcgccatggctatcctcgccgtcgcctccctgctcaaaaccctaaaccctagccctgcgggccaccgcaacaggcgcctctcctcttccctgctccgcctcccgccgccggtgccacgagggcgccgcccccggtgctccgcgcggtacggcgggcccgcggcgccgcccacgacgacgacgcggcccgcggagataccttggagcagggagctctgcaactcggtgcggctcatcggaacggtgggcaccgaggtcgaactgcgtcagctgcccagcggctccgccgtcgcgaggggtcgcctcgccgtctggaagtcggccaccgagactacatgggtgactctacaattttgggatgacctggctcatgtggcctctgagcatgtgaagaagggtgaccggatatatgtttcaggacggcttgtgtcagatactgttgatgaggggcctgagaagcggcatgtttactacaaggttgcagttcaagagttaaatttcatcgagtccatgcagcctgttcgattatatgaactagaggcaagccaggataccccaggtggaaggcgtggtgattattttgattctacctctagttcaactgaggataacaataaggataatatcagttcttctcgatcaactgaagagctgtggcaggccttctttgctaatccacttgagtggtgggataacaggacaaataagaagaacccaaggtatccagatttcaagcataagcacactggtgaagccctgtggattgatgggaggaacaaccccaactgggttgtatctcagctggcagttttggactcaagaatgggttctctgcaagacaaagagagaaaaccagtctcctatatgtatgcggacgagttcatgacattggacggcaatcgatagtcaatagtggaggaagcctcagtccccatttgcatgctgttgtgtcgaaagcgatcaaatctggctagttcatggatgttgtctcagttttgttgtacatatctgggagcttgatggttttgtcagggaggtgaacttgatggattatcagggaggtggacgggcggccgtcggtagtattatgtagtactctgtagcttagctatgacaaacatacggatagtaattggagaaggccttgttgtttatttgtttgac

SEQ ID NO: 17404 - protein, 299 aa, Panicum virgatum
  misc_feature: Ceres CLONE 1792243
  misc_feature (71)..(166): Pfam Name: SSB Pfam Description: Single-strand binding protein family
MAILAVASLLKTLNPSPAGHRNRRLSSSLLRLPPPVPRGRRPRCSARYGGPAAPPTTTTRPAEIPWSRELCNSVRLIGTVGTEVELRQLPSGSAVARGRLAVWKSATETTWVTLQFWDDLAHVASEHVKKGDRIYVSGRLVSDTVDEGPEKRHVYYKVAVQELNFIESMQPVRLYELEASQDTPGGRRGDYFDSTSSSTEDNNKDNISSSRSTEELWQAFFANPLEWWDNRTNKKNPRYPDFKHKHTGEALWIDGRNNPNWVVSQLAVLDSRMGSLQDKERKPVSYMYADEFMTLDGNR

SEQ ID NO: 17405 - DNA, 2095 bp, Panicum virgatum
  misc_feature: Ceres CLONE 1792266
  misc_feature: Encodes the peptide sequence at SEQ ID NO. 17406
aaaacccctcccttccgttccgcctccctttcccctcgctcctcctcgccgccgccatgctccgcgccgccctcacctccggcggcggccgcctcgccgccatcctcccccgacaccatgcccgcctcctctcctcatcctccaccatcgccgccctcttctccgatcccacccctcccgcggaccccgccgccgcgatccagtccgccggcgtcgatctctcccacccggacaccgtccccgcgctcctcctcgacccggggctcgcgggaaactaccccgcggcctcccgcttcttctcttgggccgcctccgaccccgccgccaaggccgcgctcaactcgcggtccttcaactccatgctccagctcgccgccgcgcacggcgacgccgaccgcttctggtctctcgtcgcctccatgcggtctaggggctacgggatctccaagcccgccttccgggccgcctccgagagcttccgggccaaggacatggccagggacgccgacctgctgcaggaggcattcgccgcgcacggcaggaacgcggcggcggccgaggtatgcaagattctacgggcgccgggcaaggatgacacccagaagctagccatgctgagtgaatcgagtgttgaggtgactgatgagctggtggcattagtggtggagaaggtcgggcagttcccgcagcaggcgatggtgttcttccggtgggtggagcagacagctggagctgggataagttggggcaaggtttacaatgcgatggccaaggttctcggccgtgaggatcgcatcgaggagttccgggaggtcctgcggaagatgaggggcaaggggcttgagatggatcgagatgtgtatgttactgtcaccgacaggttcctcaagaggaagatggttgaggatattgtggacctgttccaattcatgacaagcagaccggagaagctcttgagggatgatttcatattcttgctgaagaaggtcctagtgactggtgacttggatctcaagttggtgacgagagtcttgcggtactatcgccatgtgggcagcaaggtcaaagactcagcttttgattctgttctcaagtcgttgaggagtgtagggaggcttggggagagtggcagagttctgaaggcgatgcaggaaggtggtttcgaaccggatagtactgatcatgaaaaggctgttcttgcaatgtgtgatgctggcaatctggaagaagcacggaattatttgacaggtgtggaagagtcagggcataagttgggtccaaagatatggccttgtttagttcagaagtattctcttggtgaaaatgtggatacagcagtgtcgtgcttccatgaaatgctggaaaaaagcggcagcgagaatgtgggttctactcttgaggtgctggtttctggattgcacaagaagaaaggggcgaaggaagcattcaaagttctgaagaacatggtaacagagaaggctgtggttccttggcaaactacctacaagtatttgatccacaagttaatccgccaaggacatctgaaaccagcttttgaagtgctaggtttaatgaaaagccatggttatccacctttcgttgatccttttatccctcatatttcaaaatctgggactgtggatgatgccttgggttttctgaatgcaacatctttgagggggttgccgtcaagaatagtttatgtgcgcttatttcaagctttgttcaaagaagagaggcatgaagttgcccaacagctgctttcccagtctcctgctggcatccaaaaccatgcagatattcgtgatattttcaataagctggaagaacctgttgcagcggccttggcagagggttgatacgtggctaaattgagtttttgatgcccacatttggatggcaagctgataccagaaactttagatgaaatgcttgcactatttccaaagaaataagttacattattttctttagtttctttctgtttcagccacatatttccatgccttaaactggcagggccgtatgaatcaatagctgttgtctttgtactgctttgttactggaagatgcaaaagattggttcttatctttc

SEQ ID NO: 17406 - protein, 600 aa, Panicum virgatum
  misc_feature: Ceres CLONE 1792266
  misc_feature (232)..(266): Pfam Name: PPR Pfam Description: PPR repeat
MLRAALTSGGGRLAAILPRHHARLLSSSSTIAALFSDPTPPADPAAAIQSAGVDLSHPDTVPALLLDPGLAGNYPAASRFFSWAASDPAAKAALNSRSFNSMLQLAAAHGDADRFWSLVASMRSRGYGISKPAFRAASESFRAKDMARDADLLQEAFAAHGRNAAAAEVCKILRAPGKDDTQKLAMLSESSVEVTDELVALVVEKVGQFPQQAMVFFRWVEQTAGAGISWGKVYNAMAKVLGREDRIEEFREVLRKMRGKGLEMDRDVYVTVTDRFLKRKMVEDIVDLFQFMTSRPEKLLRDDFIFLLKKVLVTGDLDLKLVTRVLRYYRHVGSKVKDSAFDSVLKSLRSVGRLGESGRVLKAMQEGGFEPDSTDHEKAVLAMCDAGNLEEARNYLTGVEESGHKLGPKIWPCLVQKYSLGENVDTAVSCFHEMLEKSGSENVGSTLEVLVSGLHKKKGAKEAFKVLKNMVTEKAVVPWQTTYKYLIHKLIRQGHLKPAFEVLGLMKSHGYPPFVDPFIPHISKSGTVDDALGFLNATSLRGLPSRIVYVRLFQALFKEERHEVAQQLLSQSPAGIQNHADIRDIFNKLEEPVAAALAEG

SEQ ID NO: 17407 - DNA, 1326 bp, Panicum virgatum
  misc_feature: Ceres CLONE 1792268
  misc_feature: Encodes the peptide sequence at SEQ ID NO. 17408
ttccggctggcgcgtctccctcctcccctccccctagcaagctatcccagccaggtatgcctgtaggctcagccccgccataacccctcattcatggccattaccacgatgtgtcaccccacgccaccacccccttcgctgctgcccccctaaccctgctgctcgcgctttggagctttgcttttgcccctccccattaatcacttgctggctctctctcggctcggcgcgctgccctgcctcccgtctcgtgctccgcgctcgtgcccgcagccgcagccatgacggggatcgacctcaacgactccgtggaggacgacgaggaggaggcggaggccggccacgcctgctcccagcagagccggtccagctccgccgccacggggacggggaccccgccgccaccccagccgggcccgggcgccgcggtgtgcgtgtgcctcgagctgtggcacgcgtgcgccggccccgtcgcgtcactgccgcggaagggcagcgccgtggtgtacctcccgcagggccacctcgagcacctcggcgacgccgcctcggctgcggcgggtggcggcgccgtgccgccccacgtcttctgccgcgtggtcgacctcaccctccatgcggacgcgtccacggacgaggtgtacgcgcagctcgccctcgtcgccgagaacgaggaggtcgcgaggcggctgcgcggagggtcggaagacgggagcggcggagacggcgacggcgaggacggggacaacgtgaggcagcggttctcgcggatgccgcacatgttctgcaagacgctcacggcgtccgacaccagcacgcacggcggcttctccgtgccgcgccgcgccgccgaggactgcttcccgcctctggattacagccagcagcggccgtcgcaggaactcgtcgccaaggatttgcacggaaccgagtggaggttccgccacatctatcgaggtcagccccgcaggcaccttttaaccacaggatggagtgcatttgtcaacaagaagaagcttgtctcaggggacgccgtactatttctgaggggagatgatggcgagctaagacttggagtgcgccgtgcagctcagctcaaaaatggatctgcttttccagcgctttataatcagtattcaaatcttggttcgctagctaacatagcacatgctgttgccacaaaaagtgtgttccatatctactataaccccagattaagtcaatctgaattcattataccatattcgaagttcatgaagagcttcagtcaaccattttctgctggattgaggttcaaaatgagatatgagagtgatgatgctacgg

SEQ ID NO: 17408 - protein, 348 aa, Panicum virgatum
  misc_feature: Ceres CLONE 1792268
  misc_feature (167)..(272): Pfam Name: B3 Pfam Description: B3 DNA binding domain
  misc_feature (294)..(348): Pfam Name: Auxin_resp Pfam Description: Auxin response factor
  misc_feature: The sequence is a functional homolog of SEQ ID NO 696 in the 11/479,226 US patent application
  misc_feature: The sequence is a functional homolog of SEQ ID NO 2380 in the 10/374,780 US patent application
  misc_feature: The sequence is a functional homolog of SEQ ID NO 962 in the 10/225,066 US patent application
  misc_feature: The sequence is a functional homolog of SEQ ID NO 108 in the 10/225,066 US patent application
  misc_feature: The sequence is a functional homolog of SEQ ID NO 296 in the 10/412,699 US patent application
  misc_feature: The sequence is a functional homolog of SEQ ID NO 692 in the 11/479,226 US patent application
  misc_feature: The sequence is a functional homolog of SEQ ID NO 84 in the 10/374,780 US patent application
  misc_feature: Useful for making plants with modulated seed size
  misc_feature: Useful for making plants with modulated biomass
MTGIDLNDSVEDDEEEAEAGHACSQQSRSSSAATGTGTPPPPQPGPGAAVCVCLELWHACAGPVASLPRKGSAVVYLPQGHLEHLGDAASAAAGGGAVPPHVFCRVVDLTLHADASTDEVYAQLALVAENEEVARRLRGGSEDGSGGDGDGEDGDNVRQRFSRMPHMFCKTLTASDTSTHGGFSVPRRAAEDCFPPLDYSQQRPSQELVAKDLHGTEWRFRHIYRGQPRRHLLTTGWSAFVNKKKLVSGDAVLFLRGDDGELRLGVRRAAQLKNGSAFPALYNQYSNLGSLANIAHAVATKSVFHIYYNPRLSQSEFIIPYSKFMKSFSQPFSAGLRFKMRYESDDAT

SEQ ID NO: 17409 - DNA, 726 bp, Panicum virgatum
  misc_feature: Ceres CLONE 1792269
  misc_feature: Encodes the peptide sequence at SEQ ID NO. 17410
gtcgtcgaaaccatttgcccctcccaaatcgaggaaaccctagcccccaaatctctcatcataccgcagcagcagcagcagctgtcgccgccgctccaatccccccttacttccccagctccgctcgctagatccatacatgatgggagaggcaaaggagaacgacgtctacgaggaggagctcctggactacgaggaggacgacgacaagacagtcgatggctccgccgccaagcccaccggagaggtcgcgaagaagggctacgtcggcatccacagttccgtgttcagagacttccttctcaagccagagctgcttcgtgctatccaggactgcggttttgagcatccatccgaagtgcaacacgagtgcatccctcaagcaattcttgggatggatgtcatatgccaagcaaaatctgggatggggaagactgcagtttttgtcctttcatctctccaacagattgaccctgttgcgggtcaagtagcagcacttgtgttgtgccacacaagggaactggcctaccagatctgccatgagtttgagaggttcagcaaatatctgcctgaagttaaagttgctgtcttctacggaggagttcacatcaggaagcataaagatttgctgaagaatgagtgccctcatattgttgttggcacacctgggaggatacttgctcttgccagagagaaggatctctcactcgagaatgtgcggcattt

SEQ ID NO: 17410 - protein, 195 aa, Panicum virgatum
  misc_feature: Ceres CLONE 1792269
  misc_feature (72)..(193): Pfam Name: DEAD Pfam Description: DEAD/DEAH box helicase
  misc_feature: Useful for biocontainment applications
  misc_feature: Useful for making plants with modulated biomass
  misc_feature: Useful for making plants with modulated cold sensitivity
MMGEAKENDVYEEELLDYEEDDDKTVDGSAAKPTGEVAKKGYVGIHSSVFRDFLLKPELLRAIQDCGFEHPSEVQHECIPQAILGMDVICQAKSGMGKTAVFVLSSLQQIDPVAGQVAALVLCHTRELAYQICHEFERFSKYLPEVKVAVFYGGVHIRKHKDLLKNECPHIVVGTPGRILALAREKDLSLENVRH

SEQ ID NO: 17411 - DNA, 1815 bp, Panicum virgatum
  misc_feature: Ceres CLONE 1792274
  misc_feature: Encodes the peptide sequence at SEQ ID NO. 17412
gagctgtcccctacctgtgcgcttgcctcttgcgcgcttgcgagcttgcttcccctcctgccgcctccccctcctcccccgtctctcctctgattctccctgttctctgccgcagcaaggctaggcgcgaggagggagagggtgtcgtgccgtgcaaggctctacagcagcgggaggtccgcggcgcagcgagctcgccgccgtgcctggggacacaggagcttcatacattttgcaagaccactgaaacatcggaacattcacacactcaagagatcacacttgataaaactgcggtggggtcaactctaataagtcatcaaaatgtgtgctgtactgctgaattatcagggaagaacacagaaatcatggaaatcagcttattgcaggatgaatctgatgcagcaaccaccactttgctaccactgccactgttgtcatgcagccctagatctatggctccaatatcagtaccatcatcatctgatcttgagagtatcctctcgccagatccaatcttcagtgatcttcagttgaaggagataaactacaatgctccagcaatggacgaaagcactgagctccttcacctgattcttagtggcaacgatgaagtatacaataatacagctgaattccaagtctgggatgctctggacttctatgtgacagaaaacttttctactttccagtttgatagtttaatgggtttttcaaatgaagttagtacttcctacaatgactgtatgaatttagttgacatggtagagcggcctgtggctctcttgtctctagatgactcaccggagccaaatagcactagcattgaggttccggtagatcacactacactggaccctgatgacacatccttgtaccttcagacgaaaccaacagattcagaaactgaaagtagttctgccgctggggatgcggttgaaactgaatatcttgatcaaaagctactttctagaggtctgcctgatttaatggatgttgactcgcccagtggcttaacaaaaacaccagtgagaacaaaacaagtgactcttgtgctggatttggatgagactcttgtacattcaacattggatcactgcgacaatgctgattttactctagaagttttctttaatatgaaaaatcatacagtctatgtgagaaaaaggccttacttgaagatgtttcttgagaaggttgcccagatgtttgagcttgtcattttcacagctagtcagagaatctatgctgaacagcttatagatagacttgatcctgatgggaaatatatttcacggcgaatttaccgtgaatcatgtttattctctgatggttgctatacaaaggacttgacaattctaggggtcgacttggcaaaagttgcaataattgacaatactccacaggttttccagttgcaagtggataacggcataccaatcaagagctggtttgatgacccctcagatcaggaattggttgagttactcccgttcctagagagcctcgtggatgcagaggatgttaggccaatgatctcaaagaccttccacaacaaacttaagcagaattagttttagaggcatacatatcaatcgtttcatctggtgatagaacattaggccattcttgggtaattaggtataggatcaggattcgtcatttatgttatgttagctgttacaaatagcaagcataaactgcagttgtcgacaaaaatggattgtatatgtttcttcggttttcagtgttacagatcattgtacagaaaacggacaatagtgctgaataaatgatctgagtgcaattttgctt

SEQ ID NO: 17412 - protein, 523 aa, Panicum virgatum
  misc_feature: Ceres CLONE 1792274
  misc_feature (339)..(514): Pfam Name: NIF Pfam Description: NLI interacting factor-like phosphatase
  misc_feature: SWISSPROT Homolog: EC 3.1.3.16 Phosphoprotein phosphatase
AVPYLCACLLRACELASPPAASPSSPVSPLILPVLCRSKARREEGEGVVPCKALQQREVRGAASSPPCLGTQELHTFCKTTETSEHSHTQEITLDKTAVGSTLISHQNVCCTAELSGKNTEIMEISLLQDESDAATTTLLPLPLLSCSPRSMAPISVPSSSDLESILSPDPIFSDLQLKEINYNAPAMDESTELLHLILSGNDEVYNNTAEFQVWDALDFYVTENFSTFQFDSLMGFSNEVSTSYNDCMNLVDMVERPVALLSLDDSPEPNSTSIEVPVDHTTLDPDDTSLYLQTKPTDSETESSSAAGDAVETEYLDQKLLSRGLPDLMDVDSPSGLTKTPVRTKQVTLVLDLDETLVHSTLDHCDNADFTLEVFFNMKNHTVYVRKRPYLKMFLEKVAQMFELVIFTASQRIYAEQLIDRLDPDGKYISRRIYRESCLFSDGCYTKDLTILGVDLAKVAIIDNTPQVFQLQVDNGIPIKSWFDDPSDQELVELLPFLESLVDAEDVRPMISKTFHNKLKQN

SEQ ID NO: 17413 - DNA, 1644 bp, Panicum virgatum
  misc_feature: Ceres CLONE 1792287
  misc_feature: Encodes the peptide sequence at SEQ ID NO. 17414
gcaccacacaggcagaccacgcgcagatccaaacgcgacccgagcccgaccaaaccctaagccccgcctccccctccccctccgcgcgagccatggccaagtacggcgagggcgacaagcggtggatcgtggaggagcgcgccgacggcaccaacgtccacaactggcactgggcggagcgcgactgcctcgagtggtcccgcgcgcggctctcctccctgctcgcgggcctcaccgtcctcgacggcgagggcggcctcacgctccgcaccgtcgcgctcgacaagctcgacggcgaggcctacgtcaacatccgcaagggcaaggtcatcccggggtacgagctctccctcaccctctcctgggaggccgaggccgcctccgaggccggcgccgccaaggtcgccggcgccgctgaggtcccctacctcgccgacgagaacgccgacgaggaccccgacctccgcgtcaccgtccgcggtgacgagaccccgctcgcgcgccgcgccaaggacgccttcctcgcccgcggcaagcccctcgtcctcgagaagatccgcgagttcgtcgccgccatggccaagggcggcccggccaaggacgagctcgagtccaagaagacccccaccaagggcgccgcccccgccgccgcgcctggcgccgcccaggctgccaaggagcaggtccccgctcccgcgccggcggccaaggagaagaaggccaaggggaaggacaaggaggggttcaagacgattgagaggacggagaagttctactgccgcgccaaggacatatatgagatcttgatggatgagaacagatggaaggggttcacgcagagcaatgccaggatcagcagagaggttggaggggaattcagcctatttgatggctccatcaccggcgtcaatgaggagctgcaggaagggaagctgattgcccagaaatggcggtttgggagctggccagacggcctatattcctcggtgaggttggtcttcgatgagcctgaatctggagttacaatcataaagctcaaacaaactgatgtgcctgaggaagacaagtatggtaattcaactgtggtggagaacacggagaggggctggagagaactcattttccagcggatacgcggagtgtttggttttgggatctaaagaagtgatacaacctgaagctgggtctctaatttttattgagtcgggccttggatgccatagttgtccatgttttactcacccagttattccatgttgttaaaaggcaaaactcagcataccatgggggttaaaaacatcttttattcatcatgctagaatgcgtctgcttcatactcttgtttggttagtaaacatgattgcgtgtctgccagtgtcagaggatgacacgagtaatggaccgtagataaagggtgccgttgattcgagttagttttatgactgaagtatcgtatcagctattcgcttactgtctccagcctcgttttcgatcaggtataaagtataatgccagttgtgtgatgtggcagatcggatcagaggttgagtactcacaacctgagtaccgttgttcggtgttttgtaagcgtgcctccagcttataggattcatcacttgatttgattcaaactcattctagttt

SEQ ID NO: 17414 - protein, 355 aa, Panicum virgatum
  misc_feature: Ceres CLONE 1792287
  misc_feature (29)..(164): Pfam Name: Aha1_N Pfam Description: Activator of Hsp90 ATPase, N-terminal
MAKYGEGDKRWIVEERADGTNVHNWHWAERDCLEWSRARLSSLLAGLTVLDGEGGLTLRTVALDKLDGEAYVNIRKGKVIPGYELSLTLSWEAEAASEAGAAKVAGAAEVPYLADENADEDPDLRVTVRGDETPLARRAKDAFLARGKPLVLEKIREFVAAMAKGGPAKDELESKKTPTKGAAPAAAPGAAQAAKEQVPAPAPAAKEKKAKGKDKEGFKTIERTEKFYCRAKDIYEILMDENRWKGFTQSNARISREVGGEFSLFDGSITGVNEELQEGKLIAQKWRFGSWPDGLYSSVRLVFDEPESGVTIIKLKQTDVPEEDKYGNSTVVENTERGWRELIFQRIRGVFGFGI

SEQ ID NO: 17415 - DNA, 693 bp, Panicum virgatum
  misc_feature: Ceres CLONE 1792301
  misc_feature: Encodes the peptide sequence at SEQ ID NO. 17416
gaatagcactgcctccaacgagaccctaggtgtgcaaatcctcaagtcccgtggaatattcccagaagcaaagtggtactggattggctttggtgcaatgattgggttcaccatactcttcaatgctctcttcactcttgcccttacatacctcaaaccatatggcaattctcggccatcagtatctgaagaggagctgaaagagaagcatgccaacatgaaaggcgaggttctggatggcaatcacctggcatcagcaagtagtcatcgatcaacaggaatgaacatcgaaactgatccggcaatcgtggaagatgattctgccctgactaaacggggaatgatactcccatttgtcccgctttcactcacctttgataacatcagatactctgttgacatgccacaggaaatgaaagcacaaggtgtacaagaagatcgtctggagctcctcaaaggtgtcagtgggtcatttaggcctggtgtgctgaccgcactaatgggcgtcagtggcgcaggaaaaactactttgatggatgtgttggccggaagaaagacaggtggatacattgaaggagacatcagcatttcaggatacccgaagaaacaagagaccttcgcacgcgtatcaggatactgtgaacaaaatgatatccactcaccgcaggtgacagtctatgagtcactgctttt

SEQ ID NO: 17416 - protein, 230 aa, Panicum virgatum
  misc_feature: Ceres CLONE 1792301
  misc_feature (1)..(62): Pfam Name: PDR_assoc Pfam Description: Plant PDR ABC transporter associated
  misc_feature: SWISSPROT Homolog: EC 3.6.3.27 Phosphate-transporting ATPase
NSTASNETLGVQILKSRGIFPEAKWYWIGFGAMIGFTILFNALFTLALTYLKPYGNSRPSVSEEELKEKHANMKGEVLDGNHLASASSHRSTGMNIETDPAIVEDDSALTKRGMILPFVPLSLTFDNIRYSVDMPQEMKAQGVQEDRLELLKGVSGSFRPGVLTALMGVSGAGKTTLMDVLAGRKTGGYIEGDISISGYPKKQETFARVSGYCEQNDIHSPQVTVYESLL

SEQ ID NO: 17417 - DNA, 1286 bp, Panicum virgatum
  misc_feature: Ceres CLONE 1792307
  misc_feature: Encodes the peptide sequence at SEQ ID NO. 17418
ataaaatgctcgattcttcgcctacccgcccccgtctcgcccacccgctcgcgccgccgccgtcgccgcattactctgcgaatagccctccgcggcggtttcgagcttcccccccaggccccagcaatgacgttcaagcggaggaatggcgggcgcaacaagcacgggcgtggccacgtcaagtacatccgctgctccaactgcgccaagtgctgccccaaggacaaggccatcaaacggttcttagtgaggaacatcgttgagcaggctgcggtgagagatgtgcaggaggcttgtgtgcatgatggatatgttcttcccaagctgtacgcaaaggttcatcactgtgtctcatgcgcaatccatgcacacattgttcgtgttcgttctcgtgagaacaggaggaaccgtgagcctccgcagcgcttcaggcgcagggtataattctaaggatgcttttcactgcatctgtattgtcttttttttggctgaaattgaaggtcattttctgataattccattgaaagtactacaaacatgactggtggtttaacagtttgttccaatcacctggtcattcttttatggtctaatccaatcacttggtgtttgttttatgctattatcgcttttataggcgttgcattcactgtgcatatgttgcaatggatgcgtcaaygaaagcgtaaattagcatgtgttggtgcattgcataraytgatccattattcagtcataacttcctgaatgcacacattgctgtataaattttacaaagttttgtttttacttgataaacctatttttattctcagattatgcactgtcttactagtcaatgatgttcgattatcttctcctttaccttgcctccaaaaactgaaagctgattgaggatccagatgtctacgttatatctggttcttttggataaatactattgtgctatatgatatttgccagacttatggaccttcatgacaatctttcttgttttgctttacctgcgttacaggatgatggcccgaggccaggccaaggtccgccccgcccaggtggtggcgcacctcccgctgtggctcccgctgctcctcgcacctaagttgtttcagggcttagttttatcaccgatgggataatagactattccttttttgagatgagcaacattgctgtatcctgttcattttgtttaacacaatttttgtctgctcccactcttgttcatccatgttcgtggtgacactgatatattgcaatatgaagctgttggttttgccggttgc

SEQ ID NO: 17418 - protein, 105 aa, Panicum virgatum
  misc_feature: Ceres CLONE 1792307
  misc_feature (1)..(105): Pfam Name: Ribosomal_S26e Pfam Description: Ribosomal protein S26e
  misc_feature: Useful for making plants with modulated nitrogen use efficiency
MTFKRRNGGRNKHGRGHVKYIRCSNCAKCCPKDKAIKRFLVRNIVEQAAVRDVQEACVHDGYVLPKLYAKVHHCVSCAIHAHIVRVRSRENRRNREPPQRFRRRV

SEQ ID NO: 17419 - DNA, 2259 bp, Panicum virgatum
  misc_feature: Ceres CLONE 1792309
  misc_feature: Encodes the peptide sequence at SEQ ID NO. 17420
aaccaaacctcctgcgttgcccatcagcttcttctccccctccccctaccacaccacctccctcccaaatccgtccgcggcataaatttcttcgaccttcacctctccgaatccttctccatctcctcctcgaattccgcttcttggattcgatcccctcctacggcgttcttcctttccctcgcttttttttttattattctccgtagttgggagccgcccaggaactggagttcttggttccctgatccaaactgctccaattccgcgaggtagcgcggaaagattgaattttgaggtctttccgactggtttagacggattaatcggagaagccgtcggggaacttaatttggtttctgacctaaggcggtgaaaagtttggcttcttggtgatggagcaggagaagcagcagagggtggagccgccggcgtcggcgccggcatctgtgccccaagcggcatcagagccaagggcgtcaccacagccgcaagagcagccgaagccggcggtaccggtgcagccttctatcccggtgacgaggccgtggccaatggccaccatcccttctgtgaagcctgtggttgaaatgaagagtggcaccccagccaagaaaaagaaacactgtaattgcaaaaactcacaatgtttaaagctgtattgcgagtgttttgcagcaggtgattattgtgatggttgcaattgtaaacaatgtggaaacactgttgagaatgaaaagggtagacaggaggccattaacaacacaaagctacggaatccgaacgcctttcaacctaagattgaaaatggtccaattattcccagtgttcggaaggatgctggagcaccaccttcacttccaaagcataataaaggttgtcactgcaagaagtcaggttgtttaaagaagtactgtgaatgtttccaagcaaatattctttgttccaagaattgtaaatgtatggattgcaagaacttcgaaggaagtgaggagctccgtgttataattcaaggggataattcatgtgatcgaaataacattcaacaagcagctaatgttgctctgaacggtgccattggatcttcaggatatagattttctccagttcgtagaaaaaggcctccagaagatccccattatcagagattaagtgttgaaggaagtatgacacagatgcagttttcagaggctaaccattttgatgcttcccaaattgcttcatctagtggacttgaaggttccactggcaatttccagtgtaaatctaaattggtctataggtctccacttgcaaacactatccatcttactgatgtgaacgccctagccaatcgtttggtgattgtatgcaaaaaggcagcagaaggattcacagcaatagctgataacaaagaggagatggaaatagatagggaaatttgcacaaatactgaccaaaactttgacgagaacaagaaagaagtccagaaagctgctgctagtcaactgacagaaatagatcagcaaattcctgcagaatgtggatcatattgctctaacacccaagtggattctaggcctgcttctccaggaacacgagctctgttgtgtgatgagcaggatctcacatttggaacagcttatagaagttcaattccagtggcattgcatgatcaggacatttcagagctacaaactgcacaagaaaatgcagtgttgagggagttcagaaattacctccggttaattattgcacgtggacaagtaaatgcagaaggaaaatcatcatcagggacagggatggaactggatgctatgaggaatcatgaatcaagcaccagtttacccccagtaaaagctgaagaaaaatccaatgatctggacgaccccaaaaatcctaacacaagccaatcgtttgcatcgacagtgtatcaacatacggattaaaatagacgtaggtcagattttgtatttttcatgtcaagatatgtattgtaccacagccaatctccgtgtacatatggatagtatagtccttattgcctgtaacggcaaccgaccatgtagctttagtcattcatgagatgttagcaggaaagaaaaatcatgctaatcatgtaattattttttattaataataattttctatatgatttttctgtttcagtctgaaatgttttttctttgcgagaaagtgtaagaaagttgatgttggaccttgccaggtgattgaaattgttgtaaaggtcttcaatattaaaccaattaggtgtgcttg

SEQ ID NO: 17420 - protein, 510 aa, Panicum virgatum
  misc_feature: Ceres CLONE 1792309
  misc_feature (157)..(198): Pfam Name: CXC Pfam Description: Tesmin/TSO1-like CXC domain
  misc_feature (73)..(113): Pfam Name: CXC Pfam Description: Tesmin/TSO1-like CXC domain
MEQEKQQRVEPPASAPASVPQAASEPRASPQPQEQPKPAVPVQPSIPVTRPWPMATIPSVKPVVEMKSGTPAKKKKHCNCKNSQCLKLYCECFAAGDYCDGCNCKQCGNTVENEKGRQEAINNTKLRNPNAFQPKIENGPIIPSVRKDAGAPPSLPKHNKGCHCKKSGCLKKYCECFQANILCSKNCKCMDCKNFEGSEELRVIIQGDNSCDRNNIQQAANVALNGAIGSSGYRFSPVRRKRPPEDPHYQRLSVEGSMTQMQFSEANHFDASQIASSSGLEGSTGNFQCKSKLVYRSPLANTIHLTDVNALANRLVIVCKKAAEGFTAIADNKEEMEIDREICTNTDQNFDENKKEVQKAAASQLTEIDQQIPAECGSYCSNTQVDSRPASPGTRALLCDEQDLTFGTAYRSSIPVALHDQDISELQTAQENAVLREFRNYLRLIIARGQVNAEGKSSSGTGMELDAMRNHESSTSLPPVKAEEKSNDLDDPKNPNTSQSFASTVYQHTD

SEQ ID NO: 17421 - DNA, 1625 bp, Panicum virgatum
  misc_feature: Ceres CLONE 1792310
  misc_feature: Encodes the peptide sequence at SEQ ID NO. 17422
atcttctttccctttcttgagatgagagcaacgtgctcctaagagcatcatcccattcccatagctgatagattgccccatttctagagctatcatcatagtgttccgtagggtggtctaccatggactgtgttctccatccatgaagctctattttttgttattaaaaaaacaactcttttagtgtttcttgaccagccggacattccatgattagctgacaagcaaacttgcttttgtttaactaatttttaatggttgctagattcggagacgccggcgcgggagtggaagccgctgtgcgacctcacgtcgaaccgccgcatcgactggtgcgagctcgacggcgacgtccgcgtgctcggcgccaacgccagcgtcaccctggttgcgccgcccggcgccgacggccgcgccttccgcgaggagtcgtggcgcatcaagccgtacccgcgcaaggccgacccgaacgccatgcgcaacgtccgcgtggtgacggtccggtcggtggccggcggtgcgccggcgtgcacggaccagcacgacgtgccggcgctggtgttctctgaccgcgggtacacgggcaactacttccacgcgtacacggacgtgatcctgccgctgttcctgacggcgcggcagtacgccggcgaggtgctgctgctggtgacggacctccagatgtggtgggtgggcaagttcctgccggtgttcaagagcatctccaactacgaggtgatcgacctggaccgcgacccgcgcgtgcactgcttccggcacgtccaggtcgggctcaccaaccacgacgacttcagcatcgacccgcgccgcgcgcccaacggctactccatgctcgacttcaccaagttcatgcgcaccacctacgggctcccgcgcgacgtcgcctggccggccgccgccaacgcgacggccggccggagccggccccggctgctgctgatcgcgcgggcgcggacacggcggttcgtgaacacggacgagatcgtgcgcggcgcggagaaggtcgggttcgaggtggtggtgtcggagggggagcacgaggtggcgccgttcgcggagcttgccaacagctgcgacgccatcatgggcgtgcacggcgcgggcttgaccaacatggtgttcgtgccgacgggcggggtggtgatccaggtggtgccgctgggcgggctggagttcgtggccggctacttccggggcccctccagggacatggggctgcgctacctcgagtaccggatcacgccggaggagagcacgctgatcgaccagtacccgcgcgaccacatcatcttcaccgacccggagggcgtcaagagcaagggctgggagtccctcaagagcgcctacctcgacaagcaggacgtgcggctggacatgaagaggttccggccgacgctcaagaaggccatcgcgcacctcaggaaggccaaagccgacgccaactaagctgccgtcgctgtgcatgtgttcatccatcctctttgttttcttttcttctttttggattaaattatgtcggtgtacgtagcaaacagaaatcgaccgagcaaggtgtatgatatggcaggagaaaaagaaatttagagcagttttatgttcagttt

SEQ ID NO: 17422 - protein, 330 aa, Panicum virgatum
  misc_feature: Ceres CLONE 1792310
  misc_feature: Useful for making plants with altered carbohydrate content
MRNVRVVTVRSVAGGAPACTDQHDVPALVFSDRGYTGNYFHAYTDVILPLFLTARQYAGEVLLLVTDLQMWWVGKFLPVFKSISNYEVIDLDRDPRVHCFRHVQVGLTNHDDFSIDPRRAPNGYSMLDFTKFMRTTYGLPRDVAWPAAANATAGRSRPRLLLIARARTRRFVNTDEIVRGAEKVGFEVVVSEGEHEVAPFAELANSCDAIMGVHGAGLTNMVFVPTGGVVIQVVPLGGLEFVAGYFRGPSRDMGLRYLEYRITPEESTLIDQYPRDHIIFTDPEGVKSKGWESLKSAYLDKQDVRLDMKRFRPTLKKAIAHLRKAKADAN

SEQ ID NO: 17423 - DNA, 732 bp, Panicum virgatum
  misc_feature: Ceres CLONE 1792312
  misc_feature: Encodes the peptide sequence at SEQ ID NO. 17424
ctccgatcccccgtttccctcacctctcagctctagcgcgcgcggcagagagagctagagagacagagagaggaccgggaggctgcgcgcgcgcgcgggtcaaagcaaggagcttggtgttgtgaatggtgaagggcgaggcggaggcggagtgcacgcgggcgtcgctgctggggaggtatgagatcgggcgcaccctcggggagggcaacttcggcaaggtcaagtacgcgcgccacaccgccaccggcgcccacttcgccatcaagatcctcgaccgcagcaagatcctctcgctccgcatcgacgaccagataaggagggagatcgggacgctgaagctgctcaagcacccgaatgtcgtccgcctgcacgaggttgctgctagcaaaacgaagatttacatggtgcttgagttcgtcgacggcggcgagctctttgacaagattgtaagccaccaaaaactgcatcgcagatgtttgtttatttttcatgtagaaaccagtgccacatgttttctaacgctgttttttccccttccgctgcaactctgaaaggctgtaaagaggaaactgtctgaacatgagggaaggaggcttttccagcagctaattgacggcgcgagctactgccacgataaaggtgtctaccacagggaccttaagccagagaacgttcttgttgatcggaaggacaacatcaagatctccgacttcggccttagtgctctac

SEQ ID NO: 17424 - protein, 142 aa, Panicum virgatum
  misc_feature: Ceres CLONE 1792312
  misc_feature (19)..(142): Pfam Name: Pkinase Pfam Description: Protein kinase domain
  misc_feature: SWISSPROT Homolog: EC 2.7.11.1 Non-specific serine/threonine protein kinase
MVKGEAEAECTRASLLGRYEIGRTLGEGNFGKVKYARHTATGAHFAIKILDRSKILSLRIDDQIRREIGTLKLLKHPNVVRLHEVAASKTKIYMVLEFVDGGELFDKIVSHQKLHRRCLFIFHVETSATCFLTLFFPLPLQL

SEQ ID NO: 17425 - DNA, 697 bp, Panicum virgatum
  misc_feature: Ceres CLONE 1792312-R
  misc_feature: Encodes the peptide sequence at SEQ ID NO. 17426
catacgatgacgatgaagatttacttcctagttcagttctcccaatcaaagagcaaattgatgaatcagcacaagaaaagcctactcatatcaacgcttttcagttgatcggaatagcttcgtcccttgatctttctggtttcttcgaggaagaggacgtggctcaaagaaagattcggttcacatcaacacattcacccaaggatttatttgacaagatggagaatgccgtgaccgagatgggattcaaagtccataggggaccaagaaagctcaaagtattgaaaaattgcaaaacttccaagaactccaggagtcccgcatcatttttggtgtgcattgaggtgtttgagctagggccgtctttgtatgtcgtagaactgaagaaatcccatggagattctatattgtatagacagttgtgtgagaggctctcagatgagctggcggtgtgcaagacagaggagattacgaggacagaatcgctgggtgactcagatatgtcgagccttgatggcgaagcactacctttgtctggtttctgatcattgcttccctgtgtggttttgggcacaggggatgagggacatactcgttcctgatgcagttctagattaggaaatcttgtacaaagcgtgtggctcaaattagccaccatgttgaatattgttgtagcctgtctgttcccccgattctc

SEQ ID NO: 17426 - protein, 180 aa, Panicum virgatum
  misc_feature: Ceres CLONE 1792312-R
  misc_feature (26)..(86): Pfam Name: NAF Pfam Description: NAF domain
  misc_feature: SWISSPROT Homolog: EC 2.7.11.1 Non-specific serine/threonine protein kinase
YDDDEDLLPSSVLPIKEQIDESAQEKPTHINAFQLIGIASSLDLSGFFEEEDVAQRKIRFTSTHSPKDLFDKMENAVTEMGFKVHRGPRKLKVLKNCKTSKNSRSPASFLVCIEVFELGPSLYVVELKKSHGDSILYRQLCERLSDELAVCKTEEITRTESLGDSDMSSLDGEALPLSGF

SEQ ID NO: 17427 - DNA, 515 bp, Panicum virgatum
  misc_feature: Ceres CLONE 1792326
  misc_feature: Encodes the peptide sequence at SEQ ID NO. 17428
aattttcaaaaggtcgtggaggcgccgcgccgccgccgacgaggggggagagagagagagagagagagagagagagattgaggaggaggtcgaggaactagagaaggaggaaacgacattgttccagaagctggcagaaggtctcgtggaggtgaaacaggatctgatgaatttcttgcaagggctgagcaaggaagagatggagctgttggatgagatgaacatggaagcaactgaagttgagaaagtcttcagccgtgcactgccactgaggaaactaaggtagctctagcagcagatttggagaaaacaggccttccagtagtgatcaaaataaaatctatttgccgcaacagtacctatagtaagacattgttgaacagacagcaaacattttcttttgtcccccttttctgtggtcacaacatattgccagattagccctacttgtaaagcatcagagattatgcaaattttcttgcctaattaaaaatgagtatatatttatgctacct

SEQ ID NO: 17428 - protein, 94 aa, Panicum virgatum
  misc_feature: Ceres CLONE 1792326
  misc_feature: SWISSPROT Homolog: EC 1.10.99.3 Violaxanthin de-epoxidase
  misc_feature: Useful for making plants with modulated nitrogen use efficiency
IFKRSWRRRAAADEGGEREREREREIEEEVEELEKEETTLFQKLAEGLVEVKQDLMNFLQGLSKEEMELLDEMNMEATEVEKVFSRALPLRKLR

SEQ ID NO: 17429 - DNA, 2261 bp, Panicum virgatum
  misc_feature: Ceres CLONE 1792351
  misc_feature: Encodes the peptide sequence at SEQ ID NO. 17430
ctcggctcgtctcagaccaccagtccaccggcgggtccgttccatgggcggcggcggcggcggcgcggggagccggggggacgagaggggagtcggccccctggttccggagatgcagagcggcatggcgcccactcccggcggcggctccaatggtcaccaccaccagcgccggcaacaggtttcctccatggagtccggcggcgacgcgccggcagcggcgaggaggagcttcaactggaaggcaccggcgatcgtcctagtgttcgagctgctggagagcatcgccttctccggcgtggcgctgaacctggtggtgtacctggccacggtgctgcacgggagcaccgccttcaacgccgcccacgtcgacacctggaacggcaccaccttcatcgtccccgtcatcggcgccttcctcgccgacagctactggggcaagtaccggaccatcctcgccgccatcgccttctacctcgtgggcctggtgctgctcaccgtgtccgcggcggtgccgtcgctgcggcccggggcggcgtgccagatggggacggcgtgcgcgccggcgaccaagacacagttctccgtcttcttcgcggcgctctacctgacctccatcggcacgggcggggtcaaggcggcgctgctccccttcggcgccgagcagtacgacgacgacgccgagcggccggagcggaagcaggccttcttcagctggttcttcgccgccatcaacctcggcatcttcatcgccggcacgctcatctcctggctggagcagaacgtggcgtgggcgctcgggttcgggatcgggacggcctgcctgctcgtcgccgcgctcgccttcgtggccggcacgccctggtaccgggtgcagatgcccgcggggagcccgctcagggacatcatccgggtgctcgtcgccgccttcaggaagcgcggggcgaggctggaacgggaggacggcgccccggcggcgctgcacgaagacgccaaggacgacgagcagcggctggcgcgcaccaagggcctgcggtggctggacaaggccgccgtgctcgccgccaagggggaggacgcggcggcggagggcgcgtggtcgctgtgcacggtgagcgaggtggagggcgtgaagatcctggtccggatgctgcccatctgggcgacgtgcgtgctgtacgcggcgtcgctggggcagatgaccaccaccttcatccagcaggggatggccatggacgcgcggctcgggggccggttcaaggtgcccgcggcgtcgctggtgtccgtggaggtggtgttcatgctgctgtgggtggcgctgcacgacgccgccgtgatcccgctggcgcggcgggcgacgggccgccccggcggtctgacgcagctgcagcgcatgggcgtgaggcggctcctggtggcgctggccctgggcaccgccgcgctggtcgagcggcggcggctccgcggcgtggccgccggcggcggcggggcggcggcgatgagcatcgcgtggcaggtgccgcagttcgtgctggtggcgggctccgacgtgttctgcggcatcgcgcagctggagttcttctacggggaggcgccgccggcgatgcgcagcatctgctccgccttctcgttcctggcgctgtcgctgggcttctacgtcaactcgctggtggtgacgctggtggccgccgcgacggggcgccccggctggctggcgccggacctcaacgccggccacctcgactactacttctggctctgggccgtcatcagcgtcgccaacctgctgctctacatgctgctcgccgcccgctacacgcccaagcaggtcgccgtcgagacggcgcctcgccccaccaccaccggcagcaccggcgacgagtgattaattgggttgggcacatcgacccagcacggcgagtccagcagggaagcagcagctcgatccgggtacttgctaatacagacaaccgagacagtcagagtcagatggaaagcataggcagcgagtgattgttctgagtaggatacaccaccacacaaaaccacagtctacagtacagtagtaacattattgatgttcatgtccccagttaaccgttctgtgaggtctaattgtgagttttcgagcactgttagcagctagcaccatcatcatttgtacaagtgattcagacagtttagtgtagtgatttgtgcgtgtaagtacggcaagacacgaaagatccatcataaagcagcaaacacactagtgtcctgtc

SEQ ID NO: 17430 - protein, 613 aa, Panicum virgatum
  misc_feature: Ceres CLONE 1792351
  misc_feature (134)..(533): Pfam Name: PTR2 Pfam Description: POT family
MGGGGGGAGSRGDERGVGPLVPEMQSGMAPTPGGGSNGHHHQRRQQVSSMESGGDAPAAARRSFNWKAPAIVLVFELLESIAFSGVALNLVVYLATVLHGSTAFNAAHVDTWNGTTFIVPVIGAFLADSYWGKYRTILAAIAFYLVGLVLLTVSAAVPSLRPGAACQMGTACAPATKTQFSVFFAALYLTSIGTGGVKAALLPFGAEQYDDDAERPERKQAFFSWFFAAINLGIFIAGTLISWLEQNVAWALGFGIGTACLLVAALAFVAGTPWYRVQMPAGSPLRDIIRVLVAAFRKRGARLEREDGAPAALHEDAKDDEQRLARTKGLRWLDKAAVLAAKGEDAAAEGAWSLCTVSEVEGVKILVRMLPIWATCVLYAASLGQMTTTFIQQGMAMDARLGGRFKVPAASLVSVEVVFMLLWVALHDAAVIPLARRATGRPGGLTQLQRMGVRRLLVALALGTAALVERRRLRGVAAGGGGAAAMSIAWQVPQFVLVAGSDVFCGIAQLEFFYGEAPPAMRSICSAFSFLALSLGFYVNSLVVTLVAAATGRPGWLAPDLNAGHLDYYFWLWAVISVANLLLYMLLAARYTPKQVAVETAPRPTTTGSTGDE

SEQ ID NO: 17431 - DNA, 2323 bp, Panicum virgatum
  misc_feature: Ceres CLONE 1792354
  misc_feature: Encodes the peptide sequence at SEQ ID NO. 17432
agtgactagtgagctcactccctcctccttcccacttgactctgcccgccagctactgaaccaaccaacaaatacctccgggctccctccggctttgccactcccatggattggaggttggaggcctgaagggggaggtgggtcgccggacagggacggggagacggcgagagggcgttccgcaggagccgttcccgtgcttcctccaccgaccgggccgacgcgccgcgccgctgtttcaggttccagaatttcaagtattggccgctttaggatactatgggaaagtccccggggaagtggatcaagtctgtgctcttggggaagaaatcgactaaatccggttctaccaaggcaaatgagtcgaaggctacaaataacaatggacactcagctggggaggagcgtgcattttctgaaaattctccagtgatctctgagccggtgcttgttgaagcccacaaaaatggagctgtttcagttaatgggaaggctgaagatgtcaatttgccaagtgacagggctggccaacaagatctgcagaaccaaagtattgttgagtccgaaacatcagttcctgggcaattgggagaagaccaagctgcagtgaaggcacaggcagcatttcgcggttacctagcacgaaggtcattccgtgcattgaaaggtatcataagactccaggtactgattcgagggcatcttgtaaggagacaggctgtttcaacccttcgaactacttggttgattgtgaagtttcaatctctagttcgtggaagaaatgtcagactctctggtgctgacattcaactcaatgtgaagcttggccaacataaccttggtggcactagatcatctgatgcatggaaagagaagttatcttcaaatgcctatgttcggaagcttctgtcttcaccaatagtgctagaacctcttcacttccagtatgacaagagggatcccaattcaacctataactggctagagagatggaccataggctgcatctggaagcctgtttttcaaccaaaaagagttcctgatgggaaactgctggtaaggaaggctagttatgcaatggaaactgaatcagccaagttaaagcgcaacattaggaagggctctgctgctacagttgagagtttccatacaagagtgactggtgaatctgagaaacttaaacgtaatccaaagaaattctcaaacttccctgctgactcagtaccagatagccagttatctgaacttgagaaggttaaaaggaacctgaggaaggtaactgattccatggctgaagcctcaaagatctctagttccagggttgattcctcaaaggtatctgattctacacctgatgctccaaaagtatctaatcctgtggccgaaatctcaaagacatctagtctcctgaacgggatctctgaccatcaagacagccaatgtgaaaaagcactacagaatacacgtgaggcttcatttcctcttgaaactcaagattactctggcaatggtcagctattggaatattcagatatggataacttcgacttggtacctggtttgaaaagtgatctggaaactcagcttgattcagtttctataggagaaaatgttgatgagcccactgttggtgcttcagcagctgaaggtatgccactgcagaacattgatgagcccattagtttagggaagaaagaggaagcaaggtccaaggaagagcatctgtctaatggaagccttagaactggcaagagaaagtcttcatccccatacaaatcagaatatgtggaaaacgggactcacactactcctgctcagccaaggaagccaagctatatggctgcaacggagtctgcgaaggcgaaattacgagcacagaattcacccagggtggattctgattcatcagcagaaaagaatggcttcactcgacgccactctcttccttccggtacaaacagtagggcgatcaaagctgaatggaagcgctgaggaggcattgacttgaattgaatagtgcgattgtctgaatctctgctgggtgaactctgccgctgcttgctcctttttatttatcctgcgatgtaaagagaagacattgtccctgtattgaacaatctttgtgatgagtgcgtctggttcagtctgtggtaggttcacgtgccaggcctagtgccccgttcattgtatagtcacagttctctcgggattgaaatcgattcctcgtgtaagctgatgttaggactgcagtctgatcgaataacatcatccgcttgcacactgccttaagcccttaattgatatgataccgggcaatttcgtg

SEQ ID NO: 17432 - protein, 570 aa, Panicum virgatum
  misc_feature: Ceres CLONE 1792354
  misc_feature (106)..(126): Pfam Name: IQ Pfam Description: IQ calmodulin-binding motif
MGKSPGKWIKSVLLGKKSTKSGSTKANESKATNNNGHSAGEERAFSENSPVISEPVLVEAHKNGAVSVNGKAEDVNLPSDRAGQQDLQNQSIVESETSVPGQLGEDQAAVKAQAAFRGYLARRSFRALKGIIRLQVLIRGHLVRRQAVSTLRTTWLIVKFQSLVRGRNVRLSGADIQLNVKLGQHNLGGTRSSDAWKEKLSSNAYVRKLLSSPIVLEPLHFQYDKRDPNSTYNWLERWTIGCIWKPVFQPKRVPDGKLLVRKASYAMETESAKLKRNIRKGSAATVESFHTRVTGESEKLKRNPKKFSNFPADSVPDSQLSELEKVKRNLRKVTDSMAEASKISSSRVDSSKVSDSTPDAPKVSNPVAEISKTSSLLNGISDHQDSQCEKALQNTREASFPLETQDYSGNGQLLEYSDMDNFDLVPGLKSDLETQLDSVSIGENVDEPTVGASAAEGMPLQNIDEPISLGKKEEARSKEEHLSNGSLRTGKRKSSSPYKSEYVENGTHTTPAQPRKPSYMAATESAKAKLRAQNSPRVDSDSSAEKNGFTRRHSLPSGTNSRAIKAEWKR

SEQ ID NO: 17433 - DNA, 1500 bp, Panicum virgatum
  misc_feature: Ceres CLONE 1792366
  misc_feature: Encodes the peptide sequence at SEQ ID NO. 17434
gacaaatcagtcgagaggggggagaagacggtcgataaagtcaatctgcttggttggcttcgtgcttgggcctgcgaagaggagtgagcctgagccagccgcctcctcctcctccttcgacgaggggaaggaattaggctagcaagggggaaggggaagcgaggatgagcggaggaggcatggacggggctccggccgccgaattccggccgacggtgacgcacggcggccggttcctccagtacaacatcttcggcaacctgttcgagatcaccagcaagtaccagccgcccatcatgcccatcggccgcggcgcctacgggatcgtctgctcggtgatgaacttcgagacgagggagatggtggccatcaagaagatcgccaacgccttcgacaaccacatggacgccaagcgcacgctccgggagatcaagctgctcaggcacctcgagcacgagaacatcgttggcatcagggacgtgatcccgccgccgatcccgcaggcgttcaacgacgtgtacatcggcacggagctcatggacacggacctccaccacatcatccgctccaaccaggagctctcggaggagcactgccagtacttcctgtaccagatcctgcgcgggctcaagtacatccactcggcgaacgtgatccaccgggacctgaagcccagcaacctgctgctgaacgccaactgcgacctcaagatctgcgacttcgggctggcgcgcccctcgtcggagagcgacatgatgacggagtacgtggtgacgcggtggtaccgcgcgcccgagctgctgctcaactccaccgactactccgccgccatcgacgtctggtccgtcggctgcatcttcatggagctcatcaaccgccagcccctcttccccggccgcgaccacatgcaccagatgcgcctcatcaccgaggtgatcgggacgccgacggacgaggagctggggttcatccggaacgaggacgcgcgcaagtacatgcggcacctgccgcagttcccgcggcggccgttcgcgaccatgttcccgagggtgcagcccgtggcgctggacctcatcgagcggatgctcaccttcaacccgctgcagaggatcacagttgaagaggcgctggaccacccgtacctggagcgactacacgacatcgctgacgagcccatctgcacggagcccttctcgttcgacttcgagcagcaggctctgaccgaggaccaaatgaagcagctaatcttcaacgaggccatcgagatgaacccgaatttccgatactagattccgtctacttatgcatgtcgtttgtaaataggcgtacgattgaagagccggctagactgaacattgcatttgtttgtttgatgagatgttcgagcccaccatcctgttagtgtaaggctgtgtaagctgttcctgcgggtttcaggcgttgttgtaatcgactgtaccaagaataaaaggtttggagcatggttttcgagcatttcgt

SEQ ID NO: 17434 - protein, 374 aa, Panicum virgatum
  misc_feature: Ceres CLONE 1792366
  misc_feature (40)..(327): Pfam Name: Pkinase Pfam Description: Protein kinase domain
  misc_feature: SWISSPROT Homolog: EC 2.7.11.24 Mitogen-activated protein kinase
MSGGGMDGAPAAEFRPTVTHGGRFLQYNIFGNLFEITSKYQPPIMPIGRGAYGIVCSVMNFETREMVAIKKIANAFDNHMDAKRTLREIKLLRHLEHENIVGIRDVIPPPIPQAFNDVYIGTELMDTDLHHIIRSNQELSEEHCQYFLYQILRGLKYIHSANVIHRDLKPSNLLLNANCDLKICDFGLARPSSESDMMTEYVVTRWYRAPELLLNSTDYSAAIDVWSVGCIFMELINRQPLFPGRDHMHQMRLITEVIGTPTDEELGFIRNEDARKYMRHLPQFPRRPFATMFPRVQPVALDLIERMLTFNPLQRITVEEALDHPYLERLHDIADEPICTEPFSFDFEQQALTEDQMKQLIFNEAIEMNPNFRY

SEQ ID NO: 17435 - DNA, 1780 bp, Panicum virgatum
  misc_feature: Ceres CLONE 1792372
  misc_feature: Encodes the peptide sequence at SEQ ID NO. 17436
agctagctgcttcgcgagctccagccagatccagagagacccggcggccggcgatgaagcagccgaggggccggcaggagccgcgccggatgggcaacgcctccatggtcgtcaccatgctcgtctccctctgcgtcctcacctacatcaaggcgcgatactgctccaaccccttccccaagccggcggaggagctggaggtggtggaggtggacgaggactacgacagcacgaggtacaagctggacggccccatcggggaggaggacttcgaccccagccgcccgacctgctacaacacgagcaagcgctcggagcggtgcgcggcggtgggggacatccgcgtcgacggcaaccactccaagatctacatcagcccgctggaccgcgagtggcggaccaagccgtacgcgcgccgccacgaccccgtcgccatggacgacgtccgcgagtacacgctcgtgcccttcggcggcgccaaccacaccgccgtgccgccgctctgcaccgtcaaccactccgtcccggccttcctcttctccaacggcggcttcgccggcaacctctaccacgactacgccgacgtgctggtgccgctcttcaccagcacgcaccactttgacggcgaggtccggttcctgctcagcgggatgaaggactagtggaacgacaagttcacgccgctcttccgccagctgtcccggtacgaggtcatcgacgtcgacaacgaccgggaggtccactgcttcccgcggatcgtcatcggcgccaccttccaccgcgccatgggcatcgacccctcgcgctcgccggggggcgtcaccgtcgccgacttcaagcgcctcctccgccgcgccttccggctggagcgcgccgtggcgtcgcggtcgggcgcgccgcgccggaaccggccgcgcctcctcatcatctcccgcaagagctcccgccggttcctcaacgagcgcgccatggcgcacgcggcggcgcgggcgcgcttcgacgtgcgcatcgccgagccggacaaccacacggacatgccccacttcgcgcggctggtgaactcggcggacgtgatgatgggggtgcacggcgccgggctcaccaacatgatgttcctgcccagccgcgccgtgctcatccaggtggtgcccttcggggggctcgagtggctctccagggtcaccttcaaggacccggccagggacatggacgtcaactacatggagtacaacgtgtcgctggaggagagctcgctgagggacctctacccggaggaccatttctacctcaaccacccctacgacgtgcacaagaaggggtgggacgccatcaagacggtctacctcgacaagcagaacgtcagactcaacctcaccaggttcaccaagacgctcgagcaggcgcgcgatctcctgcccgagccctgatcaaagatcctgctgctcgtcatggatgccatgccttcagattggccaggcacctactgcaactgcaagtggtagataggctcgctcacaccatgtcttgaaactctttttttgtttttgattttttattggttttctcttctccttttttcttcttcttctcccctcgtgtggcaagattcatttctttcattgtttttttttctttgggcaaaggaggagaggaaacaaagcaaaggtcgtgtcatagacaagagagagagagagggtgtgtctaaggttaatttacacacacacacacaatcactgtaaattggttgattgtcgataaatgccaaggcagagaaaaaggt

SEQ ID NO: 17436 - protein, 213 aa, Panicum virgatum
  misc_feature: Ceres CLONE 1792372
  misc_feature: Useful for making plants with altered carbohydrate content
MGIDPSRSPGGVTVADFKRLLRRAFRLERAVASRSGAPRRNRPRLLIISRKSSRRFLNERAMAHAAARARFDVRIAEPDNHTDMPHFARLVNSADVMMGVHGAGLTNMMFLPSRAVLIQVVPFGGLEWLSRVTFKDPARDMDVNYMEYNVSLEESSLRDLYPEDHFYLNHPYDVHKKGWDAIKTVYLDKQNVRLNLTRFTKTLEQARDLLPEP

SEQ ID NO: 17437 - DNA, 1572 bp, Panicum virgatum
  misc_feature: Ceres CLONE 1792376
  misc_feature: Encodes the peptide sequence at SEQ ID NO. 17438
atccacccagtcccgcccccatgggccatcgcctccgcctccccagcaaccccacgccaccgcgtcgccctcttcttcctgctcctcctccccgtccacctcgccctcgccaccgcgcaggccgcaggggttacgcggcttctcctacctcctcaactgcggcgttgtgctactaccctcgactcctcacccgcccgctcaccatctctcctctcccgtttctccctccctctcccctccaaatccggcggccggcgaggcgagagcgcggccttcgcttgccagtcctggcggccggcggccggcagcgttgctaggatgtagccgccggcactcggatctgcctcggggtgggcccgctggaggcacgatgatgaacacaggcctcgcgacgactcttggcgagggggggggggggggggggctcacctcgctcaactctacggcgcagcggggccgacgagagggccgaagccatgggtgggcgcttcaagatttgccttgctcatggacgacgagggggccgacagcgaccgtggatggccgatacggaggtggtgtatgcgctcactgcccagaatctcccgtccccatcaattttgtcgaccagctgagcagctccctgctccaccaaggatccatgggattgggaagcacgaatccccctcagcccccaatcttcttgtgctgtgtattaaaggatgactttcataccaaacttttataactcacaaagggagccmtctctgctgctggctcgtgttccatctctattgttgaatggttcttctgggattgcggtcggaatggcaacaaacattcctcctcacaatctgggggagcttgttgatgcactttctgttatagttcaaaagcctgaagccacaaatcattggaattattttggtgattgttaaagtaacattggcagaaccacccagaggctgaggttgctgctctgccgccaccggccaccaccgacaccgaggaggatcgcgcagcggccgccacaccagccgacaacaatccctccatcacagtaccgtgggaagattgaaaaatagcagactaaagtagagaaatggtttgaggtaaatagaactgtcttaatgttggtaaattcacaatttccctaaattttcttacagaaatttgtatttttcagatatgtggcataacgatgcctaacatcaaacaggggatgttttaatacatatttttgcttactatgagaagaaggtatgaacaaatggattcttttctttattcacacattgcaatggtcattcttaattgatctgttgaaaggaaaccatgttcatcggcaagttgcttggatataccggttctcgtgggaaccaatgcatttaggtcttctcattatttacaaaagattgtgctgatataggattatctactactattctaggtttcaatatatttacaaactaattgatcaggccttcagaggcttccaggttcagccgtggtcatcacgagtgcaagctgataagagcaacaaccatatggagcattgcaggttctgtgaattgtgctaataaataatgggtt

SEQ ID NO: 17438 - protein, 71 aa, Panicum virgatum
  misc_feature: Ceres CLONE 1792376
  misc_feature: SWISSPROT Homolog: EC 5.99.1.3 DNA topoisomerase (ATP-hydrolyzing)
MTFIPNFYNSQREPSLLLARVPSLLLNGSSGIAVGMATNIPPHNLGELVDALSVIVQKPEATNHWNYFGDC

SEQ ID NO: 17439 - DNA, 672 bp, Panicum virgatum
  misc_feature: Ceres CLONE 1792376-R
gtaccaagctgaatgtcatacatgagctccaatatgtctattctaagagatttacatgatactactatatatattaagctatttttggtacagtcaaggacacagaatgcttgcttggtagagctgacaagttcaggcaatatggctacaatacagtccttatgcaatctgattctgtcaagtatgctcttatgcaacatgtgatttttttttccttctgtggccatttgtggagagtttatctaaatgcctaaagcatggactttacaatccacttaaagcaagatcaaagtattgcagatgcgatatacatcactaacagtgtttcattctcctttgtgatttttgacattcctgttttctgcctttattgatacaaaatttggttacaaaattttgacatctctaacagctgaaggcactgcaagatcccagaacaagacgctcgaaaaacaggatcggcggcagcaaggacacgagggctggaggggaggagcaaccagatggaggtgcatggtcaagcaatccccgttagttcatgaccgcaggctaggcgtccgaacaaacagagttgtaaaggtgtaaagggtagcctagacaatcctgtaattgtgtttgatgggatggcttgtccaaagttaaacgaaagaatcaatattgttgtctcctcgt

SEQ ID NO: 17440 - DNA, 671 bp, Panicum virgatum
  misc_feature: Ceres CLONE 1792385
  misc_feature: Encodes the peptide sequence at SEQ ID NO. 17441
tcctttgtacccctcctcctgctcctcctctgcgctcttcgcgcaccaagacgcagaagaatcccttactactcatgcgtgaccaccgcctcctcgcgccgcatatgaatcacaaatgagtaagggccgcagcacccgctcctcgaagctcatcagcgagaagcttgaggaacaccggatctccaccgccaagcactgccgccgctgcggggagacaatcgacacctagccggattgggtggggctgccggccggactcaagttcgatccatctgaccaggagctgatcgagcacctcgaggcgaaagtgaaggacgaaagctcgagatctcaccctctcatcgactagttcataccctcaatagatggggaggacggtatatgttacacccacccccaaacacttccaggcgtgaccagggatggtctgagcatgcccttcttccaccggacatccgaagcctatacgacgggcacgaggaagaggaggaagatacagacggactgcgacgtccacgaaggcgatacgaggtggcacaagaccggaacgacgcggccggagatggtgaacggccggcagaaggggtgcaagaggattctggtgctgtacaccaacttcagcaagcaccgtcaagcaggagaaaacgaactgggtgatgcaccaataccac

SEQ ID NO: 17441 - protein, 79 aa, Panicum virgatum
  misc_feature: Ceres CLONE 1792385
  misc_feature: The sequence is a functional homolog of SEQ ID NO 1710 in the 10/374,780 US patent application
  misc_feature: The sequence is a functional homolog of SEQ ID NO 1713 in the 10/374,780 US patent application
  misc_feature: The sequence is a functional homolog of SEQ ID NO 542 in the 10/666,642 US patent application
  misc_feature: The sequence is a functional homolog of SEQ ID NO 318 in the 10/374,780 US patent application
  misc_feature: The sequence is a functional homolog of SEQ ID NO 848 in the 10/225,066 US patent application
  misc_feature: The sequence is a functional homolog of SEQ ID NO 210 in the 10/666,642 US patent application
  misc_feature: Useful for making plants with altered carbohydrate content
  misc_feature: The sequence is a functional homolog of SEQ ID NO 562 in the 11/435,388 US patent application
MPFFHRTSEAYTTGTRKRRKIQTDCDVHEGDTRWHKTGTTRPEMVNGRQKGCKRILVLYTNFSKHRQAGENELGDAPIP

SEQ ID NO: 17442 - DNA, 1315 bp, Panicum virgatum
  misc_feature: Ceres CLONE 1792388
  misc_feature: Encodes the peptide sequence at SEQ ID NO. 17443
caggtgggggactcgtctccttccagtagcagtaggcaagttgccactcgagagagggcgggagcacctccgcctcagatccgccgccgactctccgagccccaccagcctcccacccatgcgcccgccggcgatgctccgctgggccgcggtggcgctcgctctcgcggccgcggcgctcctcgccgccgcaccggccgccgccttctacctccccggcgtcgcgcccagcggcttccagaagaaagatgcactcttggtgaaggtgaataagctgacatccacaaagacacaacttccctactcctattactctcttcctttctgcaagccggacacgatagttgacagcgcagagaatcttggagaagttctgcgtggtgatcgcattgagaattccccttatgtgttcgagatgagggagcccaagatgtgccagattatctgcagagcatcaattgatgataaacaagcaaatgagctcaaggaaaagatagaggatgagtatcgggtgaacatgattcttgacaacctcccgctagttgttcctatcgcaaggcaggacagggatgctattgtttatcagggtggatatcatgttggtgtcaagggccaatatgctggtagcaaggatgaaaaggtctttatccacaaccacttgacatttttagttaaataccacaaggatgaaactacmsaactctctagaattgttggatttgaggtcaaaccattcagtattaaccatcagtttgaaggccaatggaatgataaaaacactcgtttgatcacgtgtgatcctcatgccagcaagcttgtgacaaactcagatactcctcaggaggttgaagctggaaaggaaatcatatttacctatgatgttggctttgaggagagtgatgtcaagtgggcttctcgctgggacacctacctgttaatgacagatgatcaaattcactggttttccattgtgaactctctcatgatcgtactcttcttatctgggatggtggccatgattatgctccgcactctgtatagagatatctccaggtacaaccagcttgaaactgaagaagaagcccaagaggagacaggatggaagcttgttcatggagatgtgttccgccctcctgaaaactctgacttactctgtgtctgcgttgggactggtgttcagttctttggtatgctgctagtaaccatgattttcgctgttctgggattcctttcgccatcaaaccgaggcgggctgatgactgctatgctgctcacttgggtcctgatgggattgtttgctggatatgcttcttca

SEQ ID NO: 17443 - protein, 398 aa, Panicum virgatum
  misc_feature: Ceres CLONE 1792388
  misc_feature (60)..(398): Pfam Name: EMP70 Pfam Description: Endomembrane protein 70
  misc_feature (194)..(194): Xaa is any aa, unknown, or other
MRPPAMLRWAAVALALAAAALLAAAPAAAFYLPGVAPSGFQKKDALLVKVNKLTSTKTQLPYSYYSLPFCKPDTIVDSAENLGEVLRGDRIENSPYVFEMREPKMCQIICRASIDDKQANELKEKIEDEYRVNMILDNLPLVVPIARQDRDAIVYQGGYHVGVKGQYAGSKDEKVFIHNHLTFLVKYHKDETTXLSRIVGFEVKPFSINHQFEGQWNDKNTRLITCDPHASKLVTNSDTPQEVEAGKEIIFTYDVGFEESDVKWASRWDTYLLMTDDQIHWFSIVNSLMIVLFLSGMVAMIMLRTLYRDISRYNQLETEEEAQEETGWKLVHGDVFRPPENSDLLCVCVGTGVQFFGMLLVTMIFAVLGFLSPSNRGGLMTAMLLTWVLMGLFAGYAS

SEQ ID NO: 17444 - DNA, 638 bp, Panicum virgatum
  misc_feature: Ceres CLONE 1792388-R
gcttcaccagttctactacatctttggcttccttttcctggtgttcattatcctcatcatcacctgtgcggagattacgatcgtgctgtgctatttccaactgtgcagtgaggactataactggtggtggaggtcctatctcacctcaggatcatctgcaatctacctcttcctgtatgccgggttctacttcttcacaaagctgcagattaccaaactggtgtcaggcatactgtactttggctacatgcttctggcctcgtttgcgttctttgtgctcactggtacaatcgggttctgcgcctgcttctggttcacgagattgatctactcgtctgtgaagattgactaggctggatgacatgagactgcagagagtttgctgtacggttatggtgaagtggcctccatttaccaccctgcgtttttgtgaattcagaaactctgtattttaggtgttattaacagcataaaccatttatttccactgtggttcagatctgatatgatacatctgtcgctatggagttgtgtaaggataggaaactactgtcagcttcatatggggcaatttttccgtactgttatgaactggtgtataaattcaagtcatagctactcgctcataattgcctgct

SEQ ID NO: 17445 - DNA, 663 bp, Panicum virgatum
  misc_feature: Ceres CLONE 1792392-R
  misc_feature: Encodes the peptide sequence at SEQ ID NO. 17446
gtttgcatcattccaatgtttttgatgacttggtaaacgggagggcaccctctgttgagttccatgtcaacgacaacatatattcccttggatactacctagcagatggcatctatcccgattgggctacactagtgaaaaacattcctttgccagttagcaacaagcaaaaggtatttttagagcaacaagagtcatgtcgaaaggatgtggagagagcttttggtgtcctacaggctaagtggaaaatcttgcaccggccagctcgtttatggaatcaacaagtacttaattcaataatgcatgcttgtgtcatacttcacaacatggtagttgaagatgagcgcggggttcatctacctaatgtccacccatcagaatggcctggagtggctgacccaccaattaaccaggctacagaaatcccaggaattgagaaacttattgatgctcaaaacatcattcaggatagagagatggcagctcagcttcaaaatgacctgatggagcacatgtggatgctatatggccaatgatctggtccttttggtcctaataacaggcactaaagtctttctattttgttgctgaattgaacattagtggaactctatccctgctctgtaaatatttcagtgaatgacaagctgttagctgagctct

SEQ ID NO: 17446 - protein, 177 aa, Panicum virgatum
  misc_feature: Ceres CLONE 1792392-R
  misc_feature (8)..(118): Pfam Name: Plant_tran Pfam Description: Plant transposon protein
LHHSNVFDDLVNGRAPSVEFHVNDNIYSLGYYLADGIYPDWATLVKNIPLPVSNKQKVFLEQQESCRKDVERAFGVLQAKWKILHRPARLWNQQVLNSIMHACVILHNMVVEDERGVHLPNVHPSEWPGVADPPINQATEIPGIEKLIDAQNIIQDREMAAQLQNDLMEHMWMLYGQ

SEQ ID NO: 17447 - DNA, 631 bp, Panicum virgatum
  misc_feature: Ceres CLONE 1792392
ataggtcacgcacctaaacactctcgtctccaacaacaaacccaaaagaagtccaggcgacatggatgcccccccccccccaacccccccggccagtttctttcccgcgcgttcgatgaaataggcagcaaaagaagtccaggtgacacgggaaaaaggagccgtccaggcgacacagacgcagaaggagccgccggcgtcaacctcgcacagacgcaaaagaaggagccgccggcgatcagcatcacaaggctcggcgtcgtatcacaggcaatctgatttctaggggattaaatccctcaaccttctgcaatcggcttggattaaatccctcaaccttatgcaatttttccctaaatcgaccttgctttgacctggccgcgccgcctgccgggccgccgcatcctcctccccgctcccgcgttcgtcgcaaggcgccgccgccgcgggtctcctcaagccaccaccgcactggtccccccgcttcgaaccaccgcaccgccgaacccatctcctggcctctcttccaccgaggcgcggcaaattcctgcctcctagtcgtcgtcggcggtgtcgttaacatcgttatcctcgctggtggtgctggacttgcatgggcggcagatccact

SEQ ID NO: 17448 - DNA, 2542 bp, Panicum virgatum
  misc_feature: Ceres CLONE 1792402
  misc_feature: Encodes the peptide sequence at SEQ ID NO. 17449
gcctgcccttgccactcccgtcggcggaaacatcccactcccccccccgggcccccaccatctgcctgcgcgcccaccaccatccccgccgctgctcctcgtctccctgcctccccggccagaccagctacctcgccccttcccggtgttactgccctgttcttcccccgtccgcgcaaccggctgggctcggctacctcgccgcccgctctccgagtacggcttcagctacaaggatctggggcctcggcgcgcgccggccgacgggagagattttgtttgatctgagtgtactagaggacaagaagacatatcaataatcaagctgcaaaaaaatctctgaattgacttcagaactggacatgcttgtcataccagaagcacttgacaactcggagttttagtgcatccgactcttgtactgaactaggatggctgatactccaacttcccacatggtgcacccctttggcaatgtcccaaggcagactccgaagcaattcctgtattctggcaacgctcagcaccactgtgatccatatcagtcagcttcggacacccatgttgtaccgcagcatcattacaccatgaagtctcattcaccggatgctggctctgaagagcatgagacccacaagcagtacacactggactcttctgcagcttctggttgctcgaggcatgattctccctccagtcagagtatccatactgggagtggcagccctctatctcatgaagatagccactccggctccaccaatggcaacggatcacctgtgagcgcttcctgcgtcactgaggaccctactgatctgaagcagaagctaaaggatcttgaggctgtgatgcttgggacagactcagagatagtggatagccttgagatctctgttgcaaaccaactttccttggaaccggagaagtgggtgcacatgatgagcgtgcccaaaggcaacttgaaggagctgctgattgcttgtgctagagcagtggaacataataacagtttcgcaattgatctgatgattccagagctgaggaaaatggtctcagtgtctagtgagccacttgaaaggctgggggcctacatggtggaaggtctggtggccaggctcgcctcctccggaaactcaatctacaaagctctgaagtgcaaagagcccaagagttctgatctcctgtcctacatgcacttcctgtatgaggcctgcccctacttcaagtttggctacatgtcagcaaatggtgcaatcgcagaggctgtcaagggagaagacaggatccatatcattgatttccaaatcgcccaaggggcgcagtggatctctctccttcaggccctggcagccaggcctggtggaccaccattcgtgaggatcaccggcattgatgattcagtctcagcttacgcccgaggcggtggtctggagttggttggaaggagactttcacacattgctggcctctacaaggtgccctttcagttcaatgcagtcgctatctccggcagtgaagtggaagagggacatctcggcatcattcccggttaagccattgctgtcaacttcaccctggaactgcaccacatccccgacgagaccgtgagcacggcgaaccaccgggaccggatcctgaggctggtaaagggcctgtcgcccaaggtgctcacgctggtggagcaggagtccaacaccaacacggcccccttcgcacagcggttcgcggagacactggactactacacagccatcttcgagtccatcgacctggcgctgccgagggaggaccgggagcggatcaacatggagcagcactgcctggcgagggagatcgtgaacctggtggcctgcgagggggaggagcgggtggagcggcatgaggtgttcggcaaatggaaggcgcggctgatgatggccgggttcaggccgtccccactcagtgcgctggtgaatgccaccatcaagacgctgctgcagagctactcgccagactacaagctcgctgagagggacggcgtgctctacctcggctggaagaacaggcccctggtggtctcgtcggcatggcattaatgttgtgagaatgtagacctgacgaagaatgtttattgtgaccttgtacctcacaatcgtttaggtgtgtccggctgaaaactagtataggaagttatggcaatactggatggagtagaatacctataacctaatgttgtaatggtagtcactaccagcctagaactggttgatgaggtgtagtacaagtttgggtatatgttttaagttaatcagttgtgctttgaaaatctttgtgcatgctgatgaatatgacctcagtcagagaggtcatctaccattccactctttcaactaatcatttggaaatcttcattactggccagtggggctgaaaatcaacagaaaatttattcgtttcagtttgtaaaaatccaacatattttgcctacctgaagaaaacatgcctgtgaaatgatatatttcattccatatatcaatatcaaactggcatcgttcatatgcag

SEQ ID NO: 17449 - protein, 373 aa, Panicum virgatum
  misc_feature: Ceres CLONE 1792402
  misc_feature (155)..(370): Pfam Name: GRAS Pfam Description: GRAS family transcription factor
  misc_feature: The sequence is a functional homolog of SEQ ID NO 474 in the 10/666,642 US patent application
  misc_feature: Useful for making plants with modulated light quality sensitivity
  misc_feature: Useful for making plants with modulated low light sensitivity
  misc_feature: The sequence is a functional homolog of SEQ ID NO 1018 in the 10/225,066 US patent application
  misc_feature: The sequence is a functional homolog of SEQ ID NO 2712 in the 10/374,780 US patent application
  misc_feature: The sequence is a functional homolog of SEQ ID NO 220 in the 10/412,699 US patent application
  misc_feature: The sequence is a functional homolog of SEQ ID NO 443 in the 11/479,226 US patent application
MADTPTSHMVHPFGNVPRQTPKQFLYSGNAQHHCDPYQSASDTHVVPQHHYTMKSHSPDAGSEEHETHKQYTLDSSAASGCSRHDSPSSQSIHTGSGSPLSHEDSHSGSTNGNGSPVSASCVTEDPTDLKQKLKDLEAVMLGTDSEIVDSLEISVANQLSLEPEKWVHMMSVPKGNLKELLIACARAVEHNNSFAIDLMIPELRKMVSVSSEPLERLGAYMVEGLVARLASSGNSIYKALKCKEPKSSDLLSYMHFLYEACPYFKFGYMSANGAIAEAVKGEDRIHIIDFQIAQGAQWISLLQALAARPGGPPFVRITGIDDSVSAYARGGGLELVGRRLSHIAGLYKVPFQFNAVAISGSEVEEGHLGIIPG

SEQ ID NO: 17450 - DNA, 1287 bp, Panicum virgatum
  misc_feature: Ceres CLONE 1792406
  misc_feature: Encodes the peptide sequence at SEQ ID NO. 17451
gcgaccaagtactgctagtactacccacaacaagctcctgctcctcctgattcttctgctagtcgtcttcttcttcttcttcttcttcttgatcccgaccgtcttgttgcccccagaccgaaccatgtcgtcgtcgtcgtcgtcgtcttcctctgcatcggacgccgccgcttcgacgccgttcgagaagcccagggccgtggtcaagaagctcctcgccgagtcgcagcccgagggtcagggcgccaccgtccggaggagcatcggcaggcatgagctcaggaacctggaccccttcctcatgctcgacgagttctcagtctccaagcccgccgggttccccgaccacccccacagaggattcgagaccgtcacctacatgctcgagggcgccttcacccaccaggattttgcaggccacaagggcaccatcaggacaggggatgtccagtggatgactgccgggcgtggcatcgtgcactcggagatgccggcgggagacggggtgcagaagggcctgcagctctggatcaacctctcctccaaagacaagatgatcgagccccggtaccaggagctccagagcaaggacatcagccgcgccgacaaggacggcgtggaggtccggatcatcgccggcgaggccttcggcgtgcgctccccggtgtacacgcgcaccccgaccatgtacatggacttcaccatgcggccggggtcggagctccaccagcccatcccggagggctggaacgccttcgtctacatcatcgacggcgagggcgtgttcggccgggagaggtcggcccccgtcggcgcgcaccactgcctcgtgctgggccccggcgacgggctgagcgtgtggaacaagtccggcgcgccgctgcggttcgcgctggtgggcgggcagccgctgggcgagccggtggtgcagcacgggcccttcgtcatgaactcgcgcgccgagatccagcagaccatggaggactactactacggcaagaacggcttcgagagggccacccagtggacctcctcctccgcctgatccacagagaaatcgacacagggggaagaaaaaggaaaacaaaacaattgatgtcctccatcatacttggattggacagagttgaccattagcctatacatactactgtactcttatcttgataactaattttttttctccttattgtcttgtatggtgattgtaataagcagattggagaattcatttacagtctgttctaatataccatcatgatttctttcaatggattaaatttgtcc

SEQ ID NO: 17451 - protein, 347 aa, Panicum virgatum
  misc_feature: Ceres CLONE 1792406
  misc_feature (81)..(177): Pfam Name: Pirin Pfam Description: Pirin
  misc_feature (230)..(335): Pfam Name: Pirin_C Pfam Description: Pirin C-terminal cupin domain
RPSTASTTHNKLLLLLILLLVVFFFFFFFLIPTVLLPPDRTMSSSSSSSSSASDAAASTPFEKPRAVVKKLLAESQPEGQGATVRRSIGRHELRNLDPFLMLDEFSVSKPAGFPDHPHRGFETVTYMLEGAFTHQDFAGHKGTIRTGDVQWMTAGRGIVHSEMPAGDGVQKGLQLWINLSSKDKMIEPRYQELQSKDISRADKDGVEVRIIAGEAFGVRSPVYTRTPTMYMDFTMRPGSELHQPIPEGWNAFVYIIDGEGVFGRERSAPVGAHHCLVLGPGDGLSVWNKSGAPLRFALVGGQPLGEPVVQHGPFVMNSRAEIQQTMEDYYYGKNGFERATQWTSSSA

SEQ ID NO: 17452 - DNA, 740 bp, Panicum virgatum
  misc_feature: Ceres CLONE 1792410
  misc_feature: Encodes the peptide sequence at SEQ ID NO. 17453
atcccattttccctcttctcttcaagtcccacccataaggcttggagggaagaagagagagcttagcagcccagaaccaaagccggcaagcaaaatggcgatctgcagcacgcacaccaccacctccctgcactccccatgcacagtctcaaacacaggcttcaggcagaagcaagtcatcttcttcaccagcaacaggagaagtggcagaaggcatggaggggcaagaacctttcaggtttcatgctccgtcgagaagccagtggtgattggcctggcggcagactcaggatgcgggaagagtaccttcatgcgccgtctcaccagtgtgtttggtggtgctgcagagccacccaagggtggtaacccggactccaacaccctcatcagtgacaccacgacggtgatatgccttgatgactaccattccttggacagaaccgggagaaaggagaagggtgttaccgccctcgacccaagggcgaacaactttgatctcatgtatgagcaggtgaaggcgatcaaagaaggccagacaattgagaagccgatctacaaccatgtcactggcctcctcgacccaccggaggttatcacacccccaaagatttttgtcattgagggcttgcacccaatgtaagctcacattctatgcctatgctccacatgtgctactactctgtctcattctctcatgctatatgggtgtttgttcttttattttctcattgtaatcaggt

SEQ ID NO: 17453 - protein, 181 aa, Panicum virgatum
  misc_feature: Ceres CLONE 1792410
  misc_feature (58)..(181): Pfam Name: PRK Pfam Description: Phosphoribulokinase / Uridine kinase family
  misc_feature: SWISSPROT Homolog: EC 2.7.1.19 Phosphoribulokinase
  misc_feature: Useful for making plants with altered lignin content
MAICSTHTTTSLHSPCTVSNTGFRQKQVIFFTSNRRSGRRHGGARTFQVSCSVEKPVVIGLAADSGCGKSTFMRRLTSVFGGAAEPPKGGNPDSNTLISDTTTVICLDDYHSLDRTGRKEKGVTALDPRANNFDLMYEQVKAIKEGQTIEKPIYNHVTGLLDPPEVITPPKIFVIEGLHPM

SEQ ID NO: 17454 - DNA, 659 bp, Panicum virgatum
  misc_feature: Ceres CLONE 1792410-R
  misc_feature: Encodes the peptide sequence at SEQ ID NO. 17455
ttgatcatgaaagaaggcgtgaagcacttcaaccccagtttacctcttcgatgaaggatcaagtatcaactgggtgccttgcggaagaaagctcacatgctcttaccctggcatcaaatttgcctatggcccagacagttacttcggccacgaggtatcagtgttggagatggatgggcaattcgacagactagatgagctcatctatgtggagagccatctaagcaacctctcaactaaattctacggagaagtgacacagcaaatgctaaagcatgcagatttcccaggaagcaacaacggaacaggtctcttccagaccattgttggactgaagattagagatctctatgagcagatagttgctgagagggctggtgtaccagctgaagcagcgaaagtttaatgatctgcacattcagatttcctacacctcttcaaactcaatgagaatgagaatcctcgaaattcttgtaattagttcggatatatcacgactaggaggtagaaatgtcattgcagtactcaggaaaacatgcaatggaatttctagaaatacctcgccatgggggtgctcttacatctcttcttcacatgttcaaatgtatatcttcttccatgcttttatgcagaaaaaaatacagctgcctgctactatc

SEQ ID NO: 17455 - protein, 78 aa, Panicum virgatum
  misc_feature: Ceres CLONE 1792410-R
  misc_feature: SWISSPROT Homolog: EC 2.7.1.19 Phosphoribulokinase
  misc_feature: Useful for making plants with altered lignin content
MDGQFDRLDELIYVESHLSNLSTKFYGEVTQQMLKHADFPGSNNGTGLFQTIVGLKIRDLYEQIVAERAGVPAEAAKV

SEQ ID NO: 17456 - DNA, 2183 bp, Panicum virgatum
  misc_feature: Ceres CLONE 1792411
  misc_feature: Encodes the peptide sequence at SEQ ID NO. 17457
aggaagaggggcgggcgcgacgatgagggggccctcgggcgcgcggatgaccgcgcagggcgcggcggaggcggccgtgggcgccgtcgggtgcggctacgacctcacgggggacctccgcctggcgcgcgccaagccggcgggccggctgttggaggtcgacgccgcgccggcgcgggagctgtccctgccgggcggggccgtcgtcgcgggcgtgcccgccgggatcgtcgccgacaagggcgagcgcacgcggttccgctccgacatcctctccttcgctcagatggcggagcaggtgaaccagtcgctgtcgctggcggggaagatcccctcgggcgccttcaacgccatgttcgactaccgcgggtgctggcaccgggacgccgccgccacgcggagcctctgcttcgacggccgcttcgtcgagctctacagcgtcgaggccgtgcgcgcgcagctcgccctgcaggaccgcgtcaagcaggacctgccgcccttctgggatcccccggcgctcgccgagttcatcgacaagtacggcacgcacgtcatcgtcggggtgaagatgggaggcaaggacgtggtgtgcgtcaagcagctcaagggctccagcctgacgcagagcgacgtgcaggcccggctcaagcagctcgccgacgacaagttctcccacgacggcgccggagacgacagattagcagcgcacgggctaaacggaaatttcggccccggatcagctgcctggcagtcgttcagatctcccgtcgtgtcccacaaggatgacgtcgtctgcatccacatcagaagaggcggcgtcgacaacggccagggccacggcagatggctctcgacgatcaccgcctacccggacatcatctcgatatcgttcgtgcccattacttccctgctcaccggcgttcgaggctgcgggttcctgaaccatgcggtgaatctctacctcagatgtaagcgtctctgccgcgttgcactgtcatttttggcggtaagtctgatcggagctcacttgggattcagttcagatgcctgatcggccgtccatttcctgcttgtggattcagacaaaccgccgatagaggagctccagcagttcctggagttccaggtgccgcggcactgggctccggagttcggtgagcttcccctttgcctccagaggaggaagaacagcttgccgtctcttcagttcaccctcatgggccctaagcttcatgtcaatactgccaaggtcgattccggcaaccggccggtgaccggcatccggctgttcttggaaggcaagaagaacgaccggctgggcgtccacctgcagcacctgtcggtgacgccgagcaccatcacggtggtcggcgaggccgcgtcggccgaggacgtggccgtgaacgagcgcgactacatcgagcccgtcaggtcgccgctgctctcgcacgtctgcacggcgccggtgcagtacaacggcgcgcggatcgacgactgcgcggcgatcgtgacccgggcgtggctggaggtgcgcgacacctgctgcctcaagaaggtgctcttcctgcggctcggcttctcgggtgtcgcggccatgaagatacggcggtccgagtgggacgggccctccgtcgtgccccgcaagtccggctcgctgtcgatgaggctcagcgcggcgctgtccggcggcctggcgcaggcgccgccggcccccgcggaggaggagaaggtggaggtgaactccgccatattccccaagggcccgccggtgccgctcccggtccagaagatggcgaggcacgtggacaccaccgaggtgatgagggggcccgacgaccagccggggtactgggtggtcaccggcgggaagctgtgcgttgagggcggcaaggtagcgctcaaggtcaaatactcgctgcttatcgcagtgcaggaggacactgacgtctgaggcttcattgccgttggttgatcgatgcctcggcttctctgtttttgtgtgtggtttgcctagtgttagcgtgcagttcagtcgtccgagtggtgtaaatggtgagagggcggagcatgctgcttacaaatatgttgtagttgtacagaacatacagagtgcctacagaactgggttctgtttgcatgcaaagtattttttttagagtattggacaaataatacggttttgc

SEQ ID NO: 17457 - protein, 342 aa, Panicum virgatum
  misc_feature: Ceres CLONE 1792411
  misc_feature (125)..(315): Pfam Name: MACPF Pfam Description: MAC/Perforin domain
MRGPSGARMTAQGAAEAAVGAVGCGYDLTGDLRLARAKPAGRLLEVDAAPARELSLPGGAVVAGVPAGIVADKGERTRFRSDILSFAQMAEQVNQSLSLAGKIPSGAFNAMFDYRGCWHRDAAATRSLCFDGRFVELYSVEAVRAQLALQDRVKQDLPPFWDPPALAEFIDKYGTHVIVGVKMGGKDVVCVKQLKGSSLTQSDVQARLKQLADDKFSHDGAGDDRLAAHGLNGNFGPGSAAWQSFRSPVVSHKDDVVCIHIRRGGVDNGQGHGRWLSTITAYPDIISISFVPITSLLTGVRGCGFLNHAVNLYLRCKRLCRVALSFLAVSLIGAHLGFSSDA

SEQ ID NO: 17458 - DNA, 1954 bp, Panicum virgatum
  misc_feature: Ceres CLONE 1792413
  misc_feature: Encodes the peptide sequence at SEQ ID NO. 17459
atcatcaacgcatcgcatcgcgtccgcattctccagcctccgcctccctccctccgtcctcgccgcgcaccctctcccccctcgatctcgcgaaccctgctgaggcaggcgggctagatcccggacccccgccatgtccaagccctggggcggcctcggcggcgccggcgcgtgggcgctggacgccgagcgcgccgaggaggaagagcgcgaggccgccgccaacccgccgcccgccccggcctcgagcttcccgagcctccgcgaggccgccgccggcaaatccaagaagaagaacaagggcaccacgctctcgctctccgagttcgccggctacggcccgggcaggcgccaggcgccggcgccggagcccaaggggctcaccccggcggagatgatgatgctgccctcggggcccagggagcggtccgccgaggagctcgaccggccccgcggcctcggcggcggcttccgctcctacggcaccggggaccgcggcggcggcgggttcgacgatgacggccgccgcaggggcgcggatctcgacatgccctcgcgcgccgacgaggatcgcgactggtccatgagcaagaagtcgctcgcgcccgccgactccggcccgcggagccggtacggcggactcgggggcggcggcgcgcccgcgtccgtcggccgcgccgacgacgacggcgactggtcgcgcgggaagaagccgatgccgtcagggccgtcgcgctacccgagcctcagcggcggcggcggcggcggcttccgcgactcgcccgtctcgaccgactcctccgaccgctggtcccgtgccgcgcccgcgcccaccaatggcgagcgggaccggccccgcctagtgctcgatccgcccaagcgcgacgcctccgccacacctacaccaccagctgaggcggggcgcagccggccgagcccattcggggccgcgaggccacgggaagacgtactggccgacaaagggctggactggaagaagatggagactgagatcgatcagaagaagactagccgtcctaccagctcacagtcgagcaggccagagagtgctcactcgtcacgacctgggagccccgggtcacaggtaccagctgtgggtactgaaggcgtgccgagggcacgaccaaaggtgaatccttttggtgatgcaaagcctagggaggtgattctacaggagaaagggaaggattggaggaagattgacctcgagctggagcatcgccgtattgatagaccggaaacaaatgatgagagggagttgaaagaagagatcaatctacttaagttggaactaaatgaaaatgaagccaagatgagtgaagacgatgcaaaaagtttggctgagaagataactcaaatggaaaaacagctggagcttcttacaattgcaatggatgacaagatcagattttcgcaaagacctggctctggagcagggagggttacagcatcttcgccaacaaatcttgcagatgaatcccaaataaaggagtccatggaaaggccaggttcccgcagtggcatggatcaatattcaaaaccaactgaagaaagatgggggtttcaggggagcagagatagaggctcttttggtggcaacagaagttcagacaggtcgtcgggaggacaaagatggtgagccgttgccagccagatttttcacttcgtgtttagatggagcacaaataatttatgttcttgttgctgcttgactcattttgtttggcttggaagaggggagaggatcgtgcacaaaacagattgctttgcactaagttgttaattaccacccttatggtggttcgtctattttgtttttttttctttgtaaattttcttttaccctcttccatgtcaaaacaaatgtgacaacctttcatagactaactattgttcttgcttcctgcatgattatgctgtagcattcttattc

SEQ ID NO: 17459 - protein, 508 aa, Panicum virgatum
  misc_feature: Ceres CLONE 1792413
  misc_feature (1)..(508): Pfam Name: eIF-4B Pfam Description: Plant specific eukaryotic initiation factor 4B
MSKPWGGLGGAGAWALDAERAEEEEREAAANPPPAPASSFPSLREAAAGKSKKKNKGTTLSLSEFAGYGPGRRQAPAPEPKGLTPAEMMMLPSGPRERSAEELDRPRGLGGGFRSYGTGDRGGGGFDDDGRRRGADLDMPSRADEDRDWSMSKKSLAPADSGPRSRYGGLGGGGAPASVGRADDDGDWSRGKKPMPSGPSRYPSLSGGGGGGFRDSPVSTDSSDRWSRAAPAPTNGERDRPRLVLDPPKRDASATPTPPAEAGRSRPSPFGAARPREDVLADKGLDWKKMETEIDQKKTSRPTSSQSSRPESAHSSRPGSPGSQVPAVGTEGVPRARPKVNPFGDAKPREVILQEKGKDWRKIDLELEHRRIDRPETNDERELKEEINLLKLELNENEAKMSEDDAKSLAEKITQMEKQLELLTIAMDDKIRFSQRPGSGAGRVTASSPTNLADESQIKESMERPGSRSGMDQYSKPTEERWGFQGSRDRGSFGGNRSSDRSSGGQRW

SEQ ID NO: 17460 - DNA, 662 bp, Panicum virgatum
  misc_feature: Ceres CLONE 1792415
  misc_feature: Encodes the peptide sequence at SEQ ID NO. 17461
atctcgaaaccccattccccctcccatccccggccgccacacttccccagatctcgtccccacctccggccctccccccccccccgcctcgaccgccgggagtgagaagagatggcgggcaagggcgacgggccggcgatcggcatcgacctcggcaccacatactcgtgcgtcggcgtgtggcagcacgaccgcgtcgagatcatcgccgacgaccaggggaaccgcaccaccccctcgtacgtcgccttcgccgactccgagcgcctcatcggagatgccgccaagaaccaagtcgccatgaaccccatcaacaccgtctttgatgccaagcctctcatcggcaggaggttcactgatgtttctgtccagagtgatatcaagctctggccattcaagatcatttctggacctggtgagaagcccatgattgttgtccagcacaagggtgaggagaaccagtttgccgctgaggagatctcatccatggttctgatcaagatgcgtgagattgctgaagcttaccttggcagcactatcaagaactctgtggtcacagttctcgcctacttcaatgactcccagaggcaggccaccatggatgctggggtgattgctggcctcaacgtgctgcgtatcatcaatgagccgactgctgctgc

SEQ ID NO: 17461 - protein, 183 aa, Panicum virgatum
  misc_feature: Ceres CLONE 1792415
  misc_feature (9)..(183): Pfam Name: HSP70 Pfam Description: Hsp70 protein
  misc_feature: Useful for making plants with modulated heat sensitivity
MAGKGDGPAIGIDLGTTYSCVGVWQHDRVEIIADDQGNRTTPSYVAFADSERLIGDAAKNQVAMNPINTVFDAKPLIGRRFTDVSVQSDIKLWPFKIISGPGEKPMIVVQHKGEENQFAAEEISSMVLIKMREIAEAYLGSTIKNSVVTVLAYFNDSQRQATMDAGVIAGLNVLRIINEPTAA

SEQ ID NO: 17462 - DNA, 2350 bp, Panicum virgatum
  misc_feature: Ceres CLONE 1792421
  misc_feature: Encodes the peptide sequence at SEQ ID NO. 17463
gttttcctccgttcttctcactccccgagaggcaacctccggcggccggttgcttcccacgccgcgaatggcgtcccccgcatccgcctcggcgcggcctctatccctaaccctaaccgtccctttcccccgttattcctcgcgcgtcctccccttgcccttctcccgccgcctcccgagccgctgcgtcgcgctagcgccggcgcggcctggcgccgcgctcctctccagcctcagcgacgcgcgggagcaggatgaggaggaggaagaggagttctacgaggagggggatgagcaacaggaatacgacgaggaggaggaggaacaggaatacgacgaggaggacgaggagctggtggaggtgggctacgtgtccggcgcgcacggggtgcgcggcgacgtcctcgtcacgccacgcaccgacttccctgagctccgcttcgccacgccggggatgcgatggctgagggctcgggctgctgggaagcaacacgtcagggaattcgagcttgttcgaggaaaggcccacacggggaagaagtgttggatcgtcagctttgatggcatcgataatctggatgagttgctactctcctttcaggctaggcaaatagtcggttcagctatactcgtgaaagctggagataggccagaaattgaggctgatgagttctattcacttgatcttgttgaaatgagagttattgtcaaggatacaggcaagcttgtaggaacagttggtcaggttttcaattttggaggtggagatcttctacaggtgatgattggctctgctgaaggtactgttgtcgatccagattcagaaaatcaagattcaacttcatcacgcgagcatgtgtgggttccatttgccgaagatattgtacctgatgttgatatggagcgcagagaaatgtggattacacctccaaagggtttactggagctcaattcacgttctgacaagagatcgaagaaagaaaggcgtgcgatggagtggaaggacaggaagaggcttcagcgtcgtgtaattgctggaaagaaggtgctcgccgaaatggatcagggtcatgttctggaaggcttgctatctggggacaaggttcaaaaggcatcacttgcagagcagattggatgtattgactttcaattgttccgacatgcagtgcattgtgttagcaaacaaattgagagctcttcaaagaatttgctggctaattcagcactgtcaaggaaaaaggtgatcaaaataccatacaagagtttcatcaatcttggagagaaatctgaacatgcattcagtagagaactcaaagaaggtctcgagactcttttgaagtcaaaagcagctattgtacttgttagaaatggctcagattctgatgctaagtttctgagtttgctcagttcttttagtgagttaatgaaggatattgacaatcttgtgtcaccccctttcgttattgtttcccatcctggtcatgtggagtcagttacgaactgcctgataaagaataactattttggtttggatgctcaaaaggtgtgggttctggaagagctggagcttccaattgtcagtatatcctccgaggcaaacagaaaaaaggttctgatgaagtctccctgggagataattaaaaagccagtgggatctgggggtattttcagcttactatcatcaaacaaaattttggactccctcaatgaaatgggtgtacagtatatacagatatgcagctcatccagcaggccagtcattgggcatcctctgctatttggtgctgtcgcttgccgcagtgctgatgttggcatcaagctctccaagaccagtgaactgggaaatgatttcgacttgatcctttccatcgaccagttgaacaagatgtgccgagatgtcactcagctcaggttctccgcctgccctgagcaaaacgcgcatgtcgagcttgtcgatggccagtgggccgttgtcccgccggagacggcaaattcccatcgtctgaacgccgacgttacgagtgtattgaactcctgcgctgttgataaagtgtgcgttatggagattatagagcaataaaatttctacatgtatgtgcgacgctttttctactgttgccttgcacctgctgtatgagtttctaggggagctagtacggaatggaataccagccactgatgacacgcactgccgattcaagattaaaaaatgtgaatggaataatgtataactagtatgttcataagacctttttgtgatttaaatcaatattaggattctgtttcctgtaaatgctgtttgaacagagaaattgatttgataatttatggaacgtgctcctattcccgc

SEQ ID NO: 17463 - protein, 670 aa, Panicum virgatum
  misc_feature: Ceres CLONE 1792421
  misc_feature (98)..(193): Pfam Name: RimM Pfam Description: RimM N-terminal domain
  misc_feature (199)..(292): Pfam Name: PRC Pfam Description: PRC-barrel domain
  misc_feature: SWISSPROT Homolog: EC 2.7.7.23 UDP-N-acetylglucosamine diphosphorylase
MASPASASARPLSLTLTVPFPRYSSRVLPLPFSRRLPSRCVALAPARPGAALLSSLSDAREQDEEEEEEFYEEGDEQQEYDEEEEEQEYDEEDEELVEVGYVSGAHGVRGDVLVTPRTDFPELRFATPGMRWLRARAAGKQHVREFELVRGKAHTGKKCWIVSFDGIDNLDELLLSFQARQIVGSAILVKAGDRPEIEADEFYSLDLVEMRVIVKDTGKLVGTVGQVFNFGGGDLLQVMIGSAEGTVVDPDSENQDSTSSREHVWVPFAEDIVPDVDMERREMWITPPKGLLELNSRSDKRSKKERRAMEWKDRKRLQRRVIAGKKVLAEMDQGHVLEGLLSGDKVQKASLAEQIGCIDFQLFRHAVHCVSKQIESSSKNLLANSALSRKKVIKIPYKSFINLGEKSEHAFSRELKEGLETLLKSKAAIVLVRNGSDSDAKFLSLLSSFSELMKDIDNLVSPPFVIVSHPGHVESVTNCLIKNNYFGLDAQKVWVLEELELPIVSISSEANRKKVLMKSPWEIIKKPVGSGGIFSLLSSNKILDSLNEMGVQYIQICSSSSRPVIGHPLLFGAVACRSADVGIKLSKTSELGNDFDLILSIDQLNKMCRDVTQLRFSACPEQNAHVELVDGQWAVVPPETANSHRLNADVTSVLNSCAVDKVCVMEIIEQ

SEQ ID NO: 17464 - DNA, 1876 bp, Panicum virgatum
  misc_feature: Ceres CLONE 1792423
  misc_feature: Encodes the peptide sequence at SEQ ID NO. 17465
aaaaatccgcccatttcattcctccgtctcgctcgcctcgtcacctctcccgcgcccacccccacaaatctcactcccagttggtggcttggtgcgcgctcgcgtccaaaccaagcaaacccaaaaccctagcctgccgccgccgctgccggcggggctccctctggtcctgtcccggcctaccctatcctcgcagcaaccctaaccctacccgccgctgccgccggagcaggggggcaaaatgccgcgcgagatcatcacgatccaggtggggcaatgcgggaaccagatcgggatggagttctggaagcagctctgcctcgagcacggcatcggcaaggacggcctcctcgaggacttcgccacccagggtggtgacaggaaggatgtcttcttttaccaggctgatgatcagcacttcatacccaggtctcttcttattgacttggagccaagagtgatcaatggaattcagaacagtgagtataggaacctgtacaaccatgagaacatatttgtcgctgagcacggtggtggtgctgggaacaactgggccagtgggtatcatcagggtgaacaagttgttgatgatatcatggacatggttgatagagaagcagatggaagtgatagccttgagggttttgtcctttgtcactctattgctggtggaactggttcaggtatgggttcttatctgttggagacattgaatgatcgatacagtaaaaagcttgtgcagacatatagtgtcttcccaaatcagatggaaacaagtgatgttgtcgtccaaccgtacaactcgctcttgactttgaagcggctgacactgaatgccgactgtgtggttgttcttgacaatacggctcttaataggattgccgtggagcgtcttcatctatcaaatcctacttttgcacagacaaactctttggtctccacagttatgtctgcaagcacaactactttgaggtaccctggatatatgaacaatgacctagttggtcttcttgcctccttgatccccacaccaaggtgtcattttctgatgacaggttacactccattgaccattgaacggcaggttaacatgatacgcaaaacgacggtactagatgttatgagaagacttctgcagacaaagaatataatggtgtcatcatatgctcgaacaaaggaagccagccaggctaaatacatttccatacttaatatcattcaaggagaggtggaccctacacaggtccatgagagtctgcaaaggatacgtgaaaggaaacttgttaacttcatagattgggcccccgcaagcattcaggttgccttgtcaagaaaatccccgtatgttcaaacaacacacagggttagtggtttgatgttagcaaatcatactagtatacgtcacttattcagcaaatgcctgggacaatatgagaagctaaggaaaaagcaagcctttcttgacaactaccggaagtttcctatgtttgcggacaatgatctctctgaattcgatgaatctcgagaaataatagagagtctagttgatgagtacaaggcttgtgaatcaccagattacattaaatggggaatggaggatactggagaggcaaatgtcgcggccgcactggattctaagttagtggtgtaaatatcaaggtcctgctggttacccaaagattccactgtagctgtccggtagttatcagttcgatgctgcctgctcatctagatctaatcggagtgctaccagagcgggtcacgctcttctttgcaatcttgaagttcgcttccttttttttttcttgtgtgtgtgtggctatgtacatgtcgaaacccacttcctctgatctgtgctgttccatggtcttgttct

SEQ ID NO: 17465 - protein, 469 aa, Panicum virgatum
  misc_feature: Ceres CLONE 1792423
  misc_feature (46)..(247): Pfam Name: Tubulin Pfam Description: Tubulin/FtsZ family, GTPase domain
  misc_feature (249)..(395): Pfam Name: Tubulin_C Pfam Description: Tubulin/FtsZ family, C-terminal domain
MPREIITIQVGQCGNQIGMEFWKQLCLEHGIGKDGLLEDFATQGGDRKDVFFYQADDQHFIPRSLLIDLEPRVINGIQNSEYRNLYNHENIFVAEHGGGAGNNWASGYHQGEQVVDDIMDMVDREADGSDSLEGFVLCHSIAGGTGSGMGSYLLETLNDRYSKKLVQTYSVFPNQMETSDVVVQPYNSLLTLKRLTLNADCVVVLDNTALNRIAVERLHLSNPTFAQTNSLVSTVMSASTTTLRYPGYMNNDLVGLLASLIPTPRCHFLMTGYTPLTIERQVNMIRKTTVLDVMRRLLQTKNIMVSSYARTKEASQAKYISILNIIQGEVDPTQVHESLQRIRERKLVNFIDWAPASIQVALSRKSPYVQTTHRVSGLMLANHTSIRHLFSKCLGQYEKLRKKQAFLDNYRKFPMFADNDLSEFDESREIIESLVDEYKACESPDYIKWGMEDTGEANVAAALDSKLVV

SEQ ID NO: 17466 - DNA, 1792 bp, Panicum virgatum
  misc_feature: Ceres CLONE 1792426
  misc_feature: Encodes the peptide sequence at SEQ ID NO. 17467
agcgcaaacccctcttcctcttcctcttcttcgcctcgactcctcgcgccgtcccccagatctcgaggtcgggcggcgccggcggggggacgggatggggctgatctccgggatggtgatgggggtgctggtcggcgtggccgtcatggccggctagagccgcgtcatgctccgccgcagcaggaagcgcgtcgccaagaccgcggacatcaaggtgctcgggtcgctcggcagggacgacctcaggaagctgtgcggcgacaacttccccgagtggatatccttccctcagtttgagcaggtgaaatggctgaacaagcatttaagcaaactttggccatttgttgcagaagctgcaacagcagtggttaaggagtctgttgaaccactgctagatgattaccggcctccaggaataaaatctctgaagttcagcaaattttctcttggaactgtgtcaccaaaaatagaaggtattcgtattcaaaatcttcagccaggccaaatcataatggatatagatttccgttggggtggcgatccaagcataatcctagctgttgatgctgtagttgcatcactacctattcagctcaaggatcttcaggtctatactgtcatacgtgtcgtgtttcaactgtcagaagagattccttgcatatctgctgttgtcgtggctctccttgctgatccagagccaaaaattcagtacaccctgaaggccgttggaggaagcctaaccgcagttcctggactttctgacatgattgatgatactgtcaactcaattgtttctgatatgctccagtggccacacaggctagttgttccacttggtgttaatgttgatacaagtgacctggagcttaaacctcaaggaagactttctgttactgtggtaaaagcaacttctttgaaaaacaaggagttgattggtaaatcagatccttacgtgagactgtatgtgcgaccaatgtttaaagtcaaaacaaaagtcatagatgacaacctgaatccagaatggaatgaaacatttgagctgattgtcgaagacaaagaaacccaatctgtcattcttgaggtttacgatgaagacaaacttcagcaagacaaaagacttggtgtggctaaactagcattgaacaatcttgaacctgagatcacccgtgaagtcactctgaagctgctgcattcagtagatccacttaaaaatagggataccaaggatagaggcacattgcatcttaaggtcatgtatcatccgtttacaaaagaagagcaatttgaagccctagaggcggaaaagtgggccatagaggagaggaagcgtctgaaggaggctgggataattggtagcacaatggatgctgttggtggcgctgcatcactagttggttctggtattggtgctagcgtcgggcttgttggctctggtattggtgctggcgtcgggcttgtaggcgcagtcggcagtggcctcggtaaagccgggaagttcatgggcaagactgtggcagggcctttcagcatgtcccgcaagaacggcagcagctctgctgcgccccagcctgatcaaccctctgcgtagtctgatgtacagtgaaagacgattcccatttatcacagggttaccgttatatgaaatatctgctggtttattttgttcgttgtaatggagcttttatagtaaagattactgtaaattggatcgctttgagagattgatgtaacaacgccgtcgtattgaaatttaagaaaagtctatgatgtgccagtatgatattaatctgtt

SEQ ID NO: 17467 - protein, 473 aa, Panicum virgatum
  misc_feature: Ceres CLONE 1792426
  misc_feature (240)..(322): Pfam Name: C2 Pfam Description: C2 domain
  misc_feature: SWISSPROT Homolog: EC 3.1.1.4 Phospholipase A(2)
MLRRSRKRVAKTADIKVLGSLGRDDLRKLCGDNFPEWISFPQFEQVKWLNKHLSKLWPFVAEAATAVVKESVEPLLDDYRPPGIKSLKFSKFSLGTVSPKIEGIRIQNLQPGQIIMDIDFRWGGDPSIILAVDAVVASLPIQLKDLQVYTVIRVVFQLSEEIPCISAVVVALLADPEPKIQYTLKAVGGSLTAVPGLSDMIDDTVNSIVSDMLQWPHRLVVPLGVNVDTSDLELKPQGRLSVTVVKATSLKNKELIGKSDPYVRLYVRPMFKVKTKVIDDNLNPEWNETFELIVEDKETQSVILEVYDEDKLQQDKRLGVAKLALNNLEPEITREVTLKLLHSVDPLKNRDTKDRGTLHLKVMYHPFTKEEQFEALEAEKWAIEERKRLKEAGIIGSTMDAVGGAASLVGSGIGASVGLVGSGIGAGVGLVGAVGSGLGKAGKFMGKTVAGPFSMSRKNGSSSAAPQPDQPSA

SEQ ID NO: 17468 - DNA, 715 bp, Panicum virgatum
  misc_feature: Ceres CLONE 1792435
  misc_feature: Encodes the peptide sequence at SEQ ID NO. 17469
agtactcccaactgaagccagatcaaatctggaggagaaagaaaaacgccaagccggcggcgaagttgacgtcgctccccccatcacgtcaagcaaccgaaggttacagatctagctgtcaagatggtgaagatctgctgcatcggtgctggctatgtcggtggcccgaccatggccgtcattgccctcaagtgcccagacattgaggtcgtcgtcgttgacatctccaagccccgcattgaggcctggaacagtgacaccctccccatctacgagcctggtctcgatgatgttgtgaagcagtgcaggggcaagaacctcttcttcagcactgatgttgagaagcacgtcgctgaggctgacatcatctttgtctcggtgaacacccccaccaagacccgtggtcttggagctggcaaggctgccgacctcacctactgggagagtgctgctcgcatgatcgctgatgtctccaagtctgacaagatcgttgttgagaagtccactgtccctgtcaagactgctgaggctattgagaagatcttgacccacaacagcaagggcatcaactaccagatcctctccaacccggagttccttgcagagggcactgctattgaggacctgttcaagcctgacagagtgctcattggtggccaggagacccctgagggcaggaaggctgtccaggccctcaaggatgtgtacgctcact

SEQ ID NO: 17469 - protein, 197 aa, Panicum virgatum
  misc_feature: Ceres CLONE 1792435
  misc_feature (2)..(197): Pfam Name: UDPG_MGDP_dh_N Pfam Description: UDP-glucose/GDP-mannose dehydrogenase family, NAD binding domain
  misc_feature: SWISSPROT Homolog: EC 1.1.1.22 UDP-glucose 6-dehydrogenase
  misc_feature: Useful for making plants with altered carbohydrate content
  misc_feature: Useful for making plants with altered cell wall content and/or composition
MVKICCIGAGYVGGPTMAVIALKCPDIEVVVVDISKPRIEAWNSDTLPIYEPGLDDVVKQCRGKNLFFSTDVEKHVAEADIIFVSVNTPTKTRGLGAGKAADLTYWESAARMIADVSKSDKIVVEKSTVPVKTAEAIEKILTHNSKGINYQILSNPEFLAEGTAIEDLFKPDRVLIGGQETPEGRKAVQALKDVYAH

SEQ ID NO: 17470 - DNA, 1791 bp, Panicum virgatum
  misc_feature: Ceres CLONE 1792454
  misc_feature: Encodes the peptide sequence at SEQ ID NO. 17471
actccttttcagtttcgcttgctccagcctccagaagcctcacaactactcgccagcaatccggtccctcccccagaaactgaatctcaagaggagcgtagttgcagcagaaatccggaagttatcgagccaaatttggtattgttccgctcaaattgccttcctttcgctgtaggcaaaattccaattttctcctgtattcttgtgggccatgtctctgtacgacgggctcgccggagtttatccggaagaggagcaagaccgacacgccgtccagatgggtgactcagactacgaggacgatgagccggaccaacctacttgtgaggcgacagaagacacaacccctatggatgtcaagaaagggaaggatatacaagggattccatgggacaggatgaacactacaagagacaggtacaggcaggcaaggttgcagcagtatgccaattttgagaacatacctaattccggaagaaactcggagaaggaatgcacacctgtagagaaaggccaactctactacgagtttcagcacaacacaagatcggtgaaatcaaccattcttcatttccagttgagaaatttagtatgggcaacgacaaagcatgatgtgtatcttatgtcatactattctgtgcttcattggtcagcattgactcgtgagaagcaagaaatcattgatcttcaggggcatgtcgcaccatgtgagaagcaccatggaaatttctctgagggattttatcatactcaagtcagtactttggcagtgaaaaacaacttgcttgttactggtggatttcgtggcgaaataatatgcaagtttttggatcgtcgaggaataagctattgttgtaaatcaacaaatgatgacaatggtataactaattctttggagatattcgagaaacctagtggttctctgcacttcttggcctcaaacaatgattgcggacttagagactttgacattgaaaagtttcaaatctgcaacaacttccgatttgcttggcctgtgaatcatacatcactgagtcctgatggcaaacttgctgtgattgtgggggacaatcctgatggacttctggttgatgctaattcaggaaaaacggttcatgatctccgtggccatttggattactccttcgcatcagcatggaacccagatggccgaacattcgccactggaaaccaagacaagacatgcagggtatgggacatcaggaatctctccaaatcaattgctgtactgggtggcaatattggagccatcaggtcaattcgctacacatccgatggaaagttcttggcgatggcagagcctgcagatttcatccacatctttgatgttgatagtgggtacagcagggagcaggaactggatttctttggtgagatcgcaggcatatcattcagtcctgacactgaatctctctttgtcggggtgcatgatcgcgcatacagcagcctcctccagttcagccgccgacgattctactcgtaccttgacacagccctgtgaagttgctgccggcagggatctgtgagtgagatccagataacaggatgtaggaaatagaaaggggtgtatatgtgtatatgtatgtaggtgttgctctgaagaaagccgaagtgcggcgcatttacttttgcggaacaaggtgtagatattcagctagccatgtttctttgctgaaaaaagctgtagatattcagcgagccatctcttcggagatttgtactgtttctgctgctgtaacgttgttgtatataaggggctacttgatcacc

SEQ ID NO: 17471 - protein, 436 aa, Panicum virgatum
  misc_feature: Ceres CLONE 1792454
  misc_feature (298)..(336): Pfam Name: WD40 Pfam Description: WD domain, G-beta repeat
  misc_feature: SWISSPROT Homolog: EC 2.3.1.48 Histone acetyltransferase
MSLYDGLAGVYPEEEQDRHAVQMGDSDYEDDEPDQPTCEATEDTTPMDVKKGKDIQGIPWDRMNTTRDRYRQARLQQYANFENIPNSGRNSEKECTPVEKGQLYYEFQHNTRSVKSTILHFQLRNLVWATTKHDVYLMSYYSVLHWSALTREKQEIIDLQGHVAPCEKHHGNFSEGFYHTQVSTLAVKNNLLVTGGFRGEIICKFLDRRGISYCCKSTNDDNGITNSLEIFEKPSGSLHFLASNNDCGLRDFDIEKFQICNNFRFAWPVNHTSLSPDGKLAVIVGDNPDGLLVDANSGKTVHDLRGHLDYSFASAWNPDGRTFATGNQDKTCRVWDIRNLSKSIAVLGGNIGAIRSIRYTSDGKFLAMAEPADFIHIFDVDSGYSREQELDFFGEIAGISFSPDTESLFVGVHDRAYSSLLQFSRRRFYSYLDTAL

SEQ ID NO: 17472 - DNA, 1239 bp, Panicum virgatum
  misc_feature: Ceres CLONE 1792472
  misc_feature: Encodes the peptide sequence at SEQ ID NO. 17473
aaaaaaaaaaaaaaatcttcaccacccgcaccacgcctagccgttgcgtagcgcgcctcctcgtcgtcttcctcccccgcactgtgtcgcttggcttgctcgaggtgtgttgcttctgcgcgcactcctccacttgccgagatagcttgctgccggctggcgggcaggaggacgggaggaaggaggagcaggataagcctccgcactgtgcggatagggctcggatcagaggagaggtgtggtggaggagcgtgtgctgacgtcaaggaacagtgcggcgggttgctgattgggagtgggacgccgtcgctttcgatcgaccgggtccccccccccccctggctagcgccagcacgtccggaggcgcctcgtcccgctccttcgccggcacaggatggcgctgctcacggcgccggcggtggccgcgctgctgctgctcttctggtccgcggcgtacggtgacgcccagctgccgtacaaggaccccagcctgcccgtgaaggcccgcgtcaaggacctcctcggccggatgacgctcgccgagaagatcgggcagatgacgcagatcgagcggaaggtcgcgtcgccgcaggtgctcaaggacaacttcatcggcagcctgctcagcggcggcgggagcgtgccgcggctgcaggcgacggcggcggagtgggtgagcatgatcagcgacttccagaaggcgtgcctgtccacgcggctgggcatcccgatgatctacggcatcgacgccgtccacggccacaacaatgtctacggcgcaaccatcttccctcacaatgtcgcgctcggagccaccagggatcctgatctggtgaagaggatcggtgccgcgaccgcgctcgaagtgcgagccaccggcatccagtacgcgttcgcgccatgcattgcggtgtgccgtgatccgagatgggggcggtgctacgagagctacagcgaggaccacaagatcgtgcaggccatgacggagctcatcccgggcctgcagggcgacgttccgcagaacttcaccagcggcatgccctacgttgccggacagaacaaggtggcagcgtgtgccaagcatttcgtcggcgacggcggcacgcacgacggcatcaacgagaacaacaccatcatcgacaagcagggcctgatgagcatccacatgcccgcctacctggactcgctccggaagggcgtctccacggtcatgatctcctactccagctggaatgggat

SEQ ID NO: 17473 - protein, 281 aa, Panicum virgatum
  misc_feature: Ceres CLONE 1792472
  misc_feature (103)..(281): Pfam Name: Glyco_hydro_3 Pfam Description: Glycosyl hydrolase family 3 N terminal domain
  misc_feature: SWISSPROT Homolog: EC 3.2.1.21 Beta-glucosidase
MALLTAPAVAALLLLFWSAAYGDAQLPYKDPSLPVKARVKDLLGRMTLAEKIGQMTQIERKVASPQVLKDNFIGSLLSGGGSVPRLQATAAEWVSMISDFQKACLSTRLGIPMIYGIDAVHGHNNVYGATIFPHNVALGATRDPDLVKRIGAATALEVRATGIQYAFAPCIAVCRDPRWGRCYESYSEDHKIVQAMTELIPGLQGDVPQNFTSGMPYVAGQNKVAACAKHFVGDGGTHDGINENNTIIDKQGLMSIHMPAYLDSLRKGVSTVMISYSSWNG

SEQ ID NO: 17474 - DNA, 656 bp, Panicum virgatum
  misc_feature: Ceres CLONE 1792472-R
  misc_feature: Encodes the peptide sequence at SEQ ID NO. 17475
acctgggctaccagtgcggcgggtggaccatcgagtggcagggcgacacggggcgcatcaccgtcggcaccacgatccttgacgccgtgaaggccgccgtggacccgtcgacgacggtggtgttcgcggagaaccccgacgccgacttcgtcaggaacggcggcttctcgtacgccatcgtggccgtgggcgagcacccgtacacggagacccagggcgacagcatgaacctgacgatcccggacccggggccgagcaccatccagacggtgtgcggcgccgtgcggtgcgcgaccgtgctcatcagcggccgccccgtggtgatccagccgttcctggccgccacggacgcgctcgtcgccgcctggctgccgggaaccgagggccagggcgtcaccgacgtgctgttcggcgactacggcttcaccgggaagctgccgcggacgtggttcaagtcggtggaccagctgcccatgaacgtgggcgacgcgcattacgacccgctcttcccgttcggcttcgggctcaccacaaagggcaatgcgtactagaaggggattggtggtagcctgtagtgataggaaaattgaatttttaaacagtgctcagctcacactgtggagtagcatccactagatgagcggtctcattcttat

SEQ ID NO: 17475 - protein, 182 aa, Panicum virgatum
  misc_feature: Ceres CLONE 1792472-R
  misc_feature (13)..(179): Pfam Name: Glyco_hydro_3_C Pfam Description: Glycosyl hydrolase family 3 C terminal domain
  misc_feature: SWISSPROT Homolog: EC 3.2.1.21 Beta-glucosidase
LGYQCGGWTIEWQGDTGRITVGTTILDAVKAAVDPSTTVVFAENPDADFVRNGGFSYAIVAVGEHPYTETQGDSMNLTIPDPGPSTIQTVCGAVRCATVLISGRPVVIQPFLAATDALVAAWLPGTEGQGVTDVLFGDYGFTGKLPRTWFKSVDQLPMNVGDAHYDPLFPFGFGLTTKGNAY

SEQ ID NO: 17476 - DNA, 529 bp, Panicum virgatum
  misc_feature: Ceres CLONE 1792475
  misc_feature: Encodes the peptide sequence at SEQ ID NO. 17477
acacagtcccggcagcacgcactgccctttagttgtagcaacaaaagaaaatgccgcggcgaactcgagtgctgctcgttctcgccttcgctgccgcgttgctgcttgccagcggcggcgccgctccagaggtcggaggactctcggctgaggcgatgccggccctgcgcgcgagcagcttcgtgctggagggcgaggaggaggtggcgtacccgcggaggagggcgctgtacagcggcgggttcatcgactacggcgctcttaccgcgagcaaggccgcctgctatggcccgtgccccgcccgcgggcagccctacagcagcggctgccaggccatataccagtgccgcggttaagcagcgctgcagtcagtcgatttgtacgtttcttgcgtatgttgaggcgcggttatttgatctaggtgtcagcctcttatgttccttttccatttaatattgttgtgaaaagagttcactactcagtaagaacaattattcatagtttgatttagattaactttttccatagc

SEQ ID NO: 17477 - protein, 101 aa, Panicum virgatum
  misc_feature: Ceres CLONE 1792475
  misc_feature (46)..(101): Pfam Name: RALF Pfam Description: Rapid ALkalinization Factor (RALF)
MPRRTRVLLVLAFAAALLLASGGAAPEVGGLSAEAMPALRASSFVLEGEEEVAYPRRRALYSGGFIDYGALTASKAACYGPCPARGQPYSSGCQAIYQCRG

SEQ ID NO: 17478 - DNA, 572 bp, Panicum virgatum
  misc_feature: Ceres CLONE 1792479
  misc_feature: Encodes the peptide sequence at SEQ ID NO. 17479
atttcccgtcgccgagacagtatcggtcagacccgagctcccagaacgcgagaacacctaggcctggtagtctcgacggagcagacgccagaggaagccgtgccagcgttcatggtcgccgcccggccgccccgggctctccccctcctcctcctgctgctctgcgccgacttctccttccacgtggaagcggcgcacggggcgagtggcggcgcccacgggctcggcgtcaactacggccgggtggtggacgacatcccctagccgcgggggtccgtggagctcctccgcgcggttggcgccgggtacgtcaagatttacgaggcccagccgggcctgctccgcgcgctggagggcacgcgctggcccgtctccatcatggtgcccagcgacatcatcccggacatcggcgcctcgcccgccgccgcggaccgctgggtcctcgacaaactggtcccctactacccggcgagcctggtctagttcctggtcatggggaactgaaatcctctatgagtactccatcgacaactccatgtgggagcgtcttgtcacggcgatggataacatcc

SEQ ID NO: 17479 - protein, 34 aa, Panicum virgatum
  misc_feature: Ceres CLONE 1792479
  misc_feature: Useful for making plants with altered carbohydrate content
MVPSDIIPDIGASPAAADRWVLDKLVPYYPASLV

SEQ ID NO: 17480 - DNA, 1546 bp, Panicum virgatum
  misc_feature: Ceres CLONE 1792481
  misc_feature: Encodes the peptide sequence at SEQ ID NO. 17481
aaccaccgcgaaactctgcacatcgatcgagcgcacccaaagcacggccatggcgcgccatcttcgccgcctcctgctccttctcctcgccaccgtcgtcgcggcggcggcccccgccctcgccatcttccatttcgacttccgcttcgacaccgacggcccatactctggcggcatgctgtcccggcacgacatgtggcggcggcgcgccgccgagagcagagcccgggacgccgggaactcggccaggctcgccaaggccctcggcaaggacggcgacatcacggcggccgacgtgaccgtcaccccctacacccaccagggccactggctgaccgtcggcgtcggcacgccgccgcagcccagcaaggtgatcctcgacatgggcagcgacctcctgtggacgcagtgcagcctggtgggccccacggcggtgcaggaagagccggtgtacgacccctccaggtcgtcgtccttctccctcctcccctgcggcagcaagcagtgcgaggagggcgccttcaccagcaagaactgcaccgacaagaggtgcgcgtacgagaactactacggcgtcctgacggcgaccggcgtcctcgccaccgagacgttcaccttcggcgcgcaccgcaacgccaccgtcaacctcaccttcggctgcggcaagctcaccaacggcaccatcgccggcgcctccggcatcctgggcctctccccgggccccctgtcgctgctgaagcagctggccatacccaagttctcctactgcctcacccccttcgccgatcacaagacgagcccggtcatgttcggcgccatggccgacctcggcaagtacaagacgacgggcaaggtgcagacggtcccgctgctgaagaaccccgtggaggacatctactactacgtgcccatggtggggatctccctcgggagcaagcggctggacgtgccggccgagagcctggcgctgaagcccgacggcaccggcggcacggccgtggactcggcgaccacgctggcgtacctcgtggagccggccttcacggagctgaagaaggccgtgatggaggggctgaagctgccggtggcgaacaagaccgtcgacgactacccgctgtgcttcgagctgccgcgcggcgggtccatggacggcgtggaggtgccgccgctggtgctgcacttcgacggcggcgccgtgatggtgctgccgcgggacaactacttccaggacccgagccccggggtgatgtgcctggcggtggtccagtcgccgttcaaaggcgcgccgtcggtcatcggcaacgtgcagcagcagaacatgcatgtgctctacgatttgggggaacgcaagttctcctacgcgcccacgcaatgtgacaagctctgaggtgctatgtatgcaaataaatctacaacgatgatgatcttcagatttcagtggcaaaaatataacttttattttttattgtctaatgatgatgaaaccctttttgtaggacagtttgttgtatccaatgtataaaatcaataatgagggttgcctgtt

SEQ ID NO: 17481 - protein, 445 aa, Panicum virgatum
  misc_feature: Ceres CLONE 1792481
  misc_feature (96)..(440): Pfam Name: Asp Pfam Description: Eukaryotic aspartyl protease
  misc_feature: SWISSPROT Homolog: EC 3.4.23.12 Nepenthesin
MARHLRRLLLLLLATVVAAAAPALAIFHFDFRFDTDGPYSGGMLSRHDMWRRRAAESRARDAGNSARLAKALGKDGDITAADVTVTPYTHQGHWLTVGVGTPPQPSKVILDMGSDLLWTQCSLVGPTAVQEEPVYDPSRSSSFSLLPCGSKQCEEGAFTSKNCTDKRCAYENYYGVLTATGVLATETFTFGAHRNATVNLTFGCGKLTNGTIAGASGILGLSPGPLSLLKQLAIPKFSYCLTPFADHKTSPVMFGAMADLGKYKTTGKVQTVPLLKNPVEDIYYYVPMVGISLGSKRLDVPAESLALKPDGTGGTAVDSATTLAYLVEPAFTELKKAVMEGLKLPVANKTVDDYPLCFELPRGGSMDGVEVPPLVLHFDGGAVMVLPRDNYFQDPSPGVMCLAVVQSPFKGAPSVIGNVQQQNMHVLYDLGERKFSYAPTQCDKL

SEQ ID NO: 17482 - DNA, 845 bp, Panicum virgatum
  misc_feature: Ceres CLONE 1792484-R
  misc_feature: Encodes the peptide sequence at SEQ ID NO. 17483
gaaacttgctgtaggaatcagagcacgggccccgtgcgaccgccgacggcgaagccacacccacacgcaacgagcacgagcggcagcggcagcagcaatctccaccactcggctactacggcggcgccggcgatacccgaggcaggcgcgacgccagcggcgtcgtgggcgctgcagcgggaggtgttctcgaagccgacgaacgcgggaggcgcggcccggcggcggcggttcggctggagcctgctggggcggcgcaggccggcggcggcgtcggaggcggaggcggaggcgtcggagtgcgcggtgtgcctggaggagctccgggcgggggacgtgctggtgcacctgccctgcgcgcaccgcttccactggtcctgtggcgtgccctgggtccaggccgcctcgcgctgccccgtctgccgcgccctggtccacctcgcctcctgccctccccccaactgaccgacctgccgcgggatggcttggagtcttctcttcttcggccggacggagcaacgcgggaccgcgccgccgtgcgtggcagacccaagccatggacacgggcggatggcattggcaggcaggctgcgggtgaccgtgcgtgcgcgagatgcctcgtgtcgaggacaccgcagagtgggggtggggatcactggatcagagtcggatgatggtgcacggcgagacggagcactgaatcgatgagcgcatggagcgctgcgatcgcacggggcatcagtttcatggagccatgcgctgattagttttgcacagctgctcacgacgctggttatcccaaatctgtgtagtattcatctaaaaaaaactgtctagttacggtc

SEQ ID NO: 17483 - protein, 154 aa, Panicum virgatum
  misc_feature: Ceres CLONE 1792484-R
  misc_feature (101)..(141): Pfam Name: zf-C3HC4 Pfam Description: Zinc finger, C3HC4 type (RING finger)
ETCCRNQSTGPVRPPTAKPHPHATSTSGSGSSNLHHSATTAAPAIPEAGATPAASWALQREVFSKPTNAGGAARRRRFGWSLLGRRRPAAASEAEAEASECAVCLEELRAGDVLVHLPCAHRFHWSCGVPWVQAASRCPVCRALVHLASCPPPN

SEQ ID NO: 17484 - DNA, 1454 bp, Panicum virgatum
  misc_feature: Ceres CLONE 1792484
agaggtagaggtagaggttggtagttgggccattggcatttggcacgccatcagcatgagctctcctcctccttcctaagttcctcctcctcctcctcctcctccctatagatagaaagctgctgctccccgtccaaaggagatgaggctcatgactggtcgtcggagatggccggcttcgtcctcgtcctcttcctgctccggatggagggcttccacatacaccaatcgctcctagcgcctcctccgaatcccgtgtctcggggtcgtcgagcagtgcatgcgacacccgacacaatcacagggctaggtagctagcaagcatacatagcttgtggggagcgaggtcgttgcaggcggcgtcttgttgtcatcgctcgcatcgcagctgtcacgtttgtggtgcctctttgagttcgacggtggatggtcatcatggccgggatgctccccggcgtggagtgcgcgcggcggcggcggctccggcagggcaggtcgtcgtccggcgcggcggaggcgccgtgcgggacgcggcggccgtccttctgcctgtacgccggcggccacgaccacgcccaccttggctcggcggcggcctccaaggagaggagcagcagcagcgtgtgcaaggagatgatggcgcgcgcgtggacgctggacaccaacgcccgggaagcaaaggagaggctggaccagaagctcagggggcagagagaatcactggtcaagaggtgtgttgctgctgcagttcttgtctgtgcttccttcagagagaatctatgatgtagctcgctgtacggttcttcagagccccagcatttccacttctagttctagctgaggttcagaatccataggtccctcctgcttggtttatcctgagtttgcagtttgcagcaatgatgatttcctagtctatatagaggctgttcggttcaggaaatacgaaagatagattgttaacatccaatcttgagtggtatttccttttgcagcaacgtgcctgctggatacctttgtatgggaatctagttccatgcctagagaactactgtttcagatgcagagtatccattcagggtcctgtttcagcgctgaaattcgagtgcttgctctggtcccatcatctttatactctgcaaacagtctaaggccgtgtttagttcatctcccaagaatttttgggaatggaatcttgctatttaaaagtactaaatgaagtctatttataaaactttttgcatggatgagttgtaaatcgcgagacgaatctaatgagcctatttaatctataattagagattatttactgtagcacgccattatccaatcatggtctaataagcttaaaagattcgtctcgaaattacacccggggttatggaatgagttttcagttatttacatttaagacctctaattaatagtcaaatattcgaaattactgtagtgct

SEQ ID NO: 17485 - DNA, 758 bp, Panicum virgatum
  misc_feature: Ceres CLONE 1792488
  misc_feature: Encodes the peptide sequence at SEQ ID NO. 17486
actacgtgcacccggcacgcccagcgcttgtgaccaacccgcccaccttccagtcctcccagtccaacacctcgcacgcccaggtctcaaccctctccctcgccatcgccatcgccatggcgcgcaagaagatccgggagtacgactccaagcgcctcctcaaggagaacctcaagcgcctcgccggcatcgacctcaccatcctctccgcccagatcacacaatcaacagacttcgcagagcttgtgagccagcagccatggctgtcaaccacaaagttggtcgtgaagcctgatatgctgtttgggaagcgtggcaagagtggcctggtggccctcaaccttgattttgatcaagtcaaggagttcgtcaaggagcgattgggagtcgaggttgagatgggtggctgcaaggctccaattacaaccttcattgttgagccatttgtgccccacgatcaagagtattacttatcgattgtgtcagagaggctgggcagcacaatcagcttctcagagtgtggagggattgagatcgaggagaactgggacaaggttaagatggtttttcttccaactgagaagccaatgacaccagatgcatgtgctcccttgattgctacccttccactggaggcacgcggaaaaattggtgacttcatcgaaggagtgtttgctgtattccaagacctggacttctcatttatggagatgaacccatttaccatggtgaatggagagccatatcctctggacatg

SEQ ID NO: 17486 - protein, 213 aa, Panicum virgatum
  misc_feature: Ceres CLONE 1792488
  misc_feature (5)..(204): Pfam Name: ATP-grasp_2 Pfam Description: ATP-grasp domain
  misc_feature: SWISSPROT Homolog: EC 2.3.3.8 ATP citrate synthase
  misc_feature: Useful for making plants with modulated root development
MARKKIREYDSKRLLKENLKRLAGIDLTILSAQITQSTDFAELVSQQPWLSTTKLVVKPDMLFGKRGKSGLVALNLDFDQVKEFVKERLGVEVEMGGCKAPITTFIVEPFVPHDQEYYLSIVSERLGSTISFSECGGIEIEENWDKVKMVFLPTEKPMTPDACAPLIATLPLEARGKIGDFIEGVFAVFQDLDFSFMEMNPFTMVNGEPYPLD

SEQ ID NO: 17487 - DNA, 666 bp, Panicum virgatum
  misc_feature: Ceres CLONE 1792488-R
  misc_feature: Encodes the peptide sequence at SEQ ID NO. 17488
ggaggtggtgctagtgtcatatacgctgatacagttggagatttggggtatgcttcagagcttggaaactatgcggagtatagtggtgctcccaatgaggaggaggttctgcattatgctagagttgtacttgattgtgcaactgctgatcccgatggtcgtaagagggcgcttctcattggaggtggcattgctaacttcactgatgtggctgccacattcaatggcatcatccgggccttaagagagaaggaatccaagttgaaggcttcaaggatgcacatttatgttcgccgaggtggcccgaattaccaatctggactggctaaaatgcgtaagcttggtgcagatctcggcattccaattgaggtgtatgggccagaagcgacaatgacaggaatctgcaaacaagcaattgaatgcatcatggctgcagcataattggagtgtagttctgggtagtttgggatctgcagacacgcaattgaatgtgtcatagactcggccataaatgaggggtggagagtagttgcagtagttcacacccacacaggggttgttccctttctgtttcagatatgttgtagcgtggagttgtttgacgatatctttctagatcattcctgcaaagagttgtgatgcaataaatccgaggtctagtttcgt

SEQ ID NO: 17488 - protein, 146 aa, Panicum virgatum
  misc_feature: Ceres CLONE 1792488-R
  misc_feature: SWISSPROT Homolog: EC 2.3.3.8 ATP citrate synthase
  misc_feature: Useful for making plants with modulated root development
GGGASVIYADTVGDLGYASELGNYAEYSGAPNEEEVLHYARVVLDCATADPDGRKRALLIGGGIANFTDVAATFNGIIRALREKESKLKASRMHIYVRRGGPNYQSGLAKMRKLGADLGIPIEVYGPEATMTGICKQAIECIMAAA

SEQ ID NO: 17489 - DNA, 2681 bp, Panicum virgatum
  misc_feature: Ceres CLONE 1792491
  misc_feature: Encodes the peptide sequence at SEQ ID NO. 17490
gatcctcgatcgcattgtctgtcctcgcctgccaaacatttgggtagagggccgcaaattaaaagcaggcgcgcagcttcatgatcagcagaggctagcttctcaggttccaatttcttgattcatctcgcatcgcagccatggatcccgagttcggagtaggcacggcgccccgaaagagggagtcatggcggacgacgctgctgctggcgtaccagagcctcggggtggtgtacggcgacctcagcatctcgccactctacgtgtacaagagcaccttcgccgaggacatcaagcactcggacaccaacgaggagatcttcggcgccctctccttcgtcttctggacgctcaccctcatccccctcatcaagtacgtcaccgtcgtcctgcgcgccgacgacaacggcgaaggaggcactttcgcgctctactccctcatctgccgccacgccaatgttagcctcctccccaaccgccaggtcgccgacgaggagctctccacctacaagctcgagtacccgcccgaggtcgcccagaggtcacgcgtcaaggactggctggagaagcacaagaagctgcacaccgcgctgctcgtcatggtcatgatcggaacatgcatgatcatcggggacggcgtcctcacgccggcgatctcggtgttctcggctgtttcagggctcgagctctccttgtccaaagatcaacatgaatacgcgatcattcccataacctgtgccatattagtattcctgttcgctctgcagcattatggcacccaccgtgtaggattcctcttcgcgccgatcgttctgtcctggctgctctgcatgagcgctatcggcttgtacaacatcatccactggaaccctcatgtttaccgggcgctcaatccctcctacatgatcacattcctgaagaagaccaggaagtctggctggatgtcgctgggaggaattttgctatgcatgacaggatcggaagcaatgtttgcggatcttggccacttctcctacagcgcaatccaacttgctttcacttctttagtgtacccttcactgatattgggatacatgggtcaagctgcctatttgtccaaacaccataaccttgacgcaagctaccagattggattctacatcgcagttcccgagagtgtaaggtggcctgtgctagtgctggcgatattggcatcggttgtaggaagccaagcaatcatcagtggaaccttctccatcatcaaccagagccagtccctgagttgcttccccagggtgaaagttgtgcacacgtctgacaagattcatggccagatatacatccctgaggtcaactggatgctaatgatcctctgcattgcggtcaccgttggtttccgtaatacgaagcacatggggaatgcgtccggcttggccgtgatcacggtgatgctggtgacgacgtgcctcatgtccgtggtgatcatgctatgctggcaccggtcgcctctgctagccctggcattcttcctcttgttcggttcggtcgaggcgctctacttctcggcatcactgatcaagttcctggaaggtgcgtgggtgccgatcctcctctccctgatcctgctcgccgtcatgttcgtgtggcaccacgtgacgatcaggaaatacgagtacgacatgcacaacaaggtgaccctagagtggctcctcgctctcggcgacaagctgggcatggtccgcgtcccgggcatcggcctcgtctacaccgacctcacctccggcgtgccggccaacttctcccgcttcgtgaccaacctcccggcgttccaccgggtgctcgtcttcgtctgcgtcaagtccgtgccggtgccgcacgtgctccccgccgagcgctacctcgtcggccgcgtgggccccccggggcactgctcctaccggtgcatcgtgcggtacggctaccgcgacgtgcaccaggacgtggactcgttcgagacggagctcgtcgagagcctcgccacgttcatcaagctcgacgcgctgttccggtgcagcgacgccggcagggaggcgcgggacagcagctgcggctacgaaaacgagcgcgagaacgcgctcacagtcatcgggagcaacccactgcggcgccacctgcagctggggtacgacgagtcccacgacggcgtgtcgtcggcccacgagacgggcgtggacgggatcgagctcgcggcggcggcgccggcgatcaagaagcaggtgaggttcgcggcgaccccctgcaggagccccggcgtggacgagcgcgtgctggaggagctgcacgagctgtgcgaggcgcgggaggccggcacggcgttcatcctggggcactcgcacgtgcagaccaagcccgggtcgtcgctgctcaagaagctggccgtcggcgtcgggtacaacttcctgcggcggaactgccgcggcccggatgtggcgctgcgcgtgccgccggcgtcgctgctcgaggtcggcatagtctacgtgctgtgaggaacgtgacggcgatccatccgcgattgcgatctgtgcgtccggctttcagcgcgtctctctgccattgtattgtattgtgcacatctcgacttgctgatgtgaattgtagcgccatgcgatgccatgacatttttttctcgaatacgcaagagagttgcgcatctttgtagtatt

SEQ ID NO: 17490 - protein, 787 aa, Panicum virgatum
  misc_feature: Ceres CLONE 1792491
  misc_feature (22)..(787): Pfam Name: K_trans Pfam Description: K+ potassium transporter
  misc_feature: Useful for making plants with modulated biomass
MDPEFGVGTAPRKRESWRTTLLLAYQSLGVVYGDLSISPLYVYKSTFAEDIKHSDTNEEIFGALSFVFWTLTLIPLIKYVTVVLRADDNGEGGTFALYSLICRHANVSLLPNRQVADEELSTYKLEYPPEVAQRSRVKDWLEKHKKLHTALLVMVMIGTCMIIGDGVLTPAISVFSAVSGLELSLSKDQHEYAIIPITCAILVFLFALQHYGTHRVGFLFAPIVLSWLLCMSAIGLYNIIHWNPHVYRALNPSYMITFLKKTRKSGWMSLGGILLCMTGSEAMFADLGHFSYSAIQLAFTSLVYPSLILGYMGQAAYLSKHHNLDASYQIGFYIAVPESVRWPVLVLAILASVVGSQAIISGTFSIINQSQSLSCFPRVKVVHTSDKIHGQIYIPEVNWMLMILCIAVTVGFRNTKHMGNASGLAVITVMLVTTCLMSVVIMLCWHRSPLLALAFFLLFGSVEALYFSASLIKFLEGAWVPILLSLILLAVMFVWHHVTIRKYEYDMHNKVTLEWLLALGDKLGMVRVPGIGLVYTDLTSGVPANFSRFVTNLPAFHRVLVFVCVKSVPVPHVLPAERYLVGRVGPPGHCSYRCIVRYGYRDVHQDVDSFETELVESLATFIKLDALFRCSDAGREARDSSCGYENERENALTVIGSNPLRRHLQLGYDESHDGVSSAHETGVDGIELAAAAPAIKKQVRFAATPCRSPGVDERVLEELHELCEAREAGTAFILGHSHVQTKPGSSLLKKLAVGVGYNFLRRNCRGPDVALRVPPASLLEVGIVYVL

SEQ ID NO: 17491 - DNA, 1192 bp, Panicum virgatum
  misc_feature: Ceres CLONE 1792503
  misc_feature: Encodes the peptide sequence at SEQ ID NO. 17492
actcgcgcggcgccaccatggcctcctccgtcgcggcggctctccgcgccctcgccgccagcacctccgcctccctcgcgaagcccagcgccaccccgtcccccttcctcgtcctcctcgccccgaccccgccccgccgcccgctcggcctccgctccgcccgccgcctgccgctcgccccgctcgccgcctccgactccttcgagtcctccgtcggcgtcgactacgcggagccggcccccgccgagtccgagcgggagggggaggaagaggaggaggaggcgttcgcgtcgggggatgaggaggaggacgctgccgccgaggcgtccgcctccgccgaggaggccgcggacgaggaggaggtcggggagtacgtcgagccgcccgaggaggccaaggtctacgtcggcaacctgccctacgacgtcgacagcgagcgcctcgcgcagctcttcgagcaggctggtgtcgtcgaggtctcagaggtcatttacaacagagaaacagatcggagccgtggatttgggtttgtcactatgagtactgtcgaggaggctgagaaggctgtggagatgttccatcgctatgatgtcaatggaaggcttcttactgtaaataaagcagctcctagaggttctcgtgtggaaagacctcccagacaatttggcggtccttccttcaggatttatgtgggcaacctgccatggcaagtggatgactctagattggtgcagttgttcagcgagcatggtaaagtggttgatgccagagttgtctatgaccgagaatctgggcgttcgcggggatttggttttgtaactatggcaacacaggaggaattggatgatgctattgctgcccttgatggacagagtttggatggccgtgccctgcgggtgaatgttgcggaggagcgaccgcggcgaggtttctagtgaggatgtgtctgggtggacagcagacttgttccataggagcatcatagcgtggtctgatactggtttagaccctccattctcttttcttgtgttctgggctccctatcatcctgtcttattgtgaagaggaagtgttctctgctatttcattaactgttggttgtgttcatgagttcatgtattgtaggctactgttatggtgcacctagctcaatttgtcgttgcaattcaaaattttgtctgacatctgttcg

SEQ ID NO: 17492 - protein, 305 aa, Panicum virgatum
  misc_feature: Ceres CLONE 1792503
  misc_feature (223)..(294): Pfam Name: RRM_1 Pfam Description: RNA recognition motif. (a.k.a. RRM, RBD, or RNP domain)
  misc_feature (128)..(199): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MASSVAAALRALAASTSASLAKPSATPSPFLVLLAPTPPRRPLGLRSARRLPLAPLAASDSFESSVGVDYAEPAPAESEREGEEEEEEAFASGDEEEDAAAEASASAEEAADEEEVGEYVEPPEEAKVYVGNLPYDVDSERLAQLFEQAGVVEVSEVIYNRETDRSRGFGFVTMSTVEEAEKAVEMFHRYDVNGRLLTVNKAAPRGSRVERPPRQFGGPSFRIYVGNLPWQVDDSRLVQLFSEHGKVVDARVVYDRESGRSRGFGFVTMATQEELDDAIAALDGQSLDGRALRVNVAEERPRRGF

SEQ ID NO: 17493 - DNA, 1906 bp, Panicum virgatum
  misc_feature: Ceres CLONE 1792521
  misc_feature: Encodes the peptide sequence at SEQ ID NO. 17494
aagaagcgtgagcacttacttatcgtctcctcctttcctcccccgcaaccccgatcgaatcgctcgaaccatccccaggtttgcgcgtcgatctaggtttgcgagaggatccaatttgatccccctcccgtttgagcttgtgatcctcgacggagttcttcgttagcctttttcccccgatttttttcgctcatttgttcgagcttttcaagagcagaataggcagtttcgaattccgatgcacccaggtctcaagatccaattgtgaggactttcccaagctctccgcgtcgatctgcacaagaagatgggtaacgcgggtagcaacggtggaggcgccgcccctggtcatcgccgtcggagctccggccacggccacggccaccaccaccaggcgcctcctcctcccccgccgcaggagactgcgcccaaccgctacgtgttcgcggcggccacgccgtacccgccccagtaccctaaccccaacccgccgcagtactacccgcagtacgggaactactacccgccgcccccgccgtccgtgccggtgcctctcccggcgccgtacgaccaccaccacaggccgcccaccgccgccggcggggagttccctcccccgcctccggcccacccccaccactaccctggttgggctgggcggtatccctcctacggaccgcatctgcctatgccgacgccctacgtcgagcaccagaaggccgtcactatccgcaatgatgtcaacctcaagaaggagacgcttcggattgagcctgatgaagagtgccctggccgcttcctcgtctccttcacctttgacgccacggtcgccggcagcatgactgtttacttctttgcaaaggaagagctcaactgcaatttagcagcagtgaaagaagaccttattaagccagttactgttagcttcaaaaagggtcttggtcaaaaattcaggcaaccttcagggacaggaatcgacttttcagtgtttaaggaatctgatttattaaagcagagggacatggatgtatatccacttgctgttaaagctgaaacagcatcagttgatcaaccattggaaggggaagaccaaaagacgaaaactcctaactcacagatcacacaggctgtgtttgagaagaaagaaaatggggagtatcaagtacgagttgtttgtcagatcctatgggtcaatgggactaggtatgaactgcaggaaatatatggaatagggaactccatggaaggtgatgctgatgcaaatgatccagggaaagaatgtgtcatttgcctctcagagccaagggatactactgttctcccttgtaggcatatgtgcatgtgcagtgagtgcgccaaggtcctacggtaccaaaccacccggtgccccatctgcaggcagccagttgagcgtctccttgagatcaaagtcaacaacaaaactgaagatcagcaacagacgccccaatcaccgccgctgccaccgccaaccccgcagcaggaagaggtgtacccatgattttaaaaaaaatatcagcgctcaaacactatatgggtctagtttgcagcctccgggctttccctgaatgttgctcttcccatttgagcaacgggggaatgtaatcgatactttacctttagcatatgtaagcttctggcatcgcatggctaggcccggtctccactgtatctggactctggaggtgggagaccgagatggtgccatgaagggtatgtgtaccatatacatcgtgcatgcgtgtgccgtggctacctgaagaagtgtagggaggactcatgccagatcggcttccccgtcagggaaagaaagggaagcgagggcggactctgaatttgtacaaaatgactgtatttcaccttgatgccaagtcttctttctagtgtt

SEQ ID NO: 17494 - protein, 276 aa, Panicum virgatum
  misc_feature: Ceres CLONE 1792521
  misc_feature (198)..(236): Pfam Name: zf-C3HC4 Pfam Description: Zinc finger, C3HC4 type (RING finger)
  misc_feature: Useful for biocontainment applications
  misc_feature: Useful for making plants with altered alkaloid content
  misc_feature: Useful for making plants with altered terpenoid content
  misc_feature: Useful for making plants with modulated nitrogen use efficiency
MPTPYVEHQKAVTIRNDVNLKKETLRIEPDEECPGRFLVSFTFDATVAGSMTVYFFAKEELNCNLAAVKEDLIKPVTVSFKKGLGQKFRQPSGTGIDFSVFKESDLLKQRDMDVYPLAVKAETASVDQPLEGEDQKTKTPNSQITQAVFEKKENGEYQVRVVCQILWVNGTRYELQEIYGIGNSMEGDADANDPGKECVICLSEPRDTTVLPCRHMCMCSECAKVLRYQTTRCPICRQPVERLLEIKVNNKTEDQQQTPQSPPLPPPTPQQEEVYP

SEQ ID NO: 17495 - DNA, 1528 bp, Panicum virgatum
  misc_feature: Ceres CLONE 1792525
  misc_feature: Encodes the peptide sequence at SEQ ID NO. 17496
atccgaggccgtcccgcaccgcactaccagccacctcccgcgccgcgccgccgccgccgtctcgcacgcgcggcagaggacgcgcgcgatcccctcccgcccaccaccagatcgcgccatggcctccacggccttcgccgccgccaagttcctcccggcccacctcgactcctccccgcgcatcgcgccacaccgcgccggccccaccgcgaatctctccttcgccccgctttcctcctctccctcctccgcggcgtcgctcctccgcctccgatccccgtcgccgtccggcccgggaggcaggctgcccccgcccccgcgctcgtacggcggcggcggatctggcgacgccgcggactccggcggcggcgacggccgccgcgggggcatcctcggcgtcttcctggccggctgggccgcccgcgtcgccgcggacccgcagttcccgttcaaggtgctcatggaggagctcgtcggcgtcaccgcctgcgtgctcggcgacatggcctcccgccccaacttcggcctcaacgagctcgacttcgtcttctccacccttgtcgtcggatccatcctcaacttcgtcctcatgtacctcctcgcgcccaccgccggcgtcgccgccgccgcctcgtccaccgcctccgcgctccccagccacatgttcgagcccggcgcctactcgctcggctcccgcgtcgccaccctcgtgtccaagggcgcgaccttcgcgatggtcgggttcgcggccgggctcgccggcaccgcgctctccaacgggctcatcgcgatgcggaagcgcatggacccggagttcgagactcccaacaagccgccgcccacgctgctcaacgcggccacctgggcgatccacatgggcgtcagcagcaacctgcgttaccagactctgaacggggtcgagtacctgctcggcaaggtcgcgccggcgccagtgttcaaggtgtccgtcgttgctctccgctgcgtgaacaacgtgcttggtggcatgtccttcgtgttgcttgccaggttgactggatcgcaaagatcagataaaccagcgacggctgcagaagagaaggaacggttgatagctgtgggcaatgccgccgcagatgccatcagtgaagcaaaggacgcagagggtaagtaaaggggatgggtagaggagggtgcaagtggatgcatgcatgctctgcgcctgagcttcgtttgcggcttcttggaataggccaagaaacctgtagatgataagtgggttggaataaggagtgaggctcaaaacattttcttcaatctgtttgcagtgatgacatgcttagttgatcttagaataaaagcagctgagcctgccaccaccacgccagcggcatggagcagaggaagggcggtgcgcgcgtgccccgggcggtgtccgtcctggcgggcctgctggagcgcgccgccgagcgcggcgacgccgctcccgcgtcgtcagcggcggcggcgttccggggccgggccctgccggcgatccccgtgcggcggt

SEQ ID NO: 17496 - protein, 344 aa, Panicum virgatum
  misc_feature: Ceres CLONE 1792525
  misc_feature: Useful for making plants with modulated biomass
MASTAFAAAKFLPAHLDSSPRIAPHRAGPTANLSFAPLSSSPSSAASLLRLRSPSPSGPGGRLPPPPRSYGGGGSGDAADSGGGDGRRGGILGVFLAGWAARVAADPQFPFKVLMEELVGVTACVLGDMASRPNFGLNELDFVFSTLVVGSILNFVLMYLLAPTAGVAAAASSTASALPSHMFEPGAYSLGSRVATLVSKGATFAMVGFAAGLAGTALSNGLIAMRKRMDPEFETPNKPPPTLLNAATWAIHMGVSSNLRYQTLNGVEYLLGKVAPAPVFKVSVVALRCVNNVLGGMSFVLLARLTGSQRSDKPATAAEEKERLIAVGNAAADAISEAKDAEGK

SEQ ID NO: 17497 - DNA, 278 bp, Panicum virgatum
  misc_feature: Ceres CLONE 1792525-R
gccgtggagatgatcgcccgatgacgacacgattctttcagttaatttgatttgttggttcctgtgtcctaggaggccttccctccagtttaggtttattttaagaaattgaactgcaaaatgtctggggggattttcgtaaaattggtagattgcgggggttatttggtaaatttggggtcgacggagtaccggtcgattactgaaaagttcaaggggtttttcataaaattgatggacttcataattattttaataaagtccagggttttttttcc

SEQ ID NO: 17498 - DNA, 3204 bp, Panicum virgatum
  misc_feature: Ceres CLONE 1792543
  misc_feature: Encodes the peptide sequence at SEQ ID NO. 17499
aacagccctacctctgctggctgtgcaggtgcggcagctgtattcgccgcaacctcctccttccttcccatccctccgcctccggctcacggattccttcacctcgcggaattctcctcgcctccaccaccgcctcggcctcccgcgaaccccctctgcgctagaagcttcctgggacgcggtccgaggcccggatccttggccccgaggcgggggcgcggtttgcgcgggggttcggagccggcgcgggagctgctctgattcgccgggggtgccgcggggaatgctctacctcaagctgccggcgggggatctagggttccgtccagggccggcgcggcggggatccggcggtggcggggcctgaggtggcgcgagcgggcgatccggccggggccggccatggctgcggcgacggcggcggccgcggtggagcaggaggccgaggccacatgcctgcagagcttcgagctctacgagagcgagtcgagactttatattctcggaactaactctgacaaaacactttggagattactcaagattgatagatcagagccatcagaacttgtgatagatgagtgttctactgtatatagtgacagtgaacatcatgacttgttgaaaggtcttgatgaagaacacaggtcaactggcggagtaaaatttgttacaaagttttacggcgtaattggtttcatcaagttccttgggccatattacatgctaattattaccgagcagaaaagaattggggagatctttgctcatccagtgtaccaggtgactaggactgcaatggttgaattagcaaattcaaagacaagatcaacctttcaaagctccaaggatgagaacagatacaagaagatcttgagcacacttgatcttaggaaggatttcttcttcagttattcataccacatcatgagaagtcttcagaagaacttgagtgacccacatcaggaaggatggaccttatatgagacaatgtttgtctggaacgagtttctaactcgtcggatccgtaactgtctcagaaatactttgtggaccgttgcactggtccatggtttctttaagcaggataaattctcaatatctgggaaggatatcatgctcacactcattgctagacgctcgaggcattatgctggaaccagatatttgaaaaggggggtgaatgagaagggcagagtagcaaatgacgttgaaactgagcaaattgtatatgaagctgtgcctggacctagtgaagtaagttctgttgtacagaaccggggttcaatcccactattctggtcacaggagacatcaaaattgaatcttaaacctaatataatattgcatgagatggacgatgattatgaagctaccaagcttcattttgaaaatcttagaacaagatatggaaaccctatcattatcttaaacttgattaagacacgtgagaggcgagagtctatacttcgccgtgaatttgataaggcaatcaagataataaataagagcttatcagaggaggatcatctgaggttcttacattgggatctccataaaaattctcaaggcaaacctacaaatgtgcttgatgttctgctgaaagtggcatttcgggctctgagtttaaccgagtttttttattgccaagttgcaccaagttcagagactgctgcacactggtccactctgttgagtggtcttgaaccatatttatgtgatgacaacagcaatagtgacaacacagagtgttatgatattgttggtgatatatctcaagaggatatctctggcagctctgattcctctggtaacgcaactgcagaagacaaagttgagaatagtgaactgcgaccactaaaaccaccaaaattccaaaaaggtgtcttgcggacaaactgtattgattgtttggatcgaacaaatgtcgctcagtatgcgtatggtttagctgctcttggacatcagctgcatgcgcttggtgctatagaatctccagagctagctttagaggctcccttggcccatcacttgatgcacttttatgagaggatgggtgacacacttgctgtacagtatagcggttcagctgctcacaacaagatattttctgcaaagagaggtcacttgaagctttttattcagtcacaagagttcttcaggacactacaacgacactacagcaacacctgtatagatgctaacaaacaggctgccataaacttatttttgggatacttccagccgcagcaggggaaacctgcactgtgggagctagaatcatcttccggggagcataacaatgaactttttgatgaccacacaagtacattgaaaagaataagatcagatggcagtattcttcatgaaagcggtgcttctatatctggctcgggtcattgctataatgaaccgttgactgcatcacagcctgatgttcagagtgggttacaagttccaaatttgaaatctcattcaattcatgaaaatgaagtttcatcaggctatgaaagtggggtatcacacctaaggtatactcccacagcctctgatatacttcatgtcccaagagctgatcctgacaatgattctggtgattcaaacttcctggatcttgaatggctctccacctcaggcaactcaagtgatgaaaggtctgttgcaactagcacgccagatgcgaacctatcgactgaaaatgtaattagtggcataactcctgaaatcatggaaaaccaagttgctgaaattcaggctcagaagttaccggacgattttgtgcagtgggttaatcacggggacactttttggtattaagattacgatgatgctgtctcatgtattcctggctacttggaagatccagcttctcttcctgggtagtcagtgaacggatccaagtaagagactaggagttgagaataagatggatggtacagcagttcagacatttcccctgtgatttatgcccttatcatcccagagtcctttagggaagtataacgtctgtttatttgttcacatctttttttttttactatgggcgagtaggtagatattttttctttttaaagaaaatagagataggtgtggtaattattattcatctggaattgtattattattcatgggacttgctattttcatgtgtaaatatatatgcttgaggtgtctatagtggaggtggagagcaaaccaccgctt

SEQ ID NO: 17499 - protein, 804 aa, Panicum virgatum
  misc_feature: Ceres CLONE 1792543
  misc_feature (93)..(396): Pfam Name: Syja_N Pfam Description: SacI homology domain
  misc_feature: SWISSPROT Homolog: EC 3.1.3.36 Phosphoinositide 5-phosphatase
MAAATAAAAVEQEAEATCLQSFELYESESRLYILGTNSDKTLWRLLKIDRSEPSELVIDECSTVYSDSEHHDLLKGLDEEHRSTGGVKFVTKFYGVIGFIKFLGPYYMLIITEQKRIGEIFAHPVYQVTRTAMVELANSKTRSTFQSSKDENRYKKILSTLDLRKDFFFSYSYHIMRSLQKNLSDPHQEGWTLYETMFVWNEFLTRRIRNCLRNTLWTVALVHGFFKQDKFSISGKDIMLTLIARRSRHYAGTRYLKRGVNEKGRVANDVETEQIVYEAVPGPSEVSSVVQNRGSIPLFWSQETSKLNLKPNIILHEMDDDYEATKLHFENLRTRYGNPIIILNLIKTRERRESILRREFDKAIKIINKSLSEEDHLRFLHWDLHKNSQGKPTNVLDVLLKVAFRALSLTEFFYCQVAPSSETAAHWSTLLSGLEPYLCDDNSNSDNTECYDIVGDISQEDISGSSDSSGNATAEDKVENSELRPLKPPKFQKGVLRTNCIDCLDRTNVAQYAYGLAALGHQLHALGAIESPELALEAPLAHHLMHFYERMGDTLAVQYSGSAAHNKIFSAKRGHLKLFIQSQEFFRTLQRHYSNTCIDANKQAAINLFLGYFQPQQGKPALWELESSSGEHNNELFDDHTSTLKRIRSDGSILHESGASISGSGHCYNEPLTASQPDVQSGLQVPNLKSHSIHENEVSSGYESGVSHLRYTPTASDILHVPRADPDNDSGDSNFLDLEWLSTSGNSSDERSVATSTPDANLSTENVISGITPEIMENQVAEIQAQKLPDDFVQWVNHGDTFWY
